United States Patent 7,411,051 (ANTIBODIES TO HDPPA04 POLYPEPTIDE) - sequence listing, part 5

SEQ ID NO: 11710 - DNA, 50196 bp, Homo sapiens
tccgagtcaaagaaaggggtgacggacgtacctggaaaatcgggtcactcccacccgaatattacgcttttcagaccggcttaagaaacggcgcaccacgagactatatcccacacctggctcagagggtcctacgcccacggaatctcgctgattgctagcacagcagtctgagatcaaactgcaaggcggcaacgaggctgggggaggggcgcccgccattgcccaggcttgcttaggtaaacaaagcagccgggaagctcgaactgggtggagcccaccacagctcaaggaggcctgcctgcctctgtaggctccacctctgggggcagggcacagacaaacaaaaagacagcagtaacctctgcagacttaagtgtccctgtctgacagctttgaagagagcagtggttctcccagcacgcagctggagatctgagaacgggcagactgcctcctcaagtgggtccctgacccctgacccccgagcagcctaactgggaggcaccccccagcaggggcacactgacacctcacacggcagggtattccaacagacctgcagctgagggtcctgtctgttagaaggaaaactaacaaccagaaaggacatctacaccgaaaacccatctgtacatcaccatcatcaaagaccaaaagtagataaaaccacaaagatggggaaaaaacagaacagaaaaactggaaactctaaaacgcagagcgcctctcctcctccaaaggaacgcagttcctcactagcaacagaacaaagctggatggagaatgattttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcaatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatgtggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaaggaaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatactttatggacaagcaaatgctgagagattttgtcaccaccaggcctgccctaaaagagctcctgaaggaagcactaaacatggaaaggaacaaccggtaccagccgctgcaaaatcatgccaaaatgtaaagaccatcgagactaggaagaaactgcatcaactaatgagcaaaatcaccagctaacatcataatgacaggatcaaattcacacataacaatattaactttaaatataaatggactaaattctgcaattaaaagacacagactggcaagttggataaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctctgataaaacagacttcaaaccaacaaagatcaaaagagacaaagaaggccattacataatggtaaagggatcaattcaacaagaggagctaactatcctaaatatttatgcacccaatacaggagcacccagattcataaagcaagtcctcagtgacctacaaagagacttagactcccacacattaataatgggagactttaacaccccactgtcaacattagacagatcaacgagacagaaagtcaacaaggatacccaggaattgaactcagctctgcaccaagcagacctaatagacatctacagaactctccaccccaaatcaacagaatatacatttttttcagcaccacaccacacctattccaaaattgaccacatagttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacaccacataccagaatctctgggacgcattcaaagcagtgtgtagagggaaatttatagcactaaatgcctacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggatacattcctcgacacatacactctcccaagactaaaccaggaagaagttgaatctctgaatagaccaataacaggctctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaatcaggcaggagaaggaaataaagggtattcaattaggaaaagaggaagtcaaattgtccctgtttgcagacgacatgattgtttatctagaaaaccccatcatctcagcgcaaaatctccttaagctgataagcaacttcagcaaagtctcaggatacaaaatcaatgtacaaaaatcacaagcattcttatacaccaacaacagacaaacagagagccaaatcatgggtgaactcccattcacaattgcttcaaagagaataaaatacttaggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcattgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagaaatggggaaaggattccctatttaataaatggtgctgggaaaactggctagccatatgtagaaagctgaaactggatcccttccttacaccttatacaaaaatcaattcaagatggattaaagacttaaatgttagacctaaaaccataaaaaccctagaagaaaacctaggcattaccattcaggacataggtgtgggcaaggacttcatgtccaaaacaccaaaagcaatggcaacaaaaaccaaaattgacaaatgggatctaattaaactaaagagcttctgcacagcaaaagaaactaccatcagagtgaacaggcaacctacaacatgggagaaaatttttgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagtctggattaagaaaatgtggcacatatacaccatggaatactatgcagccataaaaaatgatgagttcatatcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggcgggagggatagcattgggagatatacctaatgctagatgacacattagtgggtgcagcgcaccagcatggcacatgtatacatatgtaactaacctgcacaatgtgcacatgtaccctaaaactgagagtataataaaaaaaaaaaaaagaaaaaaaaaagaaaaaaaaaaaaaaaaaaagaaacatactaaatatctcaggtttttaatgaatttgataattactgtgccttaatacattaaggaaattttgatgattagaaaaactttgaatactgaatttgttttgtgaaatgtatataagtagttctattttgtttattagtagtagctaacaagcatgggcatttcttatgttgtatagataatggaattttgtgatgcctaaggcagcagaatatttttctgaactattatagtgactggatattgaaagctatgtacataatccttctacttatttttttacataagagaaacttgccttaatgaaagttatgtgtatctttatattgtctgtcctttatacttcatgtactcagtagtaactgacatttttgtttttgtaaattaatagcagtataaaatcaagtataattctgtgatgttttaaaagttttttaatgaagcttttttggagctcagtcatttgaagattgaaataagctttctctacagtgtattggtcagagaaaagatgtgttttcaacttacaagaatgaactcttcctctttatgattttagagacatggacatgcaggaaagtagagggagttggggagagaaaatgtgaatgcgtccacctgaaatgttgaataaataatcaaataactttgttacattaaactttcctcgtcatgataatctggatggatttttaccattgttcataaacttggccaggcatggtggttcatgcctataatcccagcactttgggaggccgaggtgggtggattgcttgaggccaggagtttgagaccagcctgggcaacatagtaaaacctcgtctctacagaaaatacaaaaaattagttgggcatggtggcacgcacctcttgtcccagcttctttggaagctgaggtgggaggatggcttgagctcaggaggcgggggttgcagtgagccaagatagtagctgggcgtgctggctcacacctgtaatcccagcactttgggaggccgaggcgggtggatcatgaggtcaggagttcaagaccagcctggccaagatggtaaaactccgtctttactaaaactacaaaaattagccaggcacgatggcaggtgcctgtagtcccagctactcgggaggctgaggcaggagaatcgcttgaacccaggtgacagaggttgcagtgagctgagattgcaccactgcaactccagcctgggtgacagagtgagactccgtctcaaaagaaaaaaaaaagaatttggtgtagcatattttttattttttaaagatcattttattttaaaatgaaagtgaaacttccttctgtacgttttaagataataaactgaaagccagttcttgcctctctctccatacatgtttggccttaaatgttcaaagtgaaatcaaggttaattccaaaaggtgattgttaaaacttttgttttctaaattacatgtgtccaccctggttcttttgaatctttattgtgttatataaaatactccacaaataggaagtagagaatgtcatataccttcaccaagattctgctggcttttataggagaagctagctgcacttgaatcaagtattgaacagcgactcaagtgggcaggtggtgccaaccctgcattggcccctgtactacaagattttgaagcaacgatagctgaaagaagaaatcttgtccttaaagagagccaaagagcaagtcaggtattgtgacttacatgcaccatctttgtattcacttttacaggattagatgagtagctggaagttatatgtggggtaactaggggagcttgagagcccacgttctggctcacagccctgggaggagggacggatgggcctttcaggacatgccttaagttgaacccacagcaggttatttccttggcctttactgcctctcatttaaatattaattaaataaattcagcctctgttgaaaaataaagaggtcttaaattcatatctgtttaaggttctctgggtctcttttatacaactaaagtgatccaaagatttggaaaggtacttggaatattattttttccacatgacaataaaacgtcttaagaccttgtgccctgttggccaggcgccgtggcttacgcctgtaatcccagcactttgggaggctgaggtgggtggatcacaaggtcaggagttcaagaccagcgtgaccaatatggtgaaaccccgtctctgctaaaaatacaaaaaaattagctgggtgtggtggtgggtacctgtagtcccaactgctcaggagtctgaggcaggggaatcgcttgaacctgggagccagaggttccagtgatccaagatcgtgccactgaattccagcctgggtgacagagcaagactctgtctcaaaaaaaaaaaaaaaaggaccttgtgccctgtcaagaggctgtggattgggcagggggaggagaaccaaaaaaactattacggacattttcaactaagtacaaaattggactaatacatgatactcatacttcatacctgtcgccagtgcttaataatgatcaacttaagtcttatcttatttcacccatactccctaatcctcctttctatccatatttaatagaaatcccaaatagtgcataattttatctataaatttttcagtatatacctattaagaactatttaagaatgtatcatagctgggcatggtggtatgtccctttagctctagctgctcagaagtctgaggcgggaggatggcttgaagctaggagtttgaaaccagcctgggcaacatagcaagacactgtctctaccaaaaaaaaaattttttttgttttttttgagacggagttttgctcttgttgcccaggctgtagtgcagtggcgtgatcttggctcactgcaacctctgcctcccgagttcaagtgattctcctgcctcagcctcccaagtagctgggattacaggcacccgccaccatgcccagctaagttttttgtatttttagtagagacggggtttcaccatgttggccaggttagtttcgaactcctgacctcaggtgatccgctggcctcagcctcccaaagtgctgggattacaggtgtgagccaccacacctggccaataaattttttttttttttttagctaggcatggtggcacgcacctctggtcccagctgggagactagctacctgggagactaaggcggtaggattgcttgagcccaggagtttaaggctacagtgagccataattaagccactatactccagcctgggcaacaggggagaccttgtctcaaagggaaaaaacaaaaaaactaaccacaatattaatcatacctttaaaatgagcttaatactgccagataagttaggcaagaatagaagcagaaggggaacattctgacagaagtgtcttctgaattgtggctgtaacacaaattgcagctgaatataacagctttattgtggagtaaatattctatgtaaaaacagtaatgtagaagataaatttacctaattgtttgtcagtgcttttggccatctcagacctaacagtgtcagtataaatgtacatttatttacagcctttataaggttttggtctatttcccaaacattttcaggaccaattctggtcctgaattctcaaaatgaggaagtagtattttttcatgttattaattgccacctccctttcccaccttcctcccatctcctcttgtggttccatttctgtctttacaggtcacatttctctgcagcaatatcattcattttgaaagtttacgaacaagaactgcagaagccttaaacctggatgcggcgttatttgaactaatcaagcgatgtcagcagatgtgttcgtttgcatcacagtttaacagttcagtgtctgagttagagcttcgtttattacagagagtggtgagtcttggtggaaagaaacttgattaaataaggctagtgttatactattaaaatcaatttaatatatacattccgattacattcgttgagcatatactgtatgtaagaggttgttaggggggcggggggacagtgatgattaaattattttcttagcgcccccccccccgccccgaaacatattatatgtttaaaaatataaaaaatgaggaagtgtaaaggatcctcatagctacaaccaaaatactatgaaagtttagaagggaggagaaagacgatatgtagcaaatgattccaatgcactgaaaatagagcaggagaaagagggcttatggaagatgaatgctggaaaggttagtgaaggccagaaatagcaagttggtaagtttgacgtttatattttgtcagaaagcttaaagctgtatgttaggaagttcacatttcatctcgaagagttatttagaatttagggacctggattgccagtcatctttgtgattccgaatgtatttctcaggtcttaaactttaagcatttaaagcctgcatgattatgcagaaaagtaaaaatcttcatctatatttcatagattattgagattattgttaagtaacttgtaggtaattaattcatgacttagcaatggaggttctctttgtgtcagcttgagttactaatatcttttgatgatgttaatgaagaaagaactcattatttcagctgatactcgaagtcaaacaaatgcttgttctatttaggacactggtcttgaacatcctattggcagctctgaatggcttttgtcagcacacaaacagttgacccaggatatgtctactcagagggcaattcagacagagaaagagcagcagatagaaacggtctgtgaaacaattcagaatctggttgataatataaagactgtgctcactggtcataaccgacagcttggagatgtcaaacatctcttgaaagctatggctaaggtaagactaataccatgaacacacatttactctccctctgttataaaatttacaagtagttttatttataggaaaaacagtgacattttgtaaataacaatttatctcatcacatcttccaatttgtttgtaactgagttaacttgtgttttcatcaactattttttaaagccagtagtagtagtttgaatttcatacacagagaagctaaggcttaattagattcctttattgtgatataacttgtaataaaaccaagatatgaacctagtctgagcattcagatatccagcttgtctttctctttcttagctataccaacaaacccatacagtttgcctccaaaatgaatgaaatgttgtctcttccctccagtgttgtacatagtctagtaagtaagaaaactaagcctccagaaaaggctattacttcatcattacaaacagtaaataatttaattttagaatttacttttactttgaatttttatttgatggtggaaacaaagttcctataaaaatggagttgaactaagcagtttaaacacactcatatttgaaacatttgttacttaatcactaggtgactgtcttgagagtaattactgatactaaaactatttttcttaatcattaatttatcaattctaggatgaagaagctgctctggcagatggtgaagatgttccctatgagaacagtgttaggcagtttttgggtgaatataaatcatggcaagacaacattcaaacagttctatttacattagtccaggctatgggtcaggttcgaagtcaagaacacgttgaaatgctccaggaaatcactcccaccttgaaagaactgaaaacacaaagtcagaggtaagaatgccttctggtcagaatttataaaacataagtacaaaactactggtataagaagtttatctcttgatttaatttttcagttttgttcatatttttataagtagtatcaggtaaaacatttcgtaaataagccattttattttgtatttcagtatctataataatttagtgagttttgcatcacccttagtcaccgatgcaacaaatgaatgttcgagtccaacgtcatctgctacttatcagccatccttcgctgcaggtaggagaagagtcctgagtcttgatctgttgttaatgttacacatagatgctaagatgtttaattatacataactgtctaatattaaacacttaaggcctgtcattctataatcttaaactgaacagattttagcttatccttaaaaatactcgtaagccaggcacgatggctcacacctgtaatctcagctacttgaaggccaaggtgggaggattgtctaaggccaggagttcaagaccctgtctctttaaaaataaataaataaacagctattaaaaaaaaaaaaaaaaaaaaggccgggcgaggtggctcacacccataatcccagcactttgggaggctgagccaggtggatcacctaaggtcaggtgtttgagaccagtcgggccaacatggtgaaaccttgtctctactaaaaatacaaaaaaaattagctgggtgtggtgccagatgcttgtagtcccagctactcaggaggctgaggcaggagaattgcttgaacccgggaggtggaggttacggtgagccaagatcacgccactgcactccaggctgggtgacagagcaagactctgtctcaaaaaaatgaaacaactcgtgagtagtagtaaaaatgctttggctaatttgaatagttttctttaaaaaaaatgtttttatttttgtttgaggcggagtctcaaaactgtctcttgtcgcccaggctggagtgcagtggcacagttgcggctcactgtaacctccaccccccagattcaagcaattctcctgcctcagcttcctgagtagcttggattacaggtgctcgccaccatgcctggctaaaaaaaatatatatatatatcagagaaacataggaaaatacttaatacaaatgaagaatttgtagttccattccaaatagaggcagaaaccactctgcatttgttgatttacttgctgtgcatatgtacacatacacaaacacattgggatgattatgcaaatgtaatttttgttgcctttccagttaataatttttcagtcattaaataatctttttaaaaatgacttaatggccaatttatttttattttttattttcttatttatttttattttattttatttttttttaatttaatttaatttttttttttttttttgagatgagtctcactcagtcgcccaggctggagtgcagtggcgcaatcttggctcactgcaacttccgccttctgggttcaggggattctcctgcctcaacctccccagtagctggaattacaagaacctgccaccacgccctgctaatttttgtatttttatagagacaggattttgccatgttggctaggcttgaattaattcaagatggattaaagacttaaatgttagacctaaaaccataaaaaccctagaagaaaacctaggcaataccattcaggacataggcatgggcaaggactccatgtctaaaacaccaaaagcaatggcaacaaaagccaaaattgaaaaatggaatctaattaaactaaagagcttctgcacagcaaaagaaactaccatcagagtgaacaggcaacctacagaatgggagaaaatttttgcaatctactcatctgacaaaagtctaatatccagaatctacaaagaactcaaatttacaagaaaaaaacaaccccatcaaaaagtgggcgaaggatataaacagacacttctcaaaagaagacatttatgcagccaacagacacatgaaaaaatgctcatcatcactggccatcagagaaatgcaaatcaaaaccacaatgagataccatctcacaccagttagaatggccatcattaaaaagtcaggaaacaacaggtgctggagaggatgtggagaaataggaacacttttacactgttggtgggactgtaaactagtttaaccattgtggaagtcagtgtggtgattcctcagggatctagaactagaaataccatttgacccagccatcccattactgggtatatacccaaaggactataaatcatgctgctataaagacacatgcacacgtatgtttattgcggcactactcacaatagcaaagacttggaaccaacccaaatgtccaacaatgatagactggattaagaaaatgtggcacatatacaccatggaatactatgcagccataaaaaaggatgagttcatgtcctttgtagggacatggatgaagctggaaaccatcattctcagcaaactatcgcagggacaaaaaaccaaacaccgcatgttctcactcataggtgggaattgaacaatgagaacacttggacacaggaaggggaacatctcacaccggggcttgttgtgggtggggggacaggagagggatagcattaggagatatacctaatgtaaatgaagagttaatgggtgcagcacaccaacatggcacatgtatacatatgcaacaaacctgcatgttgtgcacatgtaccctagaacctgaagtatagtaaatgtgtgtgtatatatatatgtgtgtgtgtgtgtatatgtgtatatatatgtgtatatatatgtgtgtatgtatatatatgtgtatatatatgtatatatatgtgtgtgtatatatatgtatatatatataaaatagttcacaaagattaacacgtggatacccaaaatatcatattaccattgtatattttggtaaattaatgtttatatttcacttttattgaatttaataaattcctgacctcaactgatccgcccacttcagcctccccaaagtgctgggattacaggcgtgagccatcatgcctggctgttatttatggtttttgatgccacaagcctagtaaacataattgtacaaattcatacctgaatgtctggctgtttttaggctacatttttaggaagacaattgctgtgtccaaggataaggatttatagttgattatttaattggggtatcaaccactaccacctatcccgtgcttgctccactctgccccctccatgttctgtttacatgtaaattgagccaccaactctttctctgtagcagtccggagtaacactggccagaagactcagcctgatgtcatgtcacagaatgctagaaagctgatccaaaaaaatcttgctacatcagctgatactccaccaagcaccgttccaggaactggcaagagtgttgcttgtagtcctaaaaaggcagtcagagaccctaaaactgggaaaggtaattagttagaataaagatgccttaaatttttatataaaatgacggtttgacttacgtatgtttttgttgcttcatagcggtgcaagagagaaactcctatgcagtgagtgtgtggaagagagtgaaagccaagttagagggccgagatgttgatccgaataggaggatgtcagttgctgaacaggtgaccgtgttttaaacttgggctacacattttaatgctgctggaaaagtagaggtgtataaagatccctctcatcgatttccttaatagttcatcaaggaacttaaatgtgttttcaggattcagaagattttgagtaacacagctctggcgtcgtcaagtagtcaccattttactctgacccttccctatgagcactttcctttcccctagccctgttttaacccaaatataagtccgatcctcctccaccagactacagttagtttccatttaaagaagactgttgaaggtttcaaatgaaatgccaaggaccctttgggttgcaggtgtagtatgagtggagcatccctaattagaaactcatatgctccaaatccgaagcattttgagagttgacatgatgccataagtgaaaagttccatgcctgacctggtgatggatcccagtagtgaaaatctagtcagaacctgtttcatgcacaaaatcactgaaaatgtataaaattaccttcaggctatgtgtataataaggcataagtggattctgtgtgtagacttgcatcccaccaccaagttcctcattatatacatgtatatattccaaaatctcaaagaatccaaaatctaaaactacaggtcccaagcattttggataagggatactcaacctatgtttgtaaagcatctttgggtatcgggacatttgtctgaagtcattattctgaaattttttcattagtcttactaatattgaatatataaatttgagaataaagctacagaaaagttataggaatgcccataaacgttttacctagactcaccagttaacaatttcccatgtttcattgttctgtgtgtgtatgcacacacagtttttctgaacaatttgagggttctttgcagacatcttagcacttcatgcctaaacttcaccatgtgtctcttgaacaaaatactataatactgtagctactacataattgtcaactcaggaaacttaacattgttgtaatactattatctgacattcagtccacattcagatttctccaattatctcaaaatatcctttattgcttattcctcctctctgaaccccctgttcctccgaccttcaagatctagtcaaggatcatcatgcattttgtgtatagatagatggtcctccccttatggagtgacatcccaataaatccataagtctaaaatgcatttaataccccgataaacccatggtgaggtaaaaaatggtcattcagatccactgtgagtcagggactgtccatccttgtcctacttcttgatctgctttaatatctagaacagttcctgagcctttccctcttctcttccgttgatatttttggtttgtctagattagttggtttacagaatgtgcctccatttatatttgtctgatattttcctcataattcaattcattcaagattttttttggaaggaatgcaacatcagtgatgtttctttctcagtattttacatcaagagacacatgtcagtttgtgccatctttggtggtgataagctagatcatttggtcaagagaggtatcctcttgatgtcttcattataaatgtacatttttttcctgtgggataaaaattaagagactgaatatcctgttcttccatggtttggcatccgtaattcaattttaacatcagcaaggaatttttttttcttttaaacactattatattcttgtataggacctagacttgaactcttcttgggcaagaatttttttttttttaagaaaccgttttgtcaagtttgtcaaaaaccatgagagattttctgagtttgggatatttttacttaagaaacgttctggtaggttaatggattgtgtgcttttcatatctttataactgtcttagctctctttttaaagtatacttggttattgtgctttttattctgatagttattacattttatatgaaaattaaggggcttacaggagcagggtaagtatagagtcctttgcacttaacttttggcataatttgtctgctgattgtaattcagcagacaattgaaaagctttaaatgactttacatactatcctgcctatttttacaggttgactatgtcattaaggaagcaactaatctagataacttggctcagctgtatgaaggttggacagcctgggtgtgaatggcaagacagtagatgagtctggttaagcgaggtcagacatccaccagaatcaactcagcctcaggcatccaaagccacaccacagtcggtggtgatgcaactgggggcttactctgaggaaacctaggaaatctcggtgcactaggaagtgaatcccgcaggacagctgcactcagggatacgcccaacaccatggcctgcaaccccagggtcaagggtgaaggaaagcaagctcaccgcctgaacacggagattgtctttctgccacagaacagcagcagacgtgtcgggaggttagctgcggaaagaaatcgggatgccgcggagcacagagtgatttggaactccattccacctgaccctgtgtgtacaatccaggaaaaaaacaaaccccactcagaaacagagaaaactggggtcgcgaagaaatcacagccaaggaagatttgatgcattcagattctcgtgtaacacttgttgcttggcaacagtactggttgggttgaccagtaagtagaaaaaggctaaaggctatgcgatatgaatttcagaaatggactgaaaatggagagctatgtaacagatacactacagtagaagaacttacttctgaaatgaagggaaaaaaaccaccccatcgttccctactcctccccaccacttacccgttccccctttacctaatctagtagattagccatctttcaaattcacttttatttcagtccttatatttcatatacttccgtctcgatgctgttaacaacttctgataacatggaaaattcaaggattgtttaaaggtctgatgatcacacacaaaatgtaattccggttatttaagtcatttctgtgattctatcatgtacagtttccagaattgtcactgtgcattcaaaagtaatgaatctaacagacatttgatttaatgtacactcccttttgcttatagtgtgcattttttttggaggtcattcaaattttccctcttctgtgatagctgtagtttctttcatagaaagtagctaatccagtgtaatcttttacctttttaaaaaccaagatagagtatctattagagttttacattgttgatgatagattaacaataaagtgatgttctggtggaggtagactgaaatttttttaattcatgtttttcatttgatacttttaatttacacttagtaaattaaaagttgtttaatttacttggcattttaggacatgtacatgaaacagtgaaaatgagatccaccaacatcttttattaagttcagttattagtctgtgaagtgctttactttttgcacaattttaatagcttgctattcagtaatacattatagtgaattcatgatcaaggtttccttaaatttagcattgcatttcagtactgactgtgtaagctaaattgctgatccaaaataaaaacccagactagaatagggttcttaaaatcaagtatcaatacaaaatagaacacaattaaaatcttaattgttggctgggcacagtggctcacgcctgtaatcccagcactttgggaggccgaggcgggcggatcatgaggttaggagagcgagaccatcctggctaacacggtgaaaccccgtctttactaaaaatacaaaaaaaattagccgggcgtggtggcgggcgcctgtagtcccagctactcgggaggctgaggcaggagaatggcgtgaacccaggaggcggagcttgcagtgagccgagattgtgccactgcactccagcctgggcaacagagctagactctgtgtcaaaaataaatgactagataaaaaaaaaaattgtttgagtacattttccctgcattttagagattaggacagtggtcactttctagttgccgtcttcacagacaaacttgaaaggtattaaggaaaaaattccacatagctctgggccttttttgtattctgattgccacgttaatctgtaatcgttaagtacccatgaaagaatgtgtttcagtatcagtgcttttttggtactttaacaagtattgtaggcacggtggatttttttgaaatacccatgtgtccaatagcaagttaaggaacctagcgcatcaaattttgttttcttcattcatttggaaccttattttcgcaaaaaacctagctggaataataatgccatattgtattttgcacactgctttattttctagaggctctgggagcaaattacattcatcacattacctctgctctctcaagattaaagtctttcagcaacattctttattgtcatcataaggaaaaacttttatcgcaatgatagtcagttcacattagtttagcactatagatagtattcagaaattgctttctctttggtaaagaagataaataggtgaattttattgcctgtgttttcaggcttcagaggtacctggcaccttactcaagcaaaaacaaaaaacagctttacttcaaaagcatgtgcctctggtaaattatccatcacttttgttttaaagtggtccctccaagaataatgtggcatacacagtgggtttggttgtaaggcagatgtaatagatgacttcaaaagcctgctccttactgcactctggacaaggccctggtctgtatagtttggcttcctctgttaagtcattctacaaggtgacttgccatttgaactttcgtaagagacctcagcagttagactgagaaaagttagagtgctgtagttatgaagtcatacatttttgataaaatacctgtggaaaaccagggatcctctcctgtttctctctcttgcctccccctttccctccattcctctgtcgcctccccctctcctccactttctttaagaatcagggggtacagaataacctacaaacaacctcttcaaagtacccttggaaattgaagttcaatcttaagttttttgctgtctttaatttactagaattgcctaatttttagttgatttctctacagagcttagcttgtgtagttatttctcttttactgttgctttggtgtgtcttgaagtttgattgattatttttggtcattgagttcttagtgtagtttgctagatgattattaagattcttttgtgtctgacacttgtggtgagttgcttttgaaatctgttgagatttccatgtgagaactgataatcaggctcttgatctgcttccctaaattacttttttagagcccaaaccccaggtttagggtgagggtttgtaatacaaagaaacacttccatcacttctgcccttaacccttgcctctattacctaagcttagtaagtagttttcttaatattgtccaatgtttggtgttatctgcattgttttttgtttttttaattgtggttgttctgacgtgtgaaatttaaggaaagagccattttttaaaaatgccgagcagggcaatgcaagtacagccaaatattagacttgatgtgcaatcttcggtcctttttaatctggggtattataggcagtactttaaattgcaaagtcttccgggcctattttcctctacatttttgtaattaactctgggggcttacttgttttggcagtactgaaatcaaaggagctggttcttcttttctcccaattattttcatatgaaagcacctacaattagcctgttagtcctattcagatacatcaaatatcagtgaatgctttactattcgcacatttaagcatctttgttttacataaaattagagtatgaaaaccagtgttcaattttttatcttgttgagcttgtaaaatgccagcaatttaaaactaggacttttccccccataagccaaggaggtagaattactaatacaagggttaaagaaggtagattttgttttcaatatttgggtaatattagaaagattcttcccacagggaagaactagcaagtgtcccaattttttccaaacgttggggaggggaaaattcactgtatcatgaaaccctaagggtttgttgcacttcctgctttttaggcctggataacagtatcaccatccttatttacagaagggtaaaactgactcttaatgagaaaagctttataagttcaagggctgtaaaatatgaactacttagggtcgtttgccttccatgggaacttggctagacttagaaaaagctgtttgttgtgctaatgtaaaagtgtcatacaatttagaagatttttgaagatggtaaacttagaagaattctatgttctgaaatgcacacttttagaatgtttttctttgaaaacaggctaatagttttttctttttttgacaaagtttcagctcctctttaaagttattgtgtcatttttctggtttaaatttcccttatatttccacctgtaatgtcagtggcaacaacatcatacttcacttacttgttaatttactttttacccttattctaagagcaagttgagttgaactgaatcttccttgtcttagtaacaatgtataaatagtggcttttctgtacaaaaggttgtaatgcctcctgatggatataattttgtgattgtatttaaaagttgaataaatcacaccagcttcctgaaaatgttcataatgcatcttttggaaaacaaatacatgcctactttgtgcatatttgcattaacatggcaaagattgtatgaaatacctgtttttcagaaaataaaggttcagtctcaaaagatacagcatttaagttctgaatttattggtcaaaatagattttggaaaacttgaaaccttttggaacctgggtagcttgaaaaaacaaaacgacagggtctccctatgttgcccaggctgatctcgaactcctgggctcaagttacactcccacttcagcctcccaaagtgctgggattacaagcctgagccactaagccgagccaagcctagtcttttttttctgaatagcactaatacctcaaaaaagacccctaaattctcagaaaagtaactattttattctcaaacatctgttgtatttttgaatagcagtagaaattctacttcaacgataaaattctttgtgttaaggcccaatttataaagcttaattttggcagtatttaaaaacaaaattcccgtagatcattattgacagataggtgcattccttggagtgtgaaacctctgaaaaaaaatagaaaatgtccagcttggctttatatcttggagattgcatttgttgctgctaaatgaagttagtaagatttgtgttaactgcttagtcatctggcacatttcaaaagatcacatcctgtctctgtaggacaaaaacaaagctctaaagaaagctatgttaagggtgggtgttttttaataattagaccaatcggaaatttagtgagagaccatatagcagggctgtgcatttagaaataggtatgggaatacattgttaagtaacaaaaaatactaagtggagaaactgctgtttcagttgcttctgtttttttcacctaccttcatttcacaagctggtgttaacaagtcttaagttgtgcatggaaaacttgggtgaaaacaagaagcatattctgcagcaaaagctgatttcccaaaagtagaaatgtcagttttaaaccctaataaaataccctctcttttggaagtggctattactgtgggtctagcaagatcacatacccagtgctcaacatattcactaattatgtggctgctgattgcttcgatctttttgacttttttttttttttttttttttgagacaggttttttgctctgtcacccaagcttaagtgcataggtgcaatcatagctcactgcagcctctatttcctgggctcaagggatcttccctgcctccccatttgtatttttttttttttaggggcgtggagaagaacctgctcctcagactccatagctttaaaatctctccaaatagcgtctctgtcaactggctgtatcctgcctttacaacttctttaccccaacattctccaaagtggcactttattgaacagtcagcttcccttgcaaagactttttttcaagtgcttctccctgattcagatacttcactcccctttccccgaaagacccacagcaaattgacacccttccatgaaattcacaatgctcctgcccttgcccagctctcttaggggcagtatgtggtctgcagctatgttctctcacatttatgacttccttgaacatttaagaacctggtggttacttaaggaacattttaaaaataaatttaaattcaatggccgaatacaaatgaccatgagattggaagttaaaacctgtaaaaaagataaaaggttggaagttaaaactatagttaattcacctgaaacaaacatctgatccggacatttggcatgattctgtttgtatcaaacgatgaaaaatcggccgggcgcggtggctactgcactacagcctgggcaacagagccaggctgtgtctcaagaaaaaaagaaaaaaaaaaaaaaaaaaaaaaaaaaaagatcaaagcacttgttactgcatttgaaatcctggatagaaaagatgtacaagtgcctcaacacagttcctaaactgcctaggaattctactgcttgtgagagggtttacatattttcttagcttgacctctaatggaagaaaggtcgtgtcaagaactatccttttggccgggcgcggtagctcacgcctgtaatcccagcactttggcaggctaaggcgggcggatatcttgaggtcaggaggtccagaccaccctggccaaaatagcgaaaccccgtctctattaaaatacaaaaattagccgggcgtagtgacgggcgtctgtaattccagctactcgggaggctgacgcgccaggatcacttgaacccgggagatggaggttacagtgagcagagatcgcgccactgcacttcagccggggccacggagcgcgagactccttcgtctcaaacaaacaaacaaacaattctggccgggcgcggtggctcacgcctgtaatcctagcactttgggaggccgaggcgggcggatcacgaggtcaggagatcgagaccatcctaacacggtgaaactacgtctctactaaaaatacaaaaaattagccaggcgtgttggcggacgcctgtagtcccagctacttggaaggctgaggcaggacaatggcgtgaacccgggaggcagagcttgcagtgagcaagatcgcgccactgcactccaggctgggcaacatagcgagactccgtctcaaaaaaaaagaaaaaaaaaaaaagaatccttttggagagggagcttgtagtttaagtaacttaaacatccacgtataataaagccacttagaaggcggtgcattttcacacgttctcaaaccaggcctgggtttttccgcgcaagctaaggcctcattcctactgggtaggagagaaacattgcagcaaaatccacacaaagagctcttttcacttgtcctcaaaacctcacgggtcgcaaatccgggctaaacggctcaggggcctggctggggaactgggccgaaggtggaacggatcccagccacctcggggccaggaaaagatgaagtgtcgcaggcccggcgtccccgccctccgcctgaggcaacggagcatctctcttcgagtagcccattttccagagagtctcctcggctgcgaaagccagacgaagagggacccaaagccaccgcagcggcaagagccggagaaccactgagggacagcgccccctgcagaggcggttgaaccgcttcccacagcgctgggcggggcgtcgcgcagtccctgggcgctgattgggcactccgtgtcccctccccctcggcccggcgctgcctctgtctcctttgacctcgatttcaagccatgcgctgagcttcggttggcccggcttccttgaggcgtaagctcggtctgtccaatgaggagcgagcgtcgcgggggccgtcgggaagggcggccgacccatataagcagcctgcggggcgttccctcgggttgtggttggtgtgcgggtttcggttggaggactcgttggggaggtggcctgcgcttgtagagactgcatccccgagacgatggcggagggagataatcgcagcaccaacctgctggtgagtcctggctgcctgtcccccgggagccgagcgaggcctccagacgtccgtgggctcaaacaccgcggcctcgtccctgtcacccgccgcgggcccggcccttctctccctgggcaggcgacgatgcctggccctcgggcttcttgggtgactcctgggtgtcgaacccttacctttcctggggacggtgcgcgacggggcgaggagggcgcgtgattcatcaccgcgagtaggagtcgaggaggaagtgggaggcagaggggctgcgacactagcctggggtgcgggtgggggcagaaggcctcctggggcctgtccagcgctttcgcggctcaggccccagccgtattcggctttccccgtctttgatcttaacctggatgtgcctgccttcttttccccctaaaacttggacaagggtggagggtcaaagggctactgcccagaatttatcttagagctggtacaacttaaaacgacagggaggctgcgagctcaccgtggggaaccgggagcggggtccagctgaacagacaatgggatgtcttggcgtttgtctggaatttggaagtctggcgggggtggggtcacaggactactggaaacagctttagagtaataagcagggatccgaaggaactgcagtgagatggtatcataggcggacacatttttatttgttatgaatttaagcgcaccttgtgggcaaaaaacaagagaaatatccttgcatattctcagttgcccttccctggtgactgtaggtcacataccagcaatgaaaaacggaaccaaagaatttacttaggggcttttgaacttccaagaccccagacgctggccaatgacgtgacttcagggcagttttgattgtgcgtgattttatatttgcttttagaaatgcatggtttgttcctttaaacacacgctccttctagcatagttagttctcagcgtggatctttttaagaggattaattgaagcacagagaagtagctcaagccctgttgaaatgacaaatcctgggctagagctcctgcttcccaactctccttccagcagagcaatataactctaaggaaagcaacgcctttggtcgtggatttcttggatgcagatcagttaacctctgtatctgtttcctccttggtaaaatggggacagtaataacacctttttttaagggttgttaggaagattaattgaagtataaatatgaatgctcagcagagtgcccacacatagtagtctctttcactagtattaagcatggaatataaagtcagaaatattgagatcacactagtgctcagcgtggcacagatagcgagcgtctttgttaagattaagtgccttgttctgtcatttgcatgatttccagtgaatgacttttacaaagagacaaggtctcagcccaggctggtcccgatctcctgggctcaagcaatcccccccgacccgccaagtgctgggtttacaggcgtgatccactgcatccagcctgataacatagagacacttgagtttcttattctaaatttttcttcctttaccaaaaccagctttaagggcttttgccacattagctcatcctagaggcccactttcggctgttcagagtcagagaaatttgaagtataatcaaaatgacatcctgagtggtaagaaacactgtattgaggaggtatattgaccgtaaaatgccaccttaatttggtgaaagtagttttccttaattgtccaatgaatgtcaacatctgagtgattccattacacaaagagctattttagaaattgaatgctattcagggaaagtctttcctaatggatttagaagggtttaaatcaataagatgacaaaaacaacggatcaattctaaccatctgaaataaacaaacttaaaaaaagttatttcattttattaatactctgggcactgccacgattccccgcatgactttgagaaagtaaaccattttgagctcactttctttaattgtaaattgagtctaattatccctaccttgtggctctctgtaaggattaagttacatcatgtatataaagaatagcccagtgcttggactagaaaagtgaccattaaaggatatttaggctgggcctggtggctcacacctgtaatcccagcactttgggaagacgaggtgagtggatcacttgaggtccagagtttgagaccagcctggccaacatggtgaaaccctgtctctacaaaaaattagtcgggcgtggtggcgggcgcctatagtcccaactactcaggagtatgaggtaggagaatcgcttgaacccaggaggcggaggctgcagtgagccgagatctccccactgcactccagcctgggtgacagagcgagactccgtctcaaaaaaaaaaacacaaaaaacaaaaaaacccattgtattttcatctttgaaattgcagtttttcagaaaccaactagtttaaaattggcaatttggttaagaggttattttttgtatttggagctttaaaataattgaagtctatgaaccacaaaaatgttgagagtggtaaaatgatcactttaaatgtcggtggtatttaggctgcagagactgcaagtctggaagaacagctgcaaggatggggagaagtgatgctgatggctgataaagtcctccgatgggaaagagcctggtttccacctgccatcatgggtgtggtttctttggtgtttctgtaagtgagctattagattactatgggttgtgcttcttattaataaagactttttaatatatagcttctgtttgtgggagtgccttaagtcttctgtaatatataacccataaagaacccataaagaatgtttctcataagcacttctagtttccagaatttgtagtacttctgtaaacttggtaacctaaagcacttgagtaaatcagtgactcgcaaactttttgtcctccagacacttaaactctttttttgttattatactttaagttctgggaaacatgtgtagaatgtacaggtttgttacataggtatatatacatgtgccatggtggtttgctgcacccatcaacccttcatctacattaggtatttctcctaatgctatccctcccctagtcccccacctccctaaactcttaaaaaagtgctgagaactccaaagagcttttgtccattgatatatacttaaccactgcagctatgatatcagcatgtcacaaagcctctggaaagccacttgtgagaaaattagaagaaaaatggcaaatatctctgagaggcggtgaatagttaagtgaatagttaagttagacatgtttagttaggaataataatgactatgtttttctaacctttattaatttttttaacaggattatctactatctagatccatctgttctgtccggcgtttcctgttttgttatgtttttgtgcttggctgactaccttgttcccattctagcgcctagaatttttggctccaataaatggtaggtagcataatgatttggcagtctcatttttgtgtagttactgaacttggtggctgtgattagtatgctgtaaataagcagagataattgtctaaccatcagacacctaagcattagatttattgcttttatgtgaagaatattgtaactgatttgaatataaactatgaattttctgtactccatagttcttttatggtaaatgcacatatacatttttacatttccattgatatttaggatagtataataacttcacaaattatttttgaatgaatacagaaaaggaaactggcagattttcattcacattcatttagcaattatttattaaatgcctactgtggcaggccctgtaaagtactgtgaaatattttgacttttaagattgatcttgtgttaaggctgagatactgagacactgaggcagtggaatggcagttaacaaagtgaataccaagtgtttccgaagaggttcaagctgtatacacatgggttgctgattttatttataccattctcttttttttttttttttttgagatggaggctcgctctgttgcccaggctggagtgcagtacgctcttggctcactgcatgctccacctcccaggttcatgccattctcttgcctcagcctcccgagtagctgggactacaggtgcccaccaccacacctggctaattttttttttttttatttttagtagagacggggtttcaccatgttagccaggatggtctcgatctcctgaccttgtgatccgcccgcctcggcctcccaaagtgctgagattacaggcgtgagccaccgtgcccggcctatttataccatgaggttgcttatgaactcctcagatatagttaagtggataaggatcatattaaaagtattttaactttctctagcatgttgagttttgattcaaataatcagccaaaatagaagttggaatagatattttcttctcagctgctattctatccttggctgtttattttatttggttagtattctacttgtgcctttggttgtttgtatctcagaggatagcaaattgcaaaataattctgtaaatataagaattttaaatgtgtaccttatggatctttaagaacaaattcaaagtttgcttaaattatgatataattgacaatatttaaaggtgtttcccccaacagcagaatggattagtgttaggaactgtccaaattgtttttcacttgcagtaatgaatcaatgttgttggctcttttgggcaagtttctgaatgtgcagtataacagagttagcaaaggaaataaatcactgaccttggccttattagccagataacattccagtctgctaatttataactcctagaggaaagtttgcagaaataaccactgatagtttcgtgatgtgactcagttattgatagagcagattttgtttattttttgatcttacaaggaagaaagaatactcttttgcatagccacaatctagccttgaccatgggcaagaaataacatctcattgttgaaaagaagttccagggctcagcagaaatccttgtactttatctatcactgcagttttacagagatgagggctagagaagagaaggcaacacatccctcagcacagggcaataatagcagccattatagctgtgtagcgaagacagtgcaaaggcaattaaaaaaatcagaaccaagaaaaacattataaatataaaaggttttcttggagggtctcttgttggatttttactgctgtgttgtttgttgattatattttccctccctagggataaatttacaaagaagaatttagatttgagctgtttattgctgccttgtcatcagatgtatgaagcccagttgggggtgttatgtgttaaatgccagtagttagtatcttactaaggagtgttcaaatacagttgttcggtgggattctggtaggtatagtgcagcatttactaggatctaaagaatatttaggaatagcaaaatcaaatttatactgatttctttatggcccatagaagtcatgagtcttttactaccattaaataaatgtggcttcagagccagagatgatcctttctttatcacacgcacacacacacacactctctctctcacacacatagtttatgtaaatacttactcctgtgctataaaaggtgtcttaatggtggaaggattttttcacctacataagataatggtgaaacattgtttttatttttattttctttagaagatagctcttaaattgaacagggtgtcatgtttttgtctactgtaacgatttgtttatagcaaaaggcaaatttcttttctaggaccactgaacaacagcaaagattccatgaaatttgcagcaatctagtaaaaactcgacgcagagctgtgggttggtggaaacgcctcttcacactaaaggaagaaaaacctaagatggtactttttttgctttgacttaagtacagtaaaattttaagatttgagtcaattcgcctttttgtcttaatagctataatttgaaaattattcattggttaattcctaagtacattcataaatgtttacctgtattaattagactgaatcattttaaagttaaaaattacatttttgcatttaattttttattctaataaaacaaaattcttctgtttcatttttcttactgaaataatagtaaaagacatatacttagaaagcatctgtttaggccgggcacagtggctaatgcctataatcccagctacatggaaggctgaggatcacttgagccctggaggtcgaggctgcagtgagctgtgtttgcgcagtgagctgtttgcaccactgcactccagcctttgtgacagaatgagactctgtctcaaaaaaaaaaaaaaaaaaggaaagcatctgttcatctgttctcttatctgtaagcttcacgtcgtgaggctgttccgtgaagttattaactgaaaagatcgtataatttatatcataaaatatttacatacagaattgcagtaattctaggaagaaatgtatccaaattctataaagtagatccaatggaataggtttttaaatctaagaatttttaaagaaaagtgataataaaagctaaattatttcccgaactttgaaacacattcttctttaattgacaaataaaaattacatatatttatggtgtcacatgaagttttgatattaaattcttgttttcattgctagtacttcatgaccatgatcgtttcccttgctgcggttgcttgggtgggacaacaagtccacaacctgcttctcacctacctgataggtaagtctttgaggaaaaactacaggcacatcctggccagtgaaatttaactgtaacttcgtcagtaaacagctgaatacttcctaagttttagacaccgaaaaggaactgtgggaatatggaaagattattatggtctcatagaaagtgaaaacaatgcaataaccaaggtagaaagtaatgtgcaagaggtaaaaataagcaatgattattttctgaggtggaagaggggatgagagcagaagtttctggggatacatcccagtggaagtaattgatttcatgttgcttcctcccattactgagtttaataatgtaggaacctgccttctttaaaatgtaataactggctggtcacggtggctcagcctgtaatcccagcactttgggaggctgaggcaggtggatcacttgaggccgggagtttgagaccagcctagccaacatggcgaaaccctgtctctactaaaaatacaaaaattagttggatgtggtggtacacacctgtagtcccagctacctaggaggctgaggcatgagaatcacctgaacccaggaggtggaggttacagtgagctgagatcacaccactgcactcaccaccccccccacccaccaccgccatacacacgtaataacctctgatcacctgaggtcaggagttggagaccgcctggccaacattgcgaaatcacatgtgtactaaaaatacaaaaattagccaggcgtggcggcaggcacctgtaatcccagctactctacttggtagggtgaggcaggagaatcgcttgaacctgggaggtggaggttgcagtgaaccgagattgtgccattgcactccagcctgggcaaaaagagtgagacttgtcgctgggtgtggtggctcacgcccgtaatcccagcactctgggaggctgaagcaggcggatcacctgagattgggagttcgagaccagcctgactaacatggagaaaccccatctctactaaaaatacaaaattagtcaggcgtagtggcgcatgcctgtaatcccagctacttgggtagctgaggcaggagaatcgcttgaacctgggaggcggaggttgcggtgagccaagattgcgccattgcactccagcctgggcaacaaaagtgaaactttgtctcaaaaaaaaaaaaaaaaagtaataacctttagcaggttaattgctgcctccttaatgttgggtttttttttattttaagtgacttccttactattgcttcctggactaaaccaacatggaatcattttgaagtacattggaatggccaagagggagataaacaaacttctcaaacaaaaagaaaagaaaaacgaatgattcatctgctttaatcagtgtgattaatgcagcacccattgccccgggaaccgtttctgctgtactatctggatactaaaatgttacggaagtagctctttgttctccctcactctgcccttagttaatagaaattcagactcgccaagtaaggcttcgtgcatagtgtcttcatgtcgcgtatagttgagcgcgttcttagcagttggcttcatggacaactcattagtgttttgacttttcttacccagcgttaattgaattcttgcttttagacaacttcctttttgtagtggtgaaccttgccctttagtacagttcaagtgaatctggataattgttcatctttgctttagcttagataccatgtagtggtctgtggctacaggaagctggttctgtctgcttccacagtctgcttaaaaaactgtctgacttcgtgaatatagagaccaagtttaccacttctgatgaagagaccaattaagattcattcctcattctgtttctttccagtgggagaagagtccccatgaaataagatgaaactgattccatgcactagtacatgtaggcttctcccttgtgcaaagcttagcaatttgtaggaaactttgatctttttgtccaagaaaaggaatgtctgacaggcttaagctttcgtccccttgcacttagactcgaagttagtaaatccttaaaggctttttaatagcagacttccaaaagattgcatttaggatttctagcatgcttttaatttcagattttcagctgacattagctatagtatacagtaggttaagactcatgtctatgactttcactctaagactggcaaaaggacagcagtcttctatgtttagtcaatattcatttcagtagaagataatcttatctaatttttgagaccagaataagccttttaaggtaaacctcaaaattatcattttatggtaatactgaccattttagtcccctaggtttgacatgggagatagtgactacactggtgtctgacttttttcctagagatttctccctgaaaaatacaagggctgttggtgagagcagacttgaggtgatgatagttggcctctggtctacaaagatttcataactccttggaaagcttcttataatcattcttaacttcttggtagctagaaatttagagtagttgaaatctttaggaatgaacttctgagggccaaaaaatgtgactgacgggaacaattcttaaactgattaactagctgtaatatagttttgtgaatttattgcactgatgttgtaccttgtggtatatctgtccctattaaataagtgttgttttctcctctttaatattgctgtgaacagtggtgcccattgtagcatatgtttgatttttttttattatttcataagaaaactacgttaattttaccttactttcattgtaaataagcctgtcttcctatctggattttttgtgtgcatacatattctactgattaactacttttgcagttttaatcctgtattatttcttctactttgttttgtgtaaaaggggaaaaaataaaaaaagctggaatcttcatgtctcactttctttataacttagccaatataatatttatgattggatttatgaatctgattaatgaagtaccctgtgtggtccttagatgtctataaggtaccctacctgtaatcccaccactttgggagacctgggcaggaggttcactggagtccatgagtttgaggttgcattgagctgagtgtacccctgcactctagcctgggcaacagagcaggaccctgtctaggaaaaattttaaaaaagaacaaaaataaaaggtttaagttttatttagcaaatatccaggtaccatgctagagggaagaggaaatgcaacgaatgagcaggggcattgacgtgtgagagaggacgaagctggaagaaccggcagggacagaactggctaaatggtgcctgtgtgggcacctcgtaccccagggccttgctagcgtctggtacatgggtgctcagtaaacaactgttgggtgacttttgtctgaacttaactttttaattaaaaaaaaatttttagccgggtgtggtggctcacgcctgtaatcccaacactttgggaggccgaggtgggcagatcacttgatgtcaggggtttgagacgagcctggccaacatggtgaaaccccgtctctactaaaaatacaaaaattagccgggtgtgatggcgggcgcctgtaatcccaggtactctggaggctggggcaggagaaccgcttgaacccgggaggcggaggctgcagtgcgccaagatcgcgccactggactccagcctgggcgacagagcgagactccttatcaaaagtaaactaaaataaaaattaaggcccgcgcggtggctcccgcctgtaatcccagcactttcggaggccgaggcgggcggatcgcaaggtcaggagatcaagaacatcttcgccaacttggggaaacctcgtctctactaaaaatacaaaaattagccgggcgtggtggcgcatctctgtagttccagctactcaggaggctgaggcaggagaatcacttgaacccgggaggcgcaggttgcagtgagccgagatcacgccactgcactccagtctgggctacaagagcgaaactgtctcaaaaaaaaaaaaaaaatgtagacgaacctccaacgaacggctcaccttgcctctcccaggccccaccgggggaggtcgattccatcgactctcaactgccaacccctgaggaggctccgcctttccctcaccctcgtccttctcctaggcggtccttgtttttgccgggcctttgaaagtctcgcgatagctctcccgcttcccataactccgtgcgctctcccctcccgtcctctttccgccatctttccgcgccggtgagtagcactctctgagagctccaatttcatccgtctgccatcggcgccatcctgcaatctaaggttcggtctcggtgtcctgcgaggaggctggtccccaccttggccgaggatcctggccttgccggttcctggacaggcatagaggagagccatggctgggcgccccagactgtgcactcaggggatcccggtccgtggggtgcaggccgcagcgcgggcgggagccggagccttcgactgcccagctaggcggtagctccggttcgggccgcagcgtctggatctccctttagtgctgaggcagcgccttggccccgggcggcgggcaacatcggggctggtgggccgtgcagcttctcactgctgcggccgcgctgggagcttgggaggctgaggccacccagcaggtaaaagctgcatcgtgccggggttggcagtttgctgggtgccaacttggatcttctgggccgcagagtttttctttagacacttttgaacttaaggaatttaagttctactctttactattggcactttggtctttcaaaacttcagtgtagtgtgcggttcttgcccattagaagagagtccagtctgacaagcatgtaaaatgtttctgtttgccactgtggctcttgctgttggacgcaattttaaatggcacgaagatggatgtttaatagttagatgtgttcattgtaggtgagagtgaactgatttaaagtacaatgttaatagtatggaatctgctgattttcagcaatttggaaaatgttgccgatgatactctgcttctgttctgaatcactgatcgactatacccgatgttttccttccggtagctggcagtttctgccagttctcacgttgtcttgtgtcaagtggattttgtcccacattttattatctccagacgttggtgtgtggcacgattcgaagaagagtggttagtgaatgaatgagtttcaaaatgtgcaggctgacgtcccgataacctgttttcaacaaccgtagtaaataggaattttcctgggtggtgggaaatggagaagcagcctgcttagacttgagaaaacttcgccaaggtggggccagaaaggaaaggatacttccgcagtgtaatggttggtgtctgttgatgttggcaatgccagtaaaacctcctgttttgtcttccttgaacagccacaatggtgcgcatgaatgtcctggcagatgctctcaagagtatcaacaatgccgaaaagagaggcaaacgccaggtgcttattaggccgtgctccaaagtcatcgtccggtttctcactgtgatgatgaagcatggtaagtctgctgccgctgtgttttatgttttcatgtgagactctctaagaaatcagtcctgtagaaattaattatgggggaccaaagtatgtctgtcatacctgagaacgaatgcaattgacctgtgggctgtggaggaggggatagtctgaaactgctgaagagtcacttagagtaggactgctggaaaaaggagctctgctaggtgtttgggagctaaatgaatctaagtcattgaaaggactcctgagctcatttcgagaccagcctggccaacatggcaaaaccccgtctctactaaaaaaacaaaaaacaaaaacaaaaatcagccggtcgtggtggcaggcgcctgtagtcccagctctttggaggctgaggcagggagaattgtttgaacccagcaggtggaggttgcagtgagccgagatcggccactgcactccagcctgggcgacagtgcaagactccatctcaaaaaaaaaaaaaagaaagaaaggactcttgagatcttctcagagctctttgagaggaaagattggattattgcacttctttggcacaaagtagtctttgggaatgggaagcagtgaaggaagggtcaaggggaaaatagtttctttcagaattgcaaggtggattgttttgggtattgtctcccaattcttatatgttaggttgtaaaaattagttctgatacagagcaactgtcttccccccaactttttggagaagcagtcactgaggtgatgggagagtgaagaattgagtaggctagagcacagaggtttagctctcaagttgatgtcttttatttaatccagtcagttatcttttgtaggttacattggcgaatttgaaatcattgatgaccacagagctgggaaaattgttgtgaacctcacaggcaggctaaacaaggtaagaacgagtgatctacacatttcaaagctttaagaattttttactgtggcgttaaatgttgtaattgcctttggaaatactgagtagtggtgccatacttgatttatccagttactttaaaaaggtttaaaaattgacacatggaacttcatttgctctcctgggttgattgtgctaggattatgtcagttgacctagtgtttttatggggtataagctgtctcaggagagatggggggtgaaaccaacgctggtactggtatttggatgttaacgctacccacctcactggcttgaacttgggtggctcaaggccattgagccttttgtccaaggtgctgtgtccttcctctcagtgatgtgttgggttttttgaatggaatctttatctttgagtaaatggggctttctaaatagcaatatgaatactttttctgtttttgctggcataggtctttggggtctatgctgcttttcagtttgacttgtcaacaccttaaccaagtaaaactgactttgtggtttaagtgattgcgtgtgttttgggggcaggtgtcttaagctggttgaggtgtccactgtgcttcctgtcaggtttgtagctttcagatttgcaaggaggcagatcctctagttcaggcttgtccaacctgccttattttgttgtattgttttagacttgtagcagcctgaaaccatggtacttagtttctgtctctagtgataaatggaaaagagggatgaggaaggggccttactggcccaactagaaacagaaactaagaacccatgactgtattctctcccttggacacccctgtgtttattgcaacagataggggggaaagagacccagaaggtgagttgctgaagtatttgttaaagatttgaagaactagctgggcacagtgggtcacgcctgtaatcccagcactttgggaggctgaggcaggcggatcacgaggtcaggagtttgagacaagcctggccaacatggtgaaaccctgtctctactaaaaatagaaaaactagccaggcgcagtggcgggcgcttgtaatcccaggtactccggagactgaggcaggagaattgcttgaacctggcaggcggaggttacagtgagctgagatcgcaccactgcactccagcctgggtaacagggcaagactccctaagatttgaagaacttgcaagggtaattttcagtatgtcatgttttgttctagttgtagccattagaaccccacctcaaaataggattgatttatttttatttatatttcttttgagatagtcttgctctggttgaggctggagtgcagtggcgccatgcttggctcactgcagcttccctagctcaagccatcctcccacctcagcctcctgagtagctggggaatacaggtgcattccactgtgactgctgatttttctttaacttttttgtagaggtggggtctcgctatgttgcttaggtttgtcttggactcatgggctcaagtgatcctcccacctcagcctcccagagtgctgggattacaggtgtgagtcactgggcccagccgagaaataaatttgaacagagcattctgtaaatggaacttatttgtggcacccttgttctgtggtatgctagtttgaaaaattctagcctacaacagttgatatgcaggccctgctgctctctgcccgttttttgagacggagtctcactctcacccaggttggagtgcagtggcacgatcttggctactgcaacctctgtctcccaggttcaagcgattctcctgcctcagcctccctagtagctgagattacaggtgagtgccaccatgcccggctaatttttgtatctttggtaaagacggggtttcgccatgttggccaggctggtctgggactcctgacctcaggtgatccaccgcgcctggcctgttctgtgactttcgacaaagcaaacaatttttggtttcttggaatttcatttctccccatttaaaagagaacgtccccctccatcgctttcatgcaagacatggacctacccttagcgtggaaattgagcttggaagtaaggtagtgtgtaaagactagattgattaaaattctggccttgatcacatcctcttacgattcttctgggttgggggagggtatgctgttttaattctaccagaatgagaagaatttttgctgctggaatcaacataaaacttggatgcagcgtgcggcagactttggaaagatctttcactatagcttgcttggataaaactggttttcccatattcctatccctgcatttctttcatctgccgtgagattgtccttgttagtcaagtcacagcatagctgatggggtaatagtaggagaacttaagcaggcttcctggcgtagagcagttgggcctttctgacaagcccattttcagtttctgtgggtcaatctctgcttttggaagtgtttttcaagtgtgcctgtgattttagagcagattttgtgagcagagggtcttcagttagtggacatcagttagtggactttcttcagtagtgttttagggctggcatgtagttgagtgatggcagcccttggcgagcttttacttgggaggatcattgttgccatgtcccagtagccacgagatgagataattgcaggccctttgctctttctgccttccatcattctgtcagatttgtttggaaaaatttgtctggggctgtaggacattgtttcttggaaatatgtaacggtacttcattggtgggagcagcgttcttagttcagtgcctggacagcgtgttccttagatattctaataatttgtagagcttcaggatttgagaccctatgattttatttcagccttattatgtaagaaagggttggctgtagtctctcttgtcgagacttgatctctaggctatgtaaaatctgatcatcctggacagctctccagccaacagggagcacgccagtggcctgacactgccatgtattgccttgttccatctctttgcatgcctttgctttttctcctaggcaggcgtagtcttacttaggtgtattttttgaaaagtatgtcaagcattgtgcacagaataagtacccatctgaatgctgggttggttggtttggaggactgtttatttatgaatgtcatcttgtgttactcagtttttctgttattggtaaagtgaagaatgtttttgttgttgttgttattttatagtgtggggtgatcagccccagatttgacgtgcaactcaaagacctggaaaaatggcagaataatctgcttccatcccgccagtttgggtaagttggcctttccttaattaaaagaagttaatgctaagaatttctgtggtgcagtttgacttaagggtttttttctttttttctgtttaaaacaaagcagtggtaatttgtctactcttaaccattttgacctaatagctcaagtgttatccatatttcttttctctctctttaaaaagagacagggttggccaggcacagtggctcacgcctgtgatcctagcattttgggaggctgaggcaggcggatcacctgaggttgggagttcgagaccaccctgaccaacatggagaaccccgtgtctacctaaaatacaaaattagccaggcctggtggcacacacctgtgatcccagctacttgagaggctgaggcaggaaaatagcttgaacccgggagagaggttgcggtgagctgagattgtgccattgcactccagcctgggcaacgagtgaaactctgtctcgagaaaaaagagagagagacagggtttcactttgttgcccaggctggagtgcagtggctgttcacaggtgcggtcataacacgctacagccttggcttcttggcctcgagcagtcctccccgctcagcctcttgtggatttgggaatacaggcgcctgccaccgtgcctggctatttgccacatttcatgtgttgagcttcaggttctgagaggcacatgagagcttagactggcagaaaaggggggtcgtgtccactttcatgtctgcccttttggctcactgcagatagttccctgtgatcccagatgagggccagaatcagttctaagcctaggcctttgggaaaacttagtttgggagtctttgtccttaaaagcctatctgagttcaaacccttgtttttctgctttaaagccatgagatcttgggcaagtcacagccttgatttcttcatccgtaaaagtggtaatagttcctctgtttatcacctgatttaattttggtaaagcactttatgagctgacacagtaaatgtgtatctttgtggttaagaatttataccctccaaattatgcgtctggtgccttggttgaaagtattctcacttcatggttgctgtattacaggtacggtattctcaccaaaatcatttctctttgtaattatgatactgattttaatgccgcacatttgcatactatatgcttgttacagtgatccccacagtaactcatgaagcagccactcattgtacaaatgaacgtctccatataatagtttagctattatacagtacatggcagaaacacaattcaaactcaagtttatacgaatactttcaagtctccttacctgagagcagaaagtgacatttaaatttaaaggagttcccagcctttgttttcagtgcagtttgtttcatggtgtaggcagaagtcagggctgtgtgattgtgtggctgggctctctggatttggctctttgggttgcaggagtcatggctcatacgctacatgaggcaccagctcatgtaggcactgtcagttcctatgtgccccacaggaaagcgcccttaaccactgatgagtgttgatgtttttctgcactagaaggcactatgttgaactattaaacttaccagcactttctttttccactccatagtttcattgtactgacaacctcagctggcatcatggaccatgaagaagcaagacgaaaacacacaggagggaaaatcctgggattctttttctagggatgtaatacatatatttacaaataaaatgcctcatggactctggtgcttccacttggtcgttttgagcctttacagcagtgtagccacagcttctgcggcagcatgcagttgcttcgtttatcggtgaatgcgattccctgaagtgactaatacagccaagggaaaaagttcttatgaaaccagtatgcctaagaaacagtcacccctgctgtctgccaaaaccaggtatttgacactaaatattttagttgtatttcagtttttttttttttttttcttttttggagacagagtctgactctattgctcaggctggagtgcagtggcgcgatcttggcccactgcaacctccacctcccgggttcaagtgattgtcctgtctcagccgcctgagtaactgggattacaagtgtgtgtcgccacatccggctaatttttatattttagtagagacagggtttcgccatgttgcccaggctggtcttgagttctgggcctcaagtgatcagcctacctcggcctcccgaagtgctgggattacagccacgagccattacacctggcctatatttcagtattttctattagtttttgatgaatttgttttgcctggctaggattattctgtagataggattttagatctggcttttgtcactgactgctgtaataaatacttgctaggaatttttttttttttttttttttttttaagacaaagtcgctctgtcacacaggctggagtgcagtggcatgatcttggctcactgcacctccgcttcccagattcaagtagttctcgtgcctcagcctcctgagtagctgggattacaggtgtgtgccaccatgtctggctgatttttgtatttttagtagaggtggggtttcaccatgttggccaggctggtctcgaactcctgatctcaagtgatctgcctgccttggtctcccaaagtgctgggattacaggtgtgaccaccacgccctgccttaagaattgttccaagagaatctggtgccacttgcaggtgcccattgaagtgcaatgggcactgttgatcactgaggaggtagtgggtgctgacccggtgctggggcctgtcccctagtctctgctttgcccttggctagctaggtggtgtgccaagtggggagagaagctaccttattaaggggcatggatcagcttcctgaaaggagggcctgcctctgtaagatatgggaagtcgctgagaatgttacagaacggccctagagatggggcagataacggcccccatttgtgagaagtgagttgggaggcatgtttggggcctctgatgtttgggaggctgtgggtaattaacatgagttttggggtccagcagcagaattcaggtttcctcttccactcagtaacctcagcatccgtatctgtaatgggaatgatacaaaacctatccccaagttgagggaaaaatgagattgtgtaaagcgcacttggcacatgacagtcacaagcatgggggacagtgagtccagaaggattttcttatgccagcattgtaagccctaggatcacagggctctggcttgtttaaccatcgtgtctctggtccctagcctgcaaacctggtgtgtagggatgcctcagtcgcttacatgttgattgagtgaatcgtcggtttctttctggacactgacttcaaaaataaaataggatatgaaaatggctccatttgttgtcaccattttgtggggatcctatgtcctttgaagtggtcaggagtgggagaaacgtgacaggggaagaaggagtggtgtggctgatggatttaacatgtgttcttttatgttggcaaggaagcggatgaccttaccccttgttcctcagatcctgtaaatggctttataacatgacccagggctgcttggtgtgggactagaccccagggtttgagggtctgaagacaatttaggttcgtgctggcaggatgtcttggctcagagacaagtatttctgtggggtgatcccagcatcctcccagcatactgctgctgttgctaggcagagaccccggagtggggagagggtgatagcatctggatcatccattcctacctaggtggttttggctcatagtaaaagggacccagcacctatccgctgctcagcctcggagctgcaggtgtcagggatatgatgcactgtccaaaaagacatgcaaaacttaacacccctgcattttcatggagagaccccgtggagcctctgaccagaggctgaaagaaatgtgtcattcaaaagaccagggaaccactgccaaggacccctacattcagcaacacatctatactcgtgcctgccacgtgtcctcacttagaggctattgtctcacctcagggtcaggagtgccaggtgaaagagcacacaggtctctgggcaaggcagagtttgaagctaggtctggaccaacgtctgagaggatgacttcaccccaggcgaggaagttcactttgagctcctggccagggagaaagcaagctctgggagacctaaactctgaatctcacttggcttttcagtctaatccgttgttgccaaagacatacttggcaatcccgaatcctcagagggctccatacgtgctgcgcttcagccttcgctcacggttcatcccacctggaatgcctttttctctccaaagatgttcccaagagccaagttaaatgtcacttccatttatcttcctccaaaaggaacatgtgttttacttcatctttctcctaaaaatgtggaagccttaatgagactaataatggttgttagtgcttgccaggcgtggagctaagagtgttacatatattatttaatctgagcaatcctgcatcatgggtactattaccagctccagtttttttgagacggagtccgttttgtcgcccaggctggagtgcagtggcatgagttcaagcgattcttatgctccagccttctgagtggctgggactaccagcacacatcaccacgcccggctaattttttttgtattttagtagagacagggtttcgccgtgttggccaggctggtcttgaactcccgtcctcaggtgacctgcccgcctcagcctcccaaagtcctggaattacaggcgtgagccactgcgcctggcccagctccagttgttcaggtgaaaaaggtgaggcacagaattggaaagccatttgtccaagaggctaggaagtggtcacgtgagcatttaaatgtttttaagcctcagcctactccaggcccttagcgtgttttgtactgcgttttcctggtctttcccagtgtttattagatgtctatagtgtccagacaatgttaggcagacgggacacaagggtgcacaaacaaacagtctgtgcccttattggaacctgttaatccctaaagggctaagcctccctgcagcaagaaccctgttagtcacctgtgtatccccagcatctagactctccacgggcatggcactatgctgtaaaaaaaataatccctgaccctcacggctatgggaaagcatgccttttaaagcataatccggctgggtgcggtggctcacgcctgtaaccccagcactttgggaggctgaggcaggtggatcacctgaggtcaggagtttgagactagcctggccaacatggtgaaaccccgtctttactaaaaatacaaaaatttgctgggcgtggtggcaggtgcctgtaatcccagctactcaggaggctgaggcaagagaaccgcttgaagcctggaggcagaggttgcagtgagctgagattgcgccattgcactccagcctgggtgacgagtgaaactccgtctaaaaaaaaaaaaaaaagaaaaaaaatggataatccaatctaggtgcctctgccacagtgttgcattcacagaattccgtggacccaaaaatcagtcttggaataggctgagatatggacaggacacccaggttctgcccctacacctatcccccacctggctttttttttttttttacttgagacagtctcgccctgtgagccgaggttgcaccactgcactccagcctgggcagcagagcaagactccatctctcagaaaacaaaaaaacaaaatggggttaagagaatgggctttggaatctagtggcttcactggttgcttgctgtgtgatctcgggccacttgctgtgcctctgtgcgtcagtttccttgtctttagtagagagatgatagtaacatttcctgtagtggttgtgaagattatacataatgtttgtaacctgctggagtggtcattagagctgttcaccaaatattcagattctccccggttggcacatggtgggagtgccttgtccatgtgactaactggccagtcagctgggagcagaagtgcctccttcaggcgggggcctttagtggctggcaggagacctctatggctcctctttcttttttttttttttttaattaattttttaaaattatactttaagttttagggtacatgtgcacaacgtgcaggttcgttacatatgtatacatgtgccatgttggtgtgctgcacccagtaactcgtcatttacattaggtatatctcctaatgctatccctcccccgtccccccacccacaacagtccccagagtgtgatgttccccttcctgtgtccatgtgttctcattgttcagttcccacctacgagtgagaacatgcggtgtttggttttttgtccttgctatagtttactgagaatgatggtttccagcttcatccatgtccctacaaaggacatgaactcatccttttttatggctgcatagaattccatgatgtatatgtgccacattttcttaatccagtctatcattgttggacatttgggttggttccaagtctttgctattgtgagtggtgccgcaataaacatacgtgtgcatgtgtctttatagcagcatgatttatagtcctttgggtatatacccagtaatgggatcactgggtcaaatggtatttctagttctagatccctgaggaatcaccacactgacttccacaatggttgaactagtttacagtcccaccaacagtgtaaaagtgttcctatttctccacatcctctccagcacctgttgtttcctgactttttaatgatggccattctaactggtgtgagatggtatctcattgtggttttgatttgcatttctctgatggccagtgatgatgagcattttcctcatgtatcttttggctgcatagatgtcttcttttgagaagtgtctgttcatatcctttgcccacttttcgatggggttgtttgtttttttcttgtaaatttgtttgagttcattgtagattctggatattagccctttgtcagatgagtagattgcaaaaattttctcccattctgtaggttgcctcaatgaaataaaagaggatacaaacaaatggaagaacattccatgctcatgggtaggaagaatcagtatcatgaaaatggccatactgcccaaggtaatttacagattcaatgccatccccatcaagctaccaatgactttcttcacagaattggaaaaaactactttaaagttcatatggaaccaaaaaagagcccgcattgccaagtcaatcctaagccaaaagaacaaagctggaggcatcacactgcctgacttcaaactatactacaaggctacagtcaccaaaacagcatggtactggtaccaaaacagagatatagaccagtggaacagaacagagccctcagaaataatgccgcatatctacaaccatcagatctttgacaaacctgacaaaaacaagaaatggggaaaggattccctatttaatacatggtgctgggaaaactggctagccatgtgtagaaagctgaaactggatcccttccttacaccttatacaaaaattaattcaagatggattaaagacttaaatgttagacctgaaaccataaaaaccctagaagaaaacctaggcattaccattcaggacatagggatgggcaaggacttcatgtctaaaacaccaaaagcaatggcaacaaaagccaaaattgacaaatgggatctaattaaactaaagagcttctgcacagcaaaagaaacta

SEQ ID NO: 11711 - DNA, 293 bp, Homo sapiens
attctttttttttttttctttttttttgagacggagtctcgctatgttgcccagcctggagtgcagtggcgcgatcttgctcactgcaagctctgcctcccgggttcacgccattgtcctgcctcagccttccaagtagctgggactacaggcgtccgccaacacgcctggctaattttttgtatttttagtagagacgtagtttcaccgtgttaggatggtctcgatctcctgacctcgtgatccgcccgcctcggcctcccaaagtgctaggattacaggcgtgagccacc

SEQ ID NO: 11712 - DNA, 571 bp, Homo sapiens
gtaggtatgcttcctgtatttatttctaaagtagtttctctttccttgatgccttattgatgtgataaacagctttgggaataaatctgtctttattttggaaatggtttttagaagcctagttttggccttaattacttaggggatgtataacagcacaggctttggggtgagatggatttgtattcaaatgagacttgggtatataaacttgtacttaacttccttaagctctgatttccttaactgtagttaacatcttcagaattactatttaaatggtgcatgtgagtgatccaagaaatttattagccatgttctacctcaagaagtctttcacctggatgtgatttttttcagtgtgtcttttctgttacttctccctgcttacctcccattggctgcagctgggatttttttctcttccgccagtcctaggttgcgcctcccttcccttatttatctaaacgcttttttcctgctgattttaatacatttctttttctctcaacagtggcaacatgaagatctacttatcaatagaccacaagccatgtcagtcacacctccc

SEQ ID NO: 11713 - DNA, 771 bp, Homo sapiens
  misc_feature (21)..(21): n equals a,t,g, or c
  misc_feature (129)..(129): n equals a,t,g, or c
tttttttttttttttttttantgagacggagtcttgctctgtcgcccaggctggagtgcagtggcgcaatcgcggctcactgcaagctccgcctcctgggttcacgtcattctcctgcctcagcctctntgagtagctgggactacagtcgctccccaccacgcccggctaattttttgtatttttagtagagacggggtttcaccgtggtctcgatttcctgacctcgtgatctgcccgccttggcctcccaaagtgctgggattacaagcgtgagccaccgcgcccggccccatgtatttacttttattgagatctttgtttcttcatacagcttcaagtgactgtctagtgttcttttatttcaccctgtaggactcccttggacatttcttgcagggcaggtctaatggtaatgaactctctcagctttgtttttttttttttccgagacggagtcttgctctgtcgcccaagctggagtgcagtggcgcgatcttggctcactgcaagctccgcctcccgggttcatgccattctcctgcctcagcctcccgagtagctgggactacaggcgcccaccaccacgcccagctaatatttttttgtatttttacaaaatacaaaaagtagagacagggcttctacttgtaaaagtagagatggggtttcaccatgttggccaggatggtctcgagctcctgacctcgtgatccgccctcctcggcctcccaaagtgctgggattacaggtgtgagccaccatgcccag

SEQ ID NO: 11714 - DNA, 140 bp, Homo sapiens
tgccaccatgcccagctaattttttgtgtttttttagtagagacggggtttcaccatgttagccaggatggtctcgatctcctgacctcgtgatccacccacctcggcctcccaaagtgctgggattacaggcgtgagaa

SEQ ID NO: 11715 - DNA, 2029 bp, Homo sapiens
ttcaccatgttggccaggatggtctcaacctcctgacctcgtgatcctccctcctaggcctcccaaagtgctgggattacaggtgtgagccaccgcatctggctaccttacattttaaaataacccttatcactactgaaaatgatgtctttatatgtctatctccttatgttctgtttccttactctcctcccaggaacataaacttcatgagggcaaggactttgcctccttcacttttgtgtctctggtgcttagctccgtatttgaatatttgttggatgaatggataatgactattccaggactcgcttgatacagaactatcttctctagagaatggaaaggtaaacgtatcatttaccagccacttatcttaagtagagtcccagagtgtaggcttatgccatggagctcatgtgaatttccacttgggccatctgggattcttttctcaaaagagcctgatgccgggtgcacgggccggtcagctggcctggagggatataacccacatttacctttctcctcctggcagtattctagaatacctcactcactgcagcaagggagctttctctcctgggtcggtaggggatatggtttgaatgtagccctgaggagcgtctcaaatgacctttggcccagttgtcttgtgtcagtctcctggggagaaggatcatttactcaagtgaaaaacgaatcagtcaagcttgagagctgtagatacagcacagggagctgtgttttatggcctcaaagagtttaacccagattggaaaaaggtatttcactccagcagcaacagaggggagctgtaccttgcctctgactccagagaaacgggacatgtcacaggggtgaccaacagggcaccagccacagcagggagggtggaaacttgggcagcaagagtcacagttaatgcctggtgaggagtgaccattggagtgacgtggagctgcacggtaagcactggggacgtgccaaagaaggaggctgggtcagtcaggttttactgcaatgattctacttgaaaaacacactgaatttcagcgacttacaacatcaacaccacatttatgtatctcacctataggtgttcaggtcagctgtggtggttctgcttcaggctgtggatccagatcacgtctgccccacatggctctcacgctgggaccagcagcttctcttggcagctagcagaggtttgagaaggcagcccaaaccatgcaaactcattgaaaacctctgctcgggtgacatcctttaatatttcattggcaagacccagcgcagtggctcacacctgtaatcccagcactttggtgggccgaggagggcggatcacctgaggtcaggagttcaagaccagcctagacaacatggcgaaaactcatctgtactaaaaaatacaaaaattagctgggcttggtggtgggcgcctgtaatctcagctacttgggatgctgaggcaggagaattgcttgaacccaggagtcagaggttgcagtgagcccagatcattccactgtactctagcctgggtgacaaagtgagactttgtcaaaaaaaaaaaaaaaaaaaattccattggcaaacaaatcacatagtcaagactagcatcagtgggttatgaaaatgtgctctgtggactctagtgggggaccctgcaaagtctggggcaaaggctgtggatgctgaattctgttacagggagggagtgaaaaattgagagtagtaatccagtctcccatggggcccatcacggctgtttggaggcacacatgagttaccatggcgacatcttgaatgagaagggagaaactcaatggtaagggcaagaagcagaagattgttcctttgttcctattactttgatacatattccttgatttgcaccttccaggctaaaattttgagcctccttgatttttaccttcaagctaaatttgagcctttggaagctcaaattacaggaccatgaacatctctccctggcaggaagcaacaaggctgagaactcgag

SEQ ID NO: 11716 - DNA, 182 bp, Homo sapiens
tcagcctactgagtagctgggactacaggtgcccgccaccgcgcctggctaattttttgaatttttagtagagacggggtttcaccatgttagccaggatggtctcgatctcctgacctcgtgatccgcccgccttggcctcccaaagtgctgggattacaggcgtgagccaccatgcccag

SEQ ID NO: 11717 - DNA, 2031 bp, Homo sapiens
ttcaccatgttggccaggatggtctcaacctcctgacctcgtgatcctccctcctaggcctcccaaagtgctgggattacaggtgtgagccaccgcatctggctaccttacattttaaaataacccttatcactactgaaaatgatgtctttatatgtctatctccttattttctgtttccttactctcctcccaggaacataaacttcatgagggcaaggactttgcctccttcacttttgtgtctctggtgcttagctccgtatttgaatatttgttggatgaatggataatgactattccaggactcgcttgatacagaactatcttctctagagaatggaaaggtaaacgtatcatttaccagccacttatcttaagtagagtcccagagtgtaggcttatgccatggagctcatgtgaatttccacttgggccatctgggattcttttctcaaaagagcctgatgcctggtgcaggggccggtcagctggcctggagggatataacccacatttacctttctcctcctggcagtattctagaatacctcactcactgcagcaagggagctttctctcctgggtcggtaggggatatggtttgaatgtagccctgaggagcgtctcaaatgatctttggcccagttgtcttgtgtcagtctcctggggagaaggatcatttactgaagtgaaaaacgaatcagtcaagcttgagagctgtagataacagcacagggagctgtgttttatggcctcaaagagtttaacccagattggaaaaaggtatttcactccagcagcaacagaggggagctgtaccttgcctctgactccagagaaacgggacatgtcacaggggtgaccaacagggcaccagccacagcagggagggtggaaacttgggcagcaagagtcacagttaatgcctggtgaggagtgaccattggagtgacgtggagctgcacggtaagcactggggacgtgccaaagaaggaggctgggtcagtcaggttttactgcaatgattctacttgaaaaacacactgaatttcagcgacttacaacatcaacaccacatttatgtatctcacctataggtgttcaggtcagctgtggtggttctgcttcaggctgtggatccagatcacgtctgccccacacggctctcacgctgggaccagcagcttctcttggcagctagcagaggtttgagaaggcagcccagaccatgcaaactcattgaaaacctctgctcgggtgacatcctttaatatttcattggcaagacccagcgcagtggctcacacctgtaatcccagcactttggtgggccgaggagggcggatcacctgaggtcaggagttcaagaccagcctagacaacatggcgaaaactcatctgtactaaaaaatacaaaaattagctgggcttggtggtgggcgcctgtaatctcagctacttgggatgctgaggcaggagaattgcttgaacccaggagtcagaggttgcagtgagccgagatcattccactgtactctagcctgggtgacaaagtgagactttgccaaaaaaaaaaaaaaaaaaaaaattccattggcaaacaaatcacatagtcaagactagcatcagtgggttatgaaaatgtgctctgtggactccagtggggaccctgcaaagtctggggcaaaggctgtggatgctgaattctgttacagggagggagtgaaaaattgagagtagtaatccagtctcccacggggcccatcacggctgtttggaggcacacatgagttaccatggcgacatcttgaatgagaagggagaaactcaatggtaagggcaagaagcagaagattgttcctttgttcctattactttgatacatattccttgatttgcaccttccaggctaaaattttgagcctccttgatttttaccttcaggctaaatttgagcctttggaagctcaaattacaggaccatgaacatctctccctggcaggaagcaacaaggctgagaactcgag

SEQ ID NO: 11718 - DNA, 320 bp, Homo sapiens
gacttcgttttcttttcttttcttttcttttttcttttttttttttgagacggagtcttgctctgttgcccaggctggagtgcagtggtgcaatctcggctcactgcaagctctgcctcccgggttcacgccattctcctgtctcagcctcctgagtagctgggactacaggtgcccgccaccacgcccggctaatttttttgtatttttagtagagacggggtttcaccgtgttagccaggatggtctcaatctcctgacctcgtgatccgcccgcctcggcctcccaaagtgctgggattacaggcgtgagccaccat

SEQ ID NO: 11719 - DNA, 278 bp, Homo sapiens
tcttttttttttttttttgagacggagtctcgctgtgttgcccaggctagagtgcagtggcgcgatctcggctcactacaagctccacctcccaggttcacaccattctcctgcctcaacctcccgagttgctgggactacaggcgcccgccactacgcccggctaattttttgtatttttagtagagacagggtttctccatgttagccaggatggtctcaatctcctgacctcgtgatccacccgcctaggcctcccaaagtgctgggattacagg

SEQ ID NO: 11720 - DNA, 111 bp, Homo sapiens
ggagaatcacttgaacctcggaggcagaggttgcagtgagctgagattgtgccactgcgctccagcctgggtgacagagtgagagtctgtctaaaaaaaaaaaaaaaaaaa

SEQ ID NO: 11721 - DNA, 2664 bp, Homo sapiens
gaataggcatagcggtttagataggaaattttaaaaatgacaaattaaagaatcctggaaaatacactgtacattctgccaaggtttatcaatatggatgctggtatagtaatgagaataaatcggtaaattcttttcataaaatgaaggaaagaaattactatgtgctctttaaaatgtgttgcatcagtgcctgatttgattgtaagggtcacatcttcaagacatgtgataccaccctttataccacattatagcattgtctaatgttgtaaagtttataaattgctttcactcagtcttcatctgattctcagaatgaccctatccaattgggaatatgggtttcattagtcttacattactaaggagattcagagagtctcaattggccaacatcatgcagttaaaaatgacaaatggggattttgaacccaagtcttcctgaccccagaacccgtgatctttgtactacatcatgcttcctgagaaattaaatggacctgtcttgcagaactgttcttcttctaactagggatctggaggagtctcaagtaaataggcagatggccttagggagggatgtctggaagcacctgtttggagtcccagcaggttggtggttttctgtctgtaggtctggcagctgggcatggtaacttagccatggaaaggggctgcaagaggaggtcctcagtgctcagacccagggcagaggactgtgtggctcctgtttgtttctccagatctactctctacacgccttcaccctgctctctgtttgggatggaatcaaaggacccctttgccccctggcttatggttgccttttgccaatggaagcagtgacagaggatcagattagaggtagaaggggagtgaggaaggagagtgaagagggataaattctccttctgcctctgatcctctgtcgctgcttccactgccacctactgcttccattggcaaaaggaaggatgccgtgaggttgccatgagcatgctgcagccttccagtctcctataagacagcttccccatggggtccttttcctattcctcctcttgccccttctgacctagccccaggtacagtactgtattacttaccttctcttataccttttccatacctttgtcgatggtctccttgttggactcctcacattacccagtttgagtgtgctttctatttcctgatgggctcctggctgatcagacctgaccccagaggacctgggtaccagaatctaatgcctggattaaggcacatgagcaagacgcagaccctgcaaatggaattgaaattacaatgacctagaacaagggagatagggccaagcatgccctagtgaacgagggacccaaatggggtaggactgggaagaaatctgacttgagactgatgggctaggactctgctagaagggcccttctggtcttccaggagacaagactattcacagacgctgcaaattggtggtgcaaggaaggcagcaggagctcaatagggtacagagtctaaggagagctggaggcatgaaccaagcagagtggctgggtgtttgaatccttgcttctagtggcagagactgaccggctattcatcgaacccatttttatttcctcctgggcacatggactatggtcctcgtgttcttgagttctagccaatggaatgtgggcagaagggatgtgctagcccttaaaccttccttactctctcccacctcttgccagctgtaaggaagagtcacagtaacatctattatttacttattcattctttcattcatttatttcattcactccctgaaacaagagccaagggtacagcctctctaggaggtgactctcatgcccttttattatgctggcttgatactaatggagatgcggttgaccattgcaaaaacccctgttgagacacagcagagttggccagcattcttatggtacttcggatgtggatcctgtgatggctacagcataaaacactgcattagcctccatcttctatcctttttcccttcaaaaatgatgatcatttcattgagtgcccaccctgcaccaggtgcttctgatactttatgaaatatgatgttttaaatatgaaaatgggggcttacataatgctgtgactaatttgagccttgctcagcagttaggcagcttcaatcttcttattaatatacagggagtggttgctgataataggcacattttcaagcccaaaggcatcttgacagtgcatgctgaggattggggaaaataggaaccctccaaggaatactctgatatctttgcatctgtatacacatatgagttgtcttagtgtttttaccatagaagatccttaaaagttgacacaggcaggctctgggtatgtgcatcgagagatatttcccagagtctgtttttttgacatcctttcaccatcattttatctcttagcaggaatcagttgcccaacaactcctgtgatcatctgcaaacctctttacagttttcagtgtctcaaggtaatacataaagaaggaagaaacaaaagagtatgagtatcactattcatggatactaattaccaaatgtacttttttgaattaaatccttgtttgaatggaggttgcacagagatgaatgttttgttagcagacttctcgag

SEQ ID NO: 11722 - DNA, 14821 bp, Homo sapiens
tggctttgggtattttttttgtcttcttttctttttttaagatcaatattcattcttcatttgccctcgtaacgaaaatagatttttaaatgcctcaaatatacaaacatcattgatgcacacacattccagaaatgcagaggtatgctgctgccacggggtaggggtgcgggaggcggcctggcctcatggccacagaccgtgccccagcccgggcctggcaggtagctggccactgataaatgccactgggatcctaggagaagctggggaccatgcgtgaggtactgaaggggaccatggtggatggcatcctgggcactttgtagcttgtctgagggaaaggcctctgctgccatagaaaagctggacacatgtcaccctggggccctgacatcctaaaatgccccactgactaccagtcactaggagaaaggtctccggctatgcccttcccagtgatgcttgccccagagtgactggtcacaggtgggggacaggtttgctccagaaaccgtaggcctttcttgtctggccccctaaagaggacccaagatcaggaaaactccccagtttaaaaaaatatctgtccatctgtatataaaatacctattattagctggagttgcacacatgcaggaccaggagagactgcctgaggttctgcctggaccgaaggaggcctcgctcacagcacctctgtgaggggactggtgctcctgggaagtcacttctcttggtgaccaagctgacaccccctccacttggaaagcacagggactgagcaggcgggacctgtgctggagggagaccctcctggtgaggaactatgcgggccttctgggcctcagcagctccagcccactcctggcctggcaggccacctgcccacccacccacccatctgcctctgggcccccagtgaagtcagaagaggcaggagccccgcaggctgtgagcctggcgcaggtcggctgacagcgagcttctcatctgcctggtggtagagcggacgctctcggcagcctgcacggcccggctcagggccttgttgagctcctctaggtcgcccaggtcgagctggatggagtgccggtgtctccgggctggtgggggagaggctgtgggcggccacttggcagctggttgggctgaggtaggtcctgcaggcgcatagtacctgaggagagaagtgagtgggctcgttacacatggggagggctggggacaagccgaggagcaccgtgtgtggggtcaacccccttctaaatcccagctgggccagtggctcctactctctgggtctcagtttctttacctctaaaatgggaataatgggcacacatccagggatttcttagaaagatgaaggaagataacaacatgagtgcctgacccagaacaggtgttcaaggacaggaagttcaatctacctgttcatctgatttactgcccatctagtacatgccagccagcgtgccaggctctggggttacagtgggacaagaaaacatggactcctgcaatcttcttggagccggatcttgggaaggccaggatcaccctaggcttgatagcaaaaccccctcatggaagaatatctgggggttccatttgccaagcaaggggtgctggagaaaggcaataattaataattaataatagtaataataataataatagggattctgcaggagtgggagggtctggccccatgtcctgggaagtgggtagaagagcatccttcctagcccagtcctataggaatgtgaggtgttgttttaaagtgctgtgggaatgggctgacaagcccattgagatgaagcacggatttccctaagaggtgacaatggcatccatcagggccactaagtttagggttcaaggaaaccagcagtgggcaagagggggtgtggcctcagcactgttaaataaagggtgtgtgtggtggaggagggagataaagaagcatggacctaaatcaggaataagtttaggaggacgcagcagagtcattcattggcatcttgcttggcacactgtaaactctggctttattcctgagcccctgctgtctaacttgcattgttatacagtgtgtagaaacagatgatccaaacagacatttctccaaaggagctattcaaatggacaatacgtacatgaaaagatgcatatccttagccatcaggaaatgcaaagtgaaaccactgcacaccctctaacatcaaaaaggacagatagcaacaagtgttgacaagaatgtggagaaactggaatcctcagcactgctggtgggaatgtaaatggtggagccactgtggaaaacagtctgacagttcctccaacagttaaacccagtgcctagcccagggctggcatcctcatctttggtacccatgtaccagttggtgcctttatctttattttacagatgagcaaagcggagctcagagaagctaagtgattcaggaggcagtagaatgcaccagccttagcagctcaggccctggagccctgccccaaatcccagtcattctgctgggctactcatgggactctggacaagctaagtcactttgcaaggcctctgttttcccacctaaaacgaccacagttagcaacctctcagcttagagctgatggaaaattcaggtaaaaagctggcactgcctggctccggtaagtgctccataaacgtgagctcctaagacccagagtcagacagctggaaggggcagccatgggttcacacctgggcccgactctccccacatatctaatgtgtgctaattggcaagcagcagatgctgataaaataatctgaactgtatgaacgggcttcttgcatccccaaaacagcagcctgcactccctcctctagggaccgtctggtgtaagtaactacagaggctcctcaaattacgatggggttatgcccctataaacccgctgtaaagtcgaaaaatcataaatcgaaccattgtaaaagtagggactgtctgggctgggttttcatacacccccaccttctgttaatttgatgaccaacttggcctgaaagttacccaaaactctccctagggccaacactgaaaaagtccctctgggctggaaagtctcggctgcaggggctatgggacggctgcccagcagggggcagcacaggcccactccgctttccaaactacactggtctcaaccactgggcccgttcagtcctgctgaccagcagctggagaaatttcagggtgtcaccagcgcaaattctagcagcattagaagcaccatcattattggcaacttctatgtactatgggctttccatgcattaattcattcaatcctcagcacaacccatttcgcagagaaggaaactgaggcataggtataacccgcccatcctgagttggaaacagcaacctggtgagttctgcccacaggcctgagcctggaagaatgtgaaatggggcctcaggagaagtaaagactccatggctaccgtggggtcaccaaattctgggcaaaacctttcccgatcaatgagttggaacactggcaggcgctttcccccgtgtctgctggaggtctgagcatgcagcattggttctcatctctgctggagtggaagattccttaacgacttgcttagactcagctgagagggcagcaagaaagcaaatttacataccgggcgcggtggctacaccttgtaatgccagtgctttgggaggccaatgcgggcagatcacctgaggccaggaggtcaagaccagcctggccaacatggcgaaacccatctctaccaaaaataccaaaaaaattagccgggtgtggtggcacgctattgtattcccagctacttgagaggaggaggcatgagaatagcttgaatcttggagatgggggttgcagtgagccaagatggcgccactgcactccagcctgggcgacaaagccagaccctgtctcagaaaacacatatacataaaaaatttttaaaagcacatttataggcctggtccccgaatagaggaccagggctggatggcgccttgggtccctgctccaccaagcaccagccctcacagtgacgcaggccctcactgcctacacacccaggcttctggcaacacagccactgaagacatccagtcccaatcgactcatttcacagcaggggaagcaggcagagaagtagctgctgacagctgagacaagaagacaggtttcctacttctggggactgggcttttgtccctgcacaatcctatcatgttgaacccacttttactccttcttcttcctactagtgacaacactgagcaatagcaacattctctgtgatggcgaagctactgtttgctcagcaatgagcacgtgaccaaatggcaccacaaactccacacacttctcatttggttcctgccacgtgccacacttaatcctcacgcacaggattaagtacgtggttgagactcttcctccatttaacagatggggaagtggaggctctgagaggaagttagtttgccaaggccacagtgctactagggggcagatgggactccacggtagctctggccaactccaaacccaagccacttctgtctcggctgccctgcctctcctggcttgactgatgttacgtccagaatctgtgcaaaaagtcctacaatattcccgaccaggactccccagagatgtccaggtcatcaaaaacaaggaaggtctgaggatctgtcacagccgagggggcgtaaggaggcatggcaatcgcataccacatgggatcgtggatgggatcctggaacagagacaggactttggaggaaaacggcctgaaggaactacgaacttcggttaccaataatgtatggatattgcttcactaacgtggccaatgtgccacattattgtaagatattaataataggggaaactgtttgtgcaggagtgaggaggattgtgggaatctctctggactatctgctcaatttccctataaatctaaaactgtcctaaaaaataaagtctattaaaaaaaacccagtgctcatcacttacttgcggagaaaacccataaggaaaatggaagatggttaggattctcagtctccacaaagttataagctccaagagggcagggccctcttgctagtccccttcactgctgggtcccagggccgagcactctccttggtacatgggtttgttgagtgcctatatgagtgttggctttgttgagtgactatatgagtgttgggctcctactgcatgttatccacgcagggataaaacacaggaggagtatactgcatctcagctgccccacccaggtctgaatgctaacatattcagtgatctatagaaagaggctgggaaggtcagaatgaaggctcttacacagcggcaggtggataaggcatgatgggaaccgaggagatgtaggcaaaggctggaggggctggtgctgggggcgctgttgccagacaccacagtccggggggtgggcgtggcgacgaccccgcctgcttgctcctctgcttggggctgggagttgaaggtgcttttctcctcgtggtggccttctctgcccctatcagggagggaacagcacagagagacagagtctgaccacttggcagatccagccaaagatggagggtccacccagcccttcccctatgagagctggacaggccctaccctgtgagactccatgttggggaggtctctctttggggaacaaatcctctgccccagttgctctgtcccagactggaacaacagctgctccagttaaactcacccaggtctaataaccctggtcaaggagagctgagggtctggctaagagaagaaacagtatttgtccctaccagaggtggctgagcctggaccatctgcctctgggggagacccaacttgaccacacaggggacactgaagggtatcagcgggaggcggtcccagtgggtcccctgtgacagcaccacctagaagaggaggaagagatgtcaggggaggattacatctaaatcatcagatcaggagcccccatgcaggccttctgcagcactgagctctcctcgggacccactgcggaggggacaagctgcctccatctgggtgatgacattgacaacaaccatgacagtgagagcaagcatttagtgagccaggccctctgctaagggccttcctgcattattttatcaaatccaacaagccactgggctagccactgtcctcactcccccactttacagatggggaaattaagggtccaagacgtcaagtaatttgccaagggtctcagagctgggaagcagtggtccttggatcctaagcccgggctctcccaaatgcagcccaaccccccgccccaaccacagtgagacagagccattctccatgtgggagtggcccagaacagtcccctggggaaccaggggggtcagtagaggcaaaagggaacaggaggagagtgggtgccattgttctcttcccacatacatccccaatgccacacctgggtgagttccagggctggtctgtttctctttcaggccttggctcaaccaccactccctctgggaagccctcccacccaccccggcagagtcaggcaccccccagccccactcgtgctcccctaccccagctttggccactctgctttgttgtgtgttccttggggacggggcccagggccccataggggtaagtgatgaatgaatgaatgaatgaatgaatgaatgcatgcaggcatgaacggagaggcctgtcaggactctaacactagcacaggaagagcatagtggtgaaaaggtgggactctggagtcacaaagacctgggttcaaatcctgcttctaccacttgtaagctgtgtgcccttgggcaagttacttaatctctctgagccttggtgtccttgtctataaaatggacgtaatagtactgcagtacttagttcatagaactgtgaggattaatttatgcaaaacccttaacatgacaccctctacagagagggacttaataaatggcagctcattatcatcagtcattatcatcactattgcttgaaaagtcctagagaccatctcttccaatcctttcattatagatgtggtgactgaggtacagagaagtcaaggaactggcctaaggtcacacagcaagtcagtggcagaactgggactagaacccattgcctggattatcgggccactgctctctctgccactcctgtggacttgggggaaagtatgaggggtgaagggaggatggaggggagaataagacataatcactgatgccaggtcccctgctgcctggaggccacctatcaggacccttcaggaacttcttaaatcaaggagggtggcttcaggcagcagcacctgaagcaacagatgtgacggcaggacacccagaaaaatcctcttccctggtctgtccctataacccactgctaagttcagggcaggccagatcttgtcaagtacacactcccctgagggcaagaagctgcagccacagctgcctgggccagttttccaggtgccattccttacccgcatcctgggtcctaatgggccggcagtggggacaggagactgtgccattgccttttgggaccgccttaggggacagaacatggtattcgtggcctggggaaagaaaccagaactgtcagtatcagccctgtggatggatgcaaaatagaggaagattctggaataatgatctcctcttcctccaaatggttttaatagtctctgtctctctctcacgtgtgcacacagtgagtgtgcatacacacatcatgtgtaaaatatgtacatatttaagtatgacacacatacacacatatacgtcaccgaacatctttgtgtctgtttattgtaagctttctccagactcctattctgtttcatctcagatcctagaaccagctgacatccagtagcaaccaacacacccaggctaagtcaggatttgaaagcaggccaggaagaaatgataagcaaagcaacaataagaaatgaacaagtgatgctattccccacaccccgacttgctggtttggttctgaatggctcgggcacggggtcagtggtgttttctccccatgctctgagcggctgtaacatggggataaacatagcgcccatttcacaggcttgttgggagaactgaacggggccgtatccgtgtcgtgctccgcccagtgcctggcagatggaaagcagttgatgttatgagaaagctgggcggactgtggcctcctcacccagccccaccacctcctgccttacccacccctgagtttcaaataaggccttctgggtgacacctgaagccactgtggagcggtctcatcatctcatttccctcctgtgctgttctggctttgtgtatgtggagctgaacgtaattgctcttattttcccgacgcgacagatgaggaatctgagggtcagagaggctcagagccattttctgtgagactgacttcagagtctttggttttgacttctatactctcttcctctcattgtgttggaagcatttctccaggttaagctcacttttaagggttaagatcacctttaaaggctacagaaaacctcatccaatgatatcatctctttccttttgctagtaagtccacagagagattgtccggtgagcttggaggtgttcctgctactgtcgtttctaactccttggcctctgtccactccctcgttatggtccatggagcagaatgtgcctctggcctcttgccttgtccccagaatctgaggtcagcagccctccctcttctgcaaggtgtctgtgagagatgatgcctttactataattacctattggttatcatcttctctgctacagtcagattcatgaaggtgagaaccatatccatatatatatatatatatttatgtatttttgagacggagtctcactgtcacccaggctggagtgcaatggcatgatcttggctcactgcaacctctgcctcctgggttcaagagattcttgtgcctcagcctcccaaatagctgggattacaggcacccaccaccacacccagctaattttttttgcatgtttagtagaaacggggttttgtcacattggccaggctggtcttgaactactgatctcaggtgattctcccacctcggcctcccaaagtgctgggattagaggtgtgagccaccacacccaacccatatttttgtgttaatgttataagcacttgaaatgctaccatgtgtcatctcaagtctttactctgtgccaggtcctgtttcctgagacacaggggccctctggaaatgagaacctgaaggaagccaggtgcaaatgggacatccaattcagtgtccaccctgtatgctccgagccggaaaagcacaggtgatcagaacttctttaggattgaccagctgaacagacttcccagaaccaagcatgggccctggcaaaggggaagcatcagaaagtgtttgctgaatgaatgaatgaatgaatgaatgaatgaacaagtgcaccgagattcatggaggcaatgctccctgctggttttcatatcacagaactgatagaaaatgatatttgaatggcccactgggtatatggaaagggcttctcataacagaggagcccccgctgacaccaggagctgcacccatcccggccctccctcctgacctacctgtgtattggccccggaaggtgaccctgtctggccatccagcactgcccacccctctctttccatcccgagctgcctgtggactgtccttggtggtcttgctcttctcagagaacagtggtagggagggcagctcagattctgaacctggggtagaaaaagtggggcatcagagggggcaaggggtgggggtcacatttctcaaggagtgggtatgccatgagtttaggctctggggtggatgcctgggttttaatccccagtctcccccttaggagtaacagctggcatttccagaaccctgcccccgtgccaagcgctagtctagatgctgtgtgtgtgccgtgttgggcaccttcacagcaatcccacgatgtggacactgttataactacatggtgagctgtccctttaactgctcagagcaggtaaacaactcggccaaggacaagtggaggggagctcgctgatcccggctactgactccagagccctgatcctttagcacatcccctgcgctcactgggcttcagcgcccttatctgtgaaatgtggataatatgaccatcttgcagtggaggttaagcaagacagcagctacaaagcccttacagacaccctacacgcagtaggtgtgcaggactttagaagtgctctgtgcttcacagcactataatatcctaaaacagatgcacaaaaacccttctccaagtttccttgaatactgttgctgtggtccctgaccactgagccaacatgctcagactgtggcctctggaaatcagcctttgcaggtggtcacttactcagggacagtcggagcacctctcgaggcactgaggaagacctggctcgctgccttcctggagggacaatctgctcttcacctctaggctcaccaggcaatctctctgtggatttactagcaaaaggaaagagagatgatgtcattggatgaggttttgtgtggcctttaaaggttatttgtgagaagttcaacctggagaaatgcttctaacacgatggaaggaagagagtatagaagtcaaagccagactctgaagtcagtttcacagaaaatggctctgcgcctctctgatcctcagtttcctcatctgtcaagtggggatactaacagcaattacctcagagggttataaaaagattaatgagaaaatgttcataaaacccttcatcaagtgccctcccatagactcaaaagaagccagctgattttatgtcattgtcataaatgaataaacaccgaattaatgggtgagagtgaaggcatcctggcaatgttctaactctttggttgggtggtgggtctagggatattcattgtattattctttattattattattattattttgagacagagcctctctctgttgcccaggctggagtgcagtggcacaatctcagctcactgcaacctccgcctcctgggttcaagcaattctcctgcctcagcctcctgagtagctgggattacaggcgcacaccaccacgcccagctaatttttgtgtttttagtagagacagggtttcaccatgttggtcaggctggtttcgaactcctgaactcgtcatctgcccacctcggcctcccaaagtgctggattacaggcatgagccactgcgcccggcctattctttattattaacatagaggtttatatattcttttgtgcatcaaatactgcacagtgaacaagctcaacagtgaatgaatgaatgagtgagagagggatgtggcagtgcctgagtccatatgtctggggagagccagaggccagccaagactatcttctgtagctgccaccaggacagaggtgggagttttgaggtcacccacctgccataatgggagccccaggtggctggggagtctgctggccggccgcgggtccgggcggggcggtcaaaggcagatgctgggcgtgtcgggctgccctggagtggccggtgcaggctgtcttccagccgcagacgaagccgggacacctcttcttgcagctcacagatggcctggctggggttggagtggagacagaaacaaagaacagaggcatgaggaacagagctgcagccacccgagtatgccaggatgcggcagcctttgtcccttcacagcaggcacagggtctatctctgctgtcaaacgattctagaactttcctgtgcgacacttttcttgctacacaacttgacacctttctgagttcatgtccctgtgcagtgaacaaaacagaacttttctttgaagttttctcttcctaacacatggggtctgagtggctgttcaggaacaccagtgacaaattctcgagatggagacaaggatgcagcatagagagggccctagctacagttctgccataaaataccaaccttcactctctgtccaggcccagctcctctccctaccactgtgcaagcccatctctccagacctggcagaagatgcttgtccaccatctccccacacagacagtgagccgccagcagacaagaaagaagcgggcttcctgtcttataacccctgaggccctgcaccttgtggatgctcaggaaacagtactgcagtggatctgggctctgagacggagcagaataaagcgctgtgagtggagagcggacagggagacacctcgatgcttcctagcaccacctgaaccgggagggctgactaagagcaggctggaagctgtctgcaagactatagtaaatcctggtgaaacccccaacatggtccaacctccagccaccagcactgagggagtaaatcctgtctgtgtttctctccaatcagtccctgcatcttcagggtcttgttttgtgggcattgctgacaccgcagcagacaatcctacccagatacccctccccacaagaccccctcaaccacggagcagcgttagagccaggctcagcaaagccaccctccaggcggatgcaggctccacatctacttggtctggcttctggggtgggaattcccactggggccgttcttgcctggtggcccctggactcctgggtgagtatcccctggtgccgcctccagcagacatgagcgctcagatgactgtgtcagaaggagtggaggcctcttcctggctgtgccccagcgctgagtgtgtgtgtctgagggcagtgggttcccttggtaatccccagggagacgcttgctggtgtttctgaggcaaagccacgagggcaagtgtgggcggtggctactggagagtgacatctccccacccccagttaactcctgaaatggagagctccgcctcctagtcagaaggcactaaaaaaaaagacttaccaggccgggggcgtgagtcagccacttgggtatctcagtctctctgatgtaactctttagtttcttactgagtgccagcaggcacttaacattcatctttctctgcaaacttactcccctgtctctgcacatggcagcagcatctacctgactagccagacagaactctgagtcactctagatcccctccttccctgaacatccctgaagttaattagttaccaagtctcgtgggcccaacttccaaaatacctcttcccaaatgaatcccttcttcccctctgtaggggccctccccgagaacccagtccccatcatctctctcctggatgtggcagccttctcagcagtctcttggtctccgttctcaccctgccggtggccagagaactctaaaacataaacctgcctacgctacgtccctgcttaaaatccccttccctgtcctctcagcctttgtgcactcatggaatatgcagtgaatgtctccccttacccatggccttcaggtcctgtaggatctcccataggtctctcctctctacccctctcttcctttactgctcaacactccaccccctcacactagaggatctggctgaccgtttagctcctccaaggtgatgggcactctctcacctttaggactttgcacatgccattccctccactgaagatactcttctatctctcttccttctgatgtctgctgagataccacttcctccaggaagccctccctgaagcctctaaccggaccagatgctccttcgctgtgctcccacagtcctttagtcctctgccatcatggtatttatcacaatggagggcactactgcctgtttctttgtctgttcatcctacaagatggtaagctttaagaggcctaggatagagtcttgtccactattgtattcccaaggcctggcataccctagacaaacaagcctctaattcctccactgatgtcaggggaggctgcaggggtagacttactaaactcagacaaggaagccaaacaccagcagctggacacaactttgcacgtaggcaacatgacagcctcatgcctgttcgagccaaagaaaccttggctgggccaccaccgagcagtctccccagcgcatcccgggacagacacccactccagcaagggcgtgtaagtgatcactggccaaaagcaactaagaggaggtgtgagagaactgaccaagcgattttaccatttctgttcaaccaaggaagtggaactttcttagtagaaaaaatgcacacgaaccaaaaaaagaaaagaaaaactcagaaggcagtagcttcttggtccatacaatcaatgggcaaattgcagaaaagatagccctagaaaggacaggcttttctcggaaaagagatgatggagagagaggggagaagtgtcagcaccagaaaggtgaatctttaggtcatattccactggctggagaagtgtgtcctcgatgtctagatcaatgaggtcccacagaaacgctgggaactgggaggcaggacacctgggtccgtctgctcctaccaccaccatctgtgtgagctgggcaggtctccacctccacctgctaacacgtcgcatcacgctcccgtctgtatgatgagcttgaatccccaggatccaagtgtctaacttactctcgccctgccctggtgagcaggaagctggggatggtctctgttggtccacagggtagaggcgcagcggcaggggcgggggctggg

SEQ ID NO: 11723 - DNA, 114 bp, Homo sapiens
gggagtgcaagatcagcccgaccaacatggagaaaccctgtctctactaaaaatacaaaattagccagacgtggtggtgcatgcctgtaatcccagctactcgggaggctgagg

SEQ ID NO: 11724 - DNA, 2981 bp, Homo sapiens
ctggtggcatggacattcaaggtaaagctctctatattagatttcttctcaccctttgtcagatggtagtaagtgttatggggaaacgaaggcaggggaggagggggctgggtggagcagctgctgtggggagagagatctgcaggaggtggggatgctgtgtgacttgagagagtagcttgccctctctgggctcctgcctgtgtgtgctgggggaacgatggcgcccactgcccctggtgctgtctttgccacatcattccttggggacttctgcccaccagctgctcagaccgtagctgtgctggctatgctcttcctgtgcaggtattgactctgagtcctcatacagcctgttatgatgcgcattttacagatcagtagactgagacctgggcaggccctctgactacagactgagctcattactgcacacagcgtgctgccagtacatgctgggctctggggtgctggagccgcaggtcctggccccatcaatacaatccaaagtgagctggctctgatgaggaagaggccaagatgccccactcagggaagtcttcctgggagaggtggtagccaggcagacctgggagtaggaggaggtagggctgggctttgtagacaccacacttggtgggacagaggcctgctagggagagggcctgtgtccttgccaccagcccatcttccacgccatgtccccctgcactctttgaagggagatggtctcttttggggctaagctggggtcctggagccagaagagaactgagatttgctgtggggggttgggagctgttccatttttagtggctgctacaggaagagcggccgagtgtttccccttgtccctgcagaaggctggagtgtaactgtccttgggaactgggtcagctgatagcagggctgggggtgggggtggggatcctgaatcctccagcagatgtcctcattgccctgatctgggtggccagtgcctgtgctggacacggtcctcagtcatcggagcccactgagtctccccctgaccctgcagagaatttcaaagaggcgaagttccttccagtggcctcacaaaggctatctggcttaggagccattacctgaagccagaatttctgagttccaagtcccagctccatcacggaacttggcccaaggcccttaacccctctgggcctcagttttgtcatctttgaaatggggatcttagagatgcctacctgtcaagggacttgtgaggcgcaacgggaccacacgcagggcctggccagagtgccgtagtttcttcggttgccatgatgggacggtgaaactcctcacactcttctttctgccttgaagattctagacctggctgggtgttcatctccctttttgcctttgcttgaggcagtttatggcatggctgtgttattcacgtcgccaggtctcctcctggtggacgttgaggccattttcatttttttactcttaaaaacgacagggcagtgcacatcttcgcatctccggggtgggtcaggtctctgacctctttgccagtgtgacttattacccctttctttctttgtttttctttttgagacagtgtcttgctctgtcgccaggctggaatgcagtggtgtgatcatagatcatagctcactgcaacctccagctcctggctcaaatgatcctcccacttcagccgatattaatccattttcatgctgctgataaagacgtatttgagaccgggcaatttacaaaagaaagaggtttaatggagttacagttccacacagctgggctggggaagccccacaatcatggcagaaggcaaggaggagcaagtcacatcttatacggatggcagctggcaaagagagtgagagagcttctgcagggaaactcctgtttttaaaaccatcagatctcgtgagacttattctctatcacgagaatagcacgggaaagacccacccccatgattcattgatctcccactgggtccctgctacaacacaagggaattatgggagctacaagatgagatttgggtggggacacagagccagaccatatcagcctcccaagtagctggaactacaggtgtgcgccaacatgcctggctaattttttaaatttctgtagagacggggtctcactgtgtcacccaggccggtcttgaactcctgggctcaagtgatccaccctcctcggcgtcccacagtgctggataataggcgtgagccactgtgcccagccatttcccccttatttttagcatcactacagtagctgtgatctctgagctttggggatatcccctccccaacattttactctgaaaattcgaacatctggaaacgtcaaggctttgtacagtggacacctgtgtactcggcagccaccttccgtgatgaacatgccttatatttgctttgtcctcaatctgtgattcgggactggatttctcttgtttcctggtgggacccacactgcttgtcaattacttattttgttccccttcatcccagtcttgctgtgactttcagatacccccgggtcttatatacactcagggttatacccagaaaacatttctcctgggggatttgtctctaggtagggggccctcttgaatagtcagggggagaaagaaagactcaagaccagctctgaggaggcggcaggggtgccccttccctctacctgtgggctccttggggaagaaggacaagtgagtgccatgagaaatacccctggggattttgtggagctggaatgtgctggtggaccatgaatccacaaggacttgggcatcgaactcccttgactgggacccacagcaagggaggctctgcagcatcaccttaatcaaatggactcaccctctctgggtgatgtatcctggtgcttcctcttctgttcatcagtcaatcaacaaataaatggctgggcgtggaggcatatgcctgtaatcccagaaactttgg

SEQ ID NO: 11725 - DNA, 106 bp, Homo sapiens
atcccagcactttgggaggccgaggcgggtagatcacgaggtcaggagatcgcgatcatcctggctaacacggtgaaaccatgtctccactaaaaatacaaaaaaa

SEQ ID NO: 11726 - DNA, 4661 bp, Homo sapiens
gaagtccggcaggagattgaagcagagaccgacagggtcacggggaccaacaaaggcatctccccagtgcccatcaaccttcgagtctactcgccacacggtaggcagcacgggtggggacccatcactgaccgtttctggtcgttcatggacagtgctatgggtgagcctgtgtacttccactcatgggtatcatgtgcccattcacaaacagttgatattcacacacacatagccccttgatctgtatcttcccacttgtgctaggtatgtagtacccagacctctgtctcagcttgaagaaagagcatgccaagaagttgtttggagtggtgggggattgcagccatttcccccttttaccaagggcagccaccacttggctcaaggcagccagatctgctggtgcctcaagagaggccagaaccagtcttctgtaaaatatcctgggtttttttttttttttttttgagacagagtcttgctctgttgcccagtctggggttcagtggtgtgatctctgctcgctgcaacctccgcctcccaggttcaagcaattattgtgcctcagccgcccaagtagctgggattacaggcatgcaccactacacccagctaattttttttttttttttttgagatggagtctcgctctgtcgcccagactggagtacagtggtgtgatctcagctcactgcagtctccgcctcccaggttcaagctattctcctgcctcagcctcccaagtagctaggactagaggcaactgccaccacgcctggcaaattttttgtatttttagtagagatgggatttcaccatattggccaggcttgtctcaaactcccgaccttgtgatctgcccactttggcctcccaaaatgctgggattacagacgtgagccgccgcgcccggccaaattttttttttttttttgagacagagtctcgctctgttgcccaggctggagtgtagtggcgcaatctccactcaatgcaaccttcacctcccgggttcaagcaattctctggcctcagcctcccgagtagctgggattacaggtgtgtaccaccctgcctggctaattttttttttattttttattttttttatttttagtagagacggggtttcaccatgttgcacaggctggtctcgaactcctgagctcaggcaatccacccacctcagactcccaaagtgctaggattacaggcgtgagccaccacgcccagcccattcagctacttttttgtatttttagtagagatggggtttcaccatgttggccaggctggtctcgaactcctaacctcaggtgatcgcctgcatccccctcccaaagtgctgggattacaggttttagccaccttgcccagccaaatatcctgattttaaaactctgcattcaaacagcagcccggggccatagacatcctctggcccagaggcacagattgctaccatgatgggttccttgcgataagttttaaatttgtttttcaataaatgacacctgcatgtggctcagaattcaaaaattacagaaaggtatatcgcaaaaacctaccttgtcaaccagttttgcacacatattttaggttcttcagatgacaatgcaaacatgagctgggtgtggtttcacacacctgtcattcaagctgcctgaaaggctgagtcaggagggtcacttgggcccaggaagtcgaggttgcagtgagctatgatcacatctgtgaatagctactgcacttcacctgggtaacatagcaagaccctctatcttaaaaaaaatgtgtaagcaaaaaacatgtaagcaattgtgattgtatctatgtatatgttgtgtatgtgtttatcactccttttccttaaattgttagcataacataaaaatcacttatgctttttttgagatggagtttcactcttattgcccaggctggagtgcaatggtgcaatcttggcttaccgcaacctccacctcccgggttcaagtgattctcctgcctcagccccctgagtagctgggattacaggcatgcgccacctcacccggctaattttgtatttttagtagagacggggtttgtccgtgttggtcaggctggtctcgaactcccgacctcaggtgatcgcctgccttggcctcccaaagtgctggcattacaggtgtgagccactgcgttggcctatgctttttttttttttttgtatgcctctcagaatgtttctttattatatatttatttttttttttttttgagacagggtttaacactgttggccaagctggagtacagtggtgagatcttggctcacttcttctcctgggctcaggcgatcctcccgccttagtctcctgagtagttaggacaacagatgcacaccatcatgccaggctaattttttatatttttggtagaggtagggtttcgccatcttgcccaggctggtttcgaactcctgagctcaagtgatctacccatcatggcctcccaaagtgctgggatgacaggcatgagtcaccgcgcctggcctcatccatttgtcttttgtttttgtttttttgagacagtcttgctctgtcgcccaggctggagtgcagtggtatgatctcagctcactgcaacctccaccttctgggttcaagtgtttctcatgcctcagcctccagagtagctgggagtacaagtgtgtgctaccacgcccagctaatttttgtatacttagtacagatggggttttgccatgttggctaggctggtctagaactcctggcctcaagtgatccacccacctcggcctcccaaagtgctgggattgcagatgtgagccaccgcacccagcctcatctgtttgtctgtaatggttctttggtattggctgaatggatgggctgaaatttattcagtcatttaggtctattccagtctgaactgtcctgatttagaactgtgccattgaaatggagtaggtagaaggtatctgtaggatgggatcctagaaggggagttactggatcaaaggtgtggttcaggcagagtgtcaggcgacatcctcaagtctgagccccgcgcaggaactttggtagtcagctgggtggctgcgggcctgtttgtgcctcccctctcctggctctgaatgcctttccttctggtttccctcccagtgttgaacttgaccctcatcgacctcccgggtatcaccaaggtgcctgtgggcgaccagcctccagacatcgagtaccagatcaaggacatgatcctgcagttcatcagccgggagagcagcctcattctggctgtcacgcccgccaacatggacctggccaactccgacgccctcaagctggccaaggaagtcgatccccaaggtaaccctgagcctagggcagtcccctcttccaggtgcctctgagcatgggatgtgcccagcatccttggttccaagtcactggcgttctctttaatccatggccgctgtaggaaaaggcctcctggaacatggcacttcctccgagaaccagcagtgctggtgggcatcccctgggaagtcactgtgtggcagttggacggtcctccttggacatggcagtgcccatgttgccagagtgggaagctagcctagggctgaaggaagggcccagcgctccatcgcccagatgcgatcttaggtcccatctagctgttactctgctccctgagacatggtcccctcttagtcagaacgggaacttcagtcctaacccagatagctgatgtgaggactgttgaacttttgggttgtttctgatctttgcatggtgagatcgtctatttcccttcgagttgacacccctgggcccctctagtcagatccttctactgaaccctcactgcagaatgtgagcaggaaggggccccagggagggcacagctgtggcccccttgatgcccaaattggcacccaccagagatcttcactctggcttccatctgtccccagtgtctcatgcacatgccacacatataacacacacggttagcacagagccaggccctcagcccccgtgggagcagttgatctgcagaggtgagactttgctagaaagacatccttgactctggaatgacttgtggagaggtggaattggatgggatggtttccagagtggaattttagccattcaggcaagaggtagtcctggaaacagtcgtgtcaaactcaaatgttcccttgggactttgccggcacttggaaagtccagcatcaaaatctggcccaggaatcatgtttacgtgaggtttcccaaagcctgcagcagcagaggttgtccttaataacacaaatgacaataacggccagcatttgttgagtatttgccgtgtgccaggctcacccttatgaccaccctgtgagatcagggctgtgaccatcttcattcgacatgtcggaaactggggtccaggcctgtgacgttctggctttcccaggtgatgtgacctggaagtttcagggccaactggaccccaggtggcttgcagctgccagctgatgctctttcctggtggcagcctctgacctctgacctctgggctctttcaggcctacggaccatcggtgtcatcaccaagcttgacctgatggacgagggcaccgacgccagggacgtcttgga

SEQ ID NO: 11727 - DNA, 2010 bp, Homo sapiens
gttgagctgtaccatggagcatcctcctgtgtcctgccaacccctgccattatagtcaccggagactcctttacctatccctatctgttagggttttcagatgtcctctcgctgggtttatatttgaaggtatagaatctgggaaagggtggggtgcaagctaaccaaatagggatgctagggttgggtggggaattgaggactcttctgtgcttttattgtagggctggggatcgaggatctgggccaaaaatatgacatttccaaccagggacaaaatggaggcttgggcttagtgatgggtaaatggaagactggttgagtgggatgataatgggagaacttactgatgctcttttgggaaaaggtgctttaaagactcgatttgggagcctactggggcaaggcgactggggaggtgtacgtgttagtcaagtggaggtcaggtgggttatcttctgcctccttcactggcttcatgtgaacttgcctgtgacagaatatcttgccctagatgtcctcttccctcttgccatcgtgcaaaagcattcgatcttatgaccgtgagttcttatttgtggatgctaataactggggtaatctcagggagtactggggccatggctctttcccttgcttctctttctgctcactgctttgctttcaggtgcttagctgctcctttttatttctttgcaggactgggaaagcatgggaggaggattttgataagtttcttgttctctgcgtggtgatggggtggtctgagggccaagttaataagcctacctttggttattaccctggaaaattgagggttgatggtagggttatgattgtggcctgtgtatttgcaatttttctttgtcagtgtggctttctgtcatcttcctttttctccagtgagggttctgccactgtctcaatcccttggttcctgcaaaaaacagctaaatgtgctctcagggccagtggtgatgttctgtgttgcagccccagctcttgaaagtgacctggcccagatgagctctgcctgcttgtcatctttaggtcctgctgcccctgctgcctcagccctcaggctcctaactgctcaagccagaaggagctacaaagccaaatcatttgtcatttttctctggcagattgttttaaaatctccctcccctcttttattttaattatgccacctgtgttaatcctatagcctgcttctttgctttgtggattactgatttcaagttctataacttggggaaagttaggttgagtgaatgggaggacagacactgaatgtgtgttttggaaaaatggactctctatcttcagattattcagcttctccacctatcacctctacaacttggccttcattggagaagttttagttggcttattcctggaacaagaccacctagaggcttttagccttgtcagcctgccctcttctgaggtttggaccttgttttaaattgtgtgcatggtgggcttgagactctcttgtaatggaggtaatgggactatcactgaggggttcagcctatccaggtaggctaccgttctagtcatacccatcacttaaattctgccacagtctgcacagacggttggtcctccaggcatattgtcctattaagccaaataggtggacatcatgggatggatgaggtcatcatgaaaacagatttactggatttatggacctagtatatactatgtaacagatggaaaactgaattttacaatctataggtacctttgaaaggtcataaagggtaaaagtctatagttttccagaaaataattcttaaaactgggttttatgtctagatttaaatcatgtatctgtctgtagtgcttcaaatgtggccaggtgtggtagctcacacctgtaattcccagcgctttgggaatttgaggcaagaggattgctagaggccaggattttgagaccagcttcggcaatacggtgagaccttgtctctaccaaaagaaaaaagaaaaaaaaaa

SEQ ID NO: 11728 - DNA, 2007 bp, Homo sapiens
gttgagctgtaccatggagcatcctcctgtgtcctgccaacccctgccattatagtcaccggagactcctttacctatccctatctgttagggttttcagatgtcctctcgctgggtttatatttgaaggtatagaatctgggaaagggtggggtgcaagctaaccaaatagggatgctagggttgggtggggaattgaggactcttctgtgcttttattgtagggctggggatcgaggatctgggcaaaaaatatgacatttccaaccagggacaaaatggaggcttgggcttagtgatgggtaaatggaagactggttgagtgggatgataatgggagaacttactgatgctcttttgggaaaaggtgctttaaagactcgatttgggagcctactggggcaaggcgactggggaggtgtacgtgttagtcaagtggaggtcaggtgggttatcttctgcctccttcactggcttcatgtgaacttgcctgtgacagaatatcttgccctagatgtcctcttccctcttgccatcgtgcaaaagcattcgatcttatgaccgtgagttcttatttgtggatgctaactggggtaatctcagggagtactggggccatggctctttcccttgcttctctttctgctcactgctttgctttcaggtgcttagctgctcctttttatttctttgcaggactgggaaagcatgggaggaggattttgataagtttcttgttctctgcgtggtgatggggtggtctgagggccaagttaataagcctacctttggttattaccctggaaaattgagggttgatggtagggttatgattgtggcctgtgtatttgcaatttttctttgtcagtgtggctttctgtcatcttcctttttctccagtgagggttctgccactgtctcaatcccttggttcctgcaaaaaacagctaaatgtgctctcagggccagtggtgatgttctgtgttgcagccccagctcttgaaagtgacctggcccagatgagctctgcctgcttgtcatctttaggtcctgctgcccctgctgcctcagccctcaggctcctaactgctcaagccagaaggagctacaaagccaaatcatttgtcatttttctctggcagattgttttaaaatctccctcccctcttttattttaattatgccacctgtgttaatcctatagcctgcttctttgctttgtggattactgatttcaagttctataacttggggaaagttaggttgagtgaatgggaggacagacactgaatgtgtgttttggaaaaatggactctctatcttcagattattcagcttctccacctatcacctctacaacttggccttcattggagaagttttagttggcttattcctggaacaagaccacctagaggcttttagccttgtcagcctgccctcttctgaggtttggaccttgttttaaattgtgtgcatggtgggcttgagactctcttgtaatggaggtaatgggactatcactgaggggttcagcctatccaggtaggctaccgttctagtcatacccatcacttaaattctgccacagtctgcacagacggttggtcctccaggcatattgtcctattaagccaaataggtggacatcatgggatggatgaggtcatcatgaaaacagatttactggatttatggacctagtatatactatgtaacagatggaaaactgaattttacaatctataggtacctttgaaaggtcataaagggtaaaagtctatagttttccagaaaataattcttaaaactgggttttatgtctagatttaaatcatgtatctgtctgtagtgcttcaaatgtggccaggtgtggtagctcacacctgtaattcccagcgctttgggaatttgaggcaagaggattgctagaggccaggattttgagaccagcttcggcaatacggtgagaccttgtctctaccaaaagaaaaaagaaaaaaaaaa

SEQ ID NO: 11729 - DNA, 2005 bp, Homo sapiens
gttgagctgtaccatggagcatcctcctgtgtcctgccaacccctgccattatagtcaccggagactcctttacctatccctatctgttagggttttcagatgtcctctcgctgggtttatatttgaaggtatagaatctgggaaagggtggggtgcaagctaaccaaatagggatgctagggttgggtggggaattgaggactcttctgtgcttttattgtagggctggggatcgaggatctgggcaaaaaatatgacatttccaaccagggacaaaatggaggcttgggcttagtgatgggtaaatggaagactggttgagtgggatgataatgggagaacttactgatgctcttttgggaaaaggtgctttaaagactcgatttgggagcctactggggcaaggcgactggggaggtgtacgtgttagtcaagtggaggtcaggtgggttatcttctgcctccttcactggcttcatgtgaacttgcctgtgacagaatatcttgccctagatgtcctcttccctcttgccatcgtgcaaaagcattcgatcttatgaccgtgagttcttatttgtggatgctaactggggtaatctcagggagtactggggccatggctctttcccttgcttctctttctgctcactgctttgctttcaggtgcttagctgctcctttttatttctttgcaggactgggaaagcatgggaggaggattttgataagtttcttgttctctgcgtggtgatggggtggtctgagggccaagttaataagcctacctttggttattaccctggaaaattgagggttgatggtagggttatgattgtggcctgtgtatttgcaatttttctttgtcagtgtggctttctgtcatcttcctttttctccagtgagggttctgccactgtctcaatcccttggttcctgcaaaaaacagctaaatgtgctctcagggccagtggtgatgttctgtgttgcagccccagctcttgaaagtgacctggcccagatgagctctgcctgcttgtcatctttaggtcctgctgcccctgctgcctcagccctcaggctcctaactgctcaagccagaaggagctacaaagccaaatcatttgtcatttttctctggcagattgttttaaaatctccctcccctcttttattttaattatgccacctgtgttaatcctatagcctgcttctttgctttgtggattactgatttcaagttctataacttggggaaagttaggttgagtgaatgggaggacagacactgaatgtgtgttttggaaaaatggactctctatcttcagattattcagcttctccacctatcacctctacaacttggccttcattggagaagttttagttggcttattcctggaacaagaccacctagaggcttttagccttgtcagcctgccctcttctgaggtttggaccttgttttaaattgtgtgcatggtgggcttgagactctcttgtaatggaggtaatgggactatcactgaggggttcagcctatccaggtaggctaccgttctagtcatacccatcacttaaattctgccacagtctgcacagacggttggtcctccaggcatattgtcctattaagccaaataggtggacatcatgggatggatgaggtcatcatgaaaacagatttactggatttatggacctagtatatactatgtaacagatggaaaactgaattttacaatctataggtacctttgaaaggtcataaagggtaaaagtctatagttttccagaaaataattcttaaaactgggttttatgtctagatttaaatcatgtatctgtctgtagtgcttcaaatgtggccaggtgtggtagctcacacctgtaattcccagcgctttgggaatttgaggcaagaggattgctagaggccaggattttgagaccagcttcggcaatacggtgagaccttgtctctaccaaaagaaaagaaaaaaaaaa

SEQ ID NO: 11730 - DNA, 2005 bp, Homo sapiens
gttgagctgtaccatggagcatcctcctgtgtcctgccaacccctgccattatagtcaccggagactcctttacctatccctatctgttagggttttcagatgtcctctcgctgggtttatatttgaaggtatagaatctgggaaagggtggggtgcaagctaaccaaatagggatgctagggttgggtggggaattgaggactcttctgtgcttttattgtagggctggggatcgaggatctgggcaaaaaatatgacatttccaaccagggacaaaatggaggcttgggcttagtgatgggtaaatggaagactggttgagtgggatgataatgggagaacttactgatgctcttttgggaaaaggtgctttaaagactcgatttgggagcctactggggcaaggcgactggggaggtgtacgtgttagtcaagtggaggtcaggtgggttatcttctgcctccttcactggcttcatgtgaacttgcctgtgacagaatatcttgccctagatgtcctcttccctcttgccatcgtgcaaaagcattcgatcttatgaccgtgagttcttatttgtggatgctaactggggtaatctcagggagtactggggccatggctctttcccttgcttctctttctgctcactgctttgctttcaggtgcttagctgctcctttttatttctttgcaggactgggaaagcatgggaggaggattttgataagtttcttgttctctgcgtggtgatggggtggtctgagggccaagttaataagcctacctttggttattaccctggaaaattgagggttgatggtagggttatgattgtggcctgtgtatttgcaatttttctttgtcagtgtggctttctgtcatcttcctttttctccagtgagggttctgccactgtctcaatcccttggttcctgcaaaaaacagctaaatgtgctctcagggccagtggtgatgttctgtgttgcagccccagctcttgaaagtgacctggcccagatgagctctgcctgcttgtcatctttaggtcctgctgcccctgctgcctcagccctcaggctcctaactgctcaagccagaaggagctacaaagccaaatcatttgtcatttttctctggcagattgttttaaaatctccctcccctcttttattttaattatgccacctgtgttaatcctatagcctgcttctttgctttgtggattactgatttcaagttctataacttggggaaagttaggttgagtgaatgggaggacagacactgaatgtgtgttttggaaaaatggactctctatcttcagattattcagcttctccacctatcacctctacaacttggccttcattggagaagttttagttggcttattcctggaacaagaccacctagaggcttttagccttgtcagcctgccctcttctgaggtttggaccttgttttaaattgtgtgcatggtgggcttgagactctcttgtaatggaggtaatgggactatcactgaggggttcagcctatccaggtaggctaccgttctagtcatacccatcacttaaattctgccacagtctgcacagacggttggtcctccaggcatattgtcctattaagccaaataggtggacatcatgggatggatgaggtcatcatgaaaacagatttactggatttatggacctagtatatactatgtaacagatggaaaactgaattttaccatctataggtacctttgaaaggtcataaagggtaaaagtctatagttttccagaaaataattcttaaaactgggttttatgtctagatttaaatcatgtatctgtctgtagtgcttcaaatgtggccaggtgtggtagctcacacctgtaattcccagcgctttgggaatttgaggcaagaggattgctagaggccaggattttgagaccagcttcggcaatacggtgagaccttgtctctacccaaagaaaagaaaaaaaaaa

SEQ ID NO: 11731 - DNA, 323 bp, Homo sapiens
ttttaaaaatggagtcttgctcttgtcacccaggcaggagtacagtggcgcaatttcagctcactgcaacctctgcctcctgggttcaagtgattctcctgcctcagcctccctagtagatgggattacaggcgcccgctatcacgcccagctaatttttgtatttttagtagagacaggatttcaccatgttggccaggctggtcttgaactcctgacctcaggtgatccacttgcctcggcctcccaaagtgctgggattgcaggtgtgagccaccatgccctgccaacattagctatttctttttttttttgagtcggag

SEQ ID NO: 11732 - DNA, 2654 bp, Homo sapiens
ccgcgctcagccctctgtctcccttggggcaccatacaggggccagctggctagtcctagctcccagtctgctgcagcttcttcactcggcccatatggtggagcccagccctcagcctcggccctttcctcctatgggggtcaggcagctgcagcttcttcgctcaactcctatggggctcagggttcctcccttgcctcctatggtaaccagccatcctcttacggcgcccaggctgcctcttcctatggggttcgtgcagctgcttcttcctacaacacccagggagcagcttcctccttaggctcctacggggctcaggcagcctcctatggggcccagtctgcagcctcctcactagcttatggagcccaggcagcttcatataatgcccagccctcggcctcttacaatgcccagtctgccccatatgctgcacagcaggctgcttcctactcttcccaacctgctgcctatgtggcacagccagccacagctgctgcctatgccagccagccagcagcctacgccgcacaagccactaccccaatggctggctcctatggggcccagccggttgtgcagacccagctgaatagttacggggcccaagcatcaatgggcctttcaggctcctatggggctcagtcggctgctgcggccactggctcctatggtgccgcagcagcctacggggcccaaccttctgccaccctggcagctccttaccgcactcagtcatcagcctcattggctgcttcctatgctgcccagcagcatccccaggctgctgcctcctaccgcggccagccaggcaatgcctacgatggggcaggtcagccgtctgcagcctacctgtccatgtcccagggggccgttgccaacgccaacagcaccccgccgccctatgagcgtacccgcctctccccaccccgggccagctacgacgatccctacaaaaaggctgtcgccatgtcgaaaaggtactgtatgcccccccgcctctgcccccagctggggcttagggcaaggggctgaggttggcatgggagggaaactggaggcatcggcccctccctcggtcttctcttctctatttttgtgggatgtccagaggccgaggggagcagtgtctatgaactttcctggtcaccagggttcaggtggagcatagtgctcagcctggggtggtacctgctagtcaggccaggcacagtgtcacctgtctaggctagcccaagtgtcattggagctactgcctgcaggactgtggcccatatcctttcccactgtctcaaggatccttaagcctattacgtggttgtcctggctttggcagggatgtgggttaaagagtagtccctttggcattcactggctaaaggcaagtttacgaggtgcgtccactctgggaagttggggacctcgctttcatccgccgttctgttgataaacaaccaaggtctttctctgcagggcccaggggcggagatagtttgctgtggtgtgggaatgtagaccaaaatccaccttggctagttcagaggggaggacttcagtggagggtttgatttcccactgagttgaagccaggcttgatttttttggcctggatagggtgatgagccttctgacaaaaggagaccaatctcttggagaccactgtgatcacaccctccctgtccccattggcatctccccaatgcccacctggagtcctcccctcaattgtctcattcaccaactgtcttcttctctcgactaggtatggttccgaccggcgtttagccgagctctctgattaccgccgtttatcagagtcgcagctttcgttccgccgctcgccgacaaagtcctcgctggattaccgtcgcctgcccgatgcccattccgattacgcacgctattcgggctcctataatgattacctgcgggcggctcagatgcactctggctaccagcgccgcatgtagggccatcctgggatggggcaccacagggagggagggagaaaagaggtgggtagggttacagatccaggttataactactctggcccatacctttcctggttgtggtttttcatgccctctaccatgtgggccttccccaggagatgatcctgttaagtgttcggcagtaacctactttgttccttcgcctgcagcagcaaatcttgctactggctctagatctgcggtttcccctctaccctgcctcccgtctccccagaatgggaatttcttttatgtttttatttttttcctggctcccttttatttttgtgcgcgatatttaaggtcgtctggatggggaagcaacctgcagctgaggtcgccggcgcctttttctttttagatgggaaggaggccaggaaagggtcagcttaaccatttcctatgtgccaagctgtgccagcagtccagggtaccctgactgtccctctgtagactgttgagactgagttcctgttgggacagtcagttggtatgtatccaagtccctgctgaccactaatgttctagctgatggtgagcggcacagtcccacttccccatctccccaagtaggtggtgttagaaaaccttaattttttttcccttttgtatggactacaaataaaacttggggcaatttgcagtttggaaacctg

SEQ ID NO: 11733 - DNA, 2772 bp, Homo sapiens
  misc_feature (775)..(777): n equals a,t,g, or c
  misc_feature (885)..(885): n equals a,t,g, or c
  misc_feature (893)..(893): n equals a,t,g, or c
  misc_feature (1126)..(1127): n equals a,t,g, or c
ctctgacggcccagccagctactacgggcccagccgtccgtgtcactgggagctgcctacaggcccagccttctgcctctttgggtgttggctatcggactcagcccatgacagcccaggcagcctcttaccgcgctcagccctctgtctcccttggggcaccatacaggggccagctggctagtcctagctcccagtctgctgcagcttcttcactcggcccatatggtggagcccagccctcagcctcggccctttcctcctatgggggtcaggcagctgcagcttcttcgctcaactcctatggggctcagggttcctcccttgcctcctatggtaaccagccatcctcttacggcgcccaggctgcctcttcctatggggttcgtgcagctgcttcttcctacaacacccagggagcagcttcctccttaggctcctacggggctcaggcagcctcctatggggcccagtctgcagcctcctcactagcttatggagcccaggcagcttcatataatgcccagccctcggcctcttacaatgcccagtctgccccatatgctgcacagcaggctgcttcctactcttcccaacctgctgcctatgtgcacagccagccacagctgctgcctatgccagccagccagcagcctacgccgcacaagccactaccccaatggctggctcctatgggcccagccggttgtgcagacccagctgaatagttacggggcccaagcatcaagtgcgttcaggcacctatggggctcannngctgtgtgccactggctcctatggtgccgcagcagcctacggggcccaaccttctgcaccctggcagctccttaccgcactcagtcatagcctcattggctgcttacncctatgcncccagcgatccccaggctgctgcctcctaccgcggccagccaggcaatgcctacgatggggcaggtcagccgtctgcagcctacctgtccatgtcccaggggccgttgccaacgccaacagcaccccgccgccctatgagcgtacccgcctctccccaccccgggccagctacgacgatccctacaagaaggcggtcgccatgtcgaaaaggtactgtatgcccccccgcctnnctcgcccagctggggcttagggcaaggggctgaggttggcatgggagggaaactggaggcatcggcccctccctcggtcttctcttctctatttttgtgggatgtccagaggccgaggggagcagtgtctatgaactttcctggtcaccagggttcaggtggagcatagtgctcagcctggggtggtacctgctagtcaggccaggcacagtgtcacctgtctaggctagcccaagtgtcattggagctactgcctgcaggactgtggcccatatcctttcccactgtctcaaggatccttaagcctattacgtggttgtcctggctttggcagggatgtgggttaaagagtagtccctttggcattcactggctaaaggcaagtttacgaggtgcgtccactctgggaagttggggacctcgctttcatccgccgttctgttgataaacaaccaaggtctttctctgcagggcccaggggcggagatagtttgctgtggtgtgggaatgtagaccaaaatccaccttggctagttcagaggggaggacttcagtggagggtttgatttcccactgagttgaagccaggcttgatttttttggcctggatagggtgatgagccttctgacaaaaggagaccaatctcttggagaccactgtgatcacaccctccctgtccccattggcatctccccaatgcccacctggagtcctcccctcaattgtctcattcaccaactgtcttcttctctcgactaggtatggttccgaccggcgtttagccgagctctctgattaccgccgtttatcagagtcgcagctttcgttccgccgctcgccgacaaagtcctcgctggattaccgtcgcctgcccgatgcccattccgattacgcacgctattcgggctcctataatgattacctgcgggcggctcagatgcactctggctaccagcgccgcatgtagggccatcctgggatggggcaccacagggagggagggagaaaagaggtgggtagggttacagatccaggttataactactctggcccatacctttcctggttgtggtttttcatgccctctaccatgtgggccttccccaggagatgatcctgttaagtgttcggcagtaacctactttgttccttcgcctcagcagcaaatcttgctactggctctagatctgcggtttcccctctaccctgcctcccgtctccccagaatgggaatttcttttatgtttttatatttttcctggctcccttttatttttgtgcgcgatatttaaggtcgtctggatggggaagcaacctgcagctgaggtcgccgcgcctgtttctttttagatgggaaggaggccaggaaagggtcagcttaaccatttcctatgtgccaagtgtgccagcagtccagggtaccctgactgtccctctgtagactgttgagactgagttcctgttgggacagtcagttggtatgtatccaagtccctgctgaccactaatgttctagctgatggtgagcggcacagtcccacttccccatctccccaagtaggtggtgttagaaaaccttaattttttttcccttttgtatggactacaaataaaacttggggcaatttgcagtttggaaacctg

SEQ ID NO: 11734 - DNA, 323 bp, Homo sapiens
tttttaagatggagtcttgctcttgtcacccaggcaggagtacagtggcgcaatttcagctcactgcaacctctgcctcctgggttcaagtgattctcctgcctcagcctccctagtagatgggattacaggcgcccgctatcacgcccagctaatttttgtatttttagtagagacaggatttcaccatgttggccaggctggtcttgaactcctgacctcaggtgatccacttgcctcggcctcccaaagtgctgggattgcaggtgtgagccaccatgccctgccaacattagctatttctttttttttttgagtcggag

SEQ ID NO: 11735 - DNA, 3136 bp, Homo sapiens
agactacgcgtttgttcacatggagaaggaagcagatgccaaagccgcaatcgcgcagctcaacggcaaagaagtgaagggcaagcgcatcaacgtggaactctccaccaagggtcagaagaaggggcctggcctggctgtccagtctggggacaagaccaagaaaccaggggctggggatacggccttccctggaactggtggcttctctgccaccttcgactaccagcaggcttttggcaacagcactggtggctttgatgggcaagcccgtcagcccacaccacccttctttggtcgcgaccgcagccctctgcgccgttcacctccccgagcctcttatgtggctcctctgacggcccagccagctacctaccgggcccagccgtccgtgtcactgggagctgcctacagggcccagccttctgcctctttgggtgttggctatcggactcagcccatgacagcccaggcagcctcttaccgcgctcagccctctgtctcccttggggcaccatacaggggccagctggctagtcctagctcccagtctgctgcagcttcttcactcggcccatatggtggagcccagccctcagcctcggccctttcctcctatgggggtcaggcagctgcagcttcttcgctcaactcctatggggctcagggttcctcccttgcctcctatggtaaccagccatcctcttacggcgcccaggctgcctcttcctatggggttcgtgcagctgcttcttcctacaacacccagggagcagcttcctccttaggctcctacggggctcaggcagcctcctatggggcccagtctgcagcctcctcactagcttatggagcccaggcagcttcatataatgcccagccctcggcctcttacaatgcccagtctgccccatatgctgcacagcaggctgcttcctactcttcccaacctgctgcctatgtggcacagccagccacagctgctgcctatgccagccagccagcagcctacgccgcacaagccactaccccaatggctggctcctatggggcccagccggttgtgcagacccagctgaatagttacggggcccaagcatcaatgggcctttcaggctcctatggggctcagtcggctgctgcggccactggctcctatggtgccgcagcagcctacggggcccaaccttctgccaccctggcagctccttaccgcactcagtcatcagcctcattggctgcttcctatgctgcccagcagcatccccaggctgctgcctcctaccgcggccagccaggcaatgcctacgatggggcaggtcagccgtctgcagcctacctgtccatgtcccagggggccgttgccaacgccaacagcaccccgccgccctatgagcgtacccgcctctccccaccccgggccagctacgacgatccctacaaaaaggctgtcgccatgtcgaaaaggtactgtatgcccccccgcctctgcccccagctggggcttagggcaaggggctgaggttggcatgggagggaaactggaggcatcggcccctccctcggtcttctcttctctatttttgtgggatgtccagaggccgaggggagcagtgtctatgaactttcctggtcaccagggttcaggtggagcatagtgctcagcctggggtggtacctgctagtcaggccaggcacagtgtcacctgtctaggctagcccaagtgtcattggagctactgcctgcaggactgtggcccatatcctttcccactgtctcaaggatccttaagcctattacgtggttgtcctggctttggcagggatgtgggttaaagagtagtccctttggcattcactggctaaaggcaagtttacgaggtgcgtccactctgggaagttggggacctcgctttcatccgccgttctgttgataaacaaccaaggtctttctctgcagggcccaggggcggagatagtttgctgtggtgtgggaatgtagaccaaaatccaccttggctagttcagaggggaggacttcagtggagggtttgatttcccactgagttgaagccaggcttgatttttttggcctggatagggtgatgagccttctgacaaaaggagaccaatctcttggagaccactgtgatcacaccctccctgtccccattggcatctccccaatgcccacctggagtcctcccctcaattgtctcattcaccaactgtcttcttctctcgactaggtatggttccgaccggcgtttagccgagctctctgattaccgccgtttatcagagtcgcagctttcgttccgccgctcgccgacaaagtcctcgctggattaccgtcgcctgcccgatgcccattccgattacgcacgctattcgggctcctataatgattacctgcgggcggctcagatgcactctggctaccagcgccgcatgtagggccatcctgggatggggcaccacagggagggagggagaaaagaggtgggtagggttacagatccaggttataactactctggcccatacctttcctggttgtggtttttcatgccctctaccatgtgggccttccccaggagatgatcctgttaagtgttcggcagtaacctactttgttccttcgcctcagcagcaaatcttgctactggctctagatctgcggtttcccctctaccctgcctcccgtctccccagaatgggaatttcttttatgtttttatttttttcctggctcccttttatttttgtgcgcgatatttaaggtcgtctggatggggaagcaacctgcagctgaggtcgccggcgcctttttctttttagatgggaaggaggccaggaaagggtcagcttaaccatttcctatgtgccaagctgtgccagcagtccagggtaccctgactgtccctctgtagactgttgagactgagttcctgttgggacagtcagttggtatgtatccaagtccctgctgaccactaatgttctagctgatggtgagcggcacagtcccacttccccatctccccaagtaggtggtgttagaaaaccttaattttttttcccttttgtatggactacaaataaaacttggggcaatttgcagtttggaaacctg

SEQ ID NO: 11736 - DNA, 4307 bp, Homo sapiens
aatcccaggagccaacctccccctttgcagggctgcatttaaaaattaggtttgggacagttcttgtaccgtggtttcagccttgtgtggtcatcactggcttctggagctattggtgatgtccaagggaaagctttgagagtttatgtttactctttgagtcccaggagaagcctggcaccctctttgcaaattggcctttgctctttcaatgcctttcatccatctccactctctcaactgcctaaagtcacagcacagatactgcccagtgccttaagaggagacatgatctctaccagggactctcagcaaacacgggactgtgttcagtccacaaaggaaaagcgtttttgaagctctcattgttcatgtaaaaatcatacacgtggcatgttgctccacattccttacacacaggggtagaggggattgcttttgtgacccacgttcaaatatgtgactgttttcttttctcttttactgctaagcagcctggaaaggataaatgaatattagactaagatttgttttccaggaggctcaatctgaacacacagaatgtcagagctggaagggactatagagatcatctgatctgatcctcttgtacggatgatcgcaaaactgaggtgtagagaggggaatggccaaaatcacaaagcaagttagcgttaagagctgagactagaattcagggtcctcactcccaggccaccgaaccatgcagccccttctttgggggaagagacctgtgtcagtcttggttaattgttccagggaaccttgctaacagaaacttgctcttgccttggctcttcagtagatgacctggctgtaaagagattccctggacgagccagatcattcagtttcagcgagtccttgagctccacaacatctaccagatatagcagacaagcacccatggaggcaggtttcgggcctgaagcagatcagagggctttgcaaaagacagcatagagccatcttcctgcaactttacctctttccctcagatggggagccatgactgggttgcacctcaggatactgtaatttgactccataattgcttttgctcctgaaacctgggaatcaatggaaaggcagggaatgtgcctcttctgtggccagattctgttatttgcaattaaagcaagtttttaaaaaatgcaagaggcagttgttagtcttcagggcttggcaactgaaatagctatgtggcggatacggaaaacagaggacaatttgaggatcttgctggaataataaatgacagctaccatttgttgagcacctattatatatcaggcactgagctgggtaggctctaaacttcacaataaccctgtgacttaactactttatctccattttgtagttgaagaaataagttcagagagaaagattccttcccaaggtcatgcagctagtaaatgatagaatcaggattcatagcatcactatagggggtcaatatttacacaaaaaaggaaagtcacaagcctgtttaaaatgaagtgaccaccttttcttgcatagactaaataactcgaactggcatttttaggttggaaagacagctgaattagtagttaagtctgatagccaagtaagttttaaaaaccaaagcatccaggatgcacacccctgcaccatttgctgtgcgaattaatagttctgtctctctctctctttcttttttctttttattctttgagatggattttcgctcttgtcgcccaggctggagtacaatggcacgatcttggctcactgcaacctccgcctcccgggttcaagcgattcttctgctgggattacagcatatgccaccatgcccagattatttttttgtatttgtagtagagacggggtttcaccatgtcagtcaggctggtcttgaactcctgacctcaggtgatccacccgcctcagcctcccacactgctgggattacaggcatgagccaccgctcctggcctctctttcttttttaaacaaagaactttgcacttggccagagaggaggagaaagcccattttctcccttcctaagctagatccaaataaaagaaagttcagttttcccccataactattcttgggtcatgaactttgatctggagtttgttttgtttcaggaatgtgtgcacccagcttgctgatccaacaaagtctattgcttaccagtctagcttgatgaagccttttggccagaagtcaatttgttttggatcagagaaatttcctgacaaggtatatttgttttctagtgacagaaaggcaaaggaacaagtcctagttgttgttgttgttgttgaatactaaatttaagatatgtcagcttgctttcaatgagccttgggcttctgttattgcttgagcatttggaactcgagcttccagagaaatttgaggtcctcgcttgttctctgccttcaagaaacaatgacctgattctgtctttaaaaaaaaaaatctcagaattctttttttgtttgtgtttttttttttttttgagacagagtctcactctgttgcccaggctggagtgcagtggcgccatctcggctcactgcaacctccgcctcccaggttcaagcaattctcctgcctcagcctcccaggtagctgccactacaggtgctgcaccaccacgcccggctaatttttgtatttttagtagagacagggtttcaccatattagccaggtgggtcttgaactcctgaccttgtgatccacccgcctcggcctcccaaagtgctgggattacaggcgtgagccaccttgcctggccaaaaatctcagaattctttaagactgttttaattgctccatcagtaattttgaagcactttcctttttttttttttttcccctttttgtccctttccccaagccaccaattggatggatgaatgtttgacggggaagaggaagggtaggaggatgcatggatgagtggatgagtggatcgatggatgtattgataaatagatagaaccagtcatctgaagcaacttaagaattgtagccttgactccttgagactgtagatttcgatccaggaaacatttatttagcacctgccagatgccagaaatttataccatttaaaactcagtaagtcttttaaatatcaggaaggagagaagcgacatcatgatacatcctatgggtattaaaaagccaatagaatattatgaataattttatgctaataaatttaacaacttcaacatcataaacaaattccttgaaaaataaaaagtaccaaaattcattcaagaagaaatagataccagcctgagcaacatggcaaaatcccatctctacaaaacatcaaaaaaaaaaaaaattagtcgggcatggtggtgcacacctgtaatcccagcttgtcaggaggctgaagtgggaggatcacctgagcccagggaggtcaaggatgcagtgagccatggtctcaccactgcactctagcctgggtgacagaatgagaccccgtctcaaaaaaaaagaagaagtagataatctgaatagccctatatctatagaaacttaatagtgctgggagatataggtattattatcctcattttacagatgtgaaaattgaggctcagagaagtaaagtctattgctcaaggtcatgtggctagaatatggcagagccatgattcagatccaggtcttctgattcttattccagtgtcctttctagcataccatgttgcctctaaagattgcagctccttatttactagaaaattgttcctgcccaatctacatctccacctcaccccatcttttcttaagcactatgtttgtgtttttatcagtattatattcattgtctttggaatacatgttcttgtttgtgtttggaaaaaaaatctcttttaccagcttgcactcggaccaacttggaaaaaaaaaagcttaaatgtttttgctatgtacagtttaaaaatgtgaagtttgtagctttaactttttgtaagaaaatctaataacactggcttaagtgctgacttgaaatgctattttgtaaggtttggatgtaagtaatcaattgaggtcagcagtttgtatgagacatagcttcctccattgcccccactccttttttcttttttaagtttgagatgcttcctgtgtttttatgttagaattgttgttctccttcttttcttcttcctatacctcatcacgtttgttttaaataaactgtcctttggaccacaaacccttattaacgagaacctcaatatatagcctggataatggtgttgtgaacaa

SEQ ID NO: 11737 - DNA, 552 bp, Homo sapiens
gaggctcttggccctggaccccatgatggagcaggagattgaagagatccggcagaagtaccagtccaagcggcagcccatcctggatgccatagaggctaagaagagacggcaacaaaacttctgagcaaggccaggctgtgagggccccagctccacccaggctttgggtgaattctggatggcttgcctcatgtttgttagccagcacttctgctctgtcgtctctccacagcacctttgtgaactcaggaatgtgcgccagtgggaagggctctcttgacagtcagcgtgccatcttgatgtgtgtatgtacattggtcaggtatattatctcaaaggatttatattggcgcttttaactcagagttttaaaccccaggaacagagactcctagttgagtgatagctgggaaagttttacattgtctgtttttcttctcccaatagctttcaattgttctttctggaagacttttaaaaaaatataaatatgcatatatatatataaattataaatagattccccacgcagtgtggtggcatctctgt

SEQ ID NO: 11738 - DNA, 481 bp, Homo sapiens
ctatgaagaatggagagacacttgtagtttgttttgtttggacctttactaagagttgttctccatttcagaaaaccacatcatcagtgacagcgatgcttgtgatttttgagtcactcactcaagattggtttagatctgtagctgttgttttcacagaaagtctatgtaacatgtaaacacatggtaatttcagagaatgatgaagtacagcaaaaagaaaagaacagggtaatgggattgagagtaacgtgtgcatgtgtgtgcatgcacatctgtgtatgtgtagggagagatggctttatatagaatgataaacgatgcttctggagaaacgatgtttataatgagaactgcatgacaagaaggaaccagccaggctgaggggacagcaagaacaaagaccctgagataaaaacaaaagtttggcttgttggaagaatggaaggattcttccatggctggaacagtgtgtacaagg

SEQ ID NO: 11739 - DNA, 18286 bp, Homo sapiens
cagtacttcgacatggaagactgtgtcctgacggccatcgagcgggacttcatctcctgccccagacacccggacctccccgtgccgctgcaggagctggtccctgaactgttcatgaccgacttcccggccaggtatgccccgaaggcccctcccagaacacagtgcaggtcacagggggcgttcctcgctgtgcagttgccgagtgatctccaggaagacccctctggggcgggcaggtgccccggccatggcttcccaccaatctcagtaccttttaggttcccatcctcggctgcctgaaaggaaccaggctgccggctttccattttggaggccttgataggcccaactgggaagagtgctttgcaagtgcagccatcctgcctccccatacggctcccccttcccctcgtagccagagctgctctctcctgagctgcctctcctttccactcctacctccccaccagctctagggccagcagataagtgcagccagtgctcctcaagcattcaggaaggggagagaagggagagctcccacccagagccttgtttaccttctttgtcaaacgctgactcctgtctgtagccctagcgctgagctcccacccagagcctcgtttaccttctttgtcaaacgctgactcctgtctgtagccctagcgctgagccttggacccctcaaatctgttcttagagtttattgtacctatgctaacccaagatcataactagagagagaatcggggaggaaataggaaacgtcacctttcagaagaaaacttccaaaggggtcctttctctacggccaccacttctgtggggttcaccctgtgccagccatcaccacctctgaggccgttcctgtcctgagagccctctgtacagaggagactgaggcttagcaagcctgcataacctacccaggtgtgctcacccacaagtggcagggccggggtggcccagatctgtccagcctcacagatggctttgaaccatgactctcggccgttggggcaaatgacccagcccaggacccacccgcatcagggcgggggggatgtggctgatgcccgggcgtgtgtggcaggctcttcctggagaacagcaagctggagcacagcgaggacgagggcagcgtcctgggccagggcggcagtggcaccgtcatctaccgggcccggtaccagggccagcctgtggccgtcaagcgcttccacatcaaaaaattcaagaactttgctaacgtaccggcaggtaagcgggtccaaggttggtgctgtttttctcagacatatgctgcccggtctaagctctgtgcgggcttagagaggcctgaggctgcaggcaccccatgtcctactggctgacactgcgctgtccctggcagacaccatgctgaggcacctgcgggccaccgatgccatgaagaacttctccgagttccggcaggaggccagcatgctgcacgcgctgcagcacccctgcatcgtggcgctcatcggcatcagcatccacccgctctgcttcgccctggagctcgcgccgctcagcagcctcaacaccgtgctgtccgagaacgccagaggtaccgcggcgcgccgccccacccggccccggagaccgacagagccccgggcgcctcctgcctggcacggggggtagagcctcaggtggccttggcaagcccagggcacgcccaacccatggctcgtgtgaccatcccctggctgcgaggccaggctccccgccaggtccagtcactaggcagagccttggcgaggacgggggagcgcacactctggagtcggctaagaccaggctctgccgcggtccggaaagccgctgagtttatttgcctgtaaaaggaggatggtaacaggcctcgctgggagggcaccgagcacgggagctgcattgaatcactttcccaactgcacacgtacacggctgctgagactctgagaccgcagggtcagtgggaccatattttaacataaaatgtcgaagtaatttaccttgagaaaagagcagctaaactccagagtggccagagggtgaaaggtagctgtcttttgactaaggaagaagaaatgctatgaaaatcaatcacttctgcctcaatggaagataattttttaaacagaattctttacttttttttaatacaggatctcactttgttggccaggctggaggacagtggtgcaatctcagctcactgcagctttgacctcctgaactcaagccatcctcccaccgcaacttcccgagtagctacaagcacacgccaccacacccagctaatttgttgttgttgtttgtagagatggcctttcaccctgttgcccaggtcgttctcgaactgtgagctcagtcgatccccccactttagcctcccaaagtgctggaatcaccggcatgagccacacgcccagccaaacaaaatgcttctacttgcctctcacccctttacgtaggacagccttgacctgaggtgaactctagagatttcgaacccttgctcattcagcaaaatgccagcaattccaggaataagatatcaggaatgaagctacagcgatgagcatttctatcctaaatactgtttcacttaaccaggccattctctgtcctttatggcagtctggtgaatagtgagaatgtgtcaatggaatataaagtatctaagggccaggcgcagtggctcacatgtgtaatcccaacactttgggaggcccaggcgggcaggtcgcttaaagccaggaattcaagaccagcctggccaacatggtgaaaccccatgtctactaaaaatacgaaaattagccaggcatggtggcacgcgcctatagtcctagctactcaacttgggaggctgaggcaggagaactgcttgaaccctggaggcagaggttgcagtgagccaagaccatgccactgcactccagcctgggtgatagagggagactctgtctcaataaaagaaaaaagaaaaaaaatcataaagtatctagggagatcggaagacaaaaagacagttgttatcatgataatttgattctatcaaaactgaaattttgatacatttgaaaattgtttttctttgcaagattcttcctttatacccctgggacacatgctcacccaaaaaatagcctaccagatcgcctcgggcctggcctacctgcacaagaaaaacatcatcttctgtgacctgaagtcggacaacattctggtgtggtcccttgacgtcaaggagcacatcaacatcaagctatctgactacgggatttcgaggcagtcattccatgagggcgccctaggcgtggagggcactcctggctaccaggccccagagatcaggcctcgcattgtatatgatgagaaggtacgtgcctggatcccctggcccagccccacagtgtaggagcccagccctcaggctagccgggcagtcctggaggcacctgaagcttcggggctcagcatccccaaaagcacatttttctcactctcccttgctcaatgagggaggttctggcttgaaccagaagggtgcaggggcctgtgtctgtctgcttgtagcaaagttgacttctccttagcatcagccttctcagaccttgattcagtaacattgtagaggctgtaaacagcagatgaagagtccaagagagaaacaggtctggatttgggctccaactcacatttagatgtccacagtgaggacacaggaccagccttgcagggcactcaggaggagcagacagaataaggacggtaaagacccttggccttaagtcccggccacagggtgctggccaagttgaatgccaaaccaggagaagagtgaaagagcaagctggcatcccctggcaactgcactgccagcctcagttgagacaatgactaaatgttgatcttctgataacatttatccctgatggctacttggtagatgcaggcacacacacaacttgaagtcatcttaccacgcatgtattacatctagtgccagccttgttaattgatcacccagcattaaaattcccttgtctataatttcttattatctggtgattctacagatggtcattgactaattcctgtaggaatgacctgtgcatgtatggattagctcagcacctgtggttgttgcccatagaaaaggcaaatcagagcaacaaaaataagagcttcataatagtagctgacttcaacaaggaggtcaccttgaaactcagattatcatggaaacattcacattaaaaattctcaagtctatctatctcagtcattctcctgctaaaatgttatttcttgacccttataggggtctgtataaatttttccttgctggacctttttgattatgaaaattagaggagacaacatgttgtgatccaggagacgctcctttttttatgagttgcaatacataacacttttagtaccaagcacattaagctgagggtgtgtgttttcctgccttgtcttggtactcaagaataaggaccatgacatccttggagtccttaatcagtgactaacagcaagttctcagtgtgttttattggatggaaggatggatcgatggatagatggatggatgggacaatgggcaaatggacaatatggtgggaagtcagatggatgggtggatggaaaagaggaaggataggaagacagatggataaatgtgcaggacaggtggtcggatggatagatggatggacagatgagaagaatggataaatgtacaggaagacaagcaaatggatggatgggtggatggatggatggaaagaaggaagggtgagaaaatggatagataaatggatagaagagaaagtggtcagataggtggatggataaatggatagagggacatggtcaggtggtttgttgaatgtttgttttccttgtctaattgtgtctccctggtccctccacctgagggccaccttgtgaaggccactgggcccaggcagcgacctgacttggcttgttctgtgcccaggtagatatgttctcctatggaatggtgctctacgagttgctgtcaggacagcgccctgcactgggccaccaccagctccagattgccaagaagctgtccaagggcatccgcccggttctggggcagccggaggaagtgcagttccggcgactgcaggcgctcatgatggagtgctgggacactaagccagagaaggtacttggggacacagagcccagggcctgggacctcctgccatgtgaggaagctgtgggtccccagggggtgtgtgcctggctgcccaaccatcaccattggcaacccttctctgctcatttcttctagagggtgatgtttgctgctcctaacatacctactttcattgtctttgtgtgtgcgtgtcactcttacgaaacaaacttccttttcctccccgacttttgtgttacttcaccgtgcaaacaaagtatataaacccctttataacaatacagtccctatgcaagaacagagagaatgtgggtgtctctttgtaaagtgatggggaaaaggtttcgttgtgagaatcagggatcatattacagtgttcaggctagttttttgacggtggtgtttttgtgtttttggaagaggctagtggtttcaaagttaaaactcatttattaaatcagacagagctagtttaatgtatggggagtaaacagggtattctttagaagaacgcatgtccttatctgggcatggtgacatggacttatagtcccagccactggggaggctgaggcaggaggatcacttgagcccaggagttttaggctatggtgcgccctgatcgcacctgtgagtaggttctgcactccagcttgggcaatatagtgagatgaagagtgtatgtccttgggcctgggttggaatacccagggttcagctaacctgaccagatgagcttaaattgccgtagccaaaggtgacccagatacctggatgggtttgctcctgacgtctgaagctgtttcagcctcttgtttggatctagtctgaatgaacagaatccctcattcctccctggttggggctggctgatctcatgggcagaacgggcaccaatccggttgtaagtgaccttgctctcttctggtggcttctctccctcagcgaccgctggccctgtcggtggtgagccagatgaaggacccgacttttgccaccttcatgtatgaactgtgctgtgggaagcagacagccttcttctcatcccagggccaggagtacaccgtggtgttttgggatggaaaagaggagtccaggtaagctcctgcgggctgccctgccccctttgtatttggggtgggaggccgccgtggaatctgggaacacagtcgatgttgaccacagtgagaattatttagcagacggtagggtccagaacctggttagactgcactcaagaaagagcagggagagcagaagaaagtccacacaaagagacgtgcatgtatggttttgtggttaagagatgccaaaaatgggtagtatctgccagggtgtctggggacgtgagggcactgtggcatgtgcctacagtcctagccactccagaggctgaggcaggagaatcacctgagcccaggagttcaagtttagcctgaacaacatagcaagaccccatcttttaaaaaattagaaaatttaaaacatttttaaaaacgaaatgaggcctgtcggcctggttatgtgactttctcaagcatgttctgctgccccagattgcagaaggggcaacgggggggggcgtctaaacagagttggggttttgccaaagggagagaggggcagaggcattggggtgttttcaagggagtgatacagagatggaccaaggaacctaagtgaggccacaaattcagggagcacaatgcaaagtactaaaggatcctaggtattgccagagttaaaaaaaaaactcaagagttatggtttcaggtgggatgagccgaaaaactaggaggcggtggccagacaagacgtgcttgccgtggggtgggtgggaggcgcacagtcggtagtaaagacggcatctggagtgtgacctttggggaggatgcctggggtagagtgaggaatgagcttgagacataataagataaacggaacagacttcgcagtttctcttaggtcagtctttgtgagtttgcgtcaggttttatgccactcggactgagggttgtgacacagacgtactctaagaaatgatgctgtaaggaagtttttctgaccaggccttgtggctcatgcctgtaaccccagcactttaggaggctgaggcaggtggatcttttgagttcaggagtttgagaccagtctaggaaacatggtgaaactttgtctctacaaaaataaataaataacaaaaattagctgggaatggtggcgagcacctgtagtccctgctactcaggaggctgaggcaggaggattacttgaacccaggagtttgccactgcagtgggtggtgattgtgccactgcactccagcctgggtgacagagtgagaccctgcctcagaaaaaaagagaagttattccaaaacacagcgatggagcacgccttcctgatgggatgtactctaaggacaaaacaaaaagcaaacatattaattaaacaggtttcagtaattatattgttggcagcactgttatgattgttactctaagatgctgcttgtggttgtggagtcagttaatgagtaattatgttgctgttgctggaaacatgagctaaaggggaaagagatgtaaagtcgggtaagtaaaagcctgcagttctgaatcgattggatagactcgtgacatagttgaaaaataaacacaaatatctcagttctgctcactgaaaaggcctaaaaacaaggaccaaccaaatgccaatatgcacccctaggacccagactgtggtctctaagtaccaaagtgaaccagggctcatcagaatcatggcagagtccaggtccggggcagggagtgcacctggaacatctgccaccctagaagcaaggacatcgtcagacttctgagggtgaattggaggaccttgggccagactggtcctgggaggctgggccgggccctgccctgctggcctagagacacacacgcggcaggtacctgagacagttccgctcagggctctgaagactcatcccagagggaagacagaggcctcttcctgtgacctgtgaaggttctttaaaactcactgcggcctgaagagagactcactcacaggaagggaggagggggctggctgggagcacacgggcagccaagcaggggagccaggatggaaccggacttgacttgagatctgtctgagaattaaggaaggaaaggaggcaggagaggcagggcagacgagcaggtaaacaggatacgcctaggacacaattccagttgcagggaacaggggcaattattctttatgactctctatatttttaactgtttgttttcaaagtaaaagctattcaaatatcttagttttgtttttctgatgcataaaaaaatgatgggaaaaggagacaaatacacctgaaggaagtttttgtttgctgtattttctaccatttctatcatctgcaaatacgttatcagtcaacagctttttaaaatttggtggcaggagaaactttatattgagaactgctatccgcgagcttaacatattctcttgagtctgagggacagagctgcgtgatgcggggtacataacttcccagccccatcagcttcagcctcctctgccatgcagtgagtgctcaggatgcccgccacagcctgaggggagacagcgatgccggggacagccggcctggtgagccaaggctctcgcaaatgacaagccattagttctcagagcactcgtgctgggagcacattttgagtgcccccccgccccaacccaatctcctctggaattctcccaacttgtctttagccctggctttgtctactctacagtgaggagctccccgcataacaggggcgggcaggatatggccggcgggagggcccctccttcgtactgggggcaaccgtctcaaccctgaggggtcacggaaagaggacagcctttcttctctggcgaatgcccttcctgcgggcgacggtcaagcattacccttcgggcagaacccggctctgccctctcagaacacaggatgcaaccctgggtgggagcaggggaggtagacgaggctcgcagctggcaggccaggctcagggaaaggaggcagcccctggcccccgggcactgacagcacagtttctgccacttacaggaactacacggtggtgaacacagagaagggcctcatggaggtgcagaggatgtgctgccctgggatgaaggtgagctgccagctccaggtccagagatccctgtggacagccaccgaggtaagcactgcccgcaggcctgcccaccgaggtaagcactgcccactgggtgcagccctgggtgggggccacattcataaaaatacaggacgccaggtcaagtgaactttcagataacccccagcgcatccccgtgcagtccccaagtaatgccaggagccccgagaagtagcagcctgtcaccaggggcagctcaaccctgcctgctgctggctggaggccgggatttgcgatggtgaggaccagatgtagaccctcagcaggagacgagacccaggaggctagggacgtgcctgtgtttcccataacactgctagtcactcagctctgaaggcctcttgccttcacatcagggaaatcagggaagtcactagaaggcccaaggaggggtcttctgagaagtcccgagacaactggccaaacacaaatgttctgaggcaggctaggcacaggggctcacgcctgtaatcccagcactttgggaggccaagataggaggatcacgaggtcaagagattgagaccatcctggccaacatagtgaaaccccgtctctactaaaaaatacaaaaattagctgggcatggtggtgcgtgagtgttcccagctactcaggaggctgaggcaggagaatcggttgaacccaggaggtggaggttgcaatgagccaagatcgcaccattgcactccagccttgcgtaccacttaagcctcagaaatctcagtgttaagaaacatctgacaacagattagccgaagtaggtgcagcccagtcccaggcatccaagagatgctcccacaacatttcctcctagaatgggcgagagcaagggctctgcctaaagcgtgctgttgcatgggaagaacagtgaacatttcctcctagagtgaggaaagcaagggctctgcctaaagcatgctgtctcacatgggaagaacagtgagaagacagcattgcggcgtgagtccactttgccagtaccaggtgcacacacaaataccacagagaacttctgagaggctgtgcccccagatcccaatgttggttttctctggggaatagatgacgggctattttctgtttcctctttagactagtctgtctttttcaacgtttctacaaagagcagaaatccataaacaacccaccagaacgtgtcaatccatgtaactttccaagacccataggggatccccaagtccaagtgcatcctcatgggaatggcttgggaaatgccagacactttccagcctgggtctcacagtggacctgtctgcctctgcaggaccagaaaatctacatctacaccctcaagggcatgtgccccttaaacacaccccaacaggccttggatactccagctgtcgtcacctgcttcttggccgtgcctgttattaaaaaggtgaggtcggggcaaaggcaggtatgcaggtctctgatgcacttccacgcctaggaggcgtctcctagctatgtcagggtggcgcctgcagagccacacctaggaccacctggcctaggacgtagacttagagacggtgggaggaaagatatcagacctggtccgtcattagtgccttccggtttgcaaaaacctaagtcaagtccccagccagactgcaggccgaatgaaaaaccccctttcacatgcaaatgccctgactcaggtggaaggactgttggtacaaatggcacggtgagcagtcatgcgtgtgcccttcccctatccggagcctcttccccacctgcccaggccagagccacctcacagccacttgatcaccaggtcctggaggtcctgatctccctccctccatctctgcctcccgccaagtactcgccgtcttacaccagacgcagtttctctttgtgcagcatagccctgcagactcagctctttaacctcctagccctggcctttctaaatgagaccccaaggggcactctccccattaaaggcccagccagctgtgctgcaccttgggattagccccagcctctatgaggctggcctccagtccctgctgggcccggcaccctccccacaaagcaccccactctgtgctgggcccttgacatcccagcctcctccaggaacagcccctccacgcacctcttcccagacggcctccgattcagttctcaagacccggggccttgtcccctcctttgagaagctgcccctcagtggggggcagctccctggcttttccgggctcctccgcccacaggattcaggcacggctcagccagctctggtttcatccaccctgaggggcctgtctgtgcataggcgccctcactaaatgcacaagaagcctttactggtgttgctttgttaaaatgtgactgtcatcatccaattccagtttgcccatctacaaaacaggtataagaagagacagaaggcctagcatacccaaaggtctaggccggtgtgcttggtaaatgagtattattattacttctggatggtcgcaaaatacatgaactcttctcttcacccttcttcagtttcatttaaaaaaaaaaaaaacaggtatgaaatgaaccttagagtcatttatgaccatggccccacagcgaggctacgcagcttgggaccaggcccgtaccagagcgcaggagaacacgacacaaagtgttattgaggccaccgctggcgagagcccccagccagggcaccacctcctgcacgaccagagggaataaagcctgctctgtgcagggcctcctgggcagggtgtctgccccctccaaggccgccagcgcgaagcctgcattcttgcacgcgcacccacgttcacacccagccgggacgtggcactcaccgccctggccggggcctgagccaggactgcagatagagacctggagcctgtttgccttggctgccttctttccctaaagtcctggggatggatttcgatacgctttcttagagcatgttgtcctggacagtgagctacgggtctccactccattgccctgcacagccagcctcctgagctcccccagctccccacaaggaggctttctgccctgccccctcactggcatgaggcccagctccctgctctgccctgactccagctttgttctgcagacctcttcccacccccaccacagccgacgcggtgtctaggctgcggagctgcactctgttcctggctctgccctgggaggtgccccggggcggtctggggtgggcccagcattcagcaaggtccctgcaactttggcctctgcccggtgacctctggcgggtgtagaagagctcatgcttcattgagggggtggggggcaccctgaggaccctgtcaacgtcagctgaaccacaggcatctcgatagatgtaagctgggatgagggctcagcaggctgagacaggcctccagaagagggttgagtaggaagcgatttcttccagaattagttcagcaaacacatgtcatccacttggagcaggagccaggtggagtcacagggccaccaagatgaaggagactgagcccttccctgtgccaggctagtgccacggggatgctggtgggctgggagcccatccttatggaacactctgcctggtggggggggtggcaggcagggggcagtgcacagatgcttgccatgcccccactgctgtcatgttaagcagcaccgagaaaagggcgggggcaccaggtcctgcctctgaaggaggccttggtggcctcaaggagaaggcagctccctgctgctcgccctgcaagaagctggcagaagcagaggcagcccatgtggtccaggtgacacgcagccttacttggtgccacaggccctgcctctgggtggcacattcctttctttgctgcagggatggtagatatggctctgcggagtcagagctgcacttctttaggagtagccccggcctttctaagagatttgctgccctgaggcgcactggtggaaagtgactgcccgcctggtgtgggtgcagatgagtccagtgcctactctgtgtctctcttggaatgtgtgaaatggaaggatgtgacacatccctgtctccttccttcagaattcctacctggtcttagcgggcctcgccgatgggcttgtggctgtgtttcccgtggtgcggggcaccccaaaggacagctgctcctacctgtgctcacacacagccaacaggtccaagttcagcatcgcggatgaagacgcacggcagaacccctacccagtgaaggccatggaggtggtcaacagcggctctgaggtctggtacagcaatgggccgggcctccttgtcatcgactgtgcctccctggagatctgcaggcggctggagccctacatggccccctccatggttacgtcagtcgtgtgcagctctgagggcagaggggaggaggtcgtctggtgcctggatgacaaggccaactccttggtgatgtaccactccaccacctaccagctgtgtgcccggtacttctgcggggtccccagccccctcagggacatgtttcccgtgcggcccttggacacggaacccccggcagccagccacacggccaacccaaaggtgcctgagggggactccatcgcggacgtgagcatcatgtacagtgaggagctgggcacgcagatcctgatccaccaggaatcactcactgactactgctccatgtcctcctactcctcatccccaccccgccaggctgccaggtccccctcaagcctccccagctccccagcaagttcttccagtgtgcctttctccaccgactgcgaggactcagacatgctacatacgcccggtgctgcctccgacaggtctgagcatgacctgacccccatggacggggagaccttcagccagcacctgcaggccgtgaagatcctcgccgtcagagacctcatttgggtccccaggtacgtttcccgaggtgagggcaccatccagggcacgcccactgctcctgctctggggacagagcaaggggaagccccctggcttccttacaggtcatgtggggaggcaggtgctgttcttccaagagggttggtttcctccattgggaatggaagcgatcgctttagcaaatctaagagtggccgcacaaaagcttattgcctgccagagagcttaaggtgccacacaaggaaagccacagtcaactgtgactcagtttccactgagaaaattctcctctgctttgaagtctgtcccctccccataacttaatcccttagcagaaactgcatgtctgttgcctccctcccgcacctttctgcacaccggcttcactccccggagagcacggctaccgacaaatcgcttccccttctgggttttggttgcttaggcgcggtggagatgttatcgtcattggcctggagaaggattctggcgcccagcggggccgagtcattgccgtcttaaaagcccgagagctgactccgcatgggtaagactgagtggcagctcctttaggacccaggcagcagcatgagcacagaaggccctgcagccaggtcctgcacagtggctttgctgcccttccattctcccaaatagcatagccactaacgtggctgtaaggcaaagtggaaacaagatggggcccctcagacagctcctaggggctccgcactggccatggctgcctgtttctggagtacccagtgcacctgtagatcaagtaccctacctagtaccctacctaacgaatgtctccagggccagagttcagctgcaatcgacatgcagatgcatccaggtcattgattcactgttcttcctgccaagcaggaaaccctacccgaggtgtccaccagcccacacagcaccctatggggacagatgacacaggcacaccttgtcatctccaagcctggggtctcagctcctgcccttcctgggctgagacatagctcagtacctgtctgtgggtggggacccccaggattatgccagtctcctctgtgaaggtatgctgggcagggtggcctgtccgggacatggtctacatggttgcagtgatgtgaggctggcgccagctgcagctccccacagtgtttacaccccgcactttgactaccgagccccacacggtaaatctcccctacgaaaagtcctcagttcaaatgtgtgtgtgtgtgtgtgtgtgtgtgtgtgtgtgtgtgtgtgtactttggagctcttccatttcacactaggcctgtttccctgcagcatgagttatcccccatccctgggcaagtgggtttttatttcatctggagcataagagggtggagaaacaccagtcagcttgcttctcccaaagcaggacaatgacaaggacatccttggcagtcgcactcccttgcctgccagctttgaacttttgcagtgagtcctgggccagtgacccttactctgtaagtggttctggaagcaagatctggatctgctcctgagctctggcagagcctgtgggtagaagccttgaactgatggagttcccagcttgcaggtcgggcttctggaggaaatgggtgtgcagcacccaggttaggaccttggcatacctgccattaatgtcctaacgtttagctgttgtttttctcctattcatccctaaagccagattttacctctttctcgctagagggaggctcctcccctaaggggaggtcctggcaaggccacgcggagtgagaggtccctggacatcccagtttgcaggagcacctcagtgccacgcaggccgcacacacgggacacagagggaggaaaggcaattagtatgtgcttggggtggggcaccaccagggcagggaggccacactgtggcccaaaaggaaacctgtagcacacacccaccgatcctgcaaaactgtccacagtttcaaaaaatgtatatagtgatgactttggggcagtaggttttccatttaatatatgatcctgtatttcctaagcctgtagaaacagaatgagagaagaatcttactgagcttagtggcaagggagttgagttaaactcggtcatgagccattcacaagcagaaatttgggtcagtggtgttttctggacgctttgggagctgagtcaaggatgcatgatctgattgcctctgtggccttccagggagtctgactcttacagacaaagcccatggacgcgaactcatgcccacagcccgtctttggactttataaagcctaagcccacaggctggccactggggagaagtggtgcatctcagcacaccccagagagggctggcaagcagacacactcccctgcccttagccagctccgccttcctcagaaggcacagggggagggtcccaaccccacccgagtgggaacccctgtgagtttcctcagacccccttctctctgcagggtgctggtggatgctgccgtggtggcaaaggacactgttgtgtgcacctttgaaaatgaaaacacagagtggtgcctggccgtctggaggggctggggcgccagggagttcgacattttctaccagtcctacgaggagctgggccggctggaggcttgcactcgcaagagaaggtaattcctgtggaatgactgtcacacatcagagctggctggcccggggctgcagcctgacccctctgccatcggcctctagttctccaaggacctagaagacagatggagttctcccctgaactccttgctgctaagaagtgctgagaagttactcgcctggcggtggctccagggttctctggttctctggagcagagttctctgaataccccatcccccaactgctgattttacagccccagggaagacagtggtatcaggctgggagcggcctcctctggcctcccccatcagtttgcaggagcaggggtgcaggatcctgttctgagctgggtcaaacaaagcagggccgggccttcctgccatccccaggtctcagatggaattacactagaggccctccgctgggaagcacttgaggtagggcaggaggggggctgtgacccctgccctttccccgccagagacctcaggctctcagcacattccacaggctcctgagtccccgaggcctgggccagcttgggcaagccaagatcagatgtctctgtgttcgggaaggtctccgtgtgggaaagcccttgggggatcccgggtgaggagtgttgccccatccagagaatgaatgagttcctttaagtgccaccgccagcaagcccagaggcacacagtccgagtgcacccgcttagcctttacattcctctccaccgacaaaaggaaggggaaactcaatcagcaggacttcagaaagggccttgtgtttatagctttgtcaagtaaatttggacgcagctggagcacaggccctgtttgtttgcacataataatcttgtttatcactttaaaaaattcagtaatatctcagcagtcaggcttctggttgtgaaatcacattgtatgggatttataccaaattatgtatttgctaaacattcactgcacacgtgtacagcggagtacgaaaaggaacgttgtccacaggggatttatggatacaacagcaaacattttataaactatgcacatgcattacacacatgcacacacatatgcacacacatgtgcaaacatagccacttttttgtcaagagttaccctttggggctccttaaaccagaatgggagtttgaaagagagatcatactccagctgaagtttgttgacccttttctaaaattaaaaagatcaaatttagtatttgctggatatgcagggagatgagactcttttaatctcaaaataaacagattctttcaagaacgaa

SEQ ID NO: 11740 - DNA, 18287 bp, Homo sapiens
cagtacttcgacatggaagactgtgtcctgacggccatcgagcgggacttcatctcctgccccagacacccggacctccccgtgccgctgcaggagctggtccctgaactgttcatgaccgactgcccggccaggtatgccccgaaggccccctcccagaacacagtgcaggtcacagggggcgttcctcgctgtgcagttgccgagtgatctccaggaagacccctctggggcgggcaggtgccccggccatggcttcccaccaatctcagtaccttttaggttcccatcctcggctgcctgaaaggaaccaggctgccggctttccattttggaggccttgataggcccaactgggaagagtgctttgcaagtgcagccatcctgcctccccatacggctcccccttcccctcgtagccagagctgctctctcctgagctgcctctcctttccactcctacctccccaccagctctagggccagcagataagtgcagccagtgctcctcaagcattcaggaaggggagagaagggagagctcccacccagagccttgtttaccttctttgtcaaacgctgactcctgtctgtagccctagcgctgagctcccacccagagcctcgtttaccttctttgtcaaacgctgactcctgtctgtagccctagcgctgagccttggacccctcaaatctgttcttagagtttattgtacctatgctaacccaagatcataactagagagagaatcggggaggaaataggaaacgtcacctttcagaagaaaacttccaaaggggtcctttctctacggccaccacttctgtggggttcaccctgtgccagccatcaccacctctgaggccgttcctgtcctgagagccctctgtacagaggagactgaggcttagcaagcctgcataacctacccaggtgtgctcacccacaagtggcagggccggggtggcccagatctgtccagcctcacagatggctttgaaccatgactctcggccgttggggcaaatgacccagcccaggacccacccgcatcagggcgggggggatgtggctgatgccgggcgtgtgtggcaggctcttcctggagaacagcaagctggagcacagcgaggacgagggcagcgtcctgggccagggcggcagtggcaccgtcatctaccgggcccggtaccagggccagcctgtggccgtcaagcgcttccacatcaaaaaattcaagaactttgctaacgtaccggcaggtaagcgggtcccaggttggtgctgtttttctcagacatatgctgcccgggtctaagctctgtgcggccttagagaggcctgaggctgcaggcaccccatgtcctactggctgacactgcgctgtccctggcagacaccatgctgaggcacctgcgggccaccgatgccatgaagaacttctccgagttccggcaggaggccagcatgctgcacgcgctgcagcacccctgcatcgtggcgctcatcggcatcagcatccacccgctctgcttcgccctggagctcgcgccgctcagcagcctcaacaccgtgctgtccgagaacgccagaggtaccgcggcgcgccgccccacccggccccggagaccgacagagccccgggcgcctcctgcctggcacggggggtagagcctcaggtggccttggcaagcccagggcacgcccaacccatggctcgtgtgaccatcccctggctgcgaggccaggctccccgccaggtccagtcactaggcagagccttggcgaggacgggggagcgcacactctggagtcggctaagaccaggctctgccgcggtccggaaagccgctgagtttatttgcctgtaaaaggaggatggtaacaggcctcgctgggagggcaccgagcacgggagctgcattgaatcactttcccaactgcacacgtacacggctgctgagactctgagaccgcagggtcagtgggaccatattttaacataaaatgtcgaagtaatttaccttgagaaaagagcagctaaactccagagtggccagagggtgaaaggtagctgtcttttgactaaggaagaagaaatgctatgaaaatcaatcacttctgcctcaatggaagataattttttaaacagaattctttacttttttttaatacaggatctcactttgttggccaggctggaggacagtggtgcaatctcagctcactgcagctttgacctcctgaactcaagccatcctcccaccgcaacttcccgagtagctacaagcacacgccaccacacccagctaatttgttgttgttgtttgtagagatggcctttcaccctgttgcccaggtcgttctcgaactgtgagctcagtcgatccccccactttagcctcccaaagtgctggaatcaccggcatgagccacacgcccagccaaacaaaatgcttctacttgcctctcacccctttacgtaggacagccttgacctgaggtgaactctagagatttcgaacccttgctcattcagcaaaatgccagcaattccaggaataagatatcaggaatgaagctacagcgatgagcatttctatcctaaatactgtttcacttaaccaggccattctctgtcctttatggcagtctggtgaatagtgagaatgtgtcaatggaatataaagtatctaagggccaggcgcagtggctcacatgtgtaatcccaacactttgggaggcccaggcgggcaggtcgcttaaagccaggaattcaagaccagcctggccaacatggtgaaaccccatgtctactaaaaatacgaaaattagccaggcatggtggcacgcgcctatagtcctagctactcaacttgggaggctgaggcaggagaactgcttgaaccctggaggcagaggttgcagtgagccaagaccatgccactgcactccagcctgggtgatagagggagactctgtctcaataaaagaaaaaagaaaaaaaatcataaagtatctagggagatcggaagacaaaaagacagttgttatcatgataatttgattctatcaaaactgaaattttgatacatttgaaaattgtttttctttgcaagattcttcctttatacccctgggacacatgctcacccaaaaaatagcctaccagatcgcctcgggcctggcctacctgcacaagaaaaacatcatcttctgtgacctgaagtcggacaacattctggtgtggtcccttgacgtcaaggagcacatcaacatcaagctatctgactacgggatttcgaggcagtcattccatgagggcgccctaggcgtggagggcactcctggctaccaggccccagagatcaggcctcgcattgtatatgatgagaaggtacgtgcctggatcccctggcccagccccacagtgtaggagcccagccctcaggctagccgggcagtcctggaggcacctgaagcttcggggctcagcatccccaaaagcacatttttctcactctcccttgctcaatgagggaggttctggcttgaaccagaagggtgcaggggcctgtgtctgtctgcttgtagcaaagttgacttctccttagcatcagccttctcagaccttgattcagtaacattgtagaggctgtaaacagcagatgaagagtccaagagagaaacaggtctggatttgggctccaactcacatttagatgtccacagtgaggacacaggaccagccttgcagggcactcaggaggagcagacagaataaggacggtaaagacccttggccttaagtcccggccacagggtgctggccaagttgaatgccaaaccaggagaagagtgaaagagcaagctggcatcccctggcaactgcactgccagcctcagttgagacaatgactaaatgttgatcttctgataacatttatccctgatggctacttggtagatgcaggcacacacacaacttgaagtcatcttaccacgcatgtattacatctagtgccagccttgttaattgatcacccagcattaaaattcccttgtctataatttcttattatctggtgattctacagatggtcattgactaattcctgtaggaatgacctgtgcatgtatggattagctcagcacctgtggttgttgcccatagaaaaggcaaatcagagcaacaaaaataagagcttcataatagtagctgacttcaacaaggaggtcaccttgaaactcagattatcatggaaacattcacattaaaaattctcaagtctatctatctcagtcattctcctgctaaaatgttatttcttgacccttataggggtctgtataaatttttccttgctggacctttttgattatgaaaattagaggagacaacatgttgtgatccaggagacgctcctttttttatgagttgcaatacataacacttttagtaccaagcacattaagctgagggtgtgtgttttcctgccttgtcttggtactcaagaataaggaccatgacatccttggagtccttaatcagtgactaacagcaagttctcagtgtgttttattggatggaaggatggatcgatggatagatggatggatgggacaatgggcaaatggacaatatggtgggaagtcagatggatgggtggatggaaaagaggaaggataggaagacagatggataaatgtgcaggacaggtggtcggatggatagatggatggacagatgagaagaatggataaatgtacaggaagacaagcaaatggatggatgggtggatggatggatggaaagaaggaagggtgagaaaatggatagataaatggatagaagagaaagtggtcagataggtggatggataaatggatagagggacatggtcaggtggtttgttgaatgtttgttttccttgtctaattgtgtctccctggtccctccacctgagggccaccttgtgaaggccactgggcccaggcagcgacctgacttggcttgttctgtgcccaggtagatatgttctcctatggaatggtgctctacgagttgctgtcaggacagcgccctgcactgggccaccaccagctccagattgccaagaagctgtccaagggcatccgcccggttctggggcagccggaggaagtgcagttccggcgactgcaggcgctcatgatggagtgctgggacactaagccagagaaggtacttggggacacagagcccagggcctgggacctcctgccatgtgaggaagctgtgggtccccagggggtgtgtgcctggctgcccaaccatcaccattggcaacccttctctgctcatttcttctagagggtgatgtttgctgctcctaacatacctactttcattgtctttgtgtgtgcgtgtcactcttacgaaacaaacttccttttcctccccgacttttgtgttacttcaccgtgcaaacaaagtatataaacccctttataacaatacagtccctatgcaagaacagagagaatgtgggtgtctctttgtaaagtgatggggaaaaggtttcgttgtgagaatcagggatcatattacagtgttcaggctagttttttgacggtggtgtttttgtgtttttggaagaggctagtggtttcaaagttaaaactcatttattaaatcagacagagctagtttaatgtatggggagtaaacagggtattctttagaagaacgcatgtccttatctgggcatggtgacatggacttatagtcccagccactggggaggctgaggcaggaggatcacttgagcccaggagttttaggctatggtgcgccctgatcgcacctgtgagtaggttctgcactccagcttgggcaatatagtgagatgaagagtgtatgtccttgggcctgggttggaatacccagggttcagctaacctgaccagatgagcttaaattgccgtagccaaaggtgacccagatacctggatgggtttgctcctgacgtctgaagctgtttcagcctcttgtttggatctagtctgaatgaacagaatccctcattcctccctggttggggctggctgatctcatgggcagaacgggcaccaatccggttgtaagtgaccttgctctcttctggtggcttctctccctcagcgaccgctggccctgtcggtggtgagccagatgaaggacccgacttttgccaccttcatgtatgaactgtgctgtgggaagcagacagccttcttctcatcccagggccaggagtacaccgtggtgttttgggatggaaaagaggagtccaggtaagctcctgcgggctgccctgccccctttgtatttggggtgggaggccgccgtggaatctgggaacacagtcgatgttgaccacagtgagaattatttagcagacggtagggtccagaacctggttagactgcactcaagaaagagcagggagagcagaagaaagtccacacaaagagacgtgcatgtatggttttgtggttaagagatgccaaaaatgggtagtatctgccagggtgtctggggacgtgagggcactgtggcatgtgcctacagtcctagccactccagaggctgaggcaggagaatcacctgagcccaggagttcaagtttagcctgaacaacatagcaagaccccatcttttaaaaaattagaaaatttaaaacatttttaaaaacgaaatgaggcctgtcggcctggttatgtgactttctcaagcatgttctgctgccccagattgcagaaggggcaacgggggggggcgtctaaacagagttggggttttgccaaagggagagaggggcagaggcattggggtgttttcaagggagtgatacagagatggaccaaggaacctaagtgaggccacaaattcagggagcacaatgcaaagtactaaaggatcctaggtattgccagagttaaaaaaaaaactcaagagttatggtttcaggtgggatgagccgaaaaactaggaggcggtggccagacaagacgtgcttgccgtggggtgggtgggaggcgcacagtcggtagtaaagacggcatctggagtgtgacctttggggaggatgcctggggtagagtgaggaatgagcttgagacataataagataaacggaacagacttcgcagtttctcttaggtcagtctttgtgagtttgcgtcaggttttatgccactcggactgagggttgtgacacagacgtactctaagaaatgatgctgtaaggaagtttttctgaccaggccttgtggctcatgcctgtaaccccagcactttaggaggctgaggcaggtggatcttttgagttcaggagtttgagaccagtctaggaaacatggtgaaactttgtctctacaaaaataaataaataacaaaaattagctgggaatggtggcgagcacctgtagtccctgctactcaggaggctgaggcaggaggattacttgaacccaggagtttgccactgcagtgggtggtgattgtgccactgcactccagcctgggtgacagagtgagaccctgcctcagaaaaaaagagaagttattccaaaacacagcgatggagcacgccttcctgatgggatgtactctaaggacaaaacaaaaagcaaacatattaattaaacaggtttcagtaattatattgttggcagcactgttatgattgttactctaagatgctgcttgtggttgtggagtcagttaatgagtaattatgttgctgttgctggaaacatgagctaaaggggaaagagatgtaaagtcgggtaagtaaaagcctgcagttctgaatcgattggatagactcgtgacatagttgaaaaataaacacaaatatctcagttctgctcactgaaaaggcctaaaaacaaggaccaaccaaatgccaatatgcacccctaggacccagactgtggtctctaagtaccaaagtgaaccagggctcatcagaatcatggcagagtccaggtccggggcagggagtgcacctggaacatctgccaccctagaagcaaggacatcgtcagacttctgagggtgaattggaggaccttgggccagactggtcctgggaggctgggccgggccctgccctgctggcctagagacacacacgcggcaggtacctgagacagttccgctcagggctctgaagactcatcccagagggaagacagaggcctcttcctgtgacctgtgaaggttctttaaaactcactgcggcctgaagagagactcactcacaggaagggaggagggggctggctgggagcacacgggcagccaagcaggggagccaggatggaaccggacttgacttgagatctgtctgagaattaaggaaggaaaggaggcaggagaggcagggcagacgagcaggtaaacaggatacgcctaggacacaattccagttgcagggaacaggggcaattattctttatgactctctatatttttaactgtttgttttcaaagtaaaagctattcaaatatcttagttttgtttttctgatgcataaaaaaatgatgggaaaaggagacaaatacacctgaaggaagtttttgtttgctgtattttctaccatttctatcatctgcaaatacgttatcagtcaacagctttttaaaatttggtggcaggagaaactttatattgagaactgctatccgcgagcttaacatattctcttgagtctgagggacagagctgcgtgatgcggggtacataacttcccagccccatcagcttcagcctcctctgccatgcagtgagtgctcaggatgcccgccacagcctgaggggagacagcgatgccggggacagccggcctggtgagccaaggctctcgcaaatgacaagccattagttctcagagcactcgtgctgggagcacattttgagtgcccccccgccccaacccaatctcctctggaattctcccaacttgtctttagccctggctttgtctactctacagtgaggagctccccgcataacaggggcgggcaggatatggccggcgggagggcccctccttcgtactgggggcaaccgtctcaaccctgaggggtcacggaaagaggacagcctttcttctctggcgaatgcccttcctgcgggcgacggtcaagcattacccttcgggcagaacccggctctgccctctcagaacacaggatgcaaccctgggtgggagcaggggaggtagacgaggctcgcagctggcaggccaggctcagggaaaggaggcagcccctggcccccgggcactgacagcacagtttctgccacttacaggaactacacggtggtgaacacagagaagggcctcatggaggtgcagaggatgtgctgccctgggatgaaggtgagctgccagctccaggtccagagatccctgtggacagccaccgaggtaagcactgcccgcaggcctgcccaccgaggtaagcactgcccactgggtgcagccctgggtgggggccacattcataaaaatacaggacgccaggtcaagtgaactttcagataacccccagcgcatccccgtgcagtccccaagtaatgccaggagccccgagaagtagcagcctgtcaccaggggcagctcaaccctgcctgctgctggctggaggccgggatttgcgatggtgaggaccagatgtagaccctcagcaggagacgagacccaggaggctagggacgtgcctgtgtttcccataacactgctagtcactcagctctgaaggcctcttgccttcacatcagggaaatcagggaagtcactagaaggcccaaggaggggtcttctgagaagtcccgagacaactggccaaacacaaatgttctgaggcaggctaggcacaggggctcacgcctgtaatcccagcactttgggaggccaagataggaggatcacgaggtcaagagattgagaccatcctggccaacatagtgaaaccccgtctctactaaaaaatacaaaaattagctgggcatggtggtgcgtgagtgttcccagctactcaggaggctgaggcaggagaatcggttgaacccaggaggtggaggttgcaatgagccaagatcgcaccattgcactccagccttgcgtaccacttaagcctcagaaatctcagtgttaagaaacatctgacaacagattagccgaagtaggtgcagcccagtcccaggcatccaagagatgctcccacaacatttcctcctagaatgggcgagagcaagggctctgcctaaagcgtgctgttgcatgggaagaacagtgaacatttcctcctagagtgaggaaagcaagggctctgcctaaagcatgctgtctcacatgggaagaacagtgagaagacagcattgcggcgtgagtccactttgccagtaccaggtgcacacacaaataccacagagaacttctgagaggctgtgcccccagatcccaatgttggttttctctggggaatagatgacgggctattttctgtttcctctttagactagtctgtctttttcaacgtttctacaaagagcagaaatccataaacaacccaccagaacgtgtcaatccatgtaactttccaagacccataggggatccccaagtccaagtgcatcctcatgggaatggcttgggaaatgccagacactttccagcctgggtctcacagtggacctgtctgcctctgcaggaccagaaaatctacatctacaccctcaagggcatgtgccccttaaacacaccccaacaggccttggatactccagctgtcgtcacctgcttcttggccgtgcctgttattaaaaaggtgaggtcggggcaaaggcaggtatgcaggtctctgatgcacttccacgcctaggaggcgtctcctagctatgtcagggtggcgcctgcagagccacacctaggaccacctggcctaggacgtagacttagagacggtgggaggaaagatatcagacctggtccgtcattagtgccttccggtttgcaaaaacctaagtcaagtccccagccagactgcaggccgaatgaaaaaccccctttcacatgcaaatgccctgactcaggtggaaggactgttggtacaaatggcacggtgagcagtcatgcgtgtgcccttcccctatccggagcctcttccccacctgcccaggccagagccacctcacagccacttgatcaccaggtcctggaggtcctgatctccctccctccatctctgcctcccgccaagtactcgccgtcttacaccagacgcagtttctctttgtgcagcatagccctgcagactcagctctttaacctcctagccctggcctttctaaatgagaccccaaggggcactctccccattaaaggcccagccagctgtgctgcaccttgggattagccccagcctctatgaggctggcctccagtccctgctgggcccggcaccctccccacaaagcaccccactctgtgctgggcccttgacatcccagcctcctccaggaacagcccctccacgcacctcttcccagacggcctccgattcagttctcaagacccggggccttgtcccctcctttgagaagctgcccctcagtggggggcagctccctggcttttccgggctcctccgcccacaggattcaggcacggctcagccagctctggtttcatccaccctgaggggcctgtctgtgcataggcgccctcactaaatgcacaagaagcctttactggtgttgctttgttaaaatgtgactgtcatcatccaattccagtttgcccatctacaaaacaggtataagaagagacagaaggcctagcatacccaaaggtctaggccggtgtgcttggtaaatgagtattattattacttctggatggtcgcaaaatacatgaactcttctcttcacccttcttcagtttcatttaaaaaaaaaaaaaacaggtatgaaatgaaccttagagtcatttatgaccatggccccacagcgaggctacgcagcttgggaccaggcccgtaccagagcgcaggagaacacgacacaaagtgttattgaggccaccgctggcgagagcccccagccagggcaccacctcctgcacgaccagagggaataaagcctgctctgtgcagggcctcctgggcagggtgtctgccccctccaaggccgccagcgcgaagcctgcattcttgcacgcgcacccacgttcacacccagccgggacgtggcactcaccgccctggccggggcctgagccaggactgcagatagagacctggagcctgtttgccttggctgccttctttccctaaagtcctggggatggatttcgatacgctttcttagagcatgttgtcctggacagtgagctacgggtctccactccattgccctgcacagccagcctcctgagctcccccagctccccacaaggaggctttctgccctgccccctcactggcatgaggcccagctccctgctctgccctgactccagctttgttctgcagacctcttcccacccccaccacagccgacgcggtgtctaggctgcggagctgcactctgttcctggctctgccctgggaggtgccccggggcggtctggggtgggcccagcattcagcaaggtccctgcaactttggcctctgcccggtgacctctggcgggtgtagaagagctcatgcttcattgagggggtggggggcaccctgaggaccctgtcaacgtcagctgaaccacaggcatctcgatagatgtaagctgggatgagggctcagcaggctgagacaggcctccagaagagggttgagtaggaagcgatttcttccagaattagttcagcaaacacatgtcatccacttggagcaggagccaggtggagtcacagggccaccaagatgaaggagactgagcccttccctgtgccaggctagtgccacggggatgctggtgggctgggagcccatccttatggaacactctgcctggtggggggggtggcaggcagggggcagtgcacagatgcttgccatgcccccactgctgtcatgttaagcagcaccgagaaaagggcgggggcaccaggtcctgcctctgaaggaggccttggtggcctcaaggagaaggcagctccctgctgctcgccctgcaagaagctggcagaagcagaggcagcccatgtggtccaggtgacacgcagccttacttggtgccacaggccctgcctctgggtggcacattcctttctttgctgcagggatggtagatatggctctgcggagtcagagctgcacttctttaggagtagccccggcctttctaagagatttgctgccctgaggcgcactggtggaaagtgactgcccgcctggtgtgggtgcagatgagtccagtgcctactctgtgtctctcttggaatgtgtgaaatggaaggatgtgacacatccctgtctccttccttcagaattcctacctggtcttagcgggcctcgccgatgggcttgtggctgtgtttcccgtggtgcggggcaccccaaaggacagctgctcctacctgtgctcacacacagccaacaggtccaagttcagcatcgcggatgaagacgcacggcagaacccctacccagtgaaggccatggaggtggtcaacagcggctctgaggtctggtacagcaatgggccgggcctccttgtcatcgactgtgcctccctggagatctgcaggcggctggagccctacatggccccctccatggttacgtcagtcgtgtgcagctctgagggcagaggggaggaggtcgtctggtgcctggatgacaaggccaactccttggtgatgtaccactccaccacctaccagctgtgtgcccggtacttctgcggggtccccagccccctcagggacatgtttcccgtgcggcccttggacacggaacccccggcagccagccacacggccaacccaaaggtgcctgagggggactccatcgcggacgtgagcatcatgtacagtgaggagctgggcacgcagatcctgatccaccaggaatcactcactgactactgctccatgtcctcctactcctcatccccaccccgccaggctgccaggtccccctcaagcctccccagctccccagcaagttcttccagtgtgcctttctccaccgactgcgaggactcagacatgctacatacgcccggtgctgcctccgacaggtctgagcatgacctgacccccatggacggggagaccttcagccagcacctgcaggccgtgaagatcctcgccgtcagagacctcatttgggtccccaggtacgtttcccgaggtgagggcaccatccagggcacgcccactgctcctgctctggggacagagcaaggggaagccccctggcttccttacaggtcatgtggggaggcaggtgctgttcttccaagagggttggtttcctccattgggaatggaagcgatcgctttagcaaatctaagagtggccgcacaaaagcttattgcctgccagagagcttaaggtgccacacaaggaaagccacagtcaactgtgactcagtttccactgagaaaattctcctctgctttgaagtctgtcccctccccataacttaatcccttagcagaaactgcatgtctgttgcctccctcccgcacctttctgcacaccggcttcactccccggagagcacggctaccgacaaatcgcttccccttctgggttttggttgcttaggcgcggtggagatgttatcgtcattggcctggagaaggattctggcgcccagcggggccgagtcattgccgtcttaaaagcccgagagctgactccgcatgggtaagactgagtggcagctcctttaggacccaggcagcagcatgagcacagaaggccctgcagccaggtcctgcacagtggctttgctgcccttccattctcccaaatagcatagccactaacgtggctgtaaggcaaagtggaaacaagatggggcccctcagacagctcctaggggctccgcactggccatggctgcctgtttctggagtacccagtgcacctgtagatcaagtaccctacctagtaccctacctaacgaatgtctccagggccagagttcagctgcaatcgacatgcagatgcatccaggtcattgattcactgttcttcctgccaagcaggaaaccctacccgaggtgtccaccagcccacacagcaccctatggggacagatgacacaggcacaccttgtcatctccaagcctggggtctcagctcctgcccttcctgggctgagacatagctcagtacctgtctgtgggtggggacccccaggattatgccagtctcctctgtgaaggtatgctgggcagggtggcctgtccgggacatggtctacatggttgcagtgatgtgaggctggcgccagctgcagctccccacagtgtttacaccccgcactttgactaccgagccccacacggtaaatctcccctacgaaaagtcctcagttcaaatgtgtgtgtgtgtgtgtgtgtgtgtgtgtgtgtgtgtgtgtgtactttggagctcttccatttcacactaggcctgtttccctgcagcatgagttatcccccatccctgggcaagtgggtttttatttcatctggagcataagagggtggagaaacaccagtcagcttgcttctcccaaagcaggacaatgacaaggacatccttggcagtcgcactcccttgcctgccagctttgaacttttgcagtgagtcctgggccagtgacccttactctgtaagtggttctggaagcaagatctggatctgctcctgagctctggcagagcctgtgggtagaagccttgaactgatggagttcccagcttgcaggtcgggcttctggaggaaatgggtgtgcagcacccaggttaggaccttggcatacctgccattaatgtcctaacgtttagctgttgtttttctcctattcatccctaaagccagattttacctctttctcgctagagggaggctcctcccctaaggggaggtcctggcaaggccacgcggagtgagaggtccctggacatcccagtttgcaggagcacctcagtgccacgcaggccgcacacacgggacacagagggaggaaaggcaattagtatgtgcttggggtggggcaccaccagggcagggaggccacactgtggcccaaaaggaaacctgtagcacacacccaccgatcctgcaaaactgtccacagtttcaaaaaatgtatatagtgatgactttggggcagtaggttttccatttaatatatgatcctgtatttcctaagcctgtagaaacagaatgagagaagaatcttactgagcttagtggcaagggagttgagttaaactcggtcatgagccattcacaagcagaaatttgggtcagtggtgttttctggacgctttgggagctgagtcaaggatgcatgatctgattgcctctgtggccttccagggagtctgactcttacagacaaagcccatggacgcgaactcatgcccacagcccgtctttggactttataaagcctaagcccacaggctggccactggggagaagtggtgcatctcagcacaccccagagagggctggcaagcagacacactcccctgcccttagccagctccgccttcctcagaaggcacagggggagggtcccaaccccacccgagtgggaacccctgtgagtttcctcagacccccttctctctgcagggtgctggtggatgctgccgtggtggcaaaggacactgttgtgtgcacctttgaaaatgaaaacacagagtggtgcctggccgtctggaggggctggggcgccagggagttcgacattttctaccagtcctacgaggagctgggccggctggaggcttgcactcgcaagagaaggtaattcctgtggaatgactgtcacacatcagagctggctggcccggggctgcagcctgacccctctgccatcggcctctagttctccaaggacctagaagacagatggagttctcccctgaactccttgctgctaagaagtgctgagaagttactcgcctggcggtggctccagggttctctggttctctggagcagagttctctgaataccccatcccccaactgctgattttacagccccagggaagacagtggtatcaggctgggagcggcctcctctggcctcccccatcagtttgcaggagcaggggtgcaggatcctgttctgagctgggtcaaacaaagcagggccgggccttcctgccatccccaggtctcagatggaattacactagaggccctccgctgggaagcacttgaggtagggcaggaggggggctgtgacccctgccctttccccgccagagacctcaggctctcagcacattccacaggctcctgagtccccgaggcctgggccagcttgggcaagccaagatcagatgtctctgtgttcgggaaggtctccgtgtgggaaagcccttgggggatcccgggtgaggagtgttgccccatccagagaatgaatgagttcctttaagtgccaccgccagcaagcccagaggcacacagtccgagtgcacccgcttagcctttacattcctctccaccgacaaaaggaaggggaaactcaatcagcaggacttcagaaagggccttgtgtttatagctttgtcaagtaaatttggacgcagctggagcacaggccctgtttgtttgcacataataatcttgtttatcactttaaaaaattcagtaatatctcagcagtcaggcttctggttgtgaaatcacattgtatgggatttataccaaattatgtatttgctaaacattcactgcacacgtgtacagcggagtacgaaaaggaacgttgtccacaggggatttatggatacaacagcaaacattttataaactatgcacatgcattacacacatgcacacacatatgcacacacatgtgcaaacatagccacttttttgtcaagagttaccctttggggctccttaaaccagaatgggagtttgaaagagagatcatactccagctgaagtttgttgacccttttctaaaattaaaaagatcaaatttagtatttgctggatatgcagggagatgagactcttttaatctcaaaataaacagattctttcaagaacgaa

SEQ ID NO: 11741 - DNA, 1086 bp, Homo sapiens
ccccccactcttttttttttttttttttttttttttaccaacctgggcaccaagtcccagggggctgagggtctgtgcttcctgtctacctccctgccattctctcaccctcatcccacagcagggtctcaggagtcccactctccctctcctctcattccagtgccccacaactgcccagttaacccccagatgcaagccagattccatctgccccaggccccaagcttttgctttggcatcacgcgaggccaggctgctttgcaggcaccaaaattcaccctctcctactcctggaaaagcccagccccaggcctcacagagccaggggaggggatctcatcacatcacagttagaaatcatacaggcctaaagtcccagctacccaggagccaaggcaggaggaacccttgagcctgggagttggaggttacagtgagctatgatcacaccagctttctagcctgggtgacagagcaagacccaactcttaaaaaaaaaaaaaaaatacaggaaatgactaatgaacttgactccatgaaattgaaacttacgtggaaaattagtccaaagcctaaaagactagcaactgagaaaaaaaaacattgcaacacaaatgagagacaaagacctcacttatcttcattacagagagttcgtaatgtcaataagaaacagaaaaccggaaaggcaaacaggttaagggcatgggcagcaattgaattacaaagaaacagacagacccttaaacatcaatgcttgacctcacccaacagcagggaaacagtctccacaacagtaaaatgttgctgggatgggcccagcattcagcatggtccctgcaactttggcctctgcccagtgacctctggcgggtgtagaagagctcatgcttcagtgagggggtggggggcaccctgaggaccctgtcaacatcagctggaccacaggcatctcagatagatgtcacttaccaccctcatgttggcagagggtggtaaccagccagcatctccttcttaaacacctactaagtgtcaggcactgtgaccggagacacagtcaagaatctctgtgtttttttt

SEQ ID NO: 11742 - DNA, 1086 bp, Homo sapiens; identical to SEQ ID NO: 11741

SEQ ID NO: 11743 - DNA, 421 bp, Homo sapiens
atgcctgcatcccagacagcatcagggaaggtggctaagaggcagtggcagaatgcactcaggatacacattccagatcccagggtctggtctctgtcagggttggggtccttcacactgttggcaggaagggtgacctacaaggaaaaaaggcttagaaaggagccctcggagaagtcagctgggtgtgcgtgtcatggtgatttgggaggcacttggctgtctaagggggcccttaggcccatgtgaacccttctgggcactttgcagctccccaccagccagtgttccccacacagcaggtgctgggcagtttgacaggtgggtcccttagacagtcacctgagatggaaagggctctggtgagcacctgagacagatcgcctggagccagcatccccagccaggggcccctcccaac

SEQ ID NO: 11744 - DNA, 20020 bp, Homo sapiens
cgcagcttcccgaggctccgcaccagccgcgcttctgtccgcctgcaggtagggagcgttgttcctccgcgggtgcccacggcccagtatctctggctagctcgctgggcactttaggacggagggtctctacaccctttctttgggatggagagaggagaagggaaagggaacgcgatggtctagggggcagtagagccaattacctgttggggttaataagaacaggcaatgcatctggccttcctccaggcgcgattcagttttgctctaaaaataatttatacctctaaaaataaataagataggtagtataggataggtagtcattcttatgcgactgtgtgttcagaatatagctctgatgctaggctggaggtctggacacgggtccaagtccaccgtcagctgcttgctagtaacatgacttgtgtaagttatcccagctgcagcatctaagtaagtctcttcctgcgctaagcaggtccaggatccctgaacggaatttatttgctctgtccattctgagaacccaaaggagtcctaaaagaggaatggaggagcctaagaataaaaatagtataataaaacatttcttagacacattgaccttggcctatgtcaaagttcagtctgggtttgtcttataacacaaggagtaaaagtaccattgttctacctctttttttaatacttgaaaaaaatttactgtggatgcttttctatgaattaaataaccttctaaaaaatgttttcattgctgcattcgattagattgggtaactaaatgaaattaattcctcactgttgggtataaaggttatttacagtggttctgtcttagccattcactgaactcattgcatatatatctctggaatattgctgattgtttccttcaagtaaacttagaagtgtaactacttagtcaaagagcctgaatattttaaaggccttttgaagaaaactgaaaatgctttccagaaaggatgtatcagttgacaatgatagtcgtcaacagtatttaaggagaactatgatactctgaagaaaaacttagcctttctcagtaaaagtaggtaggcagaggccacatgacagcagttagagtgtggtcttcaaggaagtcacagaaatactgtggggaattgaaaccccatgtggaaaatgtacaagagtgtctcagtgtgactgagaaggaggttgggcatggggtttcatggagtttaataaagtttggtcacttagtagaggtttaataaatcaactgtcttaatctttgatcctacttaagaattttttttttgtttttgtagagatggggctcttgttatgttgcccaggctgttctcgaactcctagcctcaggcgatcctccctcttcaggctccagaagtcctgggattactggcgggagccaccatgcaggcctcttgctcctacttttgagaaaggaagtttaaccggttttttttgtcttttttttttttttttttgagacagagtctcactctgttgcccatgctggagtgcagtggtgcaatctcagctcactgcctcccgggttcaagtgattctcctgcctcagcctcccgagtagctgggactacaggcacctgccaccacgcccagctaatttttgtatttttagtagaaatggggtttcaccatattggccaggctgatctcgaactcctgacctcaggtgatccgcctgcctcggcctcccaaagtgctgggattacaggcatgagccactgctcctggctgcttaactttttctctatctcatcctcctacccatcctacccttggaagatagagaagtagtattagttccatagtgttatactgggcttcccccagggacaaacccacttccccaacctgaatgagccatcacttcttccccagtttacatttcattgctctttaaatgtctccattcggatatgggaattcacatatggtcataattcttacctgaagaagatgtcagtcttcttctcttagaccaactgccctgatatgaggtttagaggttaaagaacatgtgtgtatttacatgatctttgtattctgccttttcgtccctcactaatgacagctgcaccccaaggaaatggagctgtggaagagagggtttgataagaaattaagtaaatattggatctaatccatcaccctccaggaagcctttattactcctaaaaatttcaaccaaattcattaaaggacaagaactccaccagagtaggccataaacattggcaaaattagttgtaatccatgactagatttaatgtccctttgttttattcccatatggttataatgctttgcttggcattaggggtattttaagttttcttctgcctagtaagtgaatttgtgtttataatacaataatcataaaatatcacattaatattttataactgtacagttataaaatattttataagtaatatttatattttataagtaatattttataactgtacagttaactctggcccaaggaaaagatagtctgatagatgctgcagccccattttagcaaatgtgacctcacaggcctgaatgccatcgctattccacatctacaggatagacggaaaggagagaaataaaaaaataggtacctaaccctggcaagaggatgatgactcatgttatttcacttaacctttttatcttttaacatgaagggctcatacaggttgataagaaaccagtgacataaacagaccaaaaaatgatcagatctttcaaattagcaaaaaaataatattttttaaacaatgggtgaaaatacagtgtaacagtaccaattatcaacatgtgtcgagaaccagaaaaatgttctttttctttgatcagcaacactatttgggaaaatctatcctcagggcctagcctggggccctggcacacagtaggcactcaacgaatatttgctgaacacacaaatacttatgatattttaaaaaattggcaacaatctgatacctaacaatagagggattaaatattatggaactgttaaataagatgcttatgaataccatgcagtaagatgggcaatatttatgccataagctttaatgaaacaaatgggtattaaatgtatgataaggttataaattactttttaaaagattacagggaaaaaaattgaaagatatacactgaaatgttttttgctcacagtggtgacaaggtttctcagcactggcactgttgacgttttaggctgtatgtctttgctgtgggaggctggcctgtgcactgcagggtgtttggcagcactcttggcctctgcccctagatagcaatagcagtcctccctcaaccagcccaattttgacaaccaaaaatgtttccaggcatcaccagatgctccctgggtgagagtgatgaaacagtaggggattttccccttcttttcttattttctgtaattccattatattactttaataataaagaaaaaaacataaaaaataaacgaatgttattattctacgtcagtttggatgtttggactccattttggggttctttccattatatcacttggtctgctaaacattctacggtttggtaaggtgaagtgattcatgaaattttggttttatttttttcctgatactaaaaataaaacattctttcacttggaaatttggacacagaacaccaaaaaaaatccataatctcatctctctttttctgtcttttccttccttttttccctttaaaaacaataaagagtgaaacctacctgttctccctctaatttaattcctaaatataatcactgtcaatatcttggacatttcctgtgtctaaacacacacacacacttttttttttcagcaaaagtggatttctgctacatgtagtgttctgcaacttactttctatgtgtttacaaaatcagtacatgtacatatgctgaattcagtccttaatggtattatattttgtgaatataccaaaatttgtttaaccacttagacaatctaggatattctcagtttgctgttatgagcaatgctcttcctttacatatacagacatatatatatatatgtgtgtgtgtgtgtttttgttttagtaggatagatttctaggagagggtgaaaggtcttatgacatccgcatttacgattgtaataggaagtatcaaagtgccccctaaagaaaaaaatcctcccattagtgggtaagaaagcctatttgttcatatcttcacaaacactaaatattagaaatatttacaattgtggtcaagctcataagtgaaaatggtatttcatatcttatattttttattgtgagattgaacatctttcatatgtttacatgtcacctgtatttcttattctctgaactatatgttatgacctttcactttttttcctcatgggttatgtgtagtttgtatagttgtcttattgattgttaggagctatttatatattaggaacattaatctcctgtcttatatatacgtggcatcgattagttgatcatttgtgagttcatgtctgtatacaaagattggagaggcactaagagggaaaacttacctctttcttatcaaagtttgtaaatatatgtataacagaagagggagaaaatattaataaatgcacagattggctgaaatagagtataaatcttttactcccctacttcaacataaactgcaaaaggagagtgacttttctttcactctgacttccgtattcctcatgcttaaaatagtgcctagcacagaagaggtgctcaatcagtgtttgctaaacgaaataattagtcacatttcaagcaggatgactaaatgaagaatagaatctaggcagatactctggaagagtggctgtgagtcattcatatcttagtatgaattagtcaaatccaactctctccccttcccactccccactgttagtagaagaatctgtttattgagagaatagatttataatttagaataagtgagaggggcagaagaggagattttgaaggatggcacctgaaggaggactagcatggctgagacagtgaagtggaagccttgaatagctaaagggtaagatgaaagtatttagctgtagggggaaaaagcattgacaggttggaaaagtaaaagtcagattctccttgctctgaaattttgtacagggcaggttctactaggtatgttacaatgcagaaaaaacatgaaataattgagaggaatttggtgcaatattatcttcttggcttcttttgagtgggcagatttttttcacggcctgtaactataataaatttgaaacttctcatcttttagtaacttttttcacttaagtttatgtggctgtgggcaatggaatgaagatattgaacttccaattccctgttgggtttccacaattacaagtcaatcatgactggttattagaagactatttcagttagaaccaccaagtcccatattgtcatattgtatgtttaattattaagtgaagcagtcttcttttcgtgttttccataattagggcattccagaaagatgaggatatttgctgtctttatattcatgacctactggcatttgctgaacggtaagacaccaaatccttccattaggttctatattttaaatattttaaccatgagtttaaaactaaaatgatcatttaaaatgcatgcaattttcttatagagagaacattctattctttcttctactttacacaatggcaaagtcttctttctactttacgcaatgataaagttacctgtgtcattttgtaaaaatatagagaatatagacaaattgaaagacacaaaataatctattacccatttcccagggttaactactgaaaatatctggggaaatggcctgtatgtatacatttatttgtttgctttcaacaaggccaagatcctttgatctttcagtcttggttgctctgtgacatgcctttcctgatgaggatactttaaggaagaattgtaagatacatggaaaatgtcaggctaacacagtactggcatcaccctgtgctctttcctgaactccataccaatgtacttcttgccagaaaactgatcaaaagtttagggaagtaaaaagagatgactgttagaatctaccattccctctatgtaggaagcaaataggtgtcctgtcaaaggacattctggggatgtctacatgaaaccaactctccctggttgtaaggactccatctccatataatatttatacagtaatatatgtttataaattgtgggggcaacttgtttagctaattttattattctgctattgggacactgtgtctcagcatgagatatagtgtcccaaaacatatttcaagcccattggataaaatatgtgtttagcaagttcttaaatataatgataacataaccgaccagataaagtgatttataaacgctgtgccaattttgtaaatgtttcgaggaattttcccttttctgaagattgtccttctttctttttagcatttactgtcacggttcccaaggacctatatgtggtagagtatggtagcaatatgacaattgaatgcaaattcccagtagaaaaacaattagacctggctgcactaattgtctattgggaaatggaggataagaacattattcaatttgtgcatggagaggaagacctgaaggttcagcatagtagctacagacagagggcccggctgttgaaggaccagctctccctgggaaatgctgcacttcagatcacagatgtgaaattgcaggatgcaggggtgtaccgctgcatgatcagctatggtggtgccgactacaagcgaattactgtgaaagtcaatggtaagaattattatagatgagaggcctgatctttattgaaaacatattccaagtgttgaagacttttcattcttgtaagtccatacttattttcaaacagaacagcatagtctgttcattcattcattcaattcatgaattcattcacataattatccaatttcttgagcacctatttgatagtcactggaaatccagagacaaacaacacagagccatgttctacagtatgtacagttttccaaaaagaatttctagtctttacttttttattacaaatggaatacgtatacttgcaaataattcagatactgtggaagagatcaaatgaattgcaaaagtgtccctcctcccttcaccactatctcccatggcatgcagagagagtaaccattatttgtgtgtccctccagaaatttttttattcaactactatttttttattttattaggtccgtcagttttccttttttgagcctctctatatcaaatgcaaataaatatattcagaacaaaccccactgtaaggttcacattaaaaaagacttgaagtcaccctatgaagacaaaaaataatcacattaagtgtgaaagaacctattcttccagtacaggataagccatacttactgggcatatattcatcttgaaaatctatactgatgttgtcttggggaattgaaaaggaactaggagtgttagttcctcggtattgacccacagttatgttatcaggtcacttgagttcaaagttttgtgttggcactagctaagtaaaggaaaacacctctgctttcattgttgagtttcacagaattgagagctgaaaggatcccaggcaggagcagctaatccaaactcccacaaagaacaaaaatcccccagaggatcttctgttcttatatttcctgcaatggcgtccctgtcatatcccacaatggcctccctgccatttggatatcccttccatatcctgttgaaattactccctaatagtaagctgaaatctgcccctctagttgtagtcttgggattatttcatttacatgatgaccttttaatatttgactagaattaaatcatctccccttggtctttccattcctgggctaactaccatcaatctgagggctaacaatacaagtagaaaaagtatacatttgtcactgatcactgatcaattattaatcaatgatcactgataactataaactcaaaaacaaaatcatgtggggattaagagaaatgtatcagttttatgttgtatttctggtccctgatactggctcaggtaatgccactattgtcaagaagataccacttgtaaagtagatttaattttcattatattttaccatatgcttctccattcatgacatctcttgagatgttgtggtttatactttcagtttttctccagtccatccgcaaatatcaggcatctactgtgttccaagatattaaagaaatcatcatgacttagcctcatcaacagcattgctagatctgggatggaaaggaagagtataatcctggcagtcaggaagaaggcagcataaagtataagtttctgcttccaaaaaaggtctctcatcagcctgtagggagtgtgtagggaagggacagctgtccttgtagtagggaagggttttattcaggtcgtctgggctccataatatcccttgtgtatctgcagtctcctttgccatggatcaacacaataggaaatcttccggcactgatggtttttccaagggggagttcttcctggagcaaagcaaatgaccaaccaggtttgaggacctgatttgtttgacaattccattttgtattgtaaattacttaattggcattctactcccaatccatcttgtcatttgcatacagtggttttgggattgagttcagctataccaaaagtctgaaccttctgcacttagaacaaggcaaccaccaagcttcacttgcactgaggccgtgtctccaatggaaatgaggcagctggcttgcaggagcttcccaactcagggaagtagaactcctgagtcacctccatatgcaaatgatttcacagtaatgctgttgaacttcacttcccatcacagcaaatgtgtggtaacatagcttccccacaggagtttactcaccatggtattttaaaggtgaaacatttcaaaactgaaatttgaaagaatttagttttggattcactcaattatcactatcacttcgggtgttattgcacctttcttgtttgtgagtttaaatgccagactctcaggccactaactttcaattaaaagtgtttttctttaatcgctgaacctaacagcagggaaaacgaaatgttcattcagactttcagaaccttcaatgagattaggcagctgaaagatcaaagtgttgcatagttgtcccgataaagctatttggatcatatggaccaaatcgactgctgtcattccccaccaaccccatctctccccaaaattcccagccctgtttaagtgttctctgtagcatttatctctatctagtatattgtgtagcatatcatatcatacttttctgttttgtttattgtctctctcctcctagaatataaactccacaagcacaaagatttgggcctgttttataatattgttgcatccccagggcctgatatacagcagagtggtggtacgaaaagagcacacaaaaaaatatttgttgagtcaatgaatgaatgatttcctcaaataggattagcctaaaattttggaaacatgaacagatttggatatgtgaaaatttatttccagactgttcatcaggaactgttagcagcttctaaagggtacactggagcagcagtagtaaaaggaggaagaggagcagctctgctactgctactatcgagtactactacaattagcacttgcttattctgtgtgttaggccctgtactgaacactctgtctaaattagttcatttcctcctggaaatgactctagggggtaagtgcttcatcatgtaagatgagtatttttcacattttgttgtgtctgaaatctgagtgtgtctttcaatgatggaatctttgattccatgataagtggtattattcccattttaaggatgaggaaactgaggtccaaagaaattaagtaatttgcccaaattcacccagcctagaaaatgataaagctagttctaaacccaagcagattagctctgaagtctgggcccttaataaccactttttattgcctatatttgtacctctggtgtacgtatcaagttatatgttgacttcaaaactatcatgaccttttcttggttttgattgtccaacattagtatagtgttctgggtctgcaaaaattttgattactcatctcatctgtaaaacattttgaactcgtgtgtttgtgcatgcacatttgtgtgtaattataaaaattttactttctgttaatatataagttgtatcataagaaactgccgtttttgaagagcaaaaaaaggttgaatgttaccagttacatctggttcaacctaatagacatttgtacaaaaacagacattttaagaggttgaaataaaaatttaataaacaatattttcagtttttactaattgtgatgcttcactatcattagctaatatgtcaaggcataatataccttagggtgaactttatcattaacaaaggtggatggtgtcaataatcttgaggtttgtgtttttttatataacactgcgaggtctaattaagtacttactgtttaccacctcatacagtggccgataaaaagtgtcacttctgctgtttcctctgggttgtgcttgaattattagtattatcttcagtcctcagtttctttgtgggaaactttttaattagttgtttaattttgtaagatggttagtttagtcaaaattagataagagaatttgaaaatccgtagctaccccaaagcaacctacacataagaactattatttttgtgttttgaaatcataattttattgatttccagtgtttccactggtagtggtttcattgatataggagtatcaaaacatcactcattatttatttcagtttcatttgatcctagccgttttgtattaactctctgtgaagaaattacctcacaaatctattgctgtccttggtaaaggaatggagaattaaggctctagatcattagtggttacactatagtattagaagtaaaaaaaagattataccaacaaaataagaacatgttaatgtacttgtaatgaataaacatgaataaagctcttatgctatataggtgcactaaacaatctactagaattgtcagcaaactacgtatcttaatcctgaaagggtcccaaaccaatgatctaaaattgaatcaaactttcttccttgagcataattacttaaatgatttattaaaatagccagcatttaaaagcttaaaatgtaaatatcataatgtggtatcctagatagcatcccagaacagaaaaaggatattagggaaaaactggaggaatggaataaattatgcagtttagttattaataatgtactaacgtccttagttatgacgattgtaccatggtaatgtaagatactaacaatagaggaaaccgggtaaggagtatacagtaactctatactatctttgcaacttttttgtaaatttaaaacttctaaaataaagaacaaatttaaacattaaaaagtatcaccaggaacatatatcactgtttacagatgaaatactatgtattttcatatctaatttctgatcattgacttcaaatcagaaaagtgaatgacacctcaaaatcaggttttctgtttactgaagtctaagaaaagaaagcataccagctggagagattcatgtttataaagacagatttataacaacaaaaataaaatatccaagaataaatttaagaagaagcactttactgagaaacatatgaaaacctgaacaaatggagagggatattttgtatttgaatagaaagacttctggtttaaagataattctctttaaattattttttgtagaaatttaaggggtacaagagcagtgttgtcacatggatatattacatagtggtgaagtctggggttttagtgtaaattaatctttacattttgtttgagcccaataaatgtaccaacatgatttttatagaaagatagtcattcctattaatccaaacttgtcccaactttgaattgaattgaggcagagctagcaggtgttccccacggctgaggcatctgaacattaagcatatccctctgagaaccagcctgcattgatactctttctaatgtggacagcatcaagctatgtacgtagttctgtgctcagcaaaagccctgacttctttttgtttatgtcctagccccatacaacaaaatcaaccaaagaattttggttgtggatccagtcacctctgaacatgaactgacatgtcaggctgagggctaccccaaggccgaagtcatctggacaagcagtgaccatcaagtcctgagtggtaagaccaccaccaccaattccaagagagaggagaagcttttcaatgtgaccagcacactgagaatcaacacaacaactaatgagattttctactgcacttttaggagattagatcctgaggaaaaccatacagctgaattggtcatcccaggtaatattctgaatgtgtccattaaaatatgtctaacactgtcccctagcacctagcatgatgtctgcctatcatagtcattcagtgattgttgaataaatgaatgaatgaataacactatgtttacaaaatatatcctaattcctcacctccattcatccaaaccatattgttacttaataaacattcagcagatatttatggaatataccttttgttccatgcattgtagtactcattggatacacatagaataataagactcagttcacactcttcaggaaacagataaaaaactaagaaacaaacaaaaaacaggcaatccaacaccatgtgggaaatgctttcatagccgggaaacctggggaatacctgagaggaatactcaattcaggccttgtttcaggaatccaaatcctggcacatcagagctgcttccctctttccagggtggcaggaaataaatggaacatatttttctatcttatgccaaacatgagggaccctttctccccggtgcctctcccaaggtagtctacaatatttcaactctagcagtctgcttagtgcatagaacatgaggctgtgtgtccctgggcaaattactagacttctgtgtgcttcactttccctgtaggattataatctactgagcaagcttattgtaagggtcagattagcaacagtgtatgaaaatgatttgagaccattgcctgcacaaattcaactatttttttttatctcactactctacagaagtaggtagggtgggagacagagtctgatgagaggctcagaatgtgaaagaaagtgaggcgagtgagcatgatatttaatataaacacaaagatattctgagaagagctgctcactgccccctcccccaatacatgttgataggaaaatgccacgtacttcagcaaaaacaactgaaaaattagatagaaaagtcaatcaataggaaaagataatccaggacggtgttgtgaacagaaagagggggaaaaaactttagaaaatgatggggatgctcttactggggtacgagtcctcaggtattgaactggctttcagtaaaagctagattagtgggttcctgccatttacaagctgttttatgacaacttacttgttgggtggcctacagtaactcacctaactgcactgagtctgtttcctcatctgtaaattggggatttttttttaaatacctggcatgcctaactcataaagttgttctgaaactgaaataaaacatacgtgaacaggcattgtaaactgtaagttacggaaaaagctggctgttgttgtgtctttaaagtttcacctgggtagtcaaagatggatcatgggtctcagtggagagctgagccaggcaggagctgactaagggtgagaggtgggagttagcagcctctgaacatctgtgtaccatgggaccccctttcctcctgcatggtaccccagacaaggagcctagtaagagatactaatggcttgttgtccagagatgttcaaactgcagagaaagataagacaacaagcattggcctccaatcatgatgacagataggaggaggtgggagctccttagcagtgctggttggccttccatgttctactgtgggccatctctgccatgtactgtaggctactagcttctatattaaagaatgcaagaggggccaggagcggaggctcatgcctgtaatctcagcactttgggaggccaaggtgggcagatcacttgaggtcaggagtttgtgaccagcctggccaacatggtgaaactctgcctttactaaaaatataaaaattagctgggtgtggtggtgtgcacctgtaatcccagctactcgggagactgaggcacaagaattgcttgaacctgggaggcggaagttgcagtgagcccagattgcgccactgcactccaccctgggcaacagagaaagactctgcctcaaaaaaaaaaaaaaaaagcaagaggaagtgaaataatcaaggccgccatttaatagtgagcagccactccatgtggtactgtgcaagcacattataaatattagcctcacaagaaatgtattagcatttgtattttgtacactggttaagtatcttgcccaagacctcaaaactggttaagggcagcagaatttagccccagcaccaccttttcaaagcctgggcttctcacacttctccatgctgttcccattttaacacaggtatctcgccattccagccactcaaactttggcatttaagaaaattatcctaaagctaaactaaacttcaaggatgaccattctcctgaccccttcccatcaaaattttatctttagtcagtttgttttcgttttgttttgtttttcagaactacctctggcacatcctccaaatgaaaggactcacttggtaattctgggagccatcttattatgccttggtgtagcactgacattcatcttccgtttaagaaaaggtagtatttccttaattgcagtggtctccactgggggtgaggaaggggtgagaattggatcatggctgcaaggaaacccgacttaacctctgcaaggtggtgcaaaggcattccactgttcaacagcaattatattgaagctgagtgggatcactgggtgaagatgaagcgtaaggggtgaggggcaggagaatgggtatggatggaggtagaagatgcagtgtcatacagtttttttctatcatgaaaataaccacagacttacagaagagaaagagctaaaatgcccgtcattttcagttgcattttagtcttgcattagttgcaaccagctggtttctgggtaccctaagtaataaaaatagttcctctgtagaactgtagtatgtttaccatagagtattttgcaaaatttttggtagagaatgttacataatttgcatgtgttcatttctccatttacctgtgggaacaattaaaatccaggaaaatgagtatattcaaataatttcctcccatttaagatgagtcagagtaaataattcctccaatacttagagaagtataccaagagatccagtgatggtatagagttgtctgatgttaaatagggaagtagaatatggaaggggattccaatagtcgttgaaaaattccccataaccccttacatgggggaaagtagtgttaactgagagagtagagataagctgtttccaaaaattatattcttaacaggactgagatagccagaatataaggatcaagtttcaatgacagtaagatcctgagatggagttgatttgcacaaagaaataattgttgccagcatgcattttgaatatttctctggaaaaaaagattagttggcagtagaaatggatagaaatcaatagatattaaaatacctcagaatttggttcatctctgggaaaagatgaaaaataaaagtgtatactcctcaagaacatctaggatcaaaagcatgtgccctacactattgaattaattaacctcataagttgggacctgtggaataaggatgtccaccagacttcctagggattacaaatgtttcacagaacttgaaatttaaacttgggtcactgtatgggatgtagagctgtgctatatggaaataaaaatgatttctttttctcaagggagaatgatggatgtgaaaaaatgtggcatccaagatacaaactcaaagaagcaaagtggtaagaatatcagaaggaattgggaagtaaaagtcaaaggaaacaaaaagctaaagcaataacaaagagaaatccatcagtcataatctcctctccttttaaagaatgctggttcccctttgcctcacagctaacacaagaactcctccaccgtctgaggaggtttaggagcagggaaggggaaggagtcagcttcatttgctaatcttctgttgccctgcaccctagcagctccttgcagcaggggacaaggatgacttaggtggatggataattaattgattctaaaatattgtgtgtcagtattgtaatactatgttaattgcaccatgcacggtatctcatttaatcccccaccccttgccattaccaaagagagagagagagagagagagagaaatactagaatttatcctcattttacagtagagaaaacagagggtcaagaagataatgtaaagtgcccaagaacacacagctgatcacaaaaatcaagcttgggggccattagcctaaccacagacccttactcttaacccatctgcttcaatccattttgctacaaatgtttacatttataagcagggcagaaaaacctcatccaggttattgaactaagaagaaagttatattaaggtttctaatttttttaatgtagttagaaaccaaacttaacaatgagcccaagtttaaagcagtctaattaacctggacaagctcaggcaagtttcattctgtggcccatagcatcatctgtgttgtaaagctaagtagcaaatgttgtttgggtcatgctgggggacaagccatcccaatttgctcaggactgaggggttttccaggatatcatgtaaggataattgggtacaaatataacctgctgctttctctcatttcaaatttatcatttatcatatcagcaactatgagttatgttttttattagatttcttgttactttttccccagaccacttcccatgaaattaatatactattatcactctccagatacacatttggaggagacgtaatccagcattggaacttctgatcttcaagcagggattctcaacctgtggtttaggggttcatcggggctgagcgtgacaagaggaaggaatgggcccgtgggatgcaggcaatgtgggacttaaaaggcccaagcactgaaaatggaacctggcgaaagcagaggaggagaatgaagaaagatggagtcaaacagggagcctggagggagaccttgatactttcaaatgcctgaggggctcatcgacgcctgtgacagggagaaaggatacttctgaacaaggagcctccaagcaaatcatccattgctcatcctaggaagacgggttgagaatccctaatttgagggtcagttcctgcagaagtgccctttgcctccactcaatgcctcaatttgttttctgcatgactgagagtctcagtgttggaacgggacagtatttatgtatgagtttttcctatttattttgagtctgtgaggtcttcttgtcatgtgagtgtggttgtgaatgatttcttttgaagatatattgtagtagatgttacaattttgtcgccaaactaaacttgctgcttaatgatttgctcacatctagtaaaacatggagtatttgtaaggtgcttggtctcctctataactacaagtatacattggaagcataaagatcaaaccgttggttgcataggatgtcacctttatttaacccattaatactctggttgacctaatcttattctcagacctcaagtgtctgtgcagtatctgttccatttaaatatcagctttacaattatgtggtagcctacacacataatctcatttcatcgctgtaaccaccctgttgtgataaccactattattttacccatcgtacagctgaggaagcaaacagattaagtaacttgcccaaaccagtaaatagcagacctcagactgccacccactgtccttttataatacaatttacagctatattttactttaagcaattcttttattcaaaaaccatttattaagtgcccttgcaatatcaatcgctgtgccaggcattgaatctacagatgtgagcaagacaaagtacctgtcctcaaggagctcatagtataatgaggagattaacaagaaaatgtattattacaatttagtccagtgtcatagcataaggatgatgcgaggggaaaacccgagcagtgttgccaagaggaggaaataggccaatgtggtctgggacggttggatatacttaaacatcttaataatcagagtaattttcatttacaaagagaggtcggtacttaaaataaccctgaaaaataacactggaattccttttctagcattatatttattcctgatttgcctttgccatataatctaatgcttgtttatatagtgtctggtattgtttaacagttctgtcttttctatttaaatgccactaaattttaaattcatacctttccatgattcaaaattcaaaagatcccatgggagatggttggaaaatctccacttcatcctccaagccattcaagtttcctttccagaagcaactgctactgcctttcattcatatgttcttctaaagatagtctacatttggaaatgtatgttaaaagcacgtatttttaaaatttttttcctaaatagtaacacattgtatgtctgctgtgtactttgctatttttatttattttagtgtttcttatatagcagatggaatgaatttgaagttcccagggctgaggatccatgccttctttgtttctaagttatctttcccatagcttttcattatctttcatatgatccagtatatgttaaatatgtcctacatatacatttagacaaccaccatttgttaagtatttgctctaggacagagtttggatttgtttatgtttgctcaaaaggagacccatgggctctccagggtgcactgagtcaatctagtcctaaaaagcaatcttattattaactctgtatgacagaatcatgtctggaacttttgttttctgctttctgtcaagtataaacttcactttgatgctgtacttgcaaaatcacattttctttctggaaattccggcagtgtaccttgactgctagctaccctgtgccagaaaagcctcattcgttgtgcttgaacccttgaatgccaccagctgtcatcactacacagccctcctaagaggcttcctggaggtttcgagattcagatgccctgggagatcccagagtttcctttccctcttggccatattctggtgtcaatgacaaggagtaccttggctttgccacatgtcaaggctgaagaaacagtgtctccaacagagctccttgtgttatctgtttgtacatgtgcatttgtacagtaattggtgtgacagtgttctttgtgtgaattacaggcaagaattgtggctgagcaaggcacatagtctactcagtctattcctaagtcctaactcctccttgtggtgttggatttgtaaggcactttatcccttttgtctcatgtttcatcgtaaatggcataggcagagatgatacctaattctgcatttgattgtcactttttgtacctgcattaatttaataaaatattcttatttattttgttacttggtacaccagcatgtccattttcttgtttattttgtgtttaataaaatgttcagtttaacatcccagtggagaaagtta

SEQ ID NO: 11745 - DNA, 4932 bp, Homo sapiens
ttttttttattattatactttaagttctagggtacatgtgcacaaaatgtaggtttgttacatatgtatacatgtgccatgttggtgtgctgcacccattaactcgtcatttacattaggtacatctcctaatactatccctccctcctccccgtaccccacgacaggccccggtgtgtgatgttccccatcctgtgtccaagtgttctcattgttcatttcccacctatgagtgagaacatgcggtgtttggttttttgtccttgcaatagtttgctgagaatggtttccagcttcatccacgtccctacaaaggacatgaactcatccttttctatggctgcatagtattccatggggtatatgtgccacattttcttactccagtctatcattggtggacatttgggttggttccaagtctttgctattgtgaatagtgctgcaataaacatacatgtgcatgtgtctttatagcagcatgatttataatcctttgggtatatacccagtaatgggatggctgggtcaaatggtatttctagttctagatccctgaggaattgccacactgtcttccacaatggttgaactagtttacactcccaccaacagtgtaaaagcgttcctatttctccacatcctctccagcacctgttgtttcctgactttttaatgatcgccattctaactggtgtgagatggtatctcattgtggttttgatttgtatttctctgatggccagtgatggtgagctttttttcatgtgtctgttggctgcataaatgtcttcttttgagaagtgtctgttcatatccttcacccactttttgatggggttgtttgattttttcttgtagatttgtttaagttctttgtagattctggatattagccctttgtcagatgggtagattgtaaaaatgttctcccattctgtaggttgcctgttcactctgatggtagtttcttttgctgtgcagaagctctttagtttaattagatcccatttgtcaattttggcttttgttgccattgcttccagtgttttagtcatgaagtccttgcccatgcctatgtcctgaatggtattgcttaggttttcttctagggtatttatggttttaggtctaacatttaagtctttaatccatcttgaattaatttttgtataaggtgtaaggaagggatccagtttcagctttctacatatggctagccagttttcccagcaccatttattaaatagggaatcctttccccatttcttgtttttgtcaggtttgtcaaagatcagatggttgtggatgtgtggtattatttctgagggctctgttctgttccattggtctagatctctgtttcagtaccagtaccatgctgttgtggttactgtagccctatagtatagtttgaagtcaggtagcgtgatgcctccagcttttttcttttggcttaggattgtcttggcaatgcaggctcttttttgattccatatgaactttaaagtagttttttccaattctgtgaagaaagtcattggtaacttgatggggatggcattgaatctataaattaccttgggcagtagggccatttcacgatattgattcttcctatccatgagcatggaatgttcttccttcggtttgtgtcctcttttatttcattgagcagtggtttgtagttctccttgaagaggtccttcacatcccttataagatggattcctaggtattttattctctttgaagcaattgtgaatgggagttcactcatgatttggctctgtgtttgtctgttgttggtgtataggaacgcttgtgatttttgcacattgattttgtatcctgagactttgctgaagttgcttatcagcttaaggagattttgcgctgagacgatggggatttctaaatacacaatcatgtcatctgcaaacagggacaatttgacttcctcttttcctaactgaataccctttatttctttctcttgtctgactgccctggccagaacttccaacactgtgttgaataggagtggtgagagaggacatccctgtcttgtgccagttttccaagggaattcttccagtttttgcccattcagtatgatattggctgtggatttgtcataactagctcttattattttgagatacgtcccatcaatacctagtttattgagagtttttagcatgaagcgctgttgaattttgtcgaaggccttttctgcatctattgagataaacatatagtttttgtctttggttctgtttatatgatggattacgtttattgatttgcgttacgttgaaccagccttgcatcccagggatgaagccaacttcatggtggtggataagctttttgatgtgctgctggattcagtttgccagtattttactgaggatttttgcatcgacgttcatcagggatattggtctaaaattctctttttttgttgtgtctctgccaggctttggtatcaggatgatgctggccttataaaatgagtcagggaggattccctctttttctattgattagcatagtttcagaaggaatggtaccagctcctctttgtacctctggtagaattcagctgtgaatccatcttgtcctggactttttttggttggtaggctattaattattgcctcaatttcagagcatgttattggtctattcagagattcaaattcttcctggtttagtcttgggagggtgtatgtgtccaggaatttatccatttcttctagattttctagtttatttacgtagaggtatttatattattctctgatagtagtttgtatttctgtgggatcagtagtgatatcccctttatcattttttattgcatctatttgatttttctctcttttcttctttattagtcttgctagcggtctatcaattttgttgatcttttcaaaaaaccagctcctggattcattgattttttgaagggtttttcatggctctatctcctccagttctgctctgatcttagttatttcttgccttctgctagcttttgaatgtgtttgctcttgcttctctagttcttttaattgtgaggttaaggtgtcaattttagatctttcctggtttctcttgtgggcatttagtgctctaaatttccctctccacactgctttaaatgtgtcccagagattctggtatgttgtgtctttgttctcgttggtttcaaagaacatctttatttctgccttcattttgttatgtacccagtagtcattcaggagcaggttgttcagtgtttagtttccatgtagttgagcagttttgagtgagtttcttaatcctgagttctagtttgattgcactgtggtctgagagacagtttgttataatttctgttcttttacatttgctgaggagtgctttacttccaacaatgtggtcagttttggagtaagtgtgatgtggtgctgagaagaatgtatattctgttgatttgtggggagagttctgtagatgtctattacatccacttggtgcagagctgagttcaagtcctggatattcttgttaactttctgtctcattgatctgttaatgttgacagtggggtgttaaagtctcccattattattgtgtgggagtctaagtctctttgtaggtctctaaggacttgctttatgaatctgggtgctcctgtactaggtgcatatatatttaggatagttagctcttcttgttgaattgatccctttaccattacataatggccttctttgtctcttttgatctttgttggtttaaagtctgttttatcagagactaggattgcaacccctgcttttctttgttttccatttgcttggtagatcttcctccatccctttattttgagcctatgtgtgtctctgcacgtgagatgggtctcctgaatacagcacactgatgggtcatgaccctttatccaatttgctagtctgtgtcttttaattggatcatttagcccatttacatttaaggttactattgttatgtgtgaatttgatcctgtcattatgatgttagctggttattttgcgcattagttgatgcagtttcttcctagcattgatggtctttacaatttggcatgtttttgcagtggctggtactggttgttcctttccatgtttagtgcttccttcaggagctcttgtaatgcaggcctggtggtgacaaaatctctcagcatttgcttgtctataaaggattttatttctctttcacttatgaagcttagtttggctggatatgaaattctgggttgaaaattcttttctttaggaatgttgaatattggcccccactctcttctggcttgtagagtttctgctgagagatccgctgttagtctgatgggcttccctttgtgggtaactcgacctttctctctggctgcccttaacattttttccttcatttcaattttggtgaatttgaaaattatgtgtcttggagttgctcttctcaagaagtatctttgtggtgttctctgtatttcctgaatttgaatgttggcctgccttgctaggttggggaagttctcctggataatatcctgaagagtgttttccaacttggttccattctcaccatcactttcaggtacaccagtaagacgtagatttggtcttttcacatagtcccatatttctgggaggttttgttcatttcattttactcttttttctctaaacttctcttcttgcttcatttcattcatttgatcttcaatcactgataccctttcttccagttgatcgaattggctattgaagcttgtgcatgtgtcacatagttctcatgccatgtgttttcagcttcatccagtcatttaaggtcttctctatgctgtttattatagttagccatttgtctaatcttttttcaaggtttttagct

SEQ ID NO: 11746 - DNA, 7661 bp, Homo sapiens
ccgccttcggcttccccttctgccaagagccctgagccactcacagcacgaccagagaacaggcctgtctcaggcaggccctgcgcctcctatgcggagatgctactgccactgctgctgtcctcgctgctgggcggtgagtgggccaagggccggaaaggacctggggcggagctagggctggggttgcaggttgagcctctgtctccccacagggtcccaggctatggatgggagattctggatacgagtgcaggagtcagtgatggtgccggagggcctgtgcatctctgtgccctgctctttctcctacccccgacaggactggacagggtctaccccagcttatggctactggttcaaagcagtgactgagacaaccaagggtgctcctgtggccacaaaccaccagagtcgagaggtggaaatgagcacccggggccgattccagctcactggggatcccgccaaggggaactgctccttggtgatcagagacgcgcagatgcaggatgagtcacagtacttctttcgggtggagagaggaagctatgtgagatataatttcatgaacgatgggttctttctaaaagtaacaggtatggaatggggtgggaacccctgcctctcacactggggagggaccctggggacagcctatgggctgagcagagagggctctcagggacccctgcagcacaagaatctcccaccacggtctctgtcccagccctgactcagaagcctgatgtctacatccccgagaccctggagcccgggcagccggtgacggtcatctgtgtgtttaactgggcctttgaggaatgtccacccccttctttctcctggacgggggctgccctctcctcccaaggaaccaaaccaacgacctcccacttctcagtgctcagcttcacgcccagaccccaggaccacaacaccgacctcacctgccatgtggacttctccagaaagggtgtgagcgcacagaggaccgtccgactccgtgtggcctgtgagtgtggcctgggagggtggggtgtgcagacagccccggtgggtggggaggtggaggagcccagtgggacagtgagcggctcccagctcaggagcatccagggagaggaagctgtggggtcccaggatgccgccgcagccctgggagggggatgggaatggcgtctggtccacacacgtgagccctggcgctggttgtcacttgtcttcccgggatagtcccactttcttttccctgagggagttttttccaggtgtgaggaataaattgtccctccctgaagccagctcacaatcttgttgcagatgcccccagagaccttgttatcagcatttcacgtgacaacacgccaggtactgagggccgtcgggctggggctgggccagttgtctttagatgaaaaggcttcaggggatgaggggatgtgctcctccctgtaccccttctctctttctccctccctttctctcttttttttttttcctcccactccagccctggagccccagccccagggaaatgtcccatacctggaagcccaaaaaggccagttcctgcggctcctctgtgctgctgacagccagccccctgccacactgagctgggtcctgcagaacagagtcctctcctcgtcccatccctggggccctagacccctggggctggagctgcccggggtgaaggctggggattcagggcgctacacctgccgagcggagaacaggcttggctcccagcagcgagccctggacctctctgtgcagtgtgagtgtgcccagcaggggcctggagtccattgggagggcagagggatacaggggctgggctcagggtcccagagctgagggggcctggagccccaggcctcggagaccgaccttcttacctgtgtagaccctcatgcagtttgtgtctgggactcagtgggtgattctgccctgcccttctatcccacccacttcccccacctcagtgtccaggatggttccctttacccagagggaagcccctggtccgtctagagccggtcccctgtctccatttcagatcctccagagaacctgagagtgatggtttcccaagcaaacaggacaggtaggaaaggggacagaggagccaaggcctctcagtgccgaattgggggcccaggagtctggagggtccccacgcaggagggtccctgagccctgagctgctcatcgattctgcctcttccttccctagtcctggaaaaccttgggaacggcacgtctctcccagtactggagggccaaagcctgtgcctggtctgtgtcacacacagcagccccccagccaggctgagctggacccagaggggacaggttctgagcccctcccagccctcagaccccggggtcctggagctgcctcgggttcaagtggagcacgaaggagagttcacctgccacgctcggcacccactgggctcccagcacgtctctctcagcctctccgtgcactgtgagtgggggaaaggggacacctgggtcccaggaaggggaccctgctgagtcctgtcctccctcccctcagactccccgaagctgctgggcccctcctgctcctgggaggctgagggtctgcactgcagctgctcctcccaggccagcccggccccctctctgcgctggtggcttggggaggagctgctggaggggaacagcagccaggactccttcgaggtcacccccagctcagccgggccctgggccaacagctccctgagcctccatggagggctcagctccggcctcaggctccgctgtgaggcctggaacgtccatggggcccagagtggatccatcctgcagctgccaggttagggggccgcctggatgccaaggttcttggaggagaagctgactggggcaaagagtagggtcctgtggttggagcaggagcttggagggacacagcagacccgtggcatctgtatgtagacaggaaaacacaatgggaagtcctaacacctgggccggggtgtggcagggtttcctaaaagtaaacagaggggttgcagatacaatgtccgccatgggaaccggaagccttaatgccgagtgatgagcgggcttcgtgagccctgcgtggatgggaaatgctcaccttgccctctccgtgtgcagataagaagggactcatctcaacggcattctccaacggagcgtttctgggaatcggcatcacggctcttcttttcctctgcctggccctgatcatgtaggttaagaggaggcgtggcggggtctggggcctggacccaggaagaggggaggtgttgcaggccgaaagagtgaaggtcgtgatcaacgcagtatacctctggaggttacatgagtaaacagcaaactgttctcataaatgcagaatgttgtccaactgacaaactgcgtctgcttcccagagggaatgctgagggcagtcacgccccaagcgaagtgtttcttgtaattaggcacagctgaagcttgttagtaataatatgaacctgtgatcaattaaacagctgaccaattgttacctcctgctctctgctctttctacccaataaatacaaagggctgtagaggctcagacagctgccctggctcactagtagcagggaaccctcttcttcttcccctgaccccttcctttaaaataatttcttttgtcttaagttttcatttctacgtttgtcctccttctttcagtctcataatgacggtctcaagtggtaacagtagtaactgtcatagtgacggtctcaggtagtaaacgtggcagtctgtcacagggaggtgcagcagggcacaaacaggtgggttcatttcctcagcatgaagattctaccgaagagacggactcagacagaaaccccgaggcccaggttctcccggcacagcacgatcctggattacatcaatgtggtcccgacggctggccccctggtgagtgtctgggccatgcttccactttttctcttctctaaagctgacatcccactttctgacttttgcaccccttgtcttagcgacatcaaggtgggaaaagcaccgatagttctgaattcaaatcctgcctggcacttactagctatgagacctcagccacgtcactcaccccctctgagccttcatttcttcctctgtctcctttgagagttggtttgaggattagaatacatgcactttctcaatctgtagccattgttccattattactgccaccattgacatgactacacttaactgcttaacaattatgtgtatcatcgggaggctgggcatcctagggattcagcacagggggtctgaaatcagcctgcatgggttcaaatcctgctgtcatcactgtgtcatgaaacaagtgtcttaacttctctgtgcctcaatttctttagctgtaacatggagacaatactagcggccacctcctaggatgatgctgggtgttaaatatattgtacttgcataataaaatattcagaatatcacctggcccctgggtaatactctgtaaattctggaaattattaagagataacatcttatgctgatgactgcaaaattgtatctcgtggctccttccctgaagactgtctatgcaacatctccatgtgggtgtctaatcagcacttcaaacttagcctgtccaaaaccaacttaagataattccccagcctgagcaacatagtgagacctcttctctacaaaaaaaataaaaaattagccgggtgtggtggtgcatgcccattgtcccagctacttgggaggctgaggtgggaggatctcttgagcctgggagttggaggctacagtgagccatgatgacaccatgcactccagcctgggtgacagagtgagaccctgtctcaaaaaaaaaaaggccacgcctgctggctcacacctgtaatcccagcactttgggaggccgaggtgggtggatcgcctgaggtcaaaattttaagagcagcgtgttcaacatggtgaaaccccatctctactaaacatacaaaaaattacctgggcatggtgatgggtgcctgtaatcacagctactcgggaggctgaggcaggagaattacttgaacccaggaggtggaggttgcagtgagatcatgccactgcactccagcctgggcaacaagagcgaaacttcatctaaaaaaaaaaaaagactaattccaccatttatgctccatctctatccccatcttagcaaataacaccacattttcccagccaagtctaaagctttagaatcatatttcactcctctcttctctgtcaccccacaaccaatccatcagcaaattcccttcaaaatacaaccaagccagttctccctactcttccctcactactacaagccatgcatcaacaccccccaccccaccccgggcaccactggccccttctgcatgccttctctgcttccgttctcaccccctccagtctttctctccgtgcatgcatgctattctttattttatttatttttattttattttattttttgagatgggatttcactgttgttgtctaggctggagtgcagtggcaaggtctcggctcactgcaacctccacctcctggttcaagcgattcatctgcctcagcctcctgagtagctgggattacaggcatccaccaccatgcccccctaatttttgtatttttagtagagacggggtttcaccatgttgatcaggctggtctcaaactcctgacctcaggtgatccacccgcctcagcctcccaaagtgctgggattacaggtgtgaaccaccgtacccggctatcaattatttttttgaaacagattttgtctctgttgtccgggctggagtgcagtggcgcagtctcagcgcactacaacctccacctctcaggttcaagtgattttcctgcctcagcctcctgagtagctgggaccacaggcatgtgtcaccacgcccggctaatttttgtatttgtggtagagacagggtttcgctatgttggccaggccggtcttgaaattccctggatgacctattaaacagtcatcccaccctccctttcgctgccttctaaaggtgctcaaatttcttgatggcatttgtcacttaccagtcattgtacttttgctaattattgtctgttcctccttccaagatggaatgcaagctcagcaaggcaagggcagggacttagtttcactctgtgctgtaaatcagtgcccgacgcgtggtaagtgctcaaatatttgctgaatgaatgaatgaaggatggtggttcttccctcaggctcagaagcggaatcagaaagccacaccaaacagtcctcggacccctcttccaccaggtgctccctccccagaatcaaagaagaaccagaaaaagcagtatcagttgcccagtttcccagaacccaaatcatccactcaagccccagaatcccaggagagccaagaggagctccattatgccacgctcaacttcccaggcgtcagacccaggcctgaggcccggatgcccaagggcacccaggcggattatgcagaagtcaagttccaatgagggtctcttaggctttaggactgggacttcggctagggaggaaggtagagtaagaggttgaagataacagagtgcaaagtttccttctctccctctctctctctctttctctctctctctctctttctctctcttttaaaaaaacatctggccagggcacagtggctcacgcctgtaatcccagcactttgggaggttgaggtgggcagatcgcctgaggtcgggagttcgagaccagcctggccaacttggtgaaaccccgtctctactaaaaatacaaaaattagctgggcatggtggcaggcgcctgtaatcctacctacttgggaagctgaggcaggagaatcacttgaacctgggagacggaggttgcagtgagccaagatcacaccattgcacgccagcctgggcaacaaagcgagactccatctcaaaaaaaaaatcctccaaatgggttgggtgtctgtaatcccagcactttgggaggctaaggtgggtggattgcttgagcccaggagttcgagaccagcctgggcaacatggtgaaaccccatctctacaaaaaatacaaaacatagctgggcttggtggtgtgtgcctgtagtcccagctgtcagacatttaaaccagagcaactccatctggaataggagctgaataaaatgaggctgagacctactgggctgcattctcagacagtggaggcattctaagtcacaggatgagacaggaggtccgtacaagatacaggtcataaagactttgctgataaaacagattgcagtaaagaagccaaccaaatcccaccaaaaccaagttggccacgagagtgacctctggtcgtcctcactgctacactcctgacagcaccatgacagtttacaaatgccatggcaacatcaggaagttacccgatatgtcccaaaagggggaggaatgaataatccaccccttgtttagcaaataagcaagaaataaccataaaagtgggcaaccagcagctctaggcgctgctcttgtctatggagtagccattcttttgttcctttactttcttaataaacttgctttcaccttac

SEQ ID NO: 11747 - DNA, 545 bp, Homo sapiens
cacctgaggtcaggagttcgagaccagcctgaacaacatgaagaaaccccatcttttctaaaaatacaaaatcagccaggcatggtggcgcatgtctgtagtcccagctacttgggaggctgaggcaggagaatcgcttgaaccccggaggtggaggttgcagtgagccaagatcatgctactgcactccagcctgggcaacaagagggaaactccatctcaaaaaacaaaaacaaacaaacaaacaaacacctctgtctctacaaaaattatcaaaaaaaaaaatcaaaaattatctgggcgtggtggtgtgtgcctatagtcccggctagttgggaggctgaggtgggaggatcgcttgagcccagaagatggaggctgcactgagccatgatcacaccactgcactccagcctgggcaacagagcaagaccttgtctcaaaaacaaaaaacaaaaatgccatggatgaaagaaccaggacagggcagaggctgggtcatctcctccaggaggcctctcctgacttccctccaccaggaagag

SEQ ID NO: 11748 - DNA, 2722 bp, Homo sapiens
cttccggtcgtgggccatgccgggggcgggcccggaaccgccacgggtgagtcgggtcgtggctgctgccgggtcctgcgcgctccggactgaggtggcgtccctgggccggacggcggtgtcccggcgtggcgggaagccggcactggagcgggagcgcactgggcgcgggaccgggaggcgcagggaccggacggctcccgagtcgcccacctgacggtaccgagagggcggcgcccctccgagcagagccgtcccggccactcccctgggatctgacttggctcttgcggtcgcgggcaccgtgaagccctggggtgtgcgtggctcctcctggtaggcgccctttcccggcgtccggcttggggtggtggtggcgttgactccagccccgcctctccctggagaggagggctccactcgctccttcggcctcctcccctggggccgcagcgactcgggccggcttcctgcttccctgcctgccggcggtcccgctgggtacgttttagccaatcctccccatctgcgctcctgcccggggctcccccagttcccctggtctcaccctgttctgactccggctctgcatcctatctgtttctctgtttctttcaagctagaagaagtcttcacttcccaggagagccaaagcgtgtctggccctaggtgggaaaagaactggctgtgacctttgccctgacctggaagggcccagccttgggctgaatggcagcacccacgcccgcccgtccggtgctgacccacctgctggtggctctcttcggcatgggctcctgggctgcggtcaatgggatctgggtggagctacctgtggtggtcaaagagcttccagagggtgagtgggagggaggtgcaggtgtgcccaagactcctgggctgcggtcagtgggatctgggtggagctacctgtggtggtcagagagcttccagagggtgagtgggaggaggtgcaggtgtgcccaggaaggtgggctttggcactcttcctcccttgggcatcatgaccctgacatggcctcctcccttccctgcaggttggagcctcccctcttacgtctctgtgcttgtggctctggggaacctgggtctgctggtggtgaccctctggaggaggctggccccaggaaaggacgagcaggtccccatccgggtggtgcaggtgctgggcatggtgggcacagccctgctggcctctctgtggcaccatgtggccccagtggcaggacagttgcattctgtggccttcttagcactggcctttgtgctggcactggcatgctgtgcctcgaatgtcactttcctgcccttcttgagccacctgccacctcgcttcttacggtcattcttcctgggtcaaggcctgagtgccctgctgccctgcgtgctggccctagtgcagggtgtgggccgcctcgagtgcccgccagcccccatcaacggcacccctggccccccgctcgacttccttgagcgttttcccgccagcaccttcttctgggcactgactgcccttctggtcgcttcagctgctgccttccagggtcttctgctgctgttgccgccaccaccatctgtacccacaggggagttaggatcaggcctccaggtgggagccccaggagcagaggaagaggtggaagagtcctcaccactgcaagagccaccaagccaggcagcaggcaccacccctggtccagaccctaaggcctatcagcttctatcagcccgcagtgcctgcctgctgggcctgttggccgccaccaacgcgctgaccaatggcgtgctgcctgccgtgcagagcttttcctgcttaccctacgggcgtctggcctaccacctggctgtggtgctgggcagtgctgccaatcccctggcctgcttcctggccatgggtgtgctgtgcaggtacacaaggacccccagcccctgtgcgggtggaactcagggctgggagccaggtcctggcgcagtcagccctgacattctgctcgctcactgcaggtccttggcagggctgggcggcctctctctgctgggcgtgttctgtgggggctacctgatggcgctggcagtcctgagcccctgcccgcccctggtgggcacctcggcgggggtggtcctcgtggtgagcacagggggacatgaagtggggtgggggggcgttgccctggagcaggcacatctcacgctcagctggtgctgtgtccccctcaggtgctgtcgtgggtgctgtgtcttggcgtgttctcctacgtgaaggtggcagccagctccctgctgcatggcgggggccggccggcattgctggcagccggcgtggccatccaggtgggctctctgctcggcgctgttgctatgttccccccgaccagcatctatcacgtgttccacagcagaaaggactgtgcagacccctgtgactcctgagcctgggcaggtggggaccccgctccccaacacctgtctttccctcaatgctgccaccatgcctgagtgcctgcagcccaggaggcccgcacaccggtacactcgtggacacctacacactccataggagatcctggctttccagggtgggcaagggcaaggagcaggcttggagccagggaccagtgggggctgtagggtaagcccctgagcctgggacctacatgtggtttgcgtaataaaacatttgtatttaatgagttggcattaa

SEQ ID NO: 11749 - DNA, 3089 bp, Homo sapiens
aactcctaaaaatgttttattttaacaaaatgctcaaatatctgaaattgggcaaaggtggagggtgggcaagctggctgaggtgtcccaggtctgtggctgcctagctgggtgaggggctggtgagcagctgctccagacaccactggacttcctccaggccccggtaggcccgcttcaaaccccggggaaagcaccggcaggactccaggttgaggtaaagcaggcccgggcagctgctgatcacagagctgtggggagggcagaccacaggaagttgagctgttgcctcagaagggctgggccaggctagggagctgtgcctgctggtgttcgacacctggctctgccacccatagccaccaaggccaagcccagttcccctggtgtcctcaggcccaccccacgcaggggcttggacagtatgcatgcccctctgacccctggaggtctcaggccaggcaggacacaacttccaggccccaggcagacacagtgacagccacactggctccagggactggggtaggggatgctgacctgacagtgcttggtgtgacccgggtgcccctgaggttaagagagcacagggctgggtgtgagcccccaggggtgcttaagaaggcagccagggcctgctccaggtccttctcactgaacccctggccactcaagtccagttctcgcagtgtatggcaccacttctgggtcaaaaaggggctgccctccttggctagagtcagccggtctgacgtgccatacaggcccagatgaagctgctccagctctgcagtgaaaggagtgagcataagctacaaggtgacaagggcccccacacctcacccgcccggccaccacccaggactgctgaccccgacatggcagatcctgaaggccagccggcgtgatgcgcgcacagccacgaagatccagtaagcgcaggttgggagagccgtggagtaggcggcccaggacctcgttgctcacaaagttgcaggttgagctcgccaggcagagctcctctaggctagggaagcctggtccgggagccacccctcgtcccggaggcttgggcagccacatcaggttcaacagccgcagcacctgggggcaaggtccaggctgtagatgggggagggtgtgacaggtgggagaggcagggcgccaggtacctggagctgagggcagcctttctgcagagcctcgacaggcagctgaaggggaatgctattacggttgatgccggtgctcacctccaggacctggagctgggggcagcagctgccctgcagagatggggggagggggtaggtcacagggtcagtggcctggcagtccccagctcagcatctgcctctgctcccaccaatgccaacttaccagcagtgcgcccaggatggctgtcgtctgggagctgtaggtcagccacaacttgcgcattagggaccctgcctcctccaagaagctcaccacagctgtggactccacctggggccccaatacaagagcacccgtcaccccggcctgggttttttcagggccccttgggacacagggctcaccatggagtgctgtaggtccaggctatggagctggcagcaggctttggctagcatgaccagagcgtcagcagtcacaccgtggcagccggagagcttgaggaaagtgagccgaggacagcactcacctaccagctgcggggagacagaggggcagctggggttgggaaacaacaggctaagatccacaagggaaacagacaagtggctggtgccaaccccactctaccgccttagctgtgacctcctttctgcccatgccaggcctacttgggtgtccccgcctctgatacctccctgctggaggaaacagcaggaaaagagaaccaggcaggcaagcagacatccccacggagcagcgttgggcccccaaggtgcctgacccacttcctagagtactgaacagtcccagagtgtcacagctgatgtgcaggacagcctggagctctcaccttcaacacggggtgtacctgagacttccagtggatgagggtcagcctctggagctgtgaaaacctgggccgacagcggaggcagagctgcactaatgttcccacacgagtccttcccacccaacaccttggtgcagggagacggaaggagcctggagccaggggtaaggaaaagagggaacccctcaccgattgggcataagccactccagggaagcaaggagcttcttctccgccttgaccccgcccttggcaggccggccgaccagcggggacgacagggtcacggtgtgccagagcgcgggttgggaagcggcctcctgccagcggcggcacacgcgcgcagccctgggaggacagcgtgctgagggtgccggcccctccgtaggcgatgcccccctctcgcagcgcagtagacaccccggctcaaagccgggctcctgggactccaactgggcgcctaaggggctgcgctctcggactgagcggtgcgcgctccgatgctttcgccctccgcccccgcccgggccaccgctcggaccacgtctggcccaagccgctacgctcggcggcgggcccggcaccagcgttacctgcccaggaagggcatggggccgtccgccgccaccaacaacccgaaaatctgcaccaggatttccaagggaatgcggtctccccagcccgcgtcgggcccttcctcgggcgtgggcgtgggtgccggtgcgggtgcgggcgcggccgccgcctcggacctgagcccggccttgggcttggccgcggcgctggggccccggggcggctgccggggaatgcggcgggaatcgcgccgctgtgcgcggggccgggcggggcctggttcagacagcaccagcagcatgctgtcggactgcagcaggtggtaccccgagcccctcggcgccagccggtcccaccaccaatcctcggccgagcggggccgcggcgctgcccgggctctgcgtcggacctgccgggaggctggggcagccatgaccaccgacggcgctcggggaagccccagggagcggaacgggcgaggcttatagaccgactacccccc

SEQ ID NO: 11750 - DNA, 408 bp, Homo sapiens
ggattgtacagtcatgccctctgagcccagactaccccacattgcttcttggaactgccctgggctctctgggcccacacaagctaccagcttcggtggtcagaggagtagaggagcctcttcccggcaaggccactgctccacaagcacctctcaagggctgagggttagtcggatggggctgcgatgtgccgagccccctgtccacccttagccctggagtgactgtttgcctgctagcttcccaggagtatcctgctagggatttacaccagggggttggtgtgcaggcaccggggtactcagtgagggggactcagaaaagacggagtttaaggttttagcccatcgggaccgtttggcctgagcattaccccactcccctgagcctccaccctctcagtgaca

SEQ ID NO: 11751 - DNA, 23090 bp, Homo sapiens
ggaacgtctttagcaaaacccgttcgacaaaggtaaagtgggtcggtatcagcgccactcgcccccgccccagcctgtcccagggtcgtccctgtccccactgtcctcgggcgtaccctcctctgggttcccccacttccgagcttccctcacctcaaattctgggtcatgtgtcggggcagtgtggcaggccgaggctgaactggcacctcccagcccctcaggaccaagccccaaagccttggggaccctccaggcagcttcctccctgggcctgcggctcagcgcatctgccatccccatgtgtctgcaggagtctgtgtctgtgctcaacctcttcaccaggatccggtaaacctgccgggcaggaccgtgccacaccagctgtccagagtcggaggaccccagctcctcagcttgcatggactctgccttcccagcgcttgtcccccgaggaaggcggctgggcgggcggggagctgggcctggaggatcctggagtctcattaaatgcctgattgtgaaccatgtccaccagtatctggggtgggcacgtggtcggggaccctcagcagcaggggctctgtctcccttcccaaagggcgagaaccacattggacggtcccggctcagaccgtctgtactcagagcgacggatgccccctgggaccctcactgcctccgtctgttcatcacctgcccaccggagccgcatgctcttcctggaactgcccacgtctgcacagaacagaccaccagacgccagggctgattggtgggggcctgagaccccggttgcccattcatggctgcaccccaccatgtcaaacccaagaccagccccaaggccagaccaaggcatgtaggcctgggcaggtggctcggggccactggcggagccagcctgtggatccaagagacagtccccacctgggcttcacggcatccttgcagccacctctgctgtcactgctcgaagcagcagtctctctggaagcatctgtgtcatggccatcgcccggcggtcagtgggcttcagatgggcctgtgcatcctggccaagcgtcaccctcacactggaggaggatgtctgctctggacttatcaccccaggagaactgaacccggacctgctcactgccctggctggagaggagcacaacagatgccacgtcttcgtgcattcgccaacacgtgccctcacagggccagcgtcctccttccctgcgcaagacttgcgtcccccatgcctgctgggtggctgggtcctgtggaggccagcagcggtgtggcccccgcccccaggctgcctgtgtcttcacctgtcctgtccaccagcgccaacagccgtggggaagccaaggagacccaaggggtccaggaggtgggcgccctccatccttcgagaagcttcccaggctcctctgcttctctgtctcatgctcccaggctgcacagcaggcagggagggaggcaaggcaggggagtggggcctgagctgagcactgccccctcacccccccaccaccccttcccatttcatcggtggggacgtggagagggtggggcgggctggggttggagggtcccacccaccaccctgctgtgcttgggaacccccactccccactccccacatcccaacatcctggtgtctgtccccagtggggttggcgtgcatgtgtacatatgtatttgtgacttttctttggatttgttttgtgtttttgttgactagtcctggaaatgtttgaggctagacggggaggggccaggacccacccactgctcctgggggatgaggtcctggttttaaagccccgtcatttcaagcgggtcgatcttccacattcactggagagactctccccacctctgtctgggtggggcgcggacccctcactgtgcgcctgtgcagggggtgctggtgcacgtggcagtgtggatttccagtggtcacggtcttactgtttcaaggtttttaaataagaaaaccaaccctgccttcgcccatgcccgcccctgcccgcagttgccaaagagccgccttgtcgctgtgggcgtcagggcttggctggctcagtgcacaacccacagtggccttcagaggctcctcctgggactgggaaccgccgcagggccaggcggacggcgtgaggtttgtgttggggctggttctgcccatgctagggggtgggggagctcccaggacagaccagccttgtttctcatgtaatgcagtgacgctgtcattaaacacgtggattcatgtgtggccgggactggctggctctaggtccccggctcgggtggggtcacacggtcctgccctagagtccccatctggccctggagctgcagaagcagcttctgaggggcttcccaggcctgcatttcacagatggggagctcagccctcgaaggccgcagagacgcctcccaggcccgtctgccagggcgccggccacaatcctgcagggccaaggactggactccaggcaagtccctgcgctccagctggacggccctgttccagggaggaggtgctcggttgacaccatcagggagggagggtgggcactgctgggctgagttcacccccagggctggccagatggggccaggagggacagagcaaggggggtgaaggccgtggtgggagggtcccatgatgatgggccagggctcgtgtagaaatgggggaattggttccccatggcccaggacagctgagaggaggtggaggggccccaggggagtgtacgtcaggctttgcggggcacgggggccactcagcagcgctggggcaggtgcctctgctgtcagctccacccgacaggcagacgaaggccagtggggccatcgcttcctggggcgaccctggcagtggttgggagacgcccagatggagggggaggctgaccaagggccccgcagggcgggctgcaacttttctgttgatcctggaatgtagctggtgcagtgagagggaaagagaattgaaaaactcaggctgccataggttctgcgatgagaggtgcaggaggcaggagcctggcccagggggtgctggtgcctccccggggtctgggcggagagaacaggaggaatggctgggaagtggctgagggagccaggaggccggggggccgggggctgcaggggaggctgtgggggtcctggcagccaggaggccccaggtggttttgaggctcgctcttgcgcggtgcctgagaagagggtgaaggagctggggcaggccccatcctgggcattggagatgatgaaaccgagcagacctggcccatgtggagctggcatgggggacacagcccagagacagagaagcttatgaggaagtgaggaggtggcgtcacaagggtggggagggggccttggggaagggcggccttggatcagaggctcaccacaagcctggcatttcagccagggctggagaaggcagggacgcctgggtgagaggcaaagggcacagccatgcaaaggccctggggcaggacggcacctggtatgcgggaggaacagagtgaggagaggagggcagggcgtgcagggccttgtgggcctcagggaggacttgggcacctacgccgagggagtggagctcctgggtgcgtgtccagatgggaaaggcagggtcgtatctgtggggacctgacaagggcaggggaagcggagaccagggtgcaggctccgcccccacccaaggccgggcccagccagaggaggggcagggcagggcaggaggtttctggatgtttgttgggtttggtttggttttgttttgttttgtttattgtggtaaaatacaaaatctaccgtcttacagtgaggtggcgttcagtaccttcaccacgccgtgcagccatcccatctgattccagaacattctcatcacccagaaggcagccctgtccccattatgtcacctagtcacccccaggtccccctccccagtcccggcacccacgaatcctctccctgattctgtggattggtctgtcctggacatttcatagaagtgggatcacagcgtacccttctgtgtctggtgtctctcactgagcgtgacatcctcaaggtgcatccgcactgtggcctgggtcagagcttcgcacctccttgtggctgagtctcgttccagcacggtggcggcgccgtgctgatcccctcaccttcactgggtgttcggtgttctccgcctcgggctgtcacaaatcgtgctgctgtgagccactgcgtgcaggtctcatcctgggtgtattttacaaacggactggatgtgagtgggtgaggagtgaggagctggggtgacaggtgcctgcgaccccggccaggcactgcctcctgcgatcgaaggggcagggggagacagaagcccctcaagggggtgtggagatggagaagccagaccccaggtggggggtgcatagagctgggggctcagggccacggaccccacctggcagtggccctggccttgcccacccacactgtgtcacccccagttgttaaatactcagaacgactctccagcccttccctcgaggccacctcaccccgcagctgggaggagggagtggtcagcgtggttgccgagacactgggtggcctttatgctgtcaacggtggcctcagaggccttctggcaggagcccgggggatccaggcagacatgcaaaccctcaggcaagaggctgcacggccctgtatcccctcggggaccctcgaggccagcttcccagcaccgctgtacaggtgagcccctccctacaggtgagcccctcccagcccctccctccctccctccctgggtgtcaggttacatggtgtttggtttggggtcttgcacgtgtcactcgttattcctaaaaggctcatgtgtgtgacgtcccctccagctcttcctgttcccctccggccagtggccgctcactgtggggtctacagacctggagacaggccaagaacaaatgtgtctgcggccgtctccaaggactgcaaacgcactgggagcttcggccacagaaatgttcgccctctgaaatccaggcctgtgcggggctgggcccttctgtggctgagagagtctgtcccacacctcttgcagcccgtggtggctctgggcaaccccaggcactccttggcccccggtctctgcttctgtcttcacccggccttcctgtctgcgtccaagtttccctctccttataagggtgccaggcactggattcggggccatcctaacacggggtgacctcatcttagctgcatctgctaaaaccatttccaaacaaggccatgtcctgaggctctgggcagatgtgattttgggggtataccagtcaccccgatacagtgtctattatcaattgtttaaacaattatggaatactatgcagccatgaaaaagaagagtgaaagccctttgctccatttccaaggaaagaaattaaaccaagatggtggctgggcatggtggcccacacctgtaatcccagcactttggaaggctaagacaggaggatcacttgagcccaggagttcaagaccagcctgagcaacatagtgagacccatctcttttcttttttttttttttttttttttttgagacagtctcatactgttgcccaggctagggtgcagtggcgcaatcttggctcactgcaacttctgcctcccaggttctaggattcttccatctcaagccttctgagtagctaggactacaggtttgtgccacatgcccagctaatttttgtttttttttttggacggagtctcactcttgtcgcaagactggaacgcaatggtgcaatcttggctcactgcaacctccaactccctggttcgagcgattctcctgcctcagcctcccaagtagctgggattacaggcatgcgctaccatgcccagctaatttttgtatttttagtagagacggggtttcaccatgttggccaggatggtctcgatctcctgacctcatgatctgccctccttggcctcccaaagtgctgggattacaggcgtgaggcaccgcgcctagctgtgagaccccatctctataaaaaatttaaaaatcagccaggcagccaggcgcagtggctcacgcctgtaattccagcactttcggaggccgaggcaggcggatcacctgaagtcaggagttcgagaccagcctgaccaacatggtgaaaccccgtctctactaaaaatacaaaattagccgggaatggtggctcatgcctgtaatcccagctacttgggaggctgaggcaggagaatcacttgaacctcggaggcagaggttgcagtgagccgagatcgtgccactggacttcagcccagagcgaaactccatctcaaaaaaaaaaaaaaaaaatccaggcgcagtggctcacgcctgtaatccccacattttgggaggccgaggcgggtggatcacgaggtcaggagatcaagaccaacctggccaaggtagtgaaaccccatctgtactaaaagtacaaaaattagctggttgtggtggcgggcgcctgcaatcccagctactcgggaggctgaggcaggagaatcgcttgaacctgggaggcagaggttgcagtgagccgagatcaggccactgcactccagcctgggtgacagagcaagactctgtctcaaaaaaaaaaaaaaaaaatcaaccaggcatggcggcacgtgcctgtaatgccagctacttgggaggctgaggtaggaggatcgcttgagcctaggaggtcaaggctgcagtgagccgaaatcgtgccactgcattccagcctaggtgacaaagcaagactgtctcaaaaaaaaaaagagggtctcgctcggttgcccaggctggagtgcagtggaatgatctcagctcactgcaacctctgcctcctgggttctagcgattctcctgcctcagcctcctgagtagctgggattacaggcacccaccaccacgcccggctaatttttgtatttttagtagagacagtgtttcaccatgttggccaggctggtctcaaactcctgacctcatgatccgcctgcctcggcctcccacagtgctgggattacaggcatgagccaccgcacccagtgcaagaccctatttctattttttaaaaaaatggagatgcagtgaatgggctcccgcaagtgtgtaataacgggggtgagtgcatgtaccacctgctcctgggaggaaacaccagaaagtagtgagtggcaggtgggtacggggccgacagcaggggtgaggggctcatttctcattgaatattattctgtgctgttttgtttgtgttgagacagagtctcgctctctcacccaggctggagtgcagtgacgcaatctcggctcactgcaacctccgcctcccgggttcaagctaattctcctgcctcagcttcccgagtagctgggaccacaggtgtccatcaccacacctgactaatttttgtatttttagtagagacggggtttcaccatgttggtcaggctggtctcgaactcctgacctcaggtgatctacccaccttggcctcccaaagtgctgggattacaggcatgagccactgcgcccagacaattttgtgctgttttaattgtgttttaaaagctacatgtgtcttgcaattcatttcaaaagggtgaggttctcctgatcttgaaattgcctttctagtggaaaagccgagtctatgtggggtccctcaaacaggctctgtaactgaccaggctactcccatgttctgtgggcacctgggagtctagtcaggatttaagcagagttcctgccatgagagctggaaccgggctttccgtgcagggcagatgagattgttttgaaccctgctagactgtcttggggccagcaaccttgttttctgggatgacttccttgggacatattcccaagagcaaggtcaaagcataaaacatctttgagtctcttgtctttttgtttttgagacagagtctcactctgttgcccaggctggagtgcaagggcacgatctcagcttactgcaaactccacttcctgggttcaagcgattctcctgcctcagcctcctgagtagctgggattacaggtgccccccgcccccacaccatgcctggcttaattttcgtatttttagtagagatggggttttaccatgctggccaggctggtctcgaactcctgacctcaagtgatccacctgcctcagcctcccaaagtgctgggtttacaagcgtgagccacacacctggcctagtgggtcccccagtcttccctgggccatggcttagtgccagccccagaccacttcttcctggtgcacctccaggccaggggggcttcccagaggaagggacttgtgggtcttggaggctggacaaggactgtaggaatccaggagtagccagggcccttgtcctctcccctccctcttctccaggcaagaaaagctgagaacagaaaggtttagtgctgacttgggtgcttggggtgcgatgtgtggggagagggggagtcagcctctctcctcaagcacccactctggggtgaggggtacagggctgaaggacagactccaagtggcgagggagggagaccccacgccgtgggccaggcctctacatcatccaccctggcagacatcgcaaaggggtcaaagcactcgctgtagacatgggctcagtctctgccccctgcccaccctcagcgatgactacctgtccctggagggttcccgctggccaccagccatcaggcaggccacacgctggaagtacacgcccatgggacgggacgcagccggccagctgtggtacacaggcctgaccaactcggacgcctgggaagcctggtacaacctgccacgggccccggccagccccttccgcgaggcctacaaccgctggcacagctgctaccaacaccgtgagtgcagcatgccatcgggtgagtgcccccccccccgccctgggcagcgggcctgccagagggggacaggaatgaccgccagcccccgccccaccgcagcctacacccagcacctgcgggagaccgcctggcatgaccccatcgtccctgcccagtaccaggcccccagcacccggtgggggagcgcgctgtggaaagacaggccaatccggggcaaggaatacggtgaggctaggtgcagggtgggtccttgggaggccagggggacaaggccacctaggccagggtgaaactgcccggggcgatccaggagccccttgctggccaacggcgaggaggtgggggcacatggtgacccgagtcccacctacagtgctcaacaggaaccggtacggggtggagccactgtggagggcatcagactacgtgccctccctgtcggcaccccagcgcccgcccggcaccacccagaactaccgggagtgggtcctggaaccatactgcccctccacctgccagcggtccccgccttccctcacacccactccccgataaaggcatgctaccaggatgcacccactgtctctgcacccagatgagggggcactaacctagtcccaggggaccagaggctcgggacagaggcagacactgggctcgctggccgcccacaaccagggcagggctgagatgcccaggctacccctgcccagagcccccccgcaggcagacaggagccaggctgccgtcatctctttatttgctgccagcagagtccaccaagcctgccgggcagccctgctgcccaccacggtggggtccaggcccagcccaccaccccgtggctgtctcctccaggctccagccgtcctgagggggccctggcagtgtctggagacccccaggctggaggtgaggggtgaactggactgagctcagggttagggttcccccagacccttctgggattcctacttcctgttccctgccgagaggggcaccccaaatcctccagagggctgggatggattagagttgagaatgggacaccctcaaaacccagggggtccttgcaagtccctggcgggcatccctgctgccctcacccgaccccacccccgggagctgggtgaggatggagggtgggggtccagagaagagtgaggggcagtgggggcttttccccaaggccctggggggcatcctcgtgcgtccccacagttcccttgcacaggtgcaggaggctgtcaggagtcagggccgggcatcacggtcccctgcaagggaggggtggaaatggcattagagagtgtgggtcagtgtctggggagggaggggtgggccaggactcacagcgtcgcaggcgggtcggccacagcaggaggctacagagacacagggcagcggccacgcccacgccgcccgtcacagccaccatcgcccagtggtaaaagctcacgcaggccctgcagcagagctctgagctgtgggaggaggcgggggatgagtaggcaccgcgggtaccacccccccgccacccaagctgaacctgtgcctcccctcacccccgacagcggctccgtcctgtccaatccaggagctgggggccctgccactccctccctcctgtcccacacccaacagctcggccagtcctgtgggccctgcttccagcatccatgccaaatccaccatgtctccccttccctgtctcctcatggtccagccccagcatggcccgcctgcacccgccccggtcccaggctgcaacttctcccccagcagctgtcctcccggcagcaaccaccagagggcgtctgtgagcgcctgggtcagggcctgtccctcttctgcccacagctctctgtgagtcccactgtcctcagggtcaaatcccctaagtcctccccatggcccaccaggccctgcacgacctgccctcccctcctccctctactccagccacacaggcctcctccctgttcttccaacacaacatgccaggtgtggtcctgccccagggctttggcactacttgtccctccccattggcctggaatgctctgacatcctgcaggtgtcagggccacgtcacctcctccaagaagccctccctggcttcctgccctggctgtccaggtttctctgagcgttcacctttacacaccacccacgccggtaccaaccacatgttcacctctgtgactattaacacggctggctctgccccaggcccagaccggctgtggtttccaggccctgggcctctacaggcgtgaatgctgtgatgctgtggtctagaaccatccatgtctgaaccctgagttctgtgggtctgggttacacggactcggggctcccttccagctgggcccacccccgatatatttctgtacggtgtcttcagcactgcacacatggacccaacgtttgttgagtgaataaacgaagtgctcagtggaagaaaggaaaggtctcccctgcctatgactcccattggggcaggtgtctttggtccacagctggatgcccagacccagaacactgctggacacacagcaggcgcttaatcccctcttactgaacaaaagaatgaatgaacgaacagcggcactcacgggcaagggtgcaggctctggatggccatgactgccagcccattggccaccttatccaagaagctcatggagccgtacacgaacgctccgctgttctgtggagacacaggcgaggtggtcagcgtgcaccccgagatctaggacccggcctcccccaccccagcctggctaccagccctaccgtgtggggaccgatgaggtcggccgtcatggccagcgaggtgacgaggatggtggcacagccagcacccagcagcacagccgctgcgtacacggccacacccagtccctccgccagcgccacccaggcggcaaaggccaggatcaccaggaggcctgagaagtaggtcatctgcagggacagccccggggtcaggcccacaccactgggtgcccccaagcctggcgcttcaatccgccacccctacccccaaccccagcaaacaaggcatgagctggatggtccctaaggagccctggctctggccctggacacaacaccgaggctctgcagatcctccatgccagagctgtgctctctgtccacgccgtagcggctggagacgtgtggctattctgcctgagcgcaggtcagttacaacgaaagcaaacgacggactcggctcagtccccacggccacatttcaagccctcagtagctgcacagggtggacagaaagcgccagagctccatggctgcgagtgtataaactcgagacacagagaagccaggatcctagaattccttgttcccagatctggggctttttttttctggagacaagagtctcgctgtgtcgcccaggctggagtgcagtggtgtgatctcatctcactgcaagctccgcctcccgggttcacgccattctcctgcctcagcctcccgaatagctgggactacaggcacccgccaccaacgcccggctaattttgtttttgtatctttagtagagacggggtttcaccgtgttagccaggatggtctcgatctcctgacctcgtgatccgcccgcctcggcctcccaaagtgctgggattacaggcgtgagccaccgtgcccggcctagatctggggcttctacaaggcgggaactcggaggcctgagagcatccgaggatggaacccggagcgggtgggatctcggctgcagggcaccccatcctccgccccagctgtccccggtccccgcccactcacgttcctcccaatgcacttgttgatgggcttcatgaggaaggaggacaagaagccgctgaggtacatcaccaggggaatggtcgcgatgaacttctgcggaggcagagccaggcatgccgtgtcagtcatggctcgccaggctggggccgtcccatcccagcgtccccgccccaatctgctcaccttgggcaggtggagcgagtaggtgaggtacatggccatgtaggtctgggacaggttcacgatgagcctggtggtcatgtacagtatgcccacctgtgggcagaccgacagagggactggcaggggtcaggagggccttctccactcccaccagcagggggcaccggggccagggtgggcgccctgcagctggcatttgatccattggtagtgactgcccagtggggtgggccaggaagaggagagcagcacttgatgagtgacgtttgccctgggtgtgggctgcaccaggggccacgtgtgctctgcgtctggacgcagctgccccacagagcaaaggccctgtgggtgggagagaaggcccacgccagccccaccgtccccagcacgcacctggtagaaagccggctcccggagccagtgcttccagagcagcaggggctgggccgtggcaggggccaacaggggggtgtgctcgcctggctcctccgcatgcggccggcgcctctcccgggtgcccaggtggaatagcagtgagaacacggcgccgacacccaccaccagcagggacaggttctggggatgcagcagaagcagtcagtggtggcgggcccagcccccgcccctggctcgaggacttcaggcgacccacccggactccagctcacccggaacacgggcacgtcctggccccccagctggtcgctgatgctgatgtcttgggtgggctccacccgcgacgagccctgcaggtgcagcaggagccaggcggcgccgtagacggtgatgttggccaccacggtgaacgcatacctggcgggcaggcgggcagggactcaacaagacgccaggaacctgggtcacttcctccccacgtggctacgccgtcagagaggcctggggaacccctgactgacaggtgattccaaccactgccacactgggtggcctccaggaagcccgtgctggcctcagtttccccagcccgcacattacctaacgcgggaaagctgtgacctgcagctccacccttcgtgcccaggaccagggtacagtgactcggccaagcggagtccaggctacaacccaaaagtctgagaacccagagactcagaagccagaattcgagaattcttcttccccagatgctgggcggctaaagggcgagggctccctggtctagaaccatccaggccagcccctgcccacagcccggccaggcacagagtcccccggggggcctcagaatcctaccatgaatcagtctctctttctgaaagcgggaaccatgccacctccagaggccacgtgagcacagcaggaggtcagctggcaaagcaatggcacgtaggaagtgcctggggtctggccccggtcagatggggccctcaggggccctgggcattgggcaacctgtgtcgttagcgcctgcacctctgtcacatggccataatggggaactcaaatctgggggtggggaggagctggtgatacacaggcagatgtggagacagcggactcccccgacacgaaggcgctgtgaggaccctggctttgggcaccagctggggccgagtcctcctctgaaatacgcgggagagaagagttcccacctcccagctcacggggaggattaaagaagctgagattcatgttaagggcctataactatgccaggcacacggcaggtgctcaatgcatcatcctcgtaaccagaagaacctcttccagcgcctctagcaagttagtggataagccgggcacccgctgtacccaggtgtaatagaaagaattctaaggcagccccagagaggcctgcccatcccatcccctccccgtggcagcagcagctgtaagtccaccatggatgttactcccaggatgtagccagggctaagtggcattctatagcagagggaaagggacttcgcagtgtgttataaccaaggaccttggtcagctcgggtgtgtccacagggagattactggccaggcgcggtggctcacgcctgtaatctcagcactttgggaggctgaggcaggcagatcactgaggtcaggagttcgagaccagcctggccaagacggtgaaatcccatctctactaaaaatacaaaaattagccgggggtggtggcgggtgcctgtagtcccagctactcgggaggctgaggcaggagaaccgcttgaacccaggaggcagaggttgcagtgagccgagatggcgccactgcactccagcctgggtgacagagtgagactcttgtctcaaaaaaaaaaaaaaaaaaagccaggcacagtggctcacgcctgtaatcccagcactttgggaggccaaggcgggcagatcacctgaggtcaggcgttcaagaccagcctggccaacatggtacatggtgaaaccccgtgtctactaaaaatacaaaaaaaaaattagccgagatcgtgccactgcactccagcctggctgacagagcgagatcctgtcaagggagactacggtgtgtgagcctggccaagtcaggcaatcctttgggagagagggcttagggcttcctgggatcagagattctccctgctggcctcagaagcagcagccaccgtgatctccacaggtgcaagactacaacttctgccaccaaccacgtgagcatagaggagggaccgcccccagccttccataagacgctagccctgggcaaccccttgaatgcaggctcaagacagaccctgaagcccaacagccctctccccctagctcagccatgctggactcctgacccccagaaactgtgagaggagaaatgtgtgatggctgagtgtggtggctcatgcctgtaatcgcagcactttgggaggccaaggcaggaggatcgcttgagcccaagagttccagaccagcctgggcaatatagtgagaccctgtctctacaaaaactttttgttttttttttttgagacggaatctcgctctgtcgcccaggctggagtgcagtggcgctatcttggctcactgcaagctccacctcccgggttcacaccattctcctgcctcagcctcccgagtagctgggactacaggcgcccaccaccgcgcccggctaattttttgtatttttagtagagacgaggtttcacgtgttagcgaggatggtctcgatctcctgacctcgtgatctgcccacctcggcctcccaaagtgctgggattacaggtgtgagccatgcccagcctacaaaaactttaaaaaacagctgggtgtagtgacatactcctgtagtcccagctactcaggaggctgaggcaagagtatcacttgagcccaggaggttgaggctgcagtcagccgagatcaccccactgcactccagcctgggcaacagagtgagaccccctttcaaaaaaataaacatgaaagactgcctggtctcgagctgccgagtctgtggccgctcattatgcagtgccactgactgatacaccgagccggggcccaccctgcccgtgggggagggtgcccaggctcccacctgagtgccgtgagctccaccttctcatggtcgttggtgacgagctccgggatgaggctgaggtgggagatctgtgtggaggcccagccaaactggaagatcacgatgaacgggccgtagtagaggagggcagcccactcgggcgtggccgccccacagcccaggcaggggctgaagatgaaggggaaggacagcaggacgcagacggtgcctgtggaaggcagagtggtcagtcgcggggctgtcccgcaccagccagggctcccagggtgaggacatggagggaggagagagggaaactgaggcacagatggagacgccccccgcatgcacacagtcacgcaggagcgagggtctgcagtcggggtcccccaggcttatggcccctggtgacaaaaggggaatctgacaccaggtgcctgggctcagcctgcaagtcagaagaagccaggcgcagggggtcccccggaaacctgccccccacaggtgccccggttacagccgcagcctcccccagctcctccccctcggccactatcaagcctcccatagggcctcggggagcgggaggcccaggtgggcctgggctggacccctccttaagctccgccatcctcatcagctcctaaggtgaccactccctggaatgctggggcgtcctggcctccagggacagtcaggaaatagcacccgcccccacctgagatctgcggtggcaaggcctggctcttcacatcctcagaagaaaacccctaagataccctggaacaaatgtaagatcctccccgcagcccacggagccctttgcgacctgccctgtcccctccgtgccctgccctgcccttccctctctcccccttctctctctgctccagccatgcaggtctcctcactgcaggacctcttcaacatgccaggcggtcctgcccccgggcctttgcatgggcgtgcctctgcctagagctctctctcacatcttagcaagactggctccttttcacctctgggctcaacgggaatgtcacctcctcgaacacctctctcctggcccctgctgcctctacctcacccttcggagcacccgggaattctctgtctgccggcttcctgccggctttcctctgcagacagcagcctccaaggggcctggggagacccagcatggaactcgggcatttcaatatctattttttttttttttttagacagagtcttgctctgtcgcccaggctggagtgcagtggcgagatctcggctcgctgcaacctccgccccctggattcaagccattctcctgcctcagcctcccgagtagctgggactacaggcccatgccaccatacccagctaatttttgtatttttagtagagacagggtttcaccacgttggccaggctggtctccaatgcctgacctcaggtgatccacccgcctcggcctctcaaagtgctgggattacaggcgtgagccaccgcgccccgcctttttttttttttttttttttttttgagacagagtctcgctctgttgcccaggctggagtgcagtggtgcgatctcagctcattgcagcctctgcctccctagctcaagccattctcccacctcagcctcccgtgtagctgggattacaggtacctgccgccacatcccaccacatccagctaatgtttgtatttttggtagggatggggtttcaccacgttggccaggctgaagtcgaactcctagcctcaagtgatcctcctgcctcggcctcccaaagtgctcggattacagacttgagccaccataccggctgttacttcagtatcttctgagtgagtaacaatagtggccctgacacagcctgtaagcgtgggtgtcattatcctcattttccagatgggaaaattgaggcccctagagtgagtcggagccaggctccttccctgcagccctgcactcctctcctcccagcctggggcacctggaagggcccctgtaccaagcctggtggctggacctccttcctccctccggaggtgacctcatccccagaccctgggcccgcccccagagaactggaattgggaagtgaaaccaaaaccagcctctcctgctggtttctctggaactagggcctgggagggtttgcgcagattcctggggtccttggggaggtcatccgggggcagagcatgaactgtggactccagtgagaaggtcccttcctggctggactccctgttcctgctggccagtctgggttaaccattgttggggccaggctgcctggcctggggacctcgggcaagtgactgtgcctctctaggcctcagttttcagaaaacagggatagtggccaggagtggtggatcatgtaatcaatcccagcactttgggaggctgaggtgggaggactgcttgaacccaggaggtcgaggctgcagtgagtcgtgatcgtgccactgcgctccagcctgggcgacagagcgagaccctgtcaagaaaaaaaaaaaaaggccgggcgcggtggctcacgcctgtaatcccagcactttgggagaccgaggcgggtggatcatgaggtcaggagatcgagaccatcctggctaacatgatgaaaccctgtctctactaaaaatgcaaaaaaaattagccgggcgtggcggcgggcgcctgtagtcccagctactcgagaggctgaggcaggagaatggtgtgaatccgggaggcagagcttgcagtgagactccatctctcaaaaaaaaaaaaaaaaaaaaaaaaacaatgaaaagaaatgaaacagagaaagaaaggaaaagaaaagaagaggctgggtgcggtggctcatgcttgtaatcccagcactttgggaggctgcagcggatggatcacctgaggtcaggagttcgagaccagcctgaccaacatggtgaaaccctgtctctactaaaaatacaaaaattagccgggcatggtggcacgagcctgtagtcccagctactcgggaggctgaggcaggagaatcacttaaacccaggaggttgaggttgcagtgagctgagatcacgccactgccttccagcccgggtgacaaagcaagactccgtctcaaaaataaaaaataaaaataaataaaaaattaaaaaaagaagagaaagaagggtagtgaaagttcctgcccatggccaggcgtggttgctcacacctgtaatcccagcactgtggggggctgagacaggcagatcacttgaggtcagcggttcaagcccagcctggacaatatggtgaaaccttgcctctactaaaaatttaaaaattagccggctttggtggcacgtgcctgtaatcccagctactcaggaggctgacgcacgagaatcctttgaactcaggaggcgaaggttgcagtgagccgagatcccgctactgcactccagcctgagcgacagagtgagactctgtctcaacaacaacaaaacaaaaaaaaaaaaaaaagaaagaaagttcctgcctcacaggctgctgtgaggatagagttcatgtgtggcaccagcaaaagctccgtctattctgaaccacttcctgcttccgcagcttcaaagtgaggactgttcctaccttttccacagctgtttctgctacttggaatgcgcccctccacacactgctacccatccgtcaaaacctcaaagttaatgtccttccttctgaagcccatttgtgccatctgcccactcacaggagtgtttgtgtctgattctgagggtcgtctcgggattgtgggggagctccccaggacttgttaaagggcaaagtgagtccttagccaccagccccagacttgggggtgaaatacagaagtgggtgccattgccagggtaaccttcactcaagtcacctgctcaggcatcaagagcggctgcctgggcttctgctcccaacagaccctcctgaccctccaggcccacccaggtggcccccacctctcagctcccagggcaggtgccctccccgaggcggggaagaggggtgacggtggacgccttggtgtccggttggaccacctggttccctgaggtctgctttggaaaaacataaagccttcggttgctgtttctgtttgttttcttgttttggtttgttgttgttgttttttgtttttttagacagactctcgctgtgtctggagtgcagtggcgcgatcttggctgactacagcctctgcctcccgggttcaaacgattctcccacctcagcctcccaagtagctgggattacaggcgtgcgccaccacgctcggctaatttttgtactttagtagagacggggttttgccatgttggccaggttggtctcaaactcctgacctcaggtgaggaggcctcccaaagtgctgggatgacaggggtgagccaccgtgcccggcccgcccagaaattatcttacgcgactgtcaaagagcttatccaactattatgatcaaagaggcatttggggccctgggctccgctcagcaaccaatcccaacgtaaccacaaaggaagggacagccggtcccctccctgtctgccgccgcctcaggtaccccaggaatagcctggacataggaaacatgaaactccagtccccaagctgtgcctgctgcggagcctgccaccctcagaccactggagatccactgcctcttgcaaaaaatgtcatcacccagatcctgggtccaaccacccatcccagtcattgttcccaagggtgaggaggcacccgcctgcccctcctgccacctggaattccaagaactgagcaggattcctggccctgcctgctgaaatgccacatgtgtcccaaatgccaggacgcagccggcacttctgtgagggcaagaagagcagggaaggaggccggctaatcttcaggcccagggtccgggaggggagaggagggccgctgggaggcagccctgcagtcttatcgatgggcactggggcagggtgacccagcccatgacgccagcctcctgccctcccaacagccctctctaatcagggcagctcccccagacctagggggtccctgaccctggccagacagatagaggcaatgcaagaacagggcagagacccctgaccctccagtcccacccaggcggctcccaactctcaactcccggagcagcaccctcaaactgctgacgcaccaggttgccctggcagaacacacagagagagaggaggctctagggggcctgactgtccctcagccatagctgtcccagttggtcaccctaatagacgagctcaggctagacagactgacaaaggaggcgctgagcagtcaccaccaaccctccagagggttcagggtggcccgggggctcagacaaacaaaggcattcccactagaaagtcatgtagtcagatggtgagggccccgcaggtcagacagcagctctgaggcagacaggggaggctggaccaagggacagacagaggggatacggggcagttaaacagacagatgggggaggctcatggctcaggcagatagagaagccctgcacagttggacagatgggggaggcactgcacagtcagacagatgggggaggcacagcacagtcagacgggggaggctcaggccatggggcagaaagacgggggatgctggatggtgggacaggcaggggaggctcaggagtgacaccacagaggggccactgggtagtcagacagacgggggaggctcaggccacggaacagccagaggggtgaaaactcagctcatggggcagacaaacaggggagacttaggtcccaggcaggcagagagagggggctgggtggtgggactgatggaggaagctcaggccatgggcacagacagacagacaggggaggttcgggccaggggacagacagaggggtgaaaactcagctcatagggcagacagatacataggggaggttaaggccgtggacagacagtgcagggaagctcgggccacgggacagacagaccgaggggagactccgatcctgaggcaggcagacggcgggtggtgagtcagagggaggaggcgcccgggtcgcggagtctcggaggggctgcccgacaggtggcggggccgggacgcttaccgaccaggtgccaggccttgcgcgggccgtagcgggcgcagcagctggcggcgcggtcggcctcgtagcccacgagcggtgtgcacagcccgtcggccacctggcccagcagcagcagcagccccgcgccgcgggagctgtaggcgcgcaccgagtgcaggtagagcagcaggtaggtgaaccacatggacgcgcacaggtcgttgaggaagtggcccacggcgtagctcagccgcgccaccagggacagcggccgcggggacggcgccgctccggccgctgggggtcccgggcccatcgcggcgccgggcccgcgccccccacccccgggctccgcggagggtaccctggccaggccttcttgggtgccgtgggggcaggcgccggggacccccaccacgcgccgggcaccccgcgtcccgctctcttacggccgcgccctcacccacgtccgccgcgtccgccc

SEQ ID NO: 11752 - DNA, 11608 bp, Homo sapiens
cggactcctgcgtgtattacagaacccaatagtatttatggtcttcattggcatcgccttcaattttattcttgatcgaaaggtacctgtatatgtcgaaaattttcttgatggacttggaaattctttttctggatcagccctattttatcttggtctcacgatggtgggaaaaataaagagactgaagaagtcggcatttgtagtactaattcttctcatcacagctaaactgtaagcatcacttatttaacttgagaattgtactttttgaaagccgtatttagccaattcatcaggggtatgtctgcaaccattttcccctttgaatattaataacccctccttgtagaatagttgtgagataaaggaaaatgtgatggtgtattgtggaaagtcatttccttattcccagtagcttattctttccatcttactgtcagaggataaagatgatgggtttcccttcagcttttacataaagtttactcagtatctcctcatgtcccagtttgacagtattttcaaataaattttgcagcatttctgacttttccaaatccataaagaccctaaagacaaaagcatcttagtgataaccagaacaataatttctaatgcaaactttttttcatgaatttgggaaaagtattttgtagttctgaggttggccaaattttctaaatacagccaagtcaatatgaatgattattatcagccatatgatcctggcttgccaaatgaaaagtgctcatcaacttcttttttgttgttgttgtttttgtttttgtttgaaacagagtcttgctctgtcaactagactggagtgcagtcatgcgatcttggctcactgcaacctccacctcgtaggttcaagctattctcctgcctcagcctcccaagtagctgggattacaggtgcctgccaccacacctggctgatttttatatttttagtagagacgggatttcaccatgttggtcagactggtctcaaactcctgacctcaggtgatccatccatctcggcctcccaaagtgctgggattacaggcatgagccaccgtgcccagcctcaacttcttagttaatagttcttcagcttacttggtccattagccatggagttctacatgatggtgcaggtgacataattttactgcaagattatcccaaagtacttgaggcatacttaactatggaattcccctcatgtatagacagttatattcatgagaccagtacaacataatctactgttttcataataataaaaatgaatataagtactgaaaattatttatggcgatgttatgctcttcagaaacaaagtattagtattgtggaagtaataagtatagtttaaacaataatggtattatcaacttttgcttataagtagaatttaaatattctaattttaaagatggggggtctttgatacttaattagatatttaagttttttaatttaaaaagtacagatcagagtagttctttactccatcccagagggccttgctaggtgctgctgtgaaaatgttaacaatcttggtcttgctgattttaaaggagagccctatttgctcaactactgtggatttgctcattctatgaaatcctgaaaaatttgtttaataattgactcttcaacaggtctgcatttcactagttttctgctccatctcagttgttttagttcctttgctaattttttttttttttttttttacaaagatgaagagctacttgaagatacctatttttctacaggattttggaatcttttttttttttttttttttgagacagagtcttgctgtgtcacccaggctggagtacaatggctggcatgatctcagctcactgcacctccacctcctgggttcaagcagttctccagcctcagcctcctgagtagctgggattacaggcatgtgccatcatgcccggctaattttttgtatctttagtagagatggggtttcaccatgttagccaggctggtcttcaactcctgacctgaactcgtgatccgcctgcctcagcctcccaaagtgctgggattacaggcttgagcaccatgccggcaggattttagaatcttattaagcaatgttgttattaactgaaccatttcaacccctaatcatgataaagttcagcttttttttttttttttcaaaacaggagtttctgtctctctagaatactttgaaagaaagaaaaagagtttagtgattctcttgaaagaagtttttatgcagattgtcaaccttctttctttctttgaacatttcagtaaactgatagaggaagcaagaaagtagctagaattgcaacttttaccatcttttggcaaaaaacaaaaattatttgtagaaccaaaaacatctttttttccctcctaatccctgatgtgtgaggtatttccagaatattgttacactttaaatggctccaagttgaattcttgatttttttcaacaaaatgtgcccaggtagacatgcacagaatatgtgcatgcaaatagacataccttctgggcaggagaacctgatgccaaattcaccagagcagcctgctactggggacaaccatgctttgatatcaggtaaatgatgtttttcttttttcttcagtctggtgctgccacttctgtgcagagaaatggtggaactcttggacaagggcgacagtgtggtgaaccatacaagtttatcaaattatgcatttctgtatggtgtatttcctgtagcaccaggagtggctatctttgcaacacaattcaacatggaagtagaaattgtatgtatatagtactttctaagtttgatggtgtgtttagtcgaaaaaaatttttaaattcatttcaaattttttaaaattcttttttaaaaatgaaaaaatagagacgacgggggtctcactatgttgccccaggctggtttcaaactcctgccttctgccttggcctcccaaagtgctgggattacaggcatgagccaccgtgcccagcccattttaatttctaaacatagaaagcaatgttgttttttatgaggtccagcactttgggaggctgaggtgggcagaccacttgaggccaggagtttgagaccagcctggccaacatggcgaaaccctgtctctactaaaaatacaaacattagctgggtgtggtggtagttgcctgtaatcccagctacttgggtggctgaggcacaagatttgtttgaacccaggaggcagaggttgcagtgagttaagattgcaccactgtactccagcctgggtgacagagcaagcagcattgttttttatgagaatttgatgcctataagctatctcattataagaaataggcatcatgtaacataatgtaacaacagtcatttaatctggggtctttagtcagccctgactttttttaatcagtttttttagttttaactattttatttctgtacttagacagaaacctaaaaattatttacagaaaggtaactttgaaattttgaagaaaaaaatgcctattttatcattgataatttcaagcaccagatgcaaaatactgcataataactgcagcagatagctaaaatcaattgacaccaaattattaacagtgtctaaatgtattgtaaatggtatctacagcatcagagtaaatgatttttaaatataatacaaaggaactaagttgtttaatggaggtcaattctgttatttaatctgtaaaataaatatttgcatggtaattttctttttttgaattccttttcttttttgccacatagtttgtgaaacaggtttatttatatcattgctacagtttattttctagaacttagaggataactaaccatcaacagtaaatttctagtatttattatgcgtaaatataaattaagcatagattagaagaggaaccaaggtaactcaattgtattttgtattaaggattctcagaaaggggaagtatggtattggataacatgctggattttataatgtctttactgtgtctcatttttattttagaatgctttagtgtgccgtggttatttaaagtttaaaatactgtttaattgagattgtaactcctctgtttgatttcatttttgcagataacctcagggatggtgataagcacatttgtgtctgctcccatcatgtacgtttctgcctggttactgacctttcccactatggaccctaagccattggcatatgccatccagaatgttagttttgatataagtattgtcagcctgatctccttggtaagtacgttgcatcccaaaatgaatggaaaccacagaatgagttttgagaatagactgttaacagaagggatttaaaaatctagtttcttatgaaataaagaaagctaaagcctgcccataaaatataatgtcagccttctgattaactgagttttgtttttctatttgggagttagagttctatagcagacaagacatgagatttagtcacacctggattttattcctggccctctcacaaactagctgtatgcctctgtggagttaccttaacctctctaaatttctgttttccagcataaaataatgacaataatttcacatatttccatgggttttttaaggggttacatgaaataatatatgtgaaaagcattctgcaaatgatgaatcactatagaattcctagctgttctagaatcatggggtcagaaggtatctttgagttcaagtccaaccgcctatttaatgttaatgaaacttttggttacttctcaaactgaatatatctaactaaaattaaataattaagtatatgacagctagagtatcttacagatcaaatggcctattgaattcatgttagtaaaactacagatattctggctgaaaaaaaagacaatgtgtacagttaatggaggtgggggtgaatatgtatattggtaacagataaatgtgtgattaattttaaagaaattccacctctgtcacatgttcttaaaatctactacacccattcataacagggcagtttggggaaagagaccatatacatttcagttggcaatgaggaaagaaggaagtcgccaggatacttacctggccaatacgtaggtagaatggaaacccaatcctttaaaatatgaggaatgtgatctggcaccgtggctcatgcctgtaatcccaacactttgggaggcagaggcaggcagatcacttgaggccaggagttcgagaccagcctggccaacatggagaatccccatctctactaaaaatataaaattagtcaggcatggtggtatgcatctgtaatcccagctacctgggtggctggaggcacaagagtcacttgagtctgggaggcagaggtttcagtgagccgagatcgcaccactgcacttcagtgagactctgtctcacacacacacaaagaataaaaaatgaagaatgtaagatgattaatcttaaaggtgtgtggtatgtgttgtttgaagtaaaacagcctggcatttagataccccatgagacaatatgttggaaatagaaaaggaaaaaaacttagaatagtgcattattataactatctcccactaaagctccttccctgaatagttgtctgtgaccctgtgtcccaccccagacacggaaggtaggcatagttagaacatggccctggtcaagggattagttcttttttgttgagacagagtctccctctgttgcccaggctggagtgcagtggtatgatcttggcttggctcactgcaacttctccctcctgggttcaagcagttctcctcccttagcctcccaagtagctgggattacaggcatacaccaccacacccagtagaggtggggtttcgccatgttggccaggctagtctcgaactcttaacctcaagtgatccgcctgtctgggcctcccaaagtgctgggattacaggcgtgagccactgcacctggccaaggcattagtttttttttgttttgctttgttttgttttgttttgttttgttttgttttttgagatggagtcttgctctgtcacccaggctagagtgcagtggtgcaatcttggctcactgcaacctccacctcccaggttcaagcaattcttctgccttagccttctgaatagctgggattacaggcgcccgccactgtgcccagctaatttttgtatttttagtagagacagggtttcgtcatgttggccaggctggtctcgaactcctgacttcaggtgatccacctgccttggcctcccaaagtgctaagattataggaatgagccacgatgcctggccacataagttcttaaagaccctgtaatttttggagagttaatttattatgggatctctccatgcttgttattttacattggttataataatttacctttttggaactagacagattaaataaaatattggaaattctttccgaaccaggacaaagagggttatttaaagaggctaatcattgtgttatttaataagtaattataaagattaagaaacatgaataacttttgaaccttttgtcttcaagatctggtctctggctattcttcttttgagtaagaaatataaacagcttcctcatatgcttacaactaatttactcattgctcaggttagtaaaactactgatatttagaactatgtttttctaatggattattctactgtagaggagaaaataactttgctaggtttttctagttatgaagtcagaagtattaccaaatgcagtcaattacagtttgattacaactactatacgcctaacatatttaatattgcaaaatgtcttaaactatctaaagttgaggctaataatggcatttgatgataactttgcattttttaatagaaacaatttaatcattaataattgaactctttcacaatcatttttctaattaatctttgcatgtctcaaattataatggaaagaactttagcaattttaatgtaagccattactaaatacaggtataaaattaatatttagaatgaagtcatctgtttcaattggatatgtatattgtcaaaggctctgttataaaatggatttttaacataaagtttgaagttttagtataagtagtgtgtaatacttgataattattcacaaaaaattttaaacaaataattatatttgctgtgaatgaaagatgaatatggctggcttaattggaattttctgttgcagtattgaattatatggttttcttagctatttacaaagtcttttaataattttttccttagtctattgtctgtgctggaatgatgatatggaattttgttaaagaaaaaaattttgttggacaaattttggtgtttgttctattgtacagctccctctatagcacctacctgtggacaggtgagttggattatgaatggaaattgagatctgttccccaccccaccccattcctaatagccctgagcttctagtgatctatttgaagtctggtagtacaggatcaaggcatgcactgaggcagatcagcccacccacagaggccatcggcaaagctgagttctgtttcctaatgtactctattcctgcctgggcttagagccttgtccagtcacatggtccttttccccagggcctgtggctctaggctgctgtcagtgctgctcccttttggagacaagagggaagatactgaaggcagatggagaaaggcgggaatgggaaagatgcgtgaggtgtgttccagagctcactatcgagtcctgctgaacagggaaattctggctctgcctcatgcaaattacttaacttttgaagcctcagtttcctcatttgtaaaactaggttacagcaccttacagagttactttgaggacaaactgaaatgttgagtatttatgtctggtacatggtaggcactaaataaatagaactatgttagttattaaatagaagaattagaggtaataagagaagaagaaaactaggggaataaaaaggcatggaaatagaaaaggacccagtgagaaagactgtttctcatttcagctggctccaaaaaggatattcaaaatgttgtagcacattgctattttgaagtataatatttatgtggatgcatgcattctggtatgtttgtgaaaaattctgtctggctgttttgtattcatcctacaaatttgaacctataaaatggcacatgaaaggaaatagtagaatggtaggaggcaggtgtcaggaagtgtccacaaaggacggacctttgatttcatgccttcaggatcaaaagcaggtcccatctcagtcaacagccttttgaagtgaagcaacaatgtggtgaggaatcatggaatgaaaaattcagcacaaacagaagatggtttgtgcttcttaaaggcaactacatcttgcatagcatgagtttttatgcaatgtcaaattaaaagagcctaaagactttatatttcaaaatatcgatggaccaacttgatgtctaataactaggcttactcaggttaactttataatcagaataacagagcagcaactagatcaatcaattaaaatgtcctaagtctctctgaaacccccttcaagcatgcacgccaaagtctattcaaagaagtcattctgaattcccaaaacccaataaaggtgccctttaaccatcaggttattatgctatgacagaattttagacctgaaaatgtcattttaagtcatcccattcgatcatttttagttctactcattttcataccatcctcacaatttttgccatatctgcatactacttgttcttttttccttaaaattgatttactttttttaaactttaatcagttgagccttatatcagtaaaatcccaggtttcatttgctaattagtttttttcaaatatgcattaaaataaacatataactagtcaaaacattttcacctttgtgacacctataatctctacaccttaggaaacactggtctaatttaaatccttcattttgcaaactgagaaataggcccaaaaagatagactgatttaggcaggagctctcacagcttcagtgagacatccagggctagctggattctgcctgtttgtatatagttcttttcacaaggcaggagtgatgcacattagaattttaaagactgcctttgctactgtaacaaagatggcacccttttgtgattggttacttgtttccctggcactgcaactacacagtgtacaaatggattgagggaggaaaagtggtaaagaaaaccaattctcaaggacctcaatgtcaatttatattaaatctagcacagtgttatttaatctggacaatcttaaatctaggtatgtattctttatatacagctaatatgcaattctaaaaccaaagcaaattcacagattctattcaaacaaaactacaaacccagtaattctaattagcaacattaattaacatgacaaaggatcttgttttgctaatgtaaatcatagcttgaaacataaaatggaactcactgctatggcttttttgccttgcctttacttccatatgtggggttttgaccttgttatctcactgatattctttcttcaaactaccatttcatttggactgtgcgttgtaatatcatttggccttcacttgactcaaacttaatataaaacccattgtaagctctggccaggcacagtggctcatgcctgtaatcccaacactttgggagatccaggcaggaggatcgcttgaggccagtagttcgagactagcctgggcaatatagtaagaccctctctctataaaaaatttgaaaattagctttgcatgctggtacatgcctgtagtcccagctactcaggaggctgaggcaggaggatcccttgagcccagaattttgagcagtaattgtgctactgtaccccaacctggttaacaaagtgagacccccatctctaaaataaaataaaaataaacccaatgtaaattctgaaatcatgagactgcatgttggttgcaaggtggatacacagctgactaccactgaaaaaaaaaaaagaaagaaaaaaaaaagacttaaaatttctcatagaaattcccagatcctgaagaatatgtcttaggtaccctaggggtccacaaatctgagtttgagaaactgattcaagaaacaaagaatttagcttgtgtcaaaaggccaggtttctagtctcactctgccctctgctggctgtatgacttgggcaaaccctcatttccacatctaaggtgctcatttaaaaatagaggtccctttcaactttaaagttctaagatcctataactatgtagaatttattaaataaaatgttacttgcatacataattacatataagttgtaaggaaagttcaagaacttcaaaacatttgtgtttgtattaaattcagagtgtgtttgtattaagtgctatcattacacttagggcgttttctaaaaacataacctgggtaagagttgcccatacttcttagcaccagaagagggggatgtttttatttttagaattgtcctgtattcaattaaaaaatgtttttcagctgggcataatggcttatgcctataattccagaactttgggaggccaaggcaggtggatcacttgaggccagcagttcaagaccagcatgggcaacatggtgaaacccatctctactaaaaatacaaaattagcctgacatggtggtgcacacctgtaatcccagctacttgtttggctaaggcatgaaaattgcttgaacccgggaggcagaggttgcagtgaaccaagatcatgccactgaactccagcctgggcaacggagtaagactctgtctaaagaaaaaaaaaatgtttttcagttatacttagattccaaacacatgaatcaaaacaataaaatgattagggcttttggagagaaatacttctccagacgcagtggctcatgcctgtaatcccagcactttgggaggcagaagtgggaggatccactgagctcaggagttcaagaccagctagggcaacatagtatgactctgtctctacaaaaaaaaattcttatttagccaggcatggtggcatgtggctgtggtcccagctactcaggaggctgaggtggaaggatcacttgaaccctggaggtcaaggctgcagggagctgtgatcacacctctgcactccagcctgggcaacagagtgagaccctatccaaaaaacaaacaacaaaaaccagagagaaaataaaataaatcctcacagataaaaagaattgagtaaagaaacaatatatgagggaaacaatgaatgattttgaattaaaacttgtttcaaaatattgaggatagcatttatttagaaggaagaaattctaaagcaaaaaccacacactactatgaaataagcttggtttaaaaaaataaaaaggaaataaagtttcataaagtctgatcaatgttgagtaactgtctctctttcaatcttcttattcttaggccttctagcaatttctttgtttcttttgaaaaagcgagagagggtacaaattcctgttggaataatcataatatctggctgg

SEQ ID NO: 11753 - DNA, 312 bp, Homo sapiens
attgctagaccatccctctgctctgctgttaaaaactgctttgaggttcatactttccggctagaccactgatcctctctgctgttacctgctgacctcattctaggcattccctctcatttacctttatcccaagttttgtcattgtcttgtgaactaccatgaaattctctgccctgtcatttccttgacctcctcttctccagtgatgttttcctttactccatttcagccactaagtcccatagccacatcctggaccttgtcatctggaaaatatttaactgagtagctcattagctgttttactct

SEQ ID NO: 11754 - DNA, 188 bp, Homo sapiens
caaaaaattagctgggttgtggtggcgggcgcctgtattcccagctacttgggaggctgaggcaggagaatggcgtgaacctgggaggaagaggttgcagtgagccgagattgtgtcactgcactccagcctgggcgacagagcaagactccatctcaaaaaaaaaaaaaaaaaaaaaaaatgtgccc

SEQ ID NO: 11755 - DNA, 77 bp, Homo sapiens
gaggttgcggtgagctgagatcacgccattgcactcaagcctgggcaacaagagtgaaactctgtctcaaaaataaa

SEQ ID NO: 11756 - DNA, 204 bp, Homo sapiens
ctgaccaacatggagaaaccccatctctactaaaaatacaaaattagccgagcgtggtggcgcatgtctgtaatcccagctactcgggagcctgaggcagcagaatggcttgaacccgggaggcggaggttgctgtgagccgagatcgcgccattgcactccagcctgggcaacaagagtgaaactccatctcaaaaaaaaaaa

SEQ ID NO: 11757 - DNA, 1289 bp, Homo sapiens
tctactaaaaatacaaaaaaaatagctgggtgtggcggtgggcacctgtagtcccagctattcgggaggctgaggcaggagaatggtgtgaacccgggaggtggagcttgcagtgagccgagatcacgccactgcactccagcctgggtgacagagcgagactccgtctcaaaaaaaagaaaacaataactaaaattcaccatatcaatagactaaagagaaaccatatgatgtcaataaatggagaaaaagcatttgacaaaattcaatatccattcatgagaaaaactcagcaaattaggaaggagagggaatgtctttaatctgataaaaagcatgtacacaaatgcctatagctcacatcataattaatggtgaaagactgaatgtttctgccctaagactgggaatgaggcaaggtagacatttctcaccactcatactcaatgttgtactggaggacctagttagtgctgtagagcaagaaaaaaaaaagaaataaaaagcacagattagaaagtaagtaaaactgtctctattcacagatgacgtgattttctacatagaaaatcccaagggattgaactcctcgactaatgaatttaataaggcagcaaacacaaggtcaacctacaaaactcatttatatttctatatgctagaaataaaaaactagaaatagaaatttttaaacagtaataattccaacacctgcaaaaatgctttggtataaatctaaacacaagatgatgcacatggtctttatactgaaaaatacaaaacacccataaaaatatcaagacctaaatagtgcattacactatgttcacagataaaactattcaatattgttatgatgctaattctcctcaaactgatttataagtttagatacaaaatcttggcaggacattttgctgatatctacaagctaattcaaagatttatatgaaagttaaaggaaccagaatagccaaaacaatttggaaaagaacaaagttgaaggattcacacaacttaccaatttctagtagacaagacagtgtggcattagcaaaaggatgaacacatatatggaaaaaaacagagctcaggaacagacccacgcacatacggccaatttttttttttttttttttttgagacggagtttcactctgtcgcccaggctggagtgcaatggcgtgatctcggctcaccgcaacctccgcctcccaggttgaagtgattctcccgcctcagcctcccaagtagctgggattacaggtacccgccatcatgcccggcta

SEQ ID NO: 11758 - DNA, 256 bp, Homo sapiens
ggcgggcggatcacgaggtcaggagatcgagaccatcccggctaaaacggtgaaaccccgtttctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaa

SEQ ID NO: 11759 - DNA, 247 bp, Homo sapiens
aggagatcagatcgagaccatcctggctaacacggtgaaaccccgtctctactaaaaatacaaaaaattagccgggcgtggtggcgggcgcctgtagtcccagctactcgggaggctgaggcaggagaatggcgtgaacccaggaggcggagcttgcagtgagccgagatcgcgccactgcactccagcctgggcgacagagcgagactccgtctcaaaaaaaaaaaaaaaaaaaaaaaaaaaaaga

SEQ ID NO: 11760 - DNA, 157 bp, Homo sapiens
ggcgggcgcctatagtcctagctactcgggaggctgaggcaggagaatggcgtgaacccgggaggcggagcttgcagtgagccgagatcgcgccactgcactccagcctgggcaacagagcgagactccgtctcaaaaaaaaaaaaaaaaaaaaaga

SEQ ID NO: 11761 - DNA, 252 bp, Homo sapiens
ggcgggaggatcatgaggtcaggagatcgagaccatcctggctaacacagtgaaaccccgcctctactaaaaatacaaaaaaaattagccgggcgtggtggtgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaa

SEQ ID NO: 11762 - DNA, 309 bp, Homo sapiens
ggccgggcgcggtggctcacgcctgtaatcccagcactttgggaggccgaggcgggcagatcacgaggtcaggagatcgagaccatcctggctaacacggtgaaaccccgtctctactaaaaatacaaaaaattagccgggcgtagtggcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaaaaa

SEQ ID NO: 11763 - DNA, 310 bp, Homo sapiens
gccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaaagatt

SEQ ID NO: 11764 - DNA, 9463 bp, Homo sapiens
  misc_feature (252)..(252): n equals a,t,g, or c
acaagcagcaattcgcttcatgaatttgtaaaacgtctgatctccacttttaattatggtcttctcatatttttcatcaccatcattaggaaggctaaaaacagaagcagaaaacacttttgaatgtctatatccagaaaattacagcatttgcaagacaaaacaagataattttcttttaaaaaattttactcaggccacggcgcagatggacttctaacggccctgtaattcctcagccactttgggtanggccgaggccagcggccagtaatccaccaaggtccaggagatcgagaccatcctggccaacatggtgaaaccccatctctactaaaaaatgcaaaaaattggctgggcatggtggcttgcgcctatagtcccagctactcagcaggctgaggcagaggaaatcgcttgaacccgggaagcggaagttgcagtgagccgagatcgtgccatgccactacactccagcctggtgacagaatgagactccatctcaaaaaaaaaaaaaaaaaaaaatcaatcacgcctttaatcccagcactttgggaggccgaggtgagcagatcacctgaggtcaggagcttgaaaccagcctggccaacatcttgaaaccccatctctaataaaagtacaaaaaattagccaggcgtggtggcgggcgcctgtaatcccagctccttgggaggctgaggcaggagaatcacttgaacccaggagatggaggttgcagtgagccaagattgcgctattgcactccagcctgggcaagaagagtgaaactccgtctcaaaaaaaaatttctcaggccggtgcagtgggctcacgcctgtaatcccagcactttgggaggccgaggcaggcggatcacttgagctcaggagttcaaaaccatcctgggcaatctggcagaaccttgtctctacaaaaaaatacaaaaattagctgggcatggtggcatgcacctgtggtcccggctattccagaggcaaggctgtggtgagccgtgagcacaccattgcactacagcctggataacagtgtgagaccctgtctcaaaaagaaaaaaaaaaaaaaactgtcaaagttaaaaaactgtaaaactgtcaagtaattttttttttttttttgagagggagtctccctctgtcacccaggctggagtgcaatggtgcaatcttggctcactgcaacctccacctcctgggttcaagcaattctcctgcctcagcctcctgagtagctgggattgcaagtgtgcgccaacacgtccagctaatttttgtatttttagtaaagacaaggtttcaccacgtcggccaggctggtctccaactcctgacctcaagtgatccatctcggcctcccaaagtgctggaattataggagtgagccaccgcactcagccaaaaactgtcaagtaaatatttttgatatttaaattgtgtacatgtagctctgcagttccctgcccaacccttctcccaagccattttcaactcttgagtaattatttacaatttaaaaagtcgcagggcacagtggctcacacctgtaatctcaacactttggaaggccgaggcaggtggatcacgaggtcaaaagatcgagaccatcctggccaacatggtgaaaccctgtctctactaaaaatacaaaaattagctgggcatgatggtatgcacttgtaatcctagctattcaggaggctaagggaggagaattgcttaaacctgggaggtggaggttgcaatgagctgagattgagccactgtactccagcctggcaacagagcgagattctgtctcaaatatatatattttcatatatattttttaatatatatattttattatttattttatatatatatatatatatatatgtatttttcatctgggtgcggtggctcacgcctgcaatcccagcactttgggaggccaaggagagtgggtcacttgaggttaggagtttgagaccagcctggccaacatggtgaagccccatctctactaaaaatacaaaaattaaccgggtgtggtggcgggtacctgtaatcccagctacttgggaggctgaggcaggaggatcatttgaaactgggagctggaggttgcagtgagccattatcacaccgctgtactccagcctgggtgacaaagtgagactctgtctcaaaaaaaccaaaaatttttttaattagctgagtttggtggcacacacctgtagtcccagctatggggaaagctgaggccagaggatcccctgaggccaggagtttgaggctgcagtaaaccatgagcaggctgggcgtggtggctaatacctgtaatcccggcactttgggaggtcgaggtgggcggatcacgtggggccagaactccaagaagagcccggccagtatggcaaaagcccatctctactaaaaagaaaatacaaaaattagctgggtgaagtggcgcacgcctatggtcccagctactcgggaggctgagacatgagagctgcttaagccggcgagggagaggttgcagtgagccgagaacgtgccactgcactccaacctgggcaacagagcaagactgtctcaaaaaaaaaaaaaaaaaggccataaccacaccacaccactgcagttcagcctgggaaacaaagcaagatcccatctctaaaaaaaaaaaaaaaaaaaagaagaatactctagtctgaagaaacccaccaaaaataagcaaatacataaaaacttaagaaattaaaaaataaaaaatcctgccgggcgcggtggctcacacctgtaatcccggcactttgggaggccaaggcaggtggatcacgaggtcaagagattgagactatcctggtcaacatggtgaaaccccgtctctactaataatacaaaaattagctgggtgtggtggcgcgcacctgtagtcccagctacttgggaggctgaggcaagaaaattgcttgaacccaggaaggggaggttgcagtgagccgagatcgcaccactgcactccagcctggcaagagagcccatatcacacacacacaaaaataaataaataaataaataaataaataaataaataaatataaaataaaaagtccttataaccatcaattctattaaggattattttcaaacaccaacatgtcttcatgcattccccttcatcattattctgaaaaagcctacaaatgaaacagttctggtaaagaaccaggccatttctccaaatattctattgtaatttttttattctaatagtaaaaaatgctgggtgcagtggctaaaacaaatttttaggccaggcacaatggctcacgcctgtaatcccagcactttgggaggctgaggtgggtggatcacctgaggtcaggagttcgagaccagcctgaccaacatagtgaaaccccatctctactaaaaatacaaaaattagctgggcatggtggcacatggctataatcccagctacttgggaggctgaggtaggagaactgcttaaacctgagaggtggaggttgcagtgagccgagatcgtgccattgcactccagcctgggtaacaacagcgaaactcaaaaaattttaattggtcagacatggtggtgtgcacctgtactcccagctacttgggaaactaagatagattgcctgagcccaggagttcaaggctgcatgagctttgatcacaccaattcactccagcgtgggtgacagagtgagaccctgtctctctcagtcaatcaataagcaaaaatgatcattcttacctctttagagagctttggtttataaagcctttcaagatctaccctctcgcttaactctcaaaaaatcatgggatgaaacagagaacagagatatcaccatcactctcattttacagaattgaggatctgaaagcatctctgaggtcctgggccagttctggagccacagccaagagtcaataaacaaatggcgtttttcttttcctttttccattttttcaccccaatcttattatcccagatcaaatggtagttttctaacttgcctgtctctgctataaagacatattagaaacataaaagaaaatttaagagtcagtgaacgcgtcttctataaatacttgccatctctaacttctgtttgttcatcttcactttcttaacggcaattataaatagagcagggttttcaagctaactcaagttggctgataaggaagtgaagcaaaaaggtcctacatacaagttctgcctgaaagtttccccaggtcctgtggtgaaactgaagggtaactcttgtggctgcttcccaatccagtcacctctcaacctcagcagcacacatcctcacctttgggaaagcaactgatccatggcaatgccttctctctgctgatagtccctcagaaggctgtgggcatgatccaggttgacaaagtccctgtaatcatcctcatctgcaacacagatgtagtagggcaggaagagcggcagcccaggaggcacaggatgggcagcacccaggacagcatcctgcaggcggaggtcttggagccgagcagtccagtctacgtctttggcactgctggcatcattcccaaaatccaaggtaaactgtggtgaaggcccctcctcagtatcacttccccagtcatcagcaccttcacaccagtcctcagctgcaaggctgtttccctgtttctggaaaaatactcagtgaatgaggtccgagcacatttgggaggtttattctaatccttcggctccagccacccaccgccgcgccttccagagggagccttcacaccatccccttcccctctggtacactccaatcaaactttctagaccctatgtactcaaaagcacgttggaggtgacttaaaatacttgtctttcctttttggggtgagtgtgacagatatagtacaggggttattcaaccatccgttccaatatctttctgttgtgcttcatgtattgcaggaactgaaaagaaagaactacctttcccagaccccttagcagctagggtttcagatatgattaggggtctgctaatcaggtctactagagagaaacatgaacttgagacagagtgaagtagaaagaaagaccacatagcaaaaggtagccattgtgtagacacagacagaacaaggctttggagccaacggttcggtggcaaagacagcctctagttcaccagatcacacctaagcttcctgacagcaggagaggtggcatagcagctccttcacggccagttctgaggtgtgattctggagggcattcctggagcctcctccttcagcctatccacttactaaaaacctcactcctgtgttaagtctgtctcagcttaaaagccaggcatggtggcacgtgcccgtaatccagctactcaggaggctgaggcaggagaatcgcttgaacccgggaggcggaggttgcagtgagccaagatcacaccactgcactccagcctgggtgacagagcgacactcggtctcaaaaaaaaaaagaaaaagcaacagcacttttctaattatctgcacctgaaccctgacaaatataggcaaacaccactgtcttcaactttttatttaagtactgctaatactatgcctagcaaacatcaagaactgggtgcaggccgggcccagtgtctcacgcctgtaatcccagcattttgggaggttgaggtgggcggactgtttgagtccaggagttcaagaacagcctgggcaacatgacaaaatcccatctatacaaaaaatatgaaaatcagctgggcatggtggcacgtgcctgtaatcccatctactcaggaggctgacgtgggagaatggcttgggcccaagaggcagagatcatgccactgcactccagcctgggtgaccagaatgcaaccccatctcaaaaaacaaacaaacaaacaaacaaactcagtgtatatataaagacacatttacagtcaaagggaggctaaattgtgttctgcagctaccaacttgcctgccttttcaataaattcagatttcatcttatgaaatgtgttaatacatatatagctctcataaagtatatttactataaagacacgtatacattatcacatacaaccacatatatgtacacacccatatatattcccaaacaggaaaatcagtaaactgtgtgtctcaagaccttcagtgtaagtttaaaaaaactactatatatacaatggaatatttttcacccttaaaaaaaaaaaggaaattctgtcatttgtgacaacatggatggaactggagaacattttgctaagggaaataagccagacacaaagacaaatgctgcatgtattcacttatatgtggaatctaaaacaacctcaaagaagtagagagtagagtggtggttaaagaaatctggagtggccaggtgtggtggctcacgcctgtaatcccagcacctcaggaagccaaggcgggtggatcacgaggtaaagagatcgacaccatcctggctacacggtgaaaccccatctctactaaaaatacaaaaattagctgggcatggtggtgtgtgcctgtagtcccaggtactcaggaggctgaggcaggagaattgctcgaacctgggaggcggaggctacagtgagccaagattgtgctactgcactccggcctggcaacaaagcgaaactccatctcaaagaaaaaaaaaaatctggagtgagccgggcatggtggctcacgcctgtaatcccagcactttgggaggccgaggcgggtgggttgcctgaggtcaggagttcaagaccagcctggccaacatggtgaaaccctttctctactaaaaatataaaaattagctgggcgtggtggcgagtgcctgtaatcccagctactagggaggctgaggcaggcaggataagcgcttgcatccgggaggtggaggttgcagtgagctgagattgtgccattgcactccagcatgggcaataagagcgaaactcggtctcaaaaaaaaaaaaaaaaaaaaaaggaagaaagaaacctggagcgggaagaataaggagatgacggtcaaagaatacaaaacctcagttattcaggaggaatgtgggttttttttaagttctactgcacagcatgaatatagttaataatagagtattgtggctgggcacaggggctcaagcctgtaatcccagcactttgggaggccgaggtgggtggatgacaaggtcacgagatcaataccatcctggctaacatggtgaaaccctgtctctactaaaaatttaaaaaaatgaaaaaattagctggccgtggtggcgggcgcctgtggtcccagctactctggaggctgaggcagaatggtgtgaacccaggaggtggagcttgcagtgagcagagacggcgccactgcactccagcctgggcaacagagcaagactccgtctcaaaaaaaaaaaaaaataagagtattgtgtatctccaaattgctagaggaaatttcaaatgttctcacaagatgttaagtatttgaggtgatgaatgcattaactagcttcatttaattattccacatgatattcatgaatcatagccatcactttatacctcataaatttatacattattataaactgtcaatttacagttaaaaaaaaaagttgaagaaatccaggaggaagtctccatctcccttttgtttttttggcaggggacagggtctggctttgtggcccaggccggagtgcagtggcacaagtgtaggtcactgcagcctcaacctcctagactcaagcaatcctcctacctcagcctcctgagtagctggcactacagttgcgtggccatcatgcctggctaatttgtttactttttatagagacgatgttttgctatgttgcccagactgctctcccaacgttttttttttcttttgttttgttttgttttgtttttacggagtctgtcacccacgctggagtgcagtggcatgatctcagctcactgcaatctctgtctcccgggttcaagcgattctcctgcctcaacctcccttgtagctgggattacaggtgtctgccaccatgcccggctaattttttgtttttgtttttaatagagacggggtttcgccatgttggccaggctggtctcgaacttctgacctcaggagatccgcccgcctcggcctcccaaagtgctgggattacaggcgtaagccaccgcgcccagcctggtctccaacttctgagctcaagcaatcctcccacttcagcctctcaaaaaacggtgggatcacaggcgtgagccaccatgctgggcctccatctccttttaacaaaggagttagaaaataaaaataaagtaaaatagaagaaaaaaaaaactctcacaaaaccttaagaaaggccgggcgcggtggctcatgcctgtaatacccagcactttgggaggccgatgcggggtggatcacctgaggtcggcagttcgagaccagcctgaccaccatgccgaacccccgtctctattaaaaatacaaaattagccgggcgtggtggcatatgcctgtaatcccagctactagggaggctgaggcaggagaatcgcttgaacctgggaggcggaggttgcggtgagccgagatcgcgccattgcactccagcctgggcgacagagcgaaactccgtctcaaaaaaaaaaaaaaaaaaaaaactttacgaaaatagcattttatggttcttcagaaaagcaaaaaacactccagtgtacttcaaagaacacggctttaaagtctgccccaaactattctctggaaaatatcctcaaatgacagaaaaacaataacatgccaatcacaacctttacctgagcgtcctgcgcctctctctctggcacctgcaggcactgggagcggaacaccttccagcttcggggtgaagacaaagggccgtgagggctgcaccccgactccagcccgccggcccgccccagcccgctggaaaggacacccctggagcagctctgggacttccccgcctacctgcgcgcaccgccggtgctacagccggggcaggcgcacgcgaacacgtgcagcagacggtgaaacggggagccttccagcgggcaatacacctgcacgaccagagcgagcggctgcccgcagcgctgacacacgggcctgggcgcagccacggtgggcagagcatcctgaggggacagaggaggcgctcagaccccgactccccccaggacctcgcccactccctccgcacccttcagcagcacccatcgaccccagctccggcacccgccctcaccggaatgccgcccagcttgctagcagtccaggcacccggccctgtggggctgccgtgcaccggcgcatctcgaaggcccagcagcaccggcttcagaacggccgccatggccgccgggcgaccaggtgaaaacgc

SEQ ID NO: 11765 - DNA, 250 bp, Homo sapiens
ggcgggcggatcacgaggtcaggagatcgagaccatcctggctaacacggtgaaaccccgtctctactaaaaatacaaaaaattaaccgggcttggtagcgggtgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaa

SEQ ID NO: 11766 - DNA, 262 bp, Homo sapiens
ggcgggcggatcacgaggtcaggagatcgagaccatcccggctaaaacggtgaaacccagtctctactaaaaatacaaaaaattagccgggcgtagtagcgggcgcctgtagtcccagctacttgggaggctgaggcaggagaatggcgtgaacccgggaggcggagcttgcagtgagccgagatcccgccactgcactccagcctgggcgacagagcgagactccatctcaaaaaaaaaaaaaaaaaaaaaaaaaaaaaaa

SEQ ID NO: 11767 - DNA, 297 bp, Homo sapiens
gccgggcgcgtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaa

SEQ ID NO: 11768 - DNA, 306 bp, Homo sapiens
ggccgggcgcggtggctcacgcctgtaatcccagcactttgggaggccgaggcgggcggatcacaaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaa

SEQ ID NO: 11769 - DNA, 314 bp, Homo sapiens
acccggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagtgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaaatta

SEQ ID NO: 11770 - DNA, 253 bp, Homo sapiens
ggcgggcggatcacgaggtcaggagatcgagaccatcccagctaaaacggtgaaaccccgtctctactaaaaatacaaaaaattagccgggcatagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaa

SEQ ID NO: 11771 - DNA, 303 bp, Homo sapiens
ggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagattgcgccactgcactccagcctgggcgacagagcgagactccgtctcaaaaaaaaaaaaaaaaaaaaaa

SEQ ID NO: 11772 - DNA, 244 bp, Homo sapiens
ggcggatcacgaggtcaggagatcgagaccatcccggctagaacggtgaaaccccgtatatactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaa

SEQ ID NO: 11773 - DNA, 253 bp, Homo sapiens
ggcgggcggatcacgaggtcaggagatcgagaccatcccgggtaaaacggtgaaaccccgtctctactaaaaatacaaaaaattagccgggcatagtggcgggcgcctgtagtcccagctacttgggaggctgaggcaggagaatggcgtgaacctgggaggcggagcttgcagtgagccgagatcccgccactgcactccagcctgggcgacagagcgagactccgtctcaaaaaaaaaaaaaaaaaaaaaa

SEQ ID NO: 11774 - DNA, 306 bp, Homo sapiens
ggctgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagattgcgccactgcactccagcctgggcgacagagcgagactccgtctcaaaaaaaaaaaaaaaaaaaaaaaaa

SEQ ID NO: 11775 - DNA, 257 bp, Homo sapiens
ggcgggtggatcacgaggtcaggagatcgagcccatcctggctaacacggtgaaaccccgtctctactaaaaatacaaaaaattagccaggcgtggtggcggcgcctgaagtcccagctactccggaggctgaggcaggagaatggcgtgaacccgggaggcggagcttgcagtgagccgagatcgcgccactgcactccagcctgggcgacagagcgagactccgtctcaaaaaaaaaaaaaaagaaaaaaaaaaa

SEQ ID NO: 11776 - DNA, 254 bp, Homo sapiens
ggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaa

SEQ ID NO: 11777 - DNA, 304 bp, Homo sapiens
agcaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctactcgggaggctgaggcaggagaatggcgtgaacccgggaggcggagcttgcagtgagccgagatcccgccactgcactccagcctgggcgacagagcgagactccgtctcaaaaaaaaaaaaaaaaaaa

SEQ ID NO: 11778 - DNA, 201 bp, Homo sapiens
cccgtctctactaaaaatacaaaaaattagccgggcgtagtggcgggcgcctgtagtcccagctacttgggaggctgaggcgggagaatggcgtgaacccgggaggcggagcttgcagtgagccgagatcccgccactgcactccagcctgggcgacagagcgagactccgtctcaaaaaaaaaaaaataaaaaaaaaaaa

SEQ ID NO: 11779 - DNA, 257 bp, Homo sapiens
ggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaag

SEQ ID NO: 11780 - DNA, 303 bp, Homo sapiens
agcaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctactcgggaggctgaggcaggagaatggcgtgaacccgggaggcggagcttgcagtgagccgagatcccgccactgcactccagcctgggcgacagagcgagactccgtctcaaaaaaaaaaaaaaaaaa

SEQ ID NO: 11781 - DNA, 308 bp, Homo sapiens
aaaagacggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcggggaggctgaggcaggagaatggcgtgaacccgggaggcggagcttgcagtgagccgagatcccgccactgcactccagcctgggcgacagagcgagactccgtctcaaaaaaaaaaaaaaaaaaa

SEQ ID NO: 11782 - DNA, 307 bp, Homo sapiens
ggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgcccctgcactccagcctgggcgacagagcgagactccgtctcaaaaaaaaaaaaaaaaaaaaaaaaaa

SEQ ID NO: 11783 - DNA, 258 bp, Homo sapiens
ggcgggaggatcacgaggtcaggagatcgagaccatcctggctaacacagtgaaaccccgtctctactaaaaaaacacaaaaaaattagccgggcatggtggcgggcgcctgtagtcccagctacgcgggaggctgaggcaggagaatggcgtgaacccgggaggcggagcttgcagtgagccgagatcgcgccactgcactccagcctgggcaacagagcgagactccgtctcaaaaaaaaaaaaaaaaaaaaaaaa

SEQ ID NO: 11784 - DNA, 262 bp, Homo sapiens
ggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaaaa

SEQ ID NO: 11785 - DNA, 257 bp, Homo sapiens
ggcgggcggatcacgaggtcaggagatcgagaccatcccggctaaaacggtgaaaccccgtctctactaaaaatacaaaaaaattagccgggcgtagtggcgggcgcctgtcgtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaa

SEQ ID NO: 11786 - DNA, 301 bp, Homo sapiens
ggccaggcacggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtggcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaa

SEQ ID NO: 11787 - DNA, 301 bp, Homo sapiens
tggccgggcgcggtggctcacgcctgtaatcccagcactttgggaggccaaggcgggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaa

SEQ ID NO: 11788 - DNA, 277 bp, Homo sapiens
gggaggccgaggcgggcggatcacgaggtcaggagatcgagaccatcctggctaacacggtgaaaccccgtctctactaaaaaaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaaaaaaca

SEQ ID NO: 11789 - DNA, 259 bp, Homo sapiens
ggcgggaggatcatgaggtcaggagatcgagaccatcctggctaacacagtgaaaccccgcctctactaaaaatacaaaaaaaattagccgggcgtggtggtgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaagaaaa

SEQ ID NO: 11790 - DNA, 135 bp, Homo sapiens
ctgcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaa

SEQ ID NO: 11791 - DNA, 252 bp, Homo sapiens
ggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactctgtctcaaaaaaaaaaaaaaaaaaaaa

SEQ ID NO: 11792 - DNA, 306 bp, Homo sapiens
ggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccaggaggcggagcttgcagtgagccgagatcccgccactgcactccagcctgggcgacagagcgagactccgtctcaaaaaaaaaaaaaaaaaaaaaaaaa

SEQ ID NO: 11793 - DNA, 314 bp, Homo sapiens
agctgttggccgggcgcggtggctcacgcctgtaatcccagcactttgggaggccgaggcgggcggatcacgaggtcaggagatcgagaccatcctggctaacacggtgaagccccgtctctactaaaaatacaaaaaattagccgggcgtggtagcggggcgcctgtagtcccagctactcgggaggctgaggcaggagaatggcgtgaacccgggaggcgggagcttgcagtgagccgagatcgcgccactgcactccagcctgggcgacagagcgagactccgtctcaaaaaaaaaaaaaaaaaaaaaaaa

SEQ ID NO: 11794 - DNA, 311 bp, Homo sapiens
gaggcaggctgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcaagactccgtctcaaaaaaaaaaaaaaaaaaaaaaag

SEQ ID NO: 11795 - DNA, 256 bp, Homo sapiens; identical to SEQ ID NO: 11758

SEQ ID NO: 11796 - DNA, 126 bp, Homo sapiens
ccgggcgcggtggctcacacctgtaatcccagcactttgggaggctgaggcgggcggatcacgaggtcaagagatcgagaccagcctggccaacatggtgaaaccccgtctctactaaaaaaaaaa

SEQ ID NO: 11797 - DNA, 76 bp, Homo sapiens
agagaccaaacaagcgagagagagagagagagagagagagagagagagagagagagagagagagaaaatgcctagt

SEQ ID NO: 11798 - DNA, 295 bp, Homo sapiens
attattttgacaaagatagcaaggcaattaaatgtagaaaccttgtttcttaaatcatatcattctaaactaattggacatccatagggaaaaaaaaatgaaactgaatacgtatttcataccttatataaaaatggtcagacctatcagaatgaatcatgagcctaaatgtaaaacctgtaactatacaacttctagaaaaaatgtttgtgacactgctttaggcaaagctttttttagatatgacaccaaaagcattattcacaaaaagttgctaaattggacttcctaaaaa

SEQ ID NO: 11799 - DNA, 49 bp, Homo sapiens
agagacggggtttcaccattttagccaggatggtctcgatatcctgacc

SEQ ID NO: 11800 - DNA, 915 bp, Homo sapiens
ttatttttaatacaaatacaaaatttatttccatagaaagcaaaatttataagttaaatataaagattaaaatagtatttgaaaagctcactatagtgctaacaaactaaatgaaaataaggctattttgcatttaaaactgaaatacctcttaaaacaatttgatccccagtgtttgctctttttgaagtaaccgacttactcttaaaaaggatggctgccaagatggaaagtcttattgggttttcatgttaacctattctttggacataactatgaattttgtatacaatgcatttcatgaaaagttatggctcccccagatttcccacaagtgtgatcttgaagtcctaaacatttgtccatgtaagcttcaaaacagagccttaactgagttattcaagtagcagtacttaaagatataatttttgaagcagtttcaatggtttgtgatccaaataatcagtttctgaacattactacttcacgtaatagagtccatcttcagtttcttctcactttctctttcccttttgggtttcctttttctggcctgaggctaccagttctttgggtactatcaagatacttccatcatgggtacactgaagagcatagtggtttggattgactggcctaccttggtcatctcttaatctactaaaaatatcatgataaaggtcatgcagtttgtttcattatgttaatagctttgatacattgtgctcgctctctcttaagagtttccttctttgcttgcaagttacatacatcatcttctagattcaaaattatgtccaatttgcgtttacgatagttctgcgcagcaactttatttttccctcttcgtctgatatcacggataagtgagacttgtaggtctgtcagatagtacctacttaacatgctattgaa

SEQ ID NO: 11801 - DNA, 160 bp, Homo sapiens
ggctcactgcaggctccgccccctggggttcacgccattctcctggctcagcctcccaagtagctgggactacaggcgcccgccacctcgccaggctaattttttgtatttttagtagagacggggtttcactgttttagccaggatagtctcgatctcc

SEQ ID NO: 11802 - DNA, 2089 bp, Homo sapiens
tacatgtccagtgatgatgatgttgatatgagtctttttctttcccattttcggtttgatttaggggtagttttcatgacacctgtattctggtggcaaaccctttgccaaaaagctgcttaggtcttttgtccattttgaatagatttttgtgtatagtgtaagataagggtcaaatttcattcttttacatgtagacatccagttttcccaagtgtttgttgaagagactatccttgcctcattgtgtgttcctggtacccttgttgaaaattagttgaacatatttgcatgggtttatttctgagctctctattttgttccattggttatatgtctgtctttctgccagtaccgtactgttttaattactgtagctttgtaatatactttgaaatcaggaaatatgaagcctccacctttgttcttctttctcaagattgttttagctatttggggtcctttgtggttccatatgaattttaggtttgttttttctatttccatgaaaaatgccattgggattttgatagggattgcattgaatctgtagattgctttatgtattatggctattgtaatgatgttgaagtcttccaattcatgaacatgggatgtctttttatttatttgtgtctcttaaaatttatttcatcagtgttttatagtttttcatttgcaaatctttcatttccttggtcaatgttattcctaagtattttattctttttgatcttatagtaaatgagattgttttcttaatttgcttttcaaatagtttgatgttactgtatacagacacagctgattttgtatgttgatttttatatcctacaacaaatttttctgaatttgtttagtatgtctaataaatttttgatgcactctttagggttttctacatataaggtcatgtcatctgtgaacagaaataattttacttttccctttctaatttggatgccctttatttctttttattgccgaattgctctgactgtgacttccagtactatattgaatagaggtggtaagaataggcattttggctttgtttctgatcttaaggaaagacttccagtttttcactattaagtctaatgttaactgtgagtttttcatatatggccttcattattttgagatagtctcaccctgtttgtagtttgttgagattttttattatgaaaaagtgttgaattttgtcaaatgcctttctgcatctattaagagatcttgaagaaagtgaagagtaaagagttactgaaatttcttgcttagaagattagataaatggtgatgctactaattaagggaaagtagaaatttttgaagaagataaatagataagtcttagacattatgtgttttatttcttcaaacattctggttaaaatatcaaagtaacagttgttgcaaatggaaaaaatatgcagctctgaggagacattggaagcatcgataatacttagaaaaaccttacctaatgctgccccaagcactttactcttgtaaattcatctaattatcactgtaacaccacaaattagctattagttgttatcttattttatagatgagaaagctgaggcacagagaggccatgtcactcgcctgaggttccacggcttttaagtggcagaacattgatttgagtcaatgcattctgaactctgtgttcatgttctcaactatttatactattctgcttcagaaataaagactcccatttactaagcattttaacatgctagacattgtattgaacattatttgtatcatatcaattatctaatcctcaatacagctcttttatttcacagaataggaaattgaagcaaagagaggaaaagttgcatgaacgattttacacagctgttaggtcgttgaactggattctgaacctagcattctggctggagagcccaagcttttatcagttgtgtatagcagtgagagtagattccccatggaaaggtaagagctgaatacagagtccagagggaacaccaatatgaagaaggagttgtgaagcggcctgaaaagaaatgacaaagataggaagagagttacaaaaaaaaaaaaagag

SEQ ID NO: 11803 - DNA, 662 bp, Homo sapiens
aactagagattactagtggcagcaggctgagaaaactcagtagcaaaatgtggtagagacttgttgaatgtattatgctttcaaggacattttcagtgaaaggaataactattttagttattctttttagctgatctaaggttaagtctaactttacagaatttaccttaatctgcttttataaattagtcattcctgttttattttgtcccttatttatgatatatttccgtaaaatgtaagaataagtagaaggcatgatataatttattcaggagaattatttatttttaactgagaaagcttattaaggaattttatttatagttcctcccttattgagtaaaatcctctgtaagagacttaggaaattgtgttttctctttaagttctcttgtgccaaagcagactagactggagtgatcaaaactcattgctatttggtgagggctctttgatggctttctgttatgtaaaaacaactggtattcatatttcagtttatcgtagaaagcattctacatgataagaactaagaacaaaattggcatcttcacttataaactcagcaagaggccaaagattacatcagcaggaagtgtgaactaaatttttattccaagaggttggtcttctataatggataaggtagtataagtttg

SEQ ID NO: 11804 - DNA, 15024 bp, Homo sapiens
ggaggacccgggagccggcggcccggagctgggagcgcggggaaggcggttggggttctgacagctgcgcgcggtgagaaggggaaaagccctaggggctcgagaggatgaagccgggaagggtgcgacggggccgcgagccctgggcggggttcgggaagggaggctctgcagtcttggaggggactcagaccggtcccctcccctctccgggcctcagttctccctttctagggaagtgtgggggagagattcgcgcctcccagaacgcactccttccctgcacacacccctggcaccggcgaactgccccctttcctgtaccgccccgcccaggagcctgtcccctcgggaagcccgcccagacccctggacccgcgcagcactccaggcgcacccctattaaagcgcaccccaagccatttcacatgttctgtggcaatgggccaggatccccatgagactcagaaccccgtgatccatcagtcattcccgggtcaggaccagcccagagcaggtgcacaggccctgcttagtaataaggtagaaatcgagacctggggaccgggttcagaggccctggggtttccttccggatgcctctgtttacctcctgtgggccttctggaatttaacttatgctctctgtgtcttggtttcccttgtctgtaaaatggagctagcggtagctcttccttcatagggtggcatgagggtgaaacgaggcaatgcgtggccagtacactgctcagcacctaggacaccatagttgcttaataagtgcttattgttagcatagtgtttgcatgcctggccccacctccactcccactgccagccccaagcacatacaagccatgttgtcactgaggccaagcactgtggcccacagcctgagttcctttcgagatgctcgaactgctcatcttcttgatggggtcccttctggacaggccagaaatggaaggccagagaggggaagggcactgtgggagctgtggctgaatatcagggtgagggcaataaatgaggccacccaacaattgtgcttatcaaagattgggcgtcagaactgctgtggctgatctgcctgggtgtctgtcagtcatttatgtcccaaatgtttgacatatgtccacaaatccagtgtttgtggtcagaagccacagggatatatgggaaggggggacactttagagccgtggggttcctgagttcaagtcctaaggctgtcacttgctcccggcgagactttcggcaagggacttcacctctctgaacctcagttccctcacctggagaagggtgaaaacatcagctcaagtcgttgaagattgcaggaggtgacccatgtgaggcatttggtgcttagcacacggcctggattatggcaagtgctcattaattgttggaccacagcagtgttttcacattcatactgcccaggaggtggcaccagtccttctaggctggcccctcctctagtgagatccagtccttgacttgcccccaccccatctctctagtgagctaaaagagcagaagtctccaaacccatcttcccagctgaagtcacactatgtcctgaacgtgtctgtttctcctgcgactcttggctccttgcagatcctgctctctctcagccgcctgtggacatgcgcaaagggccctctcctgagtccagatgatgctcataccaatggcttcagtgatggcggtgactgaaccgaaatgggtctcggtctggagccgcttcctctgggtgacgctgctgagcatggtgctggggtccctgctggccctgctgctgccgctgggggctgtggaggagcagtgcttggctgtgctcaaaggcctctacctgctcaggagcaaaccggacagggcgcagcatgccgccaccaagtgcaccagcccgtccacggagctcagcatcacctccaggggcgcgacgctgctggtggccaagaccaaggcctctccaggtaagacagactggccgtcttcctcaatgcttgttaactggatagacagacatagaatgtgtcatgtcctgtatgtggggcatcggggtattgtgaacaagtcagccctgagctcctagtatagacaaggtgatgtgactgagacagtgtcacaagtgtggtgatggggaagcataaagggctgtaggagcataccaggaaggctccctggaggaagtgacacctgagctgggacccagttgttaagtaggagtcatccagggtgaagggcatccaaggaaaaggactccaggcagagaccagaggttagttgtcataactgacataactgtcgtaagagagcctgggggcattcgaggaactaaaggaagttgaatgtgtggggctgatcctcaggtggccaagaggggccaggacaggagggctagggctagagcaggctccccacctccaccagttctctgtggtggggactgaaagtgcattgttagatggtggtggcatccctggcctctccccatgagatgcctgtagcactccctccacctcctcagttatgacaactaaccaggtctccagacgtcaccaaatgtcccctggggcgcacaatcaaaccactgggttaaaagagttaaagaacagtcccgggatggttgacgcccccagggtctaggaagagtggggagttgttaacgcctttgggcctcccggggcaggaacctgtgtcaccagcacaagatgagctggagatgtaggagacggcctacactgggagctgtggcccacaggaaaggcccagcagagagggcccaggcgaagtaaatgcctagaactttctatgtccagaaagcaggaggctaggaagccaaggaggtgcctcccagaatacaagagagtggctctggggacacacggatagtgactgcataccaccacacggctggggcaacagagtggtaccgggcatgttgagtacacacgatgcggctgcaacaagctcctcaaggccagggacacaggctggtcatcatggtttcctgcggagaccagcacaggggacagccccccgaatgtcctctgccccctagcctccctccctcacagcgcttctttggctctcttccagcgggtaagttggaagccagagctgccctgaaccaggccctggagatgaagcgccagggcaagcgggaaaaagcccaaaagctcttcatgcacgccctcaagatggacccggacttcgtggacgcgctcaccgagtttggcatcttctcggaagaagacaaggacatcatccaggcggactacttgtacaccagagcattgaccatctcaccctaccatgagaaagcactggtcaaccgcgatcggacactgcctcttgtggaagagatcgaccagaggtatttcagcatcatcgacagcaaagtgaagaaggtcatgtccatccccaaggggaactcagctctgcgcagggtcatggaggagacctactaccatcacatctaccacacagtggccatcgagggcaacaccctcaccctctcggaaatcaggcacatcctggagacccgctacgccgtgcccgggaagagcctggaggagcagaacgaggtcataggcatgcatgcagccatgaagtacatcaacacgactctggtttcgcgcatcggctccgtcaccatcagcgacgtgctggagatccacaggcgggtgctgggctacgtggaccccgtggaagccggcaggtttcggacaacacaggtcctggtcggacaccacatccctccccatccgcaggatgtggaaaagcagatgcaggagtttgtacagtggctcaactccgaggaagccatgaacctgcacccagtggagtttgcagccttagcccattataaactcgtttacatccaccctttcattgatggcaacgggaggacctcccgtctgctcatgaacctcatcctcatgcaggcgggctacccgcccatcaccatccgcaaggagcagcggtccgactactaccacgtgttggaagctgccaacgagggcgacgtgaggcctttcattcgcttcatcgccaagtgtactgagaccaccctggacaccctgctttttgccacaactgagtactcggtggcactgccagaagcccaacccaaccactctgggttcaaggagacgcttcctgtgaagccctaaccctagaaatcctcagtgacaaaggctgtcctgaggtaggaaaaaaaaaaagaaacagcatttctagaaacctagtcacttcctaaagcaaaaggagaaacattctttacctccaaatgttttagttttaaaaaaaaaaaaaaactaagttatgaagccttgtctctaaaataacttataattcaaccaagctatttattttcttctttggagcaagctagtcagtattgtatggtgtctgctgtgtcttgctggtggccgtgctttaggggcaacagtgccaccatgtgaccagaacaaaggttctggagcagaatttgcactaaggtggaggagcggccaagaggtgtgggacggggcccagagccactgacataactcctccaagtgcttctctgaaacaggctgagaggttctgtgactgcaactgggaagtcagacccaagtcgcagctgagagaaatggttgaaagctcactttctcaaggtttagattagtggtgactaacttccaagcaaacttcatagaagagaaaatgaatgccgacattccttacttacctgcaggaagactttttgagccatagtttgcaaactttagtgccagcagctgtttttttttttttttttttcatattgagactatttttctaattaagaatagggggtagccataaagagctgtatgttggagggggaaacatggtgggcgggcagtttggttttctttgtgtatccgcgtttctctcacacttcatttgtagcaactcaggccagatgttttcgtctgaaattctctgggcttgtcattccacctgtatcgtgctgcaaaccaggtgttatgctagtaggcatctgccctcacccctctgcctgagttttctgtaggcagatgttaacctgagaaaacaagtgccatgtggacaccaagtaagcatttttgataatgaattagagcaccagtttctactgaatggagcaaaaaccttcagccatggccaggctgcatccctttggtcctggagtttcatctacttactgccatcttccacggtctttgcactgtcccgtgtcccatccccctgggaggcagaagagattgcctcggagtggccttatttttctcgcaacttgtgaaatgatgtagtgctctatgtaatatggccgggtttccaagctgtcatccaatggaagtagaatcttctctttgaatcatatggtacaggtgccaatatgactgctgctatttagagtcagagaggtggaagtcactgggtccctttcccagtgacagagcccatgatgtctaacactactgcactttgtcagtgtgtgagtgatggcgaatacgcagtgttgtctctttgatttggtaattccgttcctgacagtaatgaggccactgctctaaagtagtttatacagttcttcagttgtataaatagcacagagtagtttttgaaaggttaagaaaaataagtgaaaagacatacacgatatatgaaatggctccaaatgataattgttcaaacctttataaaatgtgttttcgtactcttatgctgccagaggtacttcttaaaactcttctcgtcttggttttataagcacaccacggaggtctgacagatgtgcttgcttctactacagagcaagagaatttgcactttagctatatgtgaaggatattattttaacaaattcctgattctaataaagttattttattacatgaatgcttgagactgtcttatttgggagatgttcccatctgtcataagggcagtgggggtattctgacctttagccctattcataatactgttctgggagagcaacagatccaagatggtgatttccatgggcaagagacccagaagttggataaaccgcctacctaggtgggcaaggatgaattactgatttttttttactaacaaacagtcaagtaactgaagtagtttttcacatttctatttatcatcagttctggattttctggggaaaacacacaaacccactcatgtagtcctggaaatccatttctagaacagtcaacacccggaacctaactgggttctgctcaagcctgaaaaggtttgcccctgtaccaagcctgggctgacatctgcaagtgtgacattaaggtcagaatactggctgcaggcaaagccaaaccgttaatgtgaagcagcaaaaagtaaggccacactcacccatagtgatattcagggctcttcatgtgtcaggtccccaaccatgagggctctgagctacccaaatcatcacaccagctgaacagtccatcagccttccaagcagcatcacagagaacactgcaggaggaacgcgtgggacagcaaaggttcttgctgctgtcaatagccgccgcttgaatttaattcagaagtaaagcctagtaaaaagttggttttgtataaaaaagagatggaggggaacctaccttttaagacttaagaggcttaccaaccaataatttacagggaggagagctgatatttgtaggaaggtggaaatttgagtggacagttgatgacatgaagggattaccactaatgtttctaggagtgaaggcctttcagtcctcctgagacacctgccgcaacattactggatgagcacaatgacatctggaacgtgcctcaatataacagagggtggaggggaaacagacatgaaggaagaggggctgggagttgaggaatgctggaagctgaatggtaggcacacaggagtttattttactgttctgtctactttttaatcggttatattaaaaaatgttaagttaaaaaaatatagaaaacccgactgatgcacaaaaacttaaacttacgcaacagataaatgaggagttgattcccacgacatatacaaggattccctgacgtctttctccagagtgtcttaataaagcaagcttcccctactgaactggccaatgctgttgctgttttcaaagcagtaaatattatttgataaaagatgtgaggtaaaaaagctcaaaagctccagtgtcaaactgctataaaatgaagacacatcacagctggaataatttaaatcaaagtgacaatgggatttgacttacaaaagttctatttacacatctattaggtaaagcaaggtacacccacttcaaaacacatctgtatgtgaatgcacatctgagtaccattcagcaagaagttttgaagagaacgtcagtttaataaagctaaatggggagaattgaagtttgcatttgacatggtattaaacaaaaccaaagggctgaaactcatgtttagacaacacaggtcactagtcactaggcaaagaaaacagtccacagcaggtggcacaaataattcctatacaaaacaaatgttgcaaatattctgcttttaggaaacatgaaacaatggctgacatgtcatttacaaacacataatataaaaatgcacagccccattgaacaaaactccagcaaatgttttatagctgacttccctcagacccacccccacaagaggccattctgtgaattactagcatctgccatttcatcttttaaaattaaaagaatgacgggcacatgtgctgtgcagggtggaagagaagtgtcatacaaaaaggggccggagctggccagaaacatttggacaactgtgtctcaaaaacagtgtgttctcgtttcgcttctgtgcctcagtctttaagatacaaaactatctcaggacaccacatcctgggcccagcctgcagagtggtcacttttctgccactgccctcaatatgagggagcactgaaaggctcttgacttagaaccccttcccctttctgtctaaagccgaggagccatctgtggttgcgagcacgcagcacaccaggcctgtccatccccagtgcactgctgggtggtgggaggtccgccgggccagagtgaagtaaggcatttcctgtctcccagcgtcccgttcactttctcagaaacagcttggcaaaatcggcattggacatcttgggtgcctcggtggctgctggggcggcaactgcaggagccgcggcagggccgttctcagcctgaggagctgcagcacttgggcgctgcagggcacgaggcagtagagacagctgcgtccttcccttccccctcctaaaagagcaaacactgaatggaccttttgaagcaacaattcgtggcccctcatttatttgtgaaaataagccaagacagttttaatataaccagaagttaaaaggtgaaaaaaaaaaaggataagataatccctgcctccttaattctgtttatgaagtaaaaactgcttcaacagacttggccttgttcagttttggcaaagatcaaccctgagcaccagtcacactcagaggggatcagtgtgactatcacctctcagacctcaccagtcacctggcaattctgctatctcctcctcatcccaaaccagcgaacagcacagcttatgtggatcatagctagggccgtagactggcacacacatgggtatgagatttctttgtaaacacacagatccaactggcaaaggggactttaaaataatcactgccttatttctgtctgaaataaatgacaagtgtaaattggccagtaccaggcagaggtcactgcctaggcttgcatcctgctctggacgccttgctccagtggaaccacagtgattaccacaaggaacagcacatcttggcttttctgtcctaacaggaagctaattcatcccgggttaatccccccgtgatccatgaactggtgccagccaggacgaagtttgcactagtctaccatgcaagcacttacgctccgtatgtctgcggcaaaagcatggggccacctggtgccttcctggtctccggcttctctggaactttcctctgaggagggttgctgattgccactttgatgatgttctctttgatagtcatgccgtccatcttcatcacagcctgcgacgcctgggattcattttcatactccacgtaggccaggccctggaagaggcaagatccagaaccaagtcagatcccgcagactagggacgcaacctcctcctgcagggcaggcactgggcttcctcccggagaccagcagaccaggccacagcaaacgacccaccaacaggttaccttccccaccaccgcatcctctgtctacaggcttatttccccaccctactctccttcccgagtgctgctatgcactgtaacttcagataacccttccaagttcagcacaccttgtacgtgctgcagaagtagaaagaaagaaggaaaaagacagatggaccagtataaatccagcaaataaaccaagaggtggatgggacacagggccagcagcccaggtgcccaggtgagccctcgtgtttctgtgccttcacccgctccctcatttcatcctctttttctctccattaacctggataaaggggagggagagtgggcagtgggtagacagtaatgaaaccacttactactcaaaatggggcacaaaaggacttagcaggagactgagggggcaagaaggaaagacaggagaagaggcactgcaatggagggactcaaggggcctggttggaggccccagagaaagagaggcctgggacagagggagaaggctgcaggagggcgcccaccccaaagcccgtatgctgctggtcacagggcttcccccaagccccacagccaggggccatagtgtggtgaattcatgatcctctatttccaagtgtcttattctttttagtacaattaactacaaacaggttaatctgactccaaatataagtagagctaagtgcagatctttctgtgaaattaacttttgtttctcagcagacaaactaggaacccattctagaggttaaatcatctttgaaccgatacagaaacgaagtttgcccaagccttgaagacaaggcacaatctgctctgactctgacctttggtttgccagcccggttggtgaccagcctgaggtccttcacggtgccatgagccttacagatttcttctagttcctctttagtacaggagaaaggcaggcctgagatgaacagcttgtgtttctctagggaagtgctgtacctgaacacctataggaagaaggaagacagagaaaaaccatgattcgaggcatgacccagctcacctgactcctctgacaccagccttgtccccatgagcagcccagccaggcagactagagccaagccatgctctgaaacttgttaatggggccaccggagcgagtcacttaacctctccaggcctccatgtcttcctctgtaaaacggcaagaataaaagtaaccattcacagagtctcatgaggagtcaatgagctgacacacataaagcattcagcacagtcccttgtcattgctaagcacccagcaagaaggagccatgccatgagtcagacctcagtcaaccggctcaggatggaccttggctcacaaggaagtttagatccaaacagagcgtaaaacttccatgtctatcctaaatatcactgctgcaggaagaaagtgcctgtctaaagcaaccacagatgaaaggcattctttttttccataaacctaccttaaaatcggggtttttgctcttatccacacagggggaaacaaacattggcctcccttctacacttttccggtccatctccagtgcctgaagggctgatttctcttctttaaactccacgtagcagtaacctcggaaatccccacggttgctgaagatgggtcggatctggaccacctccccacaggcctcgaagagtggcctgagcttcgtgtccggctcctgcatgctgtagggcaggttgctgacaaagacggtgatgctgtccttgctgctgtcgtgcagcaccttgggcatgtccctcttcagggaggctgccttctccttctgcttcgaagggggctccacatctacggcagcacatttcccagcgggccctgctgctacttctacattttgtgtttctccagctgcagggatgctgttctcgacccttctgcgtttggaaggctgctctacaggttttcaaaagaaaagtagccatggttaactgttacttctcttcagggagcttgaacagaggtgtgaagtgaaagtgctgtgacagctgcatgtgacacttactccctcaccagactcggaggggcaagcaccaccccgagaagtcttttgtgatccgcctgacctgtcccacgactttctgtgccccaattacactcgggtaagtgggctcaatcaagtggaagtaataacataaatccccattgtccactcttaattatacaaaaggtcagtggatctcaaagttcagaaggcaaattccagggcccctctcctacaaagcccagatcagcagggttgggataggacatgagaatctgcactggaaaagcaccctagtgactgatacccgtgccccagggagcacattttggaaagcactacaaaggatctgtggtttctaaaacactttcaatatggccttgtgtccttaagagagcttaaccacaatcttctactgcagtctgtcctcaccactgcctccagagggccagtactgaagctcaacagacatcagcctccggcaaacagacctccccatcagttcacccgctgcctttccaatgcaacgtaagccctgcacactgctactgtattcaagagtgtccctgggctgggtccagctgactggcccacctaccactccagcctcctcgaccactgccccacccctctctaatgcatctgagttcaaacccaattatctgctgctcacagaaaatgccaggctgtgctgtgccttcaggctgtactaacattggctcctccctgtgtagctcagaccttcccttctcgctgccacagtcactcggtcttccccctggatgccgcatctcttcccccacagtcttcctggtacgaagttgacccactagtgccttctttggcctccaccagtattaacaatgccatctcccacagtcctgatcacacgccatgccctgatcacacaccactgcggtcacacatcacatttgccttattctgccaaactgggaggccagtggagcaatgagccatcctcagtcatttaggaaagcccaaacaaggtgtgcaagcaaggtcaactcaacgatggatgactccattcccagttctctctggctcacacatctgtattaagaaagtatacagagtcctttcaagtccagagacaattcttttttttgttttgttttgtttttgagacagtgtcttgctctctctcccaggctggagtgcaacgacatgatctctactcattgcaacctctgcctcccgggctcaagtaattctcctgtctcagcctcccgagtagctgggaaaacaggcacccgccaccacagccaactaatttttgtatttttagtagaggcaggttttcaccatgttggccaggttgatcttgacccctgacctcaggtgatccgcccacctcagcctcccagagtgctgggattacaggcatgagctaccgcgcccagccaccagagacaattctttaccttgactgactctctgaaataaatatgacccagagctgcccgtccctgaaattacaagggtgaaagaaacactgctggaaaattccactaagtcagaaccattaaaagcagggccaaggccaggtgcagtgtctcatgcctgtaataacagcactttgggaggccaaggcgggaggatcacttgaggtcaggagttcaagaccagcctggctaacatggtgaaaccccgtctctactaaaatacaaaaattagctgggcatggtggctggcaaagtgtaatcccagctacttggaaggctgaaggaagagaatcacttgaacccaggaggcggaggttgcagtgagccgagatcacgcaactgcactccagcctgggcgacagagcgagactccctctcaaaaaaaaaaaaaaaaaaaagtagggccaagcctggcaggtctgtgcagggttggggctgcagcagtggtgcgggatgctagagcctgaatggaaggaagaagacaggcaggcatggggcagtgacagggacccagcagcctagatctggaagcctgagtgaaagaagcaagggtgtccatgcagggccgtgcctggccccgggtgtgggagaccaaacagggtggggatggcacatatgagaaggggaggcaggcacaggaagttgattacatacctacaggggccgggtggagtaactgaggatgctgagaatagagggagccaagtttctcaaggtcagagaagggcgtgacacagctgggcacagtggctcacacctgtaatcccagcactttgggaggccgaggcagacagatcacttgaggccacaagttcaagaccagcctggccaacatggcgaaacctgatctctactaaaaatacaaaaaattagccaggtatgatggtgcatgcctgtaatcccagctacttgagaggctgaggcacaagaatcacttgaacccgggaagcggaggttgaagtgagccaagatcaccccactgcactccagcctgggcaacaaagcgagactctgtctcaaaaataaatgaataaataaattttaaaaagagagagaagggcattgcaagtgtgaaggggaaccctgtggtgttagaccggaactggaggtattggtgtgaaatcatgactttcagtatatacaaatagttacacaagtaaatatggtcataaatatgtgtacacatgcacacgcacacgcacacacacacacactccctaccctcgaccactcaggcctcagaacaataaccaacagcagtgagcacaactagcaccttctaaataccactcatcactcaaaggaaccttggagaaatgatggattccagggctgagttatggaaagtataagatgacccttgggtattgtgtgctagaaggtaaggaaatgatcaaagaacaaggggacaggtcaaagggacatagaagcctgtgtgaaggaactcttgctagccaaacctgggataagtagagaatcagcataaataattctcaaaagggtcatcaccagtgatggaacaaagcgaatcacagtccacctgatgggactcaatgggcaggccacaggagcacttgtgcactattcctgcccgagatgcatgagtggaatccaatgcttagggagcatcagacacacccaggctgaggggcacaacacagcaactggcctgcccccttacaagactgcaggtcatcagagtaaaaaaaaaaagctgaggagtgctccagactcaaggagatccaggagacaggacaactaaacacaatagtgcatcctgaaccggatcctttcactacaaaggacattatcaggataaatgggaacccatagctcattgctaaccccggctctgatggctgcattctagtcatgtagaagagggccccttgtttgcaagacatacaccctaacagtgatcaaagggtaatgggtatcaagctggtaacggttcagggaagaaagttcttcatactgtattcgcaacttctctaactttaagacgtttcaaaacacaatttctcaagagctccttaccttcttcatcatcgccccactctttctcatcatcctcatctgctccgcgcttctctgggcctctgatctttttcttcttttttaacgctttcttctcagcccgagctcttttccgttgttcagccttttcttcttcttgctgcacaagggctgcttccttctctgcagcct

SEQ ID NO: 11805 - DNA, 33927 bp, Homo sapiens
ggaggacccgggagccggcggcccggagctgggagcgcggggaaggcggttggggttctgacagctgcgcgcggtgagaaggggaaaagccctaggggctcgagaggatgaagccgggaagggtgcgacggggccgcgagccctgggcggggttcgggaagggaggctctgcagtcttggaggggactcagaccggtcccctcccctctccgggcctcagttctccctttctagggaagtgtgggggagagattcgcgcctcccagaacgcactccttccctgcacacacccctggcaccggcgaactgccccctttcctgtaccgccccgcccaggagcctgtcccctcgggaagcccgcccagacccctggacccgcgcagcactccaggcgcacccctattaaagcgcaccccaagccatttcacatgttctgtggcaatgggccaggatccccatgagactcagaaccccgtgatccatcagtcattcccgggtcaggaccagcccagagcaggtgcacaggccctgcttagtaataaggtagaaatcgagacctggggaccgggttcagaggccctggggtttccttccggatgcctctgtttacctcctgtgggccttctggaatttaacttatgctctctgtgtcttggtttcccttgtctgtaaaatggagctagcggtagctcttccttcatagggtggcatgagggtgaaacgaggcaatgcgtggccagtacactgctcagcacctaggacaccatagttgcttaataagtgcttattgttagcatagtgtttgcatgcctggccccacctccactcccactgccagccccaagcacatacaagccatgttgtcactgaggccaagcactgtggcccacagcctgagttcctttcgagatgctcgaactgctcatcttcttgatggggtcccttctggacaggccagaaatggaaggccagagaggggaagggcactgtgggagctgtggctgaatatcagggtgagggcaataaatgaggccacccaacaattgtgcttatcaaagattgggcgtcagaactgctgtggctgatctgcctgggtgtctgtcagtcatttatgtcccaaatgtttgacatatgtccacaaatccagtgtttgtggtcagaagccacagggatatatgggaaggggggacactttagagccgtggggttcctgagttcaagtcctaaggctgtcacttgctcccggcgagactttcggcaagggacttcacctctctgaacctcagttccctcacctggagaagggtgaaaacatcagctcaagtcgttgaagattgcaggaggtgacccatgtgaggcatttggtgcttagcacacggcctggattatggcaagtgctcattaattgttggaccacagcagtgttttcacattcatactgcccaggaggtggcaccagtccttctaggctggcccctcctctagtgagatccagtccttgacttgcccccaccccatctctctagtgagctaaaagagcagaagtctccaaacccatcttcccagctgaagtcacactatgtcctgaacgtgtctgtttctcctgcgactcttggctccttgcagatcctgctctctctcagccgcctgtggacatgcgcaaagggccctctcctgagtccagatgatgctcataccaatggcttcagtgatggcggtgactgaaccgaaatgggtctcggtctggagccgcttcctctgggtgacgctgctgagcatggtgctggggtccctgctggccctgctgctgccgctgggggctgtggaggagcagtgcttggctgtgctcaaaggcctctacctgctcaggagcaaaccggacagggcgcagcatgccgccaccaagtgcaccagcccgtccacggagctcagcatcacctccaggggcgcgacgctgctggtggccaagaccaaggcctctccaggtaagacagactggccgtcttcctcaatgcttgttaactggatagacagacatagaatgtgtcatgtcctgtatgtggggcatcggggtattgtgaacaagtcagccctgagctcctagtatagacaaggtgatgtgactgagacagtgtcacaagtgtggtgatggggaagcataaagggctgtaggagcataccaggaaggctccctggaggaagtgacacctgagctgggacccagttgttaagtaggagtcatccagggtgaagggcatccaaggaaaaggactccaggcagagaccagaggttagttgtcataactgacataactgtcgtaagagagcctgggggcattcgaggaactaaaggaagttgaatgtgtggggctgatcctcaggtggccaagaggggccaggacaggagggctagggctagagcaggctccccacctccaccagttctctgtggtggggactgaaagtgcattgttagatggtggtggcatccctggcctctccccatgagatgcctgtagcactccctccacctcctcagttatgacaactaaccaggtctccagacgtcaccaaatgtcccctggggcgcacaatcaaaccactgggttaaaagagttaaagaacagtcccgggatggttgacgcccccagggtctaggaagagtggggagttgttaacgcctttgggcctcccggggcaggaacctgtgtcaccagcacaagatgagctggagatgtaggagacggcctacactgggagctgtggcccacaggaaaggcccagcagagagggcccaggcgaagtaaatgcctagaactttctatgtccagaaagcaggaggctaggaagccaaggaggtgcctcccagaatacaagagagtggctctggggacacacggatagtgactgcataccaccacacggctggggcaacagagtggtaccgggcatgttgagtacacacgatgcggctgcaacaagctcctcaaggccagggacacaggctggtcatcatggtttcctgcggagaccagcacaggggacagccccccgaatgtcctctgccccctagcctccctccctcacagcgcttctttggctctcttccagcgggtaagttggaagccagagctgccctgaaccaggccctggagatgaagcgccagggcaagcgggaaaaagcccaaaagctcttcatgcacgccctcaagatggacccggacttcgtggacgcgctcaccgagtttggcatcttctcggaagaagacaaggacatcatccaggcggactacttgtacaccagagcattgaccatctcaccctaccatgagaaagcactggtcaaccgcgatcggacactgcctcttgtggaagagatcgaccagaggtatttcagcatcatcgacagcaaagtgaagaaggtcatgtccatccccaaggggaactcagctctgcgcagggtcatggaggagacctactaccatcacatctaccacacagtggccatcgagggcaacaccctcaccctctcggaaatcaggcacatcctggagacccgctacgccgtgcccgggaagagcctggaggagcagaacgaggtcataggcatgcatgcagccatgaagtacatcaacacgactctggtttcgcgcatcggctccgtcaccatcagcgacgtgctggagatccacaggcgggtgctgggctacgtggaccccgtggaagccggcaggtttcggacaacacaggtcctggtcggacaccacatccctccccatccgcaggatgtggaaaagcagatgcaggagtttgtacagtggctcaactccgaggaagccatgaacctgcacccagtggagtttgcagccttagcccattataaactcgtttacatccaccctttcattgatggcaacgggaggacctcccgtctgctcatgaacctcatcctcatgcaggcgggctacccgcccatcaccatccgcaaggagcagcggtccgactactaccacgtgttggaagctgccaacgagggcgacgtgaggcctttcattcgcttcatcgccaagtgtactgagaccaccctggacaccctgctttttgccacaactgagtactcggtggcactgccagaagcccaacccaaccactctgggttcaaggagacgcttcctgtgaagccctaaccctagaaatcctcagtgacaaaggctgtcctgaggtaggaaaaaaaaaaagaaacagcatttctagaaacctagtcacttcctaaagcaaaaggagaaacattctttacctccaaatgttttagttttaaaaaaaaaaaaaaactaagttatgaagccttgtctctaaaataacttataattcaaccaagctatttattttcttctttggagcaagctagtcagtattgtatggtgtctgctgtgtcttgctggtggccgtgctttaggggcaacagtgccaccatgtgaccagaacaaaggttctggagcagaatttgcactaaggtggaggagcggccaagaggtgtgggacggggcccagagccactgacataactcctccaagtgcttctctgaaacaggctgagaggttctgtgactgcaactgggaagtcagacccaagtcgcagctgagagaaatggttgaaagctcactttctcaaggtttagattagtggtgactaacttccaagcaaacttcatagaagagaaaatgaatgccgacattccttacttacctgcaggaagactttttgagccatagtttgcaaactttagtgccagcagctgtttttttttttttttttttcatattgagactatttttctaattaagaatagggggtagccataaagagctgtatgttggagggggaaacatggtgggcgggcagtttggttttctttgtgtatccgcgtttctctcacacttcatttgtagcaactcaggccagatgttttcgtctgaaattctctgggcttgtcattccacctgtatcgtgctgcaaaccaggtgttatgctagtaggcatctgccctcacccctctgcctgagttttctgtaggcagatgttaacctgagaaaacaagtgccatgtggacaccaagtaagcatttttgataatgaattagagcaccagtttctactgaatggagcaaaaaccttcagccatggccaggctgcatccctttggtcctggagtttcatctacttactgccatcttccacggtctttgcactgtcccgtgtcccatccccctgggaggcagaagagattgcctcggagtggccttatttttctcgcaacttgtgaaatgatgtagtgctctatgtaatatggccgggtttccaagctgtcatccaatggaagtagaatcttctctttgaatcatatggtacaggtgccaatatgactgctgctatttagagtcagagaggtggaagtcactgggtccctttcccagtgacagagcccatgatgtctaacactactgcactttgtcagtgtgtgagtgatggcgaatacgcagtgttgtctctttgatttggtaattccgttcctgacagtaatgaggccactgctctaaagtagtttatacagttcttcagttgtataaatagcacagagtagtttttgaaaggttaagaaaaataagtgaaaagacatacacgatatatgaaatggctccaaatgataattgttcaaacctttataaaatgtgttttcgtactcttatgctgccagaggtacttcttaaaactcttctcgtcttggttttataagcacaccacggaggtctgacagatgtgcttgcttctactacagagcaagagaatttgcactttagctatatgtgaaggatattattttaacaaattcctgattctaataaagttattttattacatgaatgcttgagactgtcttatttgggagatgttcccatctgtcataagggcagtgggggtattctgacctttagccctattcataatactgttctgggagagcaacagatccaagatggtgatttccatgggcaagagacccagaagttggataaaccgcctacctaggtgggcaaggatgaattactgatttttttttactaacaaacagtcaagtaactgaagtagtttttcacatttctatttatcatcagttctggattttctggggaaaacacacaaacccactcatgtagtcctggaaatccatttctagaacagtcaacacccggaacctaactgggttctgctcaagcctgaaaaggtttgcccctgtaccaagcctgggctgacatctgcaagtgtgacattaaggtcagaatactggctgcaggcaaagccaaaccgttaatgtgaagcagcaaaaagtaaggccacactcacccatagtgatattcagggctcttcatgtgtcaggtccccaaccatgagggctctgagctacccaaatcatcacaccagctgaacagtccatcagccttccaagcagcatcacagagaacactgcaggaggaacgcgtgggacagcaaaggttcttgctgctgtcaatagccgccgcttgaatttaattcagaagtaaagcctagtaaaaagttggttttgtataaaaaagagatggaggggaacctaccttttaagacttaagaggcttaccaaccaataatttacagggaggagagctgatatttgtaggaaggtggaaatttgagtggacagttgatgacatgaagggattaccactaatgtttctaggagtgaaggcctttcagtcctcctgagacacctgccgcaacattactggatgagcacaatgacatctggaacgtgcctcaatataacagagggtggaggggaaacagacatgaaggaagaggggctgggagttgaggaatgctggaagctgaatggtaggcacacaggagtttattttactgttctgtctactttttaatcggttatattaaaaaatgttaagttaaaaaaatatagaaaacccgactgatgcacaaaaacttaaacttacgcaacagataaatgaggagttgattcccacgacatatacaaggattccctgacgtctttctccagagtgtcttaataaagcaagcttcccctactgaactggccaatgctgttgctgttttcaaagcagtaaatattatttgataaaagatgtgaggtaaaaaagctcaaaagctccagtgtcaaactgctataaaatgaagacacatcacagctggaataatttaaatcaaagtgacaatgggatttgacttacaaaagttctatttacacatctattaggtaaagcaaggtacacccacttcaaaacacatctgtatgtgaatgcacatctgagtaccattcagcaagaagttttgaagagaacgtcagtttaataaagctaaatggggagaattgaagtttgcatttgacatggtattaaacaaaaccaaagggctgaaactcatgtttagacaacacaggtcactagtcactaggcaaagaaaacagtccacagcaggtggcacaaataattcctatacaaaacaaatgttgcaaatattctgcttttaggaaacatgaaacaatggctgacatgtcatttacaaacacataatataaaaatgcacagccccattgaacaaaactccagcaaatgttttatagctgacttccctcagacccacccccacaagaggccattctgtgaattactagcatctgccatttcatcttttaaaattaaaagaatgacgggcacatgtgctgtgcagggtggaagagaagtgtcatacaaaaaggggccggagctggccagaaacatttggacaactgtgtctcaaaaacagtgtgttctcgtttcgcttctgtgcctcagtctttaagatacaaaactatctcaggacaccacatcctgggcccagcctgcagagtggtcacttttctgccactgccctcaatatgagggagcactgaaaggctcttgacttagaaccccttcccctttctgtctaaagccgaggagccatctgtggttgcgagcacgcagcacaccaggcctgtccatccccagtgcactgctgggtggtgggaggtccgccgggccagagtgaagtaaggcatttcctgtctcccagcgtcccgttcactttctcagaaacagcttggcaaaatcggcattggacatcttgggtgcctcggtggctgctggggcggcaactgcaggagccgcggcagggccgttctcagcctgaggagctgcagcacttgggcgctgcagggcacgaggcagtagagacagctgcgtccttcccttccccctcctaaaagagcaaacactgaatggaccttttgaagcaacaattcgtggcccctcatttatttgtgaaaataagccaagacagttttaatataaccagaagttaaaaggtgaaaaaaaaaaaggataagataatccctgcctccttaattctgtttatgaagtaaaaactgcttcaacagacttggccttgttcagttttggcaaagatcaaccctgagcaccagtcacactcagaggggatcagtgtgactatcacctctcagacctcaccagtcacctggcaattctgctatctcctcctcatcccaaaccagcgaacagcacagcttatgtggatcatagctagggccgtagactggcacacacatgggtatgagatttctttgtaaacacacagatccaactggcaaaggggactttaaaataatcactgccttatttctgtctgaaataaatgacaagtgtaaattggccagtaccaggcagaggtcactgcctaggcttgcatcctgctctggacgccttgctccagtggaaccacagtgattaccacaaggaacagcacatcttggcttttctgtcctaacaggaagctaattcatcccgggttaatccccccgtgatccatgaactggtgccagccaggacgaagtttgcactagtctaccatgcaagcacttacgctccgtatgtctgcggcaaaagcatggggccacctggtgccttcctggtctccggcttctctggaactttcctctgaggagggttgctgattgccactttgatgatgttctctttgatagtcatgccgtccatcttcatcacagcctgcgacgcctgggattcattttcatactccacgtaggccaggccctggaagaggcaagatccagaaccaagtcagatcccgcagactagggacgcaacctcctcctgcagggcaggcactgggcttcctcccggagaccagcagaccaggccacagcaaacgacccaccaacaggttaccttccccaccaccgcatcctctgtctacaggcttatttccccaccctactctccttcccgagtgctgctatgcactgtaacttcagataacccttccaagttcagcacaccttgtacgtgctgcagaagtagaaagaaagaaggaaaaagacagatggaccagtataaatccagcaaataaaccaagaggtggatgggacacagggccagcagcccaggtgcccaggtgagccctcgtgtttctgtgccttcacccgctccctcatttcatcctctttttctctccattaacctggataaaggggagggagagtgggcagtgggtagacagtaatgaaaccacttactactcaaaatggggcacaaaaggacttagcaggagactgagggggcaagaaggaaagacaggagaagaggcactgcaatggagggactcaaggggcctggttggaggccccagagaaagagaggcctgggacagagggagaaggctgcaggagggcgcccaccccaaagcccgtatgctgctggtcacagggcttcccccaagccccacagccaggggccatagtgtggtgaattcatgatcctctatttccaagtgtcttattctttttagtacaattaactacaaacaggttaatctgactccaaatataagtagagctaagtgcagatctttctgtgaaattaacttttgtttctcagcagacaaactaggaacccattctagaggttaaatcatctttgaaccgatacagaaacgaagtttgcccaagccttgaagacaaggcacaatctgctctgactctgacctttggtttgccagcccggttggtgaccagcctgaggtccttcacggtgccatgagccttacagatttcttctagttcctctttagtacaggagaaaggcaggcctgagatgaacagcttgtgtttctctagggaagtgctgtacctgaacacctataggaagaaggaagacagagaaaaaccatgattcgaggcatgacccagctcacctgactcctctgacaccagccttgtccccatgagcagcccagccaggcagactagagccaagccatgctctgaaacttgttaatggggccaccggagcgagtcacttaacctctccaggcctccatgtcttcctctgtaaaacggcaagaataaaagtaaccattcacagagtctcatgaggagtcaatgagctgacacacataaagcattcagcacagtcccttgtcattgctaagcacccagcaagaaggagccatgccatgagtcagacctcagtcaaccggctcaggatggaccttggctcacaaggaagtttagatccaaacagagcgtaaaacttccatgtctatcctaaatatcactgctgcaggaagaaagtgcctgtctaaagcaaccacagatgaaaggcattctttttttccataaacctaccttaaaatcggggtttttgctcttatccacacagggggaaacaaacattggcctcccttctacacttttccggtccatctccagtgcctgaagggctgatttctcttctttaaactccacgtagcagtaacctcggaaatccccacggttgctgaagatgggtcggatctggaccacctccccacaggcctcgaagagtggcctgagcttcgtgtccggctcctgcatgctgtagggcaggttgctgacaaagacggtgatgctgtccttgctgctgtcgtgcagcaccttgggcatgtccctcttcagggaggctgccttctccttctgcttcgaagggggctccacatctacggcagcacatttcccagcgggccctgctgctacttctacattttgtgtttctccagctgcagggatgctgttctcgacccttctgcgtttggaaggctgctctacaggttttcaaaagaaaagtagccatggttaactgttacttctcttcagggagcttgaacagaggtgtgaagtgaaagtgctgtgacagctgcatgtgacacttactccctcaccagactcggaggggcaagcaccaccccgagaagtcttttgtgatccgcctgacctgtcccacgactttctgtgccccaattacactcgggtaagtgggctcaatcaagtggaagtaataacataaatccccattgtccactcttaattatacaaaaggtcagtggatctcaaagttcagaaggcaaattccagggcccctctcctacaaagcccagatcagcagggttgggataggacatgagaatctgcactggaaaagcaccctagtgactgatacccgtgccccagggagcacattttggaaagcactacaaaggatctgtggtttctaaaacactttcaatatggccttgtgtccttaagagagcttaaccacaatcttctactgcagtctgtcctcaccactgcctccagagggccagtactgaagctcaacagacatcagcctccggcaaacagacctccccatcagttcacccgctgcctttccaatgcaacgtaagccctgcacactgctactgtattcaagagtgtccctgggctgggtccagctgactggcccacctaccactccagcctcctcgaccactgccccacccctctctaatgcatctgagttcaaacccaattatctgctgctcacagaaaatgccaggctgtgctgtgccttcaggctgtactaacattggctcctccctgtgtagctcagaccttcccttctcgctgccacagtcactcggtcttccccctggatgccgcatctcttcccccacagtcttcctggtacgaagttgacccactagtgccttctttggcctccaccagtattaacaatgccatctcccacagtcctgatcacacgccatgccctgatcacacaccactgcggtcacacatcacatttgccttattctgccaaactgggaggccagtggagcaatgagccatcctcagtcatttaggaaagcccaaacaaggtgtgcaagcaaggtcaactcaacgatggatgactccattcccagttctctctggctcacacatctgtattaagaaagtatacagagtcctttcaagtccagagacaattcttttttttgttttgttttgtttttgagacagtgtcttgctctctctcccaggctggagtgcaacggcatgatctctactcattgcaacctctgcctcccgggctcaagtaattctcctgtctcagcctcccgagtagctgggaaaacaggcacccgccaccacagccaactaatttttgtatttttagtagaggcaggttttcaccatgttggccaggttgatcttgacccctgacctcaggtgatccgcccacctcagcctcccagagtgctgggattacaggcatgagctaccgcgcccagccaccagagacaattctttaccttgactgactctctgaaataaatatgacccagagctgcccgtccctgaaattacaagggtgaaagaaacactgctggaaaattccactaagtcagaaccattaaaagcagggccaaggccaggtgcagtgtctcatgcctgtaataacagcactttgggaggccaaggcgggaggatcacttgaggtcaggagttcaagaccagcctggctaacatggtgaaaccccgtctctactaaaatacaaaaattagctgggcatggtggctggcaaagtgtaatcccagctacttggaaggctgaaggaagagaatcacttgaacccaggaggcggaggttgcagtgagccgagatcacgcaactgcactccagcctgggcgacagagcgagactccctctcaaaaaaaaaaaaaaaaaaaagtagggccaagcctggcaggtctgtgcagggttggggctgcagcagtggtgcgggatgctagagcctgaatggaaggaagaagacaggcaggcatggggcagtgacagggacccagcagcctagatctggaagcctgagtgaaagaagcaagggtgtccatgcagggccgtgcctggccccgggtgtgggagaccaaacagggtggggatggcacatatgagaaggggaggcaggcacaggaagttgattacatacctacaggggccgggtggagtaactgaggatgctgagaatagagggagccaagtttctcaaggtcagagaagggcgtgacacagctgggcacagtggctcacacctgtaatcccagcactttgggaggccgaggcagacagatcacttgaggccacaagttcaagaccagcctggccaacatggcgaaacctgatctctactaaaaatacaaaaaattagccaggtatgatggtgcatgcctgtaatcccagctacttgagaggctgaggcacaagaatcacttgaacccgggaagcggaggttgaagtgagccaagatcaccccactgcactccagcctgggcaacaaagcgagactctgtctcaaaaataaatgaataaataaattttaaaaagagagagaagggcattgcaagtgtgaaggggaaccctgtggtgttagaccggaactggaggtattggtgtgaaatcatgactttcagtatatacaaatagttacacaagtaaatatggtcataaatatgtgtacacatgcacacgcacacgcacacacacacacactccctaccctcgaccactcaggcctcagaacaataaccaacagcagtgagcacaactagcaccttctaaataccactcatcactcaaaggaaccttggagaaatgatggattccagggctgagttatggaaagtataagatgacccttgggtattgtgtgctagaaggtaaggaaatgatcaaagaacaaggggacaggtcaaagggacatagaagcctgtgtgaaggaactcttgctagccaaacctgggataagtagagaatcagcataaataattctcaaaagggtcatcaccagtgatggaacaaagcgaatcacagtccacctgatgggactcaatgggcaggccacaggagcacttgtgcactattcctgcccgagatgcatgagtggaatccaatgcttagggagcatcagacacacccaggctgaggggcacaacacagcaactggcctgcccccttacaagactgcaggtcatcagagtaaaaaaaaaaagctgaggagtgctccagactcaaggagatccaggagacaggacaactaaacacaatagtgcatcctgaaccggatcctttcactacaaaggacattatcaggataaatgggaacccatagctcattgctaaccccggctctgatggctgcattctagtcatgtagaagagggccccttgtttgcaagacatacaccctaacagtgatcaaagggtaatgggtatcaagctggtaacggttcagggaagaaagttcttcatactgtattcgcaacttctctaactttaagacgtttcaaaacacaatttctcaagagctccttaccttcttcatcatcgccccactctttctcatcatcctcatctgctccgcgcttctctgggcctctgatctttttcttcttttttaacgctttcttctcagcccgagctcttttccgttgttcagccttttcttcttcttgctgcacaagggctgcttccttctctgcagcctagaaaagtgggaagatgatgcatcgctggatgtggcaattacattcactgtactgatttgtcatgaaaggggagaaggagtggaaattcattactaatgaaaagcagagatcaggagaaaaacgtggacaggctcacggctgttccacaccagggctcattcaggttcgttggaattctggatctgatgtctctgttacattagcaatttcctcaccctaatcattactcaccaaaaggaaggcaaaaaaatccataaaactggccgggcgcggtggctcacgcctgtaatcccagcactttgggaggccgagatgggtggatcacgaggtcaggagatcgagaccatcctagctaacatggtgaaaccccatctctactaaaaaaatacaaaaaattagctaggtgtggtagcgggcacctgtagtcccagctactcgagaagctgaggcagaagaatggcgtgaacccgggaggcagagcttgcagtgagccgagatcatgccactgcactccagcctgggcaacagagcgagactccgtctcaaaaaaaaaaaaatccataaaactgaagccctaaataagttggggtgttcatgttccactcactaggctaagtgaggctcttctttattctttttcatcaattctcgtaaattttagagccaaaattccctcactaaatgaaacaagtacttaatattggggctgatgttttagaacaatgtaaaaatgacacaagacaggtttaagcattgatctaaatattttataattaatactgagtaaaagacacttaggaaaatgtaaaacatcttgacaagaaacatccataccaaactgagccaaaatagctaccagaggtgccaaagacttcaaacattgtcattaccttcattctctgctcattgacacgagctaatcgggtttcagttttctgaacagctatatcccaatcttctaaagaaccttgaaagaaagagaagcaaaactttcactctttaggattttgaaggatacaatcacataaatttttcttaatttctctgtacctccagaagagatctctcccatcaaacaataagaaaatgtaatccctgtaggcttgaagttcagaattcaaatagtccttctaagtgggtttaaaatgtccctctcctttcaggagagacttgaaaaccagaatatgatctattaagggctctaaatggcaagaatatgaaaacgaacgttctaatgcaaaagtacatttatattaagactgaagaattttaagagctactcaaatgttgaggcatttatttcttattttttggtggtctttgcaagccagttctgaggggtccatacccaaaatccagaccaatacccacagataagttcacattatttttctattggttctagctaacactgaaggctctgaaatttaacaagggatgcaaaggacacattgagccatttgcctctccaagctcctttgttggatagatgttgtactagagcacagtgactctcaaaggagggatcctgcccatcaagagacatttggcaatgttaagagacatttctggttgtcatgtttggttgtggtggtgaagctgctactggcatttcagggctagaagccagggatgcccctaaacattgtataacgcacagtcccccccacagagaattagaaccctgtgctacagtgacatcacagagtcctccttgtagctgcagaatttgagaagagctgcaggaggactcattttcaggacacttgtgacagtctaatcatagggcaccacctaaggtggcagcataaacacagtctgtccccagactgtaaccagatgctcctacttgagaccaaacagcaaatgggttaggctccaagccagaagagagctgggggtcccaccttctgtcctctccatggtgagtaacacttcgcagacgtgctctgggtagtcactggtgcactggacggcccggtgcagagccttccggcagtgctgggtgtcaccatgagctctaaggcagaaaacaaaaagttgctgccaccaggacacaaagtggaaggcactcgaagggagaggccgtcttctcccaggtagaaactcactcttcagtaactctagcttctgagaagaccttagctttcagatctatccatgatgctttctccttccagagtctctacagtcacctacgaagtatttccctgaagcactctctccctcagccatgtaggggctactggaaagtgtacctgatattgtgatctgcaaccagcattctgcctttacagcattcacatgtgcggcacatggcgggggagtccaacagctctctgtaacctgatacagtccccagggaaattttactatggcgtcctactgacaggagagttatgaatccagggtagtgtcaaatttcatacccagagtcagatcttttttttttttttgaaagggagtctcgctcttgtcacccaggtgggagtgcaatagcacgatctcggctcactccaacctctgtctcccaggttcaggcaattctcctgcttcagcctcctgagtagctgggattacaggtgcccaccactacacccagctaatttttgtatttctaatagagacaggttttcaccaggttggcaaggctggtcgcaaacagatcctttttgtacactgctaatcacaacagctacacaattctgctaatcataactgttatgcaacagtgtattcatatttgtttttaaaacattttaaatatacataattatatatacatattatgatgctcagaataaattcagagcactggttctcaaagtaagatccacgtacccctgaggatctcccagagcctctcaggggccctgcaaagtcaaaactccttttataataataccaagacattactggactttttcactgtgttgacatcttcaagacagtgcacaagtaatggtggcccttagcacaaatcaaggcagtagaaatctttttaatgcactgtgtgatgaaatactaagtacacttaaagcccttctgcatactgaagtacaatggttattgccaaaaaaaaaaaaaaaagcatattactgtttgagttgcaagctaatcaagtcatttttttcaaggacaccatttttacttgaaaggaaacttgagtgacaaaccacggtcagttactcagacctgggtatttggcagacatttttgaaaattaacaaagtgaggctgccactctggggaaaaccactgacattatttgttgcatgtgatagaattcaagctttcaagtgaaaattagaattttggaaaacttgtatctgccaccacaagtctgacagcttcctacttaaaatacttttcaactaagatcaatacagatatgaacaaatacgattttttaatactataggatgaaatatgtcaacattggaagagctgcatgatttagtgaattgggatttttccaaataatgtcgtagaattgtggcatcaagtaaaagataaaatagacaaatgggtattactgtaacagactctgtcaatatggtttcagattccacatgcaacactgaagttttgctataatatgtatgaaagaagaatacccacaattatctgaaaatgcttctaaaatacctttctttcctaacctcttcaatgaaaacaacagatcacaacagacagaatcagtaacagacatgagaatttagctgtcttctcctaggtcagaataatgtgcaaataaatatatttgcaaaaatagaaaacactgccacttttctcactatattattttggggtctggaaaacagtcactgctcaaaaaagatattaatgttagataatttgttatatttaaataaattaaaatgttttttagatttctcaatttataaattataaatatcaatagatataactcacatacataaaagttttttgggatcctccaattttaagagtggaaaatggatcctgagaccaaaaaaattgtgaactgcagatctagggggatattcaacaagctttaacagtggttatctctggggtgggattgtaagaaactgtcacgtttagccggatatggtggctcatgcctgtaattcctacactttgggaggccgaggtaggaggatcacttgaggtcagcatgacctacatggtgaaactgtgcctcttctaaaaaaaaaaaaaaatccaaaaattagccaggtgtggtggtgcacgcctgtaatcccagctactcaagaggctgaggcagaagaattgctcgaacccaggaggcaaggttgcagctgagactgcaccactgcacttcagcctgggcaacagagtgagactccccacctcccccgaaaaaagaaaagaaactgtcgctttctatcacatatttttgtaaatattctaatttgggcacacagtgttttttaaatagggaaaaaatcttcaaaaaagaaaacccagcaatgtagcaatgttatgcaatgaacaacgttcaagacagactgaaaagttggtcacattctttatgttttccccatgttataaatattgttaggcctatcttatttcgttcaaatagttttaaaggcttgtaacacatgcatgctataattgcattttcattacaaaaaaatttaaacatagaaaagtctcaaagaatgggtcatggttatgactgggtcagtaatttgagttttttttctcttagctttttagtattttctacttttctataaaagcaaatataaaaaacaaatagctccaaaaggtcaaataaaatatcatgcccaaaaatcaagacaaaaacaaattaaaagaaatgcatggctataagagttccaggcacaaaatatcatgtctggttctctagccctgcccattaaaaatgtacccactactgaaagagacagaatgaaagaaaacagcccagttctaaggagctagtccaagctggtaggagtcagccaggagtgaagacaggtgcacagctgacaagcactgcctccctccccaccccgagatcagttacctttccaggttgtaatactctagccacatgttggcgtacttggcatttcctctggtcatgatgctatcccagagttcccgagctttctgcatgttattgcacagtcgagcctaaagtgcatcagcaggctgttaggagacctgaaccttatgacgtcgacacccatcatacaacacacttccaacagacacacataaaaagcaccccacaactattagtgttacagatgtccctgggcattccccaggcctccctccagtggtaaacgacccagcccaaacacttgagcctttctgcagccacaagctaatctacctatgtttcctgagaaccgagagagggagcgcacggtacttactcgacagtactagatagtcacgttttttatttttatcaagcttaactacaagtgtttgagagacaatgttaaaaaaaaaaaaaagactgatctagtattaaatgcacactctgctactaatacttacaaactgtgacttgggcaaattacttaacctgtaattctcagttttctcatctttaaaatggttaaaagataagcatcccatataaaaactacctgacaaatgttagtttcttctatctgacgctccctccgaggagaaaacatgattagaattgttacaatcctacctgctgatcaagggaggttccgtgtcttactgaccttggtgtccctgacccagtaatgacattcaagtcatcatatcctctaattacttgtcaaatcatctgtcttctacattagatagaagccttactagcaaaggaattttatctgtcttattcccacagcacctagtacagtgctgacaaacagtacacgctcactgtgctctcacaaatgaagcaaagaggcagagacagaagtaaacgagtgaatacctagcatctaaacatttactgcacaacttctagctgggagctaatattttcaccaacatatttacaaatatatgtcaagctaggtaaataacatgaatccttgtggagcctagaccattacctaggtaataacataaatccttatagagcttaggccattatctgggattctgactcaattttaattaaagtttaataggatgctattaaacaatgatggatgaaagtgctagatgtgtcaaaaacatttacctcaatcctagcccagttctgcataatcacgcagcttggatcaccactctcattgaaaccttcaaaaacagaattagtaaaattagaaaggaacttggagacagatagtcgctggctgaaaaggtacatcaaccaggaaatagtacagacaaggaaatacaactgggcaaaaccacaggctggggcatacttacgctcttccacctcctgcttcagatactccaaggcacgagtaaaggcggccctcaactcctccagctctttactggagtctaacggaaagtgcaaaaaaaggctttaggaaaccacatagcctggctttgttttattttttatcctatgctgaaactgcctggagacccactatgtacctggcatcatgcaagggacacagaaataaaattgccaattcctgccctcatcacatagttggggagaaagaaatttgaacagaatagagcatggacagcgtggtgaaaaaggcaaacacagggtgctgtgggggggagtctcccccagctggggtgacacaggcaaacaagagaatggctaaaggctacctgtatgaggtgacagctgacatgagtgtgcaagtacaagttaggggttttctggttgttttcggggggacatgaaggggcaaaggatcccacagaggtacaaagatttttctaaaacacagcagacttatttcaagaagtatttaggataaataaaaagacctgaaaggagaaatgagagctaagactaaaaaggctggcaggagccagtataaacgattactctcttgctttacaatccacatcatgacttgttaaagacagaaattgctaagatttctgggggaaaaagtcaccaatacctagtctacatcatttgcccaatcacaatgtatctggggaactgggacatctcgccaaaagttgtattaagaacatgttcagctctaaagtgaaaaacatgtgcttaaataccttgtttgaaatcaacccttctcctcaggtaatcaaggtatgcctgccaaatctccacataatcagtggcctggatgaagccggcattcaaagctttctcgaaggttactggagttggagaaaagtcaggatttgttaccaattcaaatggaaactaatagaaagtcactacattctactgactataaaacactacatgactttaaagactaatagatgcaacagaatgaaatgagctagacaggaatgttgaagacagaagttgctacagcactctacagactgtgttctagaaaaaacttcttccacaagacgccctgcaagaaaagttccagatcaaggaagtttggagaaaacactacaacttcttagaaaatacaatgaatattagcatgttaaaaagctctaagaagccacaaatataaccagttcatctctcactcagagccctttttgtcactacactccataacccaaagaaaaccccagggaacactgatgtaatgactttgtcaccgctctctgtttttcacttgggacaaatagcttagaagttctcccacaaaaacatccgcaccagaaattacttgatgatcaactccatgtctctccatggccaagaggtaccgactccataaggcaactgtccaggggcagtttctaatagcgcggttatgtacagataaaaccaaatcctttactttcagttgtcgatcctatgataaagaattccagagttaggaaattacactttattaagcattcaccatcaacaagacattgccagcacgaccaagtgatgaaagaaatgtccttataaacatctcttgtgacctggtttcctcaacaacaacaaaaaaatcactaaggggagtggaggagaaggagaggagcaacttacaggttaaaacagccttaaaagacgtcagccaaccctactggatagacctcatttggatccttttatacagacacactgaaatattttatatacacatactgaaatatttaccaacgaaatatcatttctggatttgcttcaaagtaacacagaagggacaagtaggtgagactacagatcaaagtaaactaaagctataaatgttactaattgttgaagctgggtgaggggtacagaagtttcattttactgatctgtctacttttatatgtttacatttttgccataataaaaagttaaaagaaaaatatcaagttgttataagtcctcaacacagacaatatgctcattttacttacagttagtgaccatttttaaataacttgaaacactaaaactttctaaacgagttggcaaagaggagaaaaagcagatggaggaaaagcaagagtagggccgtatgcaacaaactcctggcactcttactgattttaagtagattctaaattggcaaaaataaaatgaaattagaacagtgatcttactaggtactgactgtaacggatccataagtctgggacaaggcagttctcgaccagggcgcgctcaaagatcaactgaatgcgagcaggatcgccaattttcatctcaaaatcgatatatgcttgatattctgccagccttggtgcctctgcctgcaactggagtacaggaaaattgtattgaatttagttactggcaggaagcacaacacatctgcaaataaaataaattttggcaaaactggctacagtaactatgaatcgccaaatcctcactctcagaaccactccactatggcctctacaacttcttgagcaaaacaagagtcttctcatctggtccaaagtgccagttcatggcagtcgctacaaaggctccataaactcttttctaaatccattcctagaccacagggaattaagtagcccatcaatcaggaactgagtgaaagagcaacacctttgccagtgaccactgtcaaccacccttccaaaccagaagtcatgttcttgggctactgagtagagttaatacaaccaaactggaaaattttggtgcctgatgctatttcaggtttcttattccaaatatcagttcctggaagaatgtagataaatgcagaagatgaaggcagctgtgctgaatgtttaatgatccaaagacatacaatcaaattctttttagaaaaaaatcttattcgacatgttttctcttcaggcacattttgctgatggccatgacataattgaatgatcgaagttttgggaagcacaggtacatgcaaatcatttacacatgaaaaagaaaggatgaagcagtgcaggagagtaagagaacacacagactccatatgtagaaaggggatgtttcagggcctccatttccagtaacgaggaagaattagttacccagacacactgtaccattcaaaacaactaaaactgctaaattaaatataatatcttcttaaaagtcatcaacaaactggcaaagaaacaagaaatactaaggactaaggacaaaatctaaatgagggtggcaagctaagtaaacattaaccttttgctggcttgacgtatattaagaatctgaccttcacaatcctattgttggcaaagaaagatagaaaaaaagagtcaagaagcccaaaaaacttcaagccagtccacacatggacctactgcagtgaaattagaggacagcaaaccaaatcaatgagatcttaaaagcagtcagacaaaaaagtgactacctctgaagaagcaagatttatacaaaccgctgacttctcaacagcaacaacagacatcagaagacagaaagatacaatcaattgctgagaggacacattgtccgtctagaattcttttgctgttgtcggtctagaattctatagcctaagaaaataattttcaagaagggaagcaaagacctttttgaacacagaaaatctgttaccagcaaatctcccttgcaggggactctaaaggtcaagtgttgaagacactggacaaatttataatattattataaagctttacagaaagacaagatataagtagcagaaacctatatatgttcatagattggaagatgtaaattattccccaaattgatctccaggttcaatgcaattccaattaaaaaaaaaaagattttaaaaatataactagaaaagctgattctaaatccgatggaagcattgaaggcaaaaaaaaaaaaaaagccaagatcctcttgaagaggaaaaaggtggatgggactcaccctatccaagagcaaaacattataactctcatcattacaacagtgtaacataaaccagtgggacagaacagaaaatccagaagaaagacccacacataaatggacagctaatctatgacagatgtggcactgcacatcagtgaggggaagaaggaatgatcaaactcagtactagaacaactggttctccatatggaaaaatgaaaccagacgcagtctcataccactcaaaaatcaatcccaggtggatgagggcctaaatatgaaacagaaaactataaaacttttagaagaaattagagctaagtagggaatattttttaaataagcacaacaaaagcacaaccaaaagggaaagaattttaatctaattgatcactaagaactgttcatcaaaagacactgttaaaaaataaaaaagtgaaaaggcagttgcagtgactcacgcctgtaatcccagccctttgggaggctgaggcaggtgaatcacctgaggtcaggagtatgagaccagcctggccaacatggcgaaaccccgtctctactaaaaatacaaaaattagcggggcttggtgacaagggcctataatcccagctaattgggaggctgaggcaggagaatcgcttgaacctggcggggcggaagttgcagtgagccgagatcacgccacttcactccagcctgggtgaaagcgaaactccagtctcaaaaaaaaagaagtgaaaagacaaacaactggggagaaaatctgcaacacatacagcctaaaataagacttaagacaaagcactcccacaaatcaattagaaaaaagatacatcaaaagggaaatgggtcaaagacttttttttttgagacggagtctcacactgttgcccaggctggatggagtgcagtggtgcgatctcggctcacagcaacctccacctcccggcttcaagcgattcccctgcctcagcctcccaaacagctgggattacaggcgcccgccaccatgcccagctaattttttgtatttttagtagagacggggtttcactatgttggccaggctggtctcaaactcctgacctcatgattcacctgccttgggctccgaaagtgctgggattacaggcatgagccaccccgcccggcccagacttttttttaagaaatagggttttgctttgtcacttaggtgacaatgcagtggcatgattacagctcactgcagccttgacctcctgggctcaaacaatcctcctaccttcgcctctggagaagctgggactacagacacatgccaccaagcccggctttttttttttttttttttttttttttttggtagagacagggttgtgctacgctgccaggctgatctcaaactcctgggctccagcaatcctcccgccttggcctcccaaagtgctgggattataggcataagccactgtgcccagcctgaacactttaacacgcacaaaaatttgaatggccaatccacgtgaaaagatgctcaacttcattagtaaccaagaaaatacaaattaaaactacaatttcaaattcatcaaattaagtaaaatttaagtatgaccaatatccaagattggcacaagcaacgagaactctcagatactgctcacagcagtgcaaactgataacctggaaaacactttaacatcaccctatgatccagcaaagtcattcctaagtacgtattctagagaaactctttttcatgtgtacaaggagatacacacaagaatgttcagagtggcgctgctccttctcctagcaaaaacctggaaatgacccaactatccagcaacatggataaatacatcgcagtacacagacaactttacagcagtgaaaacaaatgcaccggagttatacttagcaacatgagtaaaacccaaaagcatgttcaatgaaaataaaatatacagcatgattccaatatataaaagttcaaaagcaagcaaaattaaacaatatattaattaaggatactttcatagcttgtaaaactataaagaaaagcaagggaattatcatcacaaaagtcaggaaagtgattacctctcgggagagggaggaggaggcaatcggagaggggcacataggagacttctaaggtactggcaatgttctatttcttaacctgggtggtaggtacatggatgttcactttattattagtatgtaaactgtacgtatacatttatacactctatatatttcagaataaaacattttaaagatactgtttaactcgcaactatccatcagggaaaggtttgtagagagacgtttactataaaagaagccaacacttaccagtgcttcttcatagggtttatatttctccagctgctgtagtgctttgttatagttctgaattactgactctggtattgggtcttctgaccattcttcatactctgcaaatgtggcctccatatctattgaaagatggattcagccccgtgggtcttgccattgggctttatcaacccaaacacagattaagccatgagactcaggtgccactagcccctcccacatctgtggcatggcagctcttactgatcaaattctgatttctgctgagcccaaacctgtctgtagaatctgtcttaaaacaatgtcccaggcaaccctcccagctaattaatcagtcaatgacactagtggcaacgatttaacaacacttacccagtgttacctatgttctaccacttcacatccactaactcattcagtcatcccactctacaaggtagtctattgtgatcctcattttgcagttgaggaaactgaagcagagggttcagttgctcgtctacagttaatggtagagcaaggctgtgaacccaagcagtctggctcaagttcgcactctaatcattatgctaggttgtttcacgctggtaggtgaaatctgcaagccggctcagctctagtgttttctgcatgatacccaaccatttgattagacgactactttataacttgttaaatccaataaaccatgaagagaaataacatgtgggctccagtaaagttgcccagaggttctgagtatgtacaacacatgcccgtgtctagggaacaaacacaacagccatgacaaactcttcccatactcagaaaaatcctcccagcacgcacacactcatagctccaaagactcaaaggcttagattgccaaaatgtatttaccaaataaggaaactctttaccaaaccccaagaaactcacttatgagtacttccaatcaactgcacttctgaaccaaatccctcccatagaggaatgatctaaactcatgtaaaattcctgctgttatggaagaggttacttgtgaagagaaaatgattataatggaactcttgttcaatgaagtttccccaaaaaatacaggtgtcattcactattcctttcagagaccctatctctgcccttccaactaggtctcaaaggagaaaagagctctcacctgggagtcagggagtctggcttccagtcctgcctctgaccctcacaaccctcttaagcactaacattcaagatgtttttaccaaggacctcatccaaagagacaatatccaaggagagtaagaacaccagctttacctgcctcacaggatggtgggaaaggtctaactacatgttgttccccaaagcattttaaaaaccatagagggctggctgttgacatgtcagtttctcttaccatagagtgggatcgccaactgtcgccggaaaagactgtggactttctcaagctgtgaatcaaaggtttgttcccggtcaaaaggggaaaggaagccagctacgggctaaagaagcaaattagtagtaaatgacaaactgtggttctttctttttcttttgagaagggttcttgctgtcaccctggctggagtgtggtggtgtgatcacaactcactacagcctcacactccaggctcatgcaatcctcccacctcagagtcctgagtagctaggaccacaggcatacgccatcatgcccagctaatgttttagttcttgtagagatggggactcactacattgcccaggctggtcttgtactcctgaactcaagtgatcctctggcctcagcctcccaaactgctggaattacaagcatgagccaccgcacttggccaactctggttctttctacttcaaaaaatatctcaacaaattttcagttcaagctaaaaaaatttatacgacctcttccatacatattgtaccaaatgctagaaggggtataaaaaaaggttatctatcaccccaccactaagggattggcaaagaccattttgttaactatatgaactgcaagattcatcatggacatgtgtttcaaaataatccttccaaggagacttacaaagacagccccaacccgttcagagacaaccacaggtactcacccgagcagcttccacaatcgcactttcaaactctcggtaagcctcccagagggcgagtcctttggtcatatgtaaaccaacagacgagagagccctttcaaacacggagcgaactttctcaaggccacctttctgaccaatcccaccaactgagtactggccatactctagccaaatgttaggacctaaaaataagaagtgttcaattagtttgggatataaaatacccaaatatcaaaactgatgcataacaaacgaaatgtgcctaccaaaaaagtactcagacagcagcactaaatgacagtgaaggcctaacagcagagatgaccataaaggactaaaaaacattacagtctggggaagaccatagatcctcagaaaaagataaatggtgctattaacaatgcctgtgagagagtaagaagggggtaacaggatcatcagaaatcatgggaacaccatgcactgctaaaattatcagtggctctaaaagaagactcatgggccacagagcagagatacaggtatagtttttaaaaacacatttggccaggtgcggtggctcacgcctgtaatcccagcactttgggagactgacgtgggaggaccacaaggtcaggagatcgaaaccagcctggccaatatggtgaaaccccgtctctactaaaaatagaaaaattagccaggcgttgtggcaggcacctgtagtcccagctactcaggaggctgaggcaggagaatcgcttgaacctgggtaggggggaggttgcagtgagccgagatcacaccactgcactccagcctaagcgaaagagtaagactctctctcaaaaaaaaaaaaaaaaacacacatataatatagttttatattcataaaacaccgcttattttcattattcagattataaaccaaaaaactgtgaattcttcttggcttgtaaagatacacaaaaaattctctatcatctcagaacagtctatctggttagtagcaatgcttctcacagggggactgctcccattgggaaatcaacaaggaagagggtacgaaatctgaaaggggaaattgtttgtttgttgagacacagtctcgttctgtcgcccaggctagcgtgcagaggcatgatcacggctcactgcaccctctacctcctgggttcaagcaattctcctgcctcagcctcccaagtagctgggacaacaggagcatgccaccacgcctagctagttttttgtatttttagtagagatggggtttcaccgtgatagccaggatggtctcaatctcctgaactcgtgatatacctgcctcagcctcccaaagttctgggattacaggcgtgagccactatgcccagtctgaaaggggaaatttttttaatgcttttttttttttttttgagacagagtctcactttgtcgccaaggctggagtacagtggcacaatctcggcccactgcaacctccgcctcctgggttcaagcaattttcatgcctcagccacctgagtagctgggattacaggcctgcatgccaccccgcccggctaattgtatttttagtggagatggggttttccccatgttgggcaggctgatttcgaactcctgggctcaagggatccgcctgcctcagtctcccaaactgctgggattataggcataagccaccatgcctggccttaaaatgcttttttttgagacagaatcttgctctgttgcccaggctagagtgtagtagcacaacctcaactcgctgcaacctccacttcccaggttcaagcaattctcctgcctcagcctcttgagtagctgagattacaggtacgtgccaccatgcctggctaatttttgtatttttagcagagacggggttttgccatgttggccaggctggtcttgaactcccgacctcaagtgatccaccagccttggtctcccaaagttctgggattacaggcgtgagccaccacacccagccttaaaacgctttttaaaagcattttgtccacagcattgtctgatgtggtccccaattcacatggagaaaatatttaagacaattatactatatacaagggacggtaaagagacttaaagggaggtgagtcttctatacttcacttgcactggtaagatgtcaataccagcaggcgagggaggtctctgtggggacagaacagctctgtatctggactgcagcagtggttagatgaatctacacatgtaataaaatgtcttttttttcccattgttccaaggtcaatttcctggttttgattttgtattacagaaacaagatattggaggaaactgggtgaagggagtacacaagacttctctgtactatttctgcaacttcctatgactctataattacttcaaaataaaaaggttttcttttaatgttttaatctttttttttaaagcatcctgtccaaaacctctaaaaacctattgaatgtataaaagatcagtggaaataccatgtaagttctcactgtcaataaatcctgagtgtgagtgtattcattcccttactacaagtgcttcttccacttttattttaaaattaaacttcctcaattaaagaccaaagacaatgataagacaactcaacttaaatcttgctaattgtgaaactaacgttcccttttctgggtagcaacatctcataatacagtcctcaacagcagactgatatatatgacattgccagatatccaaaaaaagtccacgggaacttacaaatgtaatccttcacggctttctcaaagaggtcatacacgtgctctctgtccaggccatcctgggccatgctgatctcgtcatgcagccactccagccagagctctacgagacaaaaatacttcccgcattaataccaaagggtaggctaagcgcagggactttaccaagagacatcagcatgcaaacgtttcatccatcttacacaacctggcgttgtttccagaaattcacttcttaaaacctgaactaagcacataggaggttttatgcttccaaataagatcaaatcactaaaatcataatatcctccacctgttaggcattttatattttgcaaagcacttttctcattcagtctttatcacaatcctgtaaggttggtgatagtaacactaataataatgacatctatctaaggatgacaacatgccaggcatgtgttaagtgttatacgtagaatagctcatcctataccgtcatacattacaatgcagaaactactgttgccatcatttaactgctagaaaaactgagtcttagaatgtttacataatttgcttaaggtcacacagctagtaaaagatgtagccaggaatgaatctaggtcacctgactccagcatctacactcggcagttatgctttgcagaagggaaaaggggcagagtgggatctaggaccaaagtgttctaagtactgcccaaagatcacttattaatattcatgaagattgaactacagagttgttcagtgcaattatgtttctaataagcaaataagtagaaataacctaaatgcccaactattctggaacaattaatgtatgaaacatttacataaaaaactgtctgtaaaagtttaaatatatttacaattttctggtttcaagagaatggtttaaatacataaatagtgaaatgggaaatacagaaatgaaagccaagtttaattacattacaaatgtttaccacaacgttagaataaagaaatcagaattcaaaatccgtgttatatgatcataactacattttgcaaaaaactacaataaactaaaaatagctaactctgatgcgttttcttctttccactacactgaacgttccaggttttctacaaggagcatgtcccactttcaacattgtaaaaaatgtgcaagccttgtttctgtttctaaaagcagcctgactgctgaagcttaccttcagtcaagggaaagatttcactcatcttctggcgggccatcctcaccttggtaagctccccttccagcctgagcagtctgatcaagtccacatggcagttgtagtcatagacgttgatagacaact

SEQ ID NO: 11806 - DNA, 254 bp, Homo sapiens
tttgaaacttttcaaactaaaattattttaagttaccatatatctgagacaaagaaaaatgaaaaaaatgtcactagcagacctacccttgaagaatagctaaaggaagttcttcgaacagaaaagttagaagaaggaatcctaaagcatcaaaaaggaagaaagaacaggaagagcagaaatacgggaactacgacagattatcctcctctcctcatgagctttctaaatcatatgtaatggaacaaacattg

SEQ ID NO: 11807 - DNA, 2363 bp, Homo sapiens
ttgttttttttttttaataacaagggaacagattgtattaattccaaaagtttagagaaagcaatttaaagaagttaattagggtccctccaaagagcttttgttattaagatgggttttagacattcaaatggctcaagtcaaccaaaacagatattcatggctgtctttagagatgacacatggcaaccaggaaaagctgggcaccatgaggtctatggtctcagaagttcttcagggggcaggtccttttcttttagagactctgcaagggctctctattgcaagcaggctttaagtcatatattatgaggggtggccaaagcctttcacttcccactggcttccaatgaaaattgctgcaaaaaagtgctgactcattcatactaaagtgtaaatgactgcaataagaatacttttatgtgactgactgatagaaggccgccattgagtaaacagagatagagaaaatgggagtagttatggcaatgtggggagcagaagaattagaaagaaaaaggaagagatgttaatcttgcctctggcttattgtaactgaggctactggcagatgatagtaacagccaaactgaccgtgtccactgtctatcctttatttccatgaatctgcacggtgacccactcccctcccttccctgcatcattctctccactttacagatgaggaatctgagtccaaaagaggttaagttacttgcccaaggtcacaaaatagagattaaaatttagttttgtctgactccatattcttaaccttcaaggtccactgcatctctgcagagcttcccaagctttccactgaaggcctctttatattctattgcacctatgtcatccacattttgaaagattttattactgagcacactgcatttgtgaactaataatttcttccatctggctgatgattatttttctactcctgtttctgttacaacatcaatccagactttaatcccaattattgaaggttcaacataatattataaaatcacataaatcactgttgtgtctatgcagctaataggctaataaaattaaatcagcatatgcgccattgcccagtgctgaattctgaatgccacatggttttagagtcaatgccacctaaacactaggcattctcaacccaaagtccggggttcccagagagaggcagtgtttggtccaccccatacatctcagacattccagggacatcaatagccaattacagtgttcgagcaacatgatgtgcccagggttatcacatcgagttgctagaattcggatctaaagcaaagcaaagtctagaatgtgtggtagattataacaatggcccccaatgaatcatgcctttcagtacccaagcgcttgtatagactcttcccacactgactctgagcttggccacgtgatccgttttagccaatgagacatgagcaagcgcgatgcaggcaaaggctggataaatacttgtgcattggggcttacttgcttggaaccctgagaccatcatgctggataaaggaccacaggcagagagaggccaggtcatcccagctgagccccagacactggctgacccagcagctacctgtagcctcatgagtgagcccaggcagaaccagcagaagaactgcccagggaagaccagcagaaagagtgcccagtcaagccaaagaatcattgagaaataagaagttgttgtttcaatccactaagtgtttcaagagtggcttgtaatgcaacaaaaggcaagtgattacagtctagctcttgacactgattcacctggaggactgccgttactacttttgtggtgcccaggaaatttggggtccttaagccaaaaagcctgtgtcctgagcttctcttgaaagactgaaaaccctaacacctccatcaagatttgggtttcatttagcttttccagcataactggcagaggtaccatttccctctcccctactcagcaggtttcttgtatcttcttctcttagtcttcacctctgctctgcatgcaacttcctcagcctaacatggtagacaaaggatgagggcagtgggaccagctctgtttgttggtacaaatatgggatggacatgttggaaaatgtaatactctgagaagattctggaacattcctgtttttcaaaccccagtgttcctccatgtgatgctccagctttggcgattgttgagagaaaggcctgaagtctgtgcgtacaaagagcctcatgaattttgttgacagaaatactgaccattttctcactcgattagaaaggaaacagtggggccgggcgcaatgggtcatgcctgtaattccagcactttgggagaccgaggggaatggatc

SEQ ID NO: 11808 - DNA, 265 bp, Homo sapiens
agatggagtctcactctgtcacccaggctggagtgcaatggtgcaatctcaactcactgcaacctccacctcctgtattcaagcaattctcctgcctcagcctcctgagtagctgggattacaggcatgcaccaccatgcccagctaatttttgtatttttagtagagactaggtttcaccatgttggccaggctggtctcgaactcctgacctctggtgatccacccaccttggcctcccaaagtgctgggattacaggcgtga

SEQ ID NO: 11809 - DNA, 22253 bp, Homo sapiens
agcttttcaggctgcctttcgagctcaggggcccctggctatgctgcagcactttgatactatctacagcattttgcagtaagtgaaacacccaactggtactttaaaaagaactggtgactgtttgtcctaactgtgcatgttagtcctgaaattccaagttataggttcactgataaatgcctctggatattgatatctctactgatgagcatgtacccagcttgccaccgtatttattcagttgaacaatttcacgtgtatttttaaacattcgattccacgggttagatctgatctgttagaaggggctctgcaggctccttcctgtctcacccccacactttctttccctcatagtcactttcgaagtatagatcctggcctcaaagaagatactctgcaattcctgataaaaggtgtttatgggtcagggggtaggggatggaaggtgtttgttatcgtttgtttgtttgtctgtttgtttgtttttcctacattttgtcagccacatgatgatatcaaggctgttgtgattcagttggtttggctaagcccagggacctttggcctgttaaaggtctgtaatcttggtgggcgatacagagttatgtgtgttcactgtaagggcagaccaacaagaactttttcctacttttgagctacctctttttaataggggtgattcttccagttgctggagagaaattgtggtaactggagtgagagagtaggaacagggcatgttcagggtatcagggccaagggtcctaaaggacttagcttgtgttatggccactgagagatgaaacacagatctttggtaatctgatggctgcaagtgctgggtgttttgaagttggggtatatgaaagaagtgagtgaaactgactccaagattctgcccctcacagtggtatcccgccactcccaggagcttccagctatcctggatgatacaactttgagtggatcagatagaaacgcccatctaaatgccctcaaaatgaactgttatgctctgatacgtctcctggaatcctttgagaccatggccagccagacaaaccttgtggacctggaccttggtgggaaggtaatttggagttttgggctcacgttatatggggtctggggagataggggaatagatggaaaagaagggaatccaatgatccacaaatcctttctgtcctcattgagaatttaggagaaagaactcaaaagtgtcacacgttttcttcctggacaagtagcgctgtggaacttgtaatatttcttccgtattaccttctatgttgtcttggtactagattgtttgggcactcagactgacagatcttgacccacttttttcccttattttttcctcaatgtatacatgatcctttttagggtaagaaagctcggaccaaggcagcccatggctttgactgggaagaagagaggcaaccaattcttcagcttttaacacagctacttcagttggacatccgtcacctgtggaaccactcaataattgaagaagaatttgtcaggtgggtagggaggatggctacagataatactgagctgtgagagtgaggctctgttgatagatatgccgtttttttggttttgttttttttttgtggggggacagagcttcactcttgtcgcccaggctggagcgcagtggttcaatctcggctcactgcagcctctacctcctgggttcaagcaattttcctgcctcagcctcccgagtagctgggattacaggtgcccgccaccacaagctgatttttgtatttttaatagagacgggttttgccatgttggccaggctggtcttgaactcctaacctcaggtgatctccctgctttggccccccaaagtgctgggattacaggtgtgagccaccacgcccagccagaagtctatttttaaaataagtaaaataagtttgatggaagaaggttgtgattttaaatcagctactctaggcccggtgcggtggctcacgcctataatcccagcactctgggaggccgaggcgagtggatcacctgaggtcaggagttcaagaccggcctggccaacatggtgaaaccttgtctctactaaaaaaatatgaaaattagctgtgcatggtggtgtgtgcctgtaatgccagctacttgggaggctgaggcaggagcatcacttgaacctgggagagggaggttgcaatgagctgagatcgcaccattgcactccatcctgggcgacaagagcaaaatcccgtctcaaaaaaaatagatagggccaggcgcggtggctcacgcctgtaatcccagcactttgggaggctgaggcaggtggatcacgaggtcaggagatcgagaccacggtgaaaccccgtctctactaaaaatacaaaaaaaaattagccgggcatggtggcgggcgcctctagtcccagctactcaggaggctgaggcaggagaatggcgtgaacccgggaggtggagcttgcagtgacctgagatcgcgccactgcactccagcctgggcaacagagcaagactccatctccaaaaaaaaaaaaaaaaaaaaagatagatagatagatagacagacagacaaacagacagacaagctactctagtaagacttctttgagatggtgacatttgagcaaagacccagaggaggtgactgagagctatgagaatatgtggaggaatagcaagggcagggaaaaggaatagcatatgcaaagaccttgaggagggagcatgtccagcacgtacgagcaatagcaaggaggccagagagctgacagctgagagcaggtacgagggttaggccgtgaggccatgggagcagtggggagccagaccgcaggttcttgtgggccatcatggtgactttggcatttcctcagaatgaagtggagccactggggagccacaagcagggaggtgaggtgacctgacttgtacttcaacagggccatcctagctgttgtattgaaatcgactatggagggaaaggggaagcaagagaccagttaagaggctgttccaataactcaagcaagagatgatggtctcttagaccaaggcgtggcagtggagatggggagaagtagttggattctatactttttccttaaggtagagcttacaggatttgctaacagactgggtgtgaggtgggagggagagttcagtcaaggatgactctcccgggttttggtctgagcatttggaagactggagttaatggtaactgagatagggagaaggctgtgaataggtgttttgggaggaagatcagatgttctgttttggacatacaaagtttgaggtgtttattagccacgtaaagtcagatttggacgttgaatatatagatctggagttcaggagagaggtctgagctagagataacacatttgggaatataatagtattcagagccgtgagactgaatgaaattaccaaatcagtaagtgtagctaaaagagcaggaatccaaggactggtaccctagggcactccagcattaagagtgaggatgccgggtgcatggctcacgcctataatcctagcactttgggaggctgaggcaggaggatcacttgagcccaggagtttgagatcagcctggacaacatagtgaaactgtgtctctacaaaaaatagaaaaattagctgggcatggtggaggctgaggtgggagcatcacctgagctatgaggaggtcaaggatgcagtgagccgtgattgcaccactgcactccagcctgggcaacagaggcagaccctgtctcaaaaaaaagagtctgaggaggaactagccaaagaaactgagaaaggagtcttgttcttgtgtcctggaagcgagataaagcatatatttcaaggagaaagtgagtgattaactgtatcacatgcagctgtgaaagaccacttgagatgcagattgaatcagtcgttatatttaggaatgagaagtcattggtgactttgtcttttttttttttttttttgtgatggagtctcgcaatgtcgcctggcctggagtgcagtggcatgatatcagctcactgcaacctccacctcccaggttcaagggattctcctgcctcagcctcccaagtagctgggattacaggcgcccaccaccacacccagctaattttttgtatttttagtagagacagggtttcactatgttggccaagctggtcttgaatgcctgacctcgtgatccacctgcctcggcctcccaaagtgctgggattacaggcatgagccaccacacccggccaactctatcatatttttatgatatatttaggttctttgtcagcatcacaactggttgaaagttggtaatcttgaaggaaggagtacctaactggggtcagcaaagcaaagcaacttgttatagaaagtaatggctagaataaagaaaaccctgactttgggagcagtagggatagaatgaatgaggcagggctctgatacaattggattcagacagctgctttcatcatctcaaactcttcctttctcagtttggttactggctgttgctaccgccttctggagaatcccaccattaatcaccagaagaaccgccccactcgggaagccataacacacctgcttggtgtagccttgacccgttataaccatatgctcagtaagttaccagtcgctttgccccgccttttttgtattgcccataatttctcatgtttaatgcttccacaggtgctacagtgaagatcatccagatgctgcagcactttgaacacctggcacctgtactggttgcagccgtgagtctatgggcaactgactatggaatgaagagcatagtgggagagattgtaaggtgactcttccttctcgaagtttctcatgcttattttccttggggagggaataaagaaagattggaaatacattatctgtgcaacagtagattccttcagatattagatacctgtcttaccttcccttactgggaactgaataattgatctatgttgctatggctgtgttttcttccctgtgtagagagattggacaaaagtgtccccaagagctgagtcgagacccttcagggacaaagggctttgcagcattcctgacagaactagcagaacgtgtcccagctatcctgatgtccagcatgtgcattttgctagatcacctggatggagaagtaggtggtccactaggggtcactgagctttttctggggattttaagtccagtgttgaaaggctgtttcttaacagaacaagaaagtagctttgacaagttgtctagatttatcattgtgacatttcctttctgtagagaagcaggtcaagtttgttgaataaggagctctttattaatctgttaatctttcaattcacattgcttttatccagttctggtaagggagatgacatttctgcagcttaagtctagtaagagcaactcagctttgattttttttttttcttggaggtaggatctggctctgtcacccatgctggagcatgatcatagctcattgcagcctcgatctcctgggctcaagcaatcctcccacctcagcctcccaagtagctgggacttcaggcacatactaccatgcctggctaatttttttagtttttgtagaggtggggtcttgccatattgcccaggctagtctcaaactcctggtctcaagcaaccctcctgcctcagcctcccaaagtgctgggattgcaggcgctaccatgcttagccttcagctttgattctgagtcccatctgttcctcaggataaagcgtcttcccaccagctggcttgccttgcttcctcaaacaatgaactttctcaaatcaacccatgtcatctctctcaattctcttttatgcctgaatgctaacctggctgattcccatactgatgttgggcactcctaggtgaatgtcaaggacaaagacagtccacttgttcatctcatttactttaactttttgtgcaagaccctattctctggttcttagcctggcaaaaccttaaccctgctctccactagattatgtattggacttgctggcactcttaaggctgatttccatgtttctgtctcattttctgtcagtaaagcatctgaaggagagtgggagggaaaggaggggatatttattagtaaggattaaagactttgaggccaggtgtggtggctcacgcctgtaatcccagcactttgggaggctgaggtgagtggatcacttgaggtcaagagtttaagactagcctggccaacatggtgaaatcccatctctactaaaaatacaaaaaaaaattagctgggtgtggtggcgcgcacctgtaatcctagctactcgggaggctgaagtgggagggttgcttgaacctgggaaatggaggttacagtgagccgagatcgcaccactgcactccaacctgggtgacaaaacgagactctgtctcaaaaaaaaaaccaaaaaaaaccacacagacgggcgcggtggctcacgcctataatctcagcactttgggaggccgaggagggtggatcacgaggtcaggagtttgagaccagcctggccaatatggtgaaatcctgtctctactaaaaatacaaaaattagctgggtgtggtggcgggcacctgtaatcccagctgcttgggaggctgaggcaggagaatcacttgaacccgggagtcagaggttgcagtgagccgagatggcgccacagcactccagcctgggcaacagagcaagactccgtctcaaaaacaaacaaacaaccacaataacaaaggctttgagacctcagctgaagggtagttaataaatgcttttcaaatgtgtgttggtgagtggatgtgatttttttattcagctactaccatgctttcctgtgtgagccctatgaggaaaaattggttttggcccttgttctagcattctctgagcaacaagtcctctttgggattcagctttctcctgtgaccttgggagtgaatacctaggcagttaatggaaaaagttatggccaagcacaagcaagcttcgccttgactaaaggtttgacccctctatgcttctctctcttagaattacatgatgcgtaatgctgtgctggcagccatggcggagatggtgctgcaggttctcagtggcgatcaactggaagcagcagcccgagacaccagagaccagttcttggatactttacaagcccatggccatgatgtcaactcctttgtgcggagccgtgttttgcagctcttcacccgaattgtccagcagaaggtaaccaacttctatgtggcaaaaacatatggtacctctccatataccagtgtaaagaggaatccagtgttgaagataaatatctgccccaaagaggtctagaattcacatttttattatcagtagtaaaagtcttcctctaccaaggacgaggatatctggctccctttaaggactgtaatgtgtcttaccactacaaggagtactcctaatctatattctgtagaaagggtttttagagtgagtgggtagctcagtttagagtatacttaaagatcatcttgaacaaaatggatgatgtgggacttgagcagattcttctcttcctaccctacacaggctctccccctgacacgtttccaggcagtggtggctttagctgtgggacgtctggcagacaagtcagtgctagtatgtaaaaatgccatccagctgctggccagttttctagccaataatcctttctcctgcaaggtaagtagacttggtccaccaaaagagaaggaattaaatggaaacagggatgaaattatgtcatttactgaccctgctattcattttacctgatagcttagtgatgctgaccttgccggaccactgcagaaggagacccagaaattacaagagatgagggcccagaggcgaactgcagcagcttgtaagtagttactgccttggagtcctaatgccagacaggcttctccttgcagtcagaaactctagtgaaagagactaagtgacactctcatttagctgcagtgctggacccagaggaggagtgggaagccatgctgccagagttgaagtctaccctgcagcagcttctacagcttccccagggagaggaggagattcctgagcaaattgccaatacagagacaactgaagatgtgaaaggacgcatctatcaactgcttgccaaagctagttacaagtaggcaaaagaatgggatattcttcgtgatctgtttatgtttagagttaacctttgagaaacttacataatgtgtcttttaaattaactgcacacagatatgctgccaccaggtgatggtagatgttttcatgtagtaatggtctgaccataggcctagtccacaattaagcatgtgtttctactttataaatgtttaaaaaaactactgaaacaattaaatgttaacagtattataatcaaacatgagtactccttcaattgaagaagagcacctataaataagttctagttgtatgatcttgaataagttgcttaactttctgtgcctcggtttcattatctataaaataagaaattgattagatcttatgatctctaaggactttctaattctaaatttcatgaactaataatatcaaacatgcttaatactaccttaatcttcaaacctagtatgaatcctgatcttagagaaaagatttctcctagtgtttttgtgactctagaacttaacaacaaaagcccttacagccgtcaacaagttttttttttttttttttttttttttttttgagatggagtctcactcactctgttgcccaggctgcagtacagtgacacgatcttggctcactgcaacctctgcctcccaggttcaagcaattctcgtgcctcagcctcccaagtagctgggaccacaggcgcgcaccaccacaccgcactaatttttttatttttagtagagacagggtttcaccatattggccaggctggtcttgaactcctgacctcaggtgatccacccatctcagcctcccaaagtgccatgattacaggcgtgagccaccgcactcggctgccaacaagtattcttaaacctcagccacaagttatttgttatttatttacttcttacctaattgggctgaattttttttttggagacggagtcttgctctgttgcccaggctggagtgcagtggtgcgatcttggctcactgcaacctccacctcctgggttcacgccattctcctgcctcagcctcccgagtagctgggactacaggcgcccgccaccacgcccggctaatttttttttttatatttttagtagagacggggtttcaccgtgttagccaggatggtctcaatctcctgacctcgtgatccgcctgcctcggcctcccaaagtgctgggattacaggcttgagccaccgtgcccggcttgggctgtttttagaaggctagagagtggcttgtttgccctatgactcccttatgttactttagtgtctctctttttattttgctaaagcaaaaatagagactatagttttataagtgcatgttccaccaagcattctagtattttctcctgtcaattagaaaaggattgtttgtttttgagacagaatctcactgttgcccaggctggagtacagtagcgcaatcacagctcactgcagcctctcactgtagcctcaaccctgctgggctcaagcgatctcccacattagcctcctgagtagcctggttaatttatttataatttgtagctgggattacaggtacacaccaccaggcctggcctttgccagcctgggcaacgtggcaagaagataacatgtagacaagcagtcaaacatgtattctttttttcccccttttatatgactgatagaattctctgcccactgatctaccatcttgtttttttcacttaactatgtgtctcagtggtttttaaaaatatttatggctgggtgcaatggctcatgcctgtaatcccagctacttgggaggctgaggcaggagaattgcttgaacccaggaagcagaggttgcagtgagctgagattgctccgctacactctaccctgggtgacagaggaagagtccatctcaaaaaaaaaaaaaaatttatagatggccaggtgcagtggctcacacctgtaatcccagcaccttgggagcccaaagctggtggatctcttgaggccaggagtttgaggccagcctggccaacgtggcgaaatggcgaaacccatctctgctaaaattacaaaaattggccaggtatggtggcacgtacctgtaatcctagctatttggggagctgaggcatgagaatcactcaaacctaggaagcagaggttatagtgagccaagatcatgccactacacttcagcctgggtgacagaacaagactctgtctctaaaaaaaaaaatatatatatatatatacacatatatatttatacataaatagtttcccactctcctctttttttgagagagagagtgtctcactcttttgcccatgctggagtacagtggtatgatcacaactcactgcagctttgatctcccaggctcaagtgatcctcccacctcagctccctcgagtagctgagaccacaggcacacaccattacacccacaggcacacaccatcacacccacaggcacacaccatcacacccacaggcatacaccatcacacccacaggcacacaccatcacacccggctaactttttttactttttgtatagttgggtctccctgtgttgcccagactgatctcaaattcctgggctcacgtgtccccattattttttatgactacatagaatcttattgtctggatgtgcctgaattaactaattattgaaagtttattgtttctaaacttaggaaagtttttaaacaggtgtttggagtaggtttatgattttaaaactttaaaaagccttattggagtttttttgaagactgtagtaatgccttgtaggttcagaaataggaaaagtgtttgcagatgagcagtcaggggaaaaaaataggcaaagtgttttgagccctaccccttagtaggtgctgtaacaactttttaagcatgttaagtgctccttttctctgggcagtaggtccagggacttgatagaatcatgaggtaagctcccttacaaacggctgcagtgacattcttctgggtactgacaggctggtgttctttcagaaaggccatcattctcactcgagaagccacaggccacttccaggagtccgaacccttcagtcatatagacccagaggagtcagaggagaccaggctcttgaatatcttaggacttatcttcaaaggtaatcattttccttcttcagtcaataaataacacatgtcaactggtatttactgagcattaactttatgccatcattggcctggttaacagaacctggtgctgaagagcccagagatgaattggcattacttttgctctggaatggaagcagcccacgggcctaagattgatagtcacagggtgactgtccagaccatagcggtctttaggtatggtttttgagaaatttagatattttagagtaagttttaatttcatatcttcacattgtgaaaagagatatccagggccagatgtcgtggcttatgcctgtaatcctaacactttgggaggccaaggcaggaggattgcttgagcccaggagttgaaaatcagcctgagcaacatgacgaaacccccatctctacaagggataccaaaaaaaaattagccaggtgcggtggcacgcacctgtagtcccaactgctcaggagctgaagtgagagaatcaccttagcccggggaagttgaggctgcagtgagcggtgatcattgccactgcacagcctaggcaacagagtgagaccccatctcaaaagaaaagaagaaggaaaataaataagtaaatatccaggaatgttgacagctgttggattcccctgtatccccttgaacgaaaccatcctgtacttctctaactccttaggcccagcagcttccacacaagaaaagaatccccgggagtctacaggaaacatggtcacaggacagactgtctgtaaaaataaacccaatatgtcggatcctgaggaatccaggggaaatgatgaactagtgaagcaggagatgctggtacagtatctgcaggatgcctacagcttctcccggaagattacagaggccattggcatcatcagcaagatgatgtatgaaaacacaactacaggtatgccagagtccctttctataaggacagccttggggttcttttggattttttaattttttaaatttttattaacaatagagatggggccttcctttgttgctcaggctggtctccaactcctgggctcaggcaattcttctgcgtcagcctcccaaagtgctggtattacaggtgtgagccactgcacccggccatggatcttggagttcttttccatattttattgatatatctatctgctcctttaaaaggcaggggttctcggctgggcgcgatggctcatgcctgtaatccctacaaaactgggaggccaaagcaggaagacaggttgaggccaggagttcgagagcagcctgggcaacatagcaagaccccatctctacaaagaaacaaaaactaactgggcgtgatggcacgcacctgtagttccagctactcggaaggctgggcaggaggattgcttgagcccgggagtttgaggctacagtgagctgtggtcatgccactgcactctagccggagcaacagaataagaacctgtgtcttaagaaaagaaaaaaaaaaggcaggggttctttttttctgtttgcttcctctagccacttacagcttatacattttaatgcatatagtatttcatgataaggcatcataggaggagtcgacattctcagggaaaatgcggaaggcctccatttgcatcttgctacattcagaaaggttctgtcgttaggtattgggggagttttgtgaagtagataggtgacatttgtacatgttctctcagtggtgcaggaggtgattgaattctttgtgatggtcttccaatttggggtaccccaggccctgtttggggtgcgccgtatgctgcctctcatctggtctaaggagcctggtgtccgggaagccgtgcttaatgcctaccgccaactctacctcaaccccaaaggggactctgccaggtatatggggtgcttttgcctttgctgacttttccaaggtcagcttctcacaggacttcccttgtctcctaaaggaagaggtgcatttctccaggggagttccagatccataggcagtccatcatagtggggcttagggtggggctcggtttccagggagagcagttttgtagcactgtggtgggatagccctaatcactgtttgccaagttcagcttcccaatcttatagtgaccgctgatctctgctgttcccacagagccaaggcccaggctttgattcagaatctctctctgctgctagtggatgcctcggttgggaccattcagtgtcttgaggaaattgtaaggcttcctgctttctctttctttattcattcaacaagtattttggttgtttttttttttttttttgagacggagtcatgccccattgcccaggctggagtgcaatggcacaatcttggctcactgcaacctccgcctcccaggttcaagcaattctcctgcctcagcctcccgagtaactggaattacatgcatgtgccaccatgcccgactagttttttgtatctttagtagagacggggtttcaccatgttggccgagctggtctcgaacccttgacctcgtgatccacccgcctcaacctcccagagtgctgggattacaggcgtgagccaaagcgcccggcaacaagtattattgagttattactatgtatttagcaatttacttagctccagaaagaagtataagactatttgctttcatgttcccaactttaaaggaaccaacagtctagttggtagtgaaaaaccacagaacatttttagaacaatgcagcaggtagataataaagtgccagaatgagttgtacgggtaatggttgtcatagcaataataacaacctcacttatatggtattgaatatatgacaggcactcacacgttactcacagtaacttgtttaatcctcacgacagccctgtgaggtagcattatctgcattttacaatgagaaatctgaggcacagagaagttactgaacttggctggttacagctagttagtggcaaagtttgagattcaaactcaggcaataagagctctagaaaacatactcttaacttctgtgttctactgagggatacagagtaggaaagagagcggtttggggtagaatggtcaaggaagcttcctgaaggtggtaggacttaagctgggtcttgaaagatgagtaggatttagagaatcagagcaaggagggagggcatttcaaacagaacccaagaaagagcacagttcacattgtagaacaaagaagactgtgttctggttcaaattatctggaaaagaccaggcgcgatggctcacgtctgtaatcccagcactttgggaggccaaggcagcagattacctgaggtctgaggtcaggagttcgagaccagcctggtcaacatggcgaaaccccacctttactaaaaatacaaaaaaattagccaggtgtggtggtgggcacctgtagtcccagctacttgggaggctgaggcaggacagttgcttgaacccaggaggtggaggtagcagtgagccgagattgcgccactgcactccagcctgggcgacagagggagactctgtctcaaaaaaaaaaaaaaaaaaaaaaatctggaaaagataataaagttgtgaatgtaggttggaactaaactgtggaagtccctgaatgacttcaggagtctaggactttaactgtgttagccaggcacccagcattttagtgagacattctgctttgtagcatttgcattgcgggcacagagagtggaggtggcgctgggaagcgtgctcctgccagccacatttttctcctcactggggaaaagaaaagagcctggtggtggtgattggccatgatgtcataggtcagttaccggcaaaagccctacaagaggcaggggagagcacctgcaaactggggtgcaacagaagggacgtggggaagcagaggctgaggagaccaacccatgggaaggaaggcccgtggaggctgctgcagtgggcagtaacgaggggctggacttgaggattggagaaatcactgcagaatgggcttaatggaagacaaatttttaaaggaaaaatagtgactgatttgtaaaaaaattagatgaccgaaattttaagcacatattactgatagagtgttgataccactggcaaaatgaaaaggcaaggaaggatgatggcttccatgttggacatgttgagtttgtggtaacggcaagaaaacctgttagaaatctccagacttagaactatggacccacgtggaactcaaaaggtcagtttcgatatgtcacttgaataaaatagttttgaaggcatgagagtagaaaagtagagaatggaaagcctctcaagaccctgctgtacattttgaacctcctcttttctttttctcttcctaagtattacttttgtctacttcaggttcgcaatatcatcttcagaaaagcagaccaaagatcaaggaattgttcatttttggcttgagccctttttcttttctctttagctctgtgagtttgtgcagaaggatgagttgaaaccagcagtgacccagctgctgtgggagcgggccaccgagaaggtcgcctgctgtcctctggagcgctgttcctctgtcatgcttcttggcatgatggcacggtgaggctcaaatctagcaggcaatggggtgggagagcaaaggaaggttctgagagggctccttttccttcagtgacattgtcacagtgaggcccaactgagctctgctgtgagttataacgccacctaaatggaaaagcaaatagtgagaggaccagccctcctgcctagtagtagtgggattcagtaaagcaacaggacccaagaggctggccctgcggcagagccacgctatagtgctccacggctctagacaccacatgaggtgctggtacctacccctattggccctttctcccccgatgagtccaatccatgactgcctttaactctgtggcttccttcccctagaggaaagccagaaattgtgggaagcaatttagacacactggtgagcatagggctggatgagaagtttccacaggactacaggctggcccagcaggtgtgccatgccattgccaacatctcggacaggagaaaggtatgtgggggtggttccaaactaaggagagtggagattctcgtgtccaccctgtacacacacccacgttgtcttgctctccacagccttctctgggcaaacgtcacccccccttccggctgcctcaggaacacaggttgtttgagcgactgcgggagacagtcacaaaaggtgagctctcagggaaggccttgggcagaattgggccctttgttgcagtaaacaacttctccctcctcctctgcaggctttgtccacccagacccactctggatcccattcaaagaggtggcagtgaccctcatttaccaactggcagagggccccgaagtgatctgtgcccagatattgcagggctgtgcaaaacaggccctggagaagctagaagagaagagaaccagtcaggaggacccgagtaagtgggcaggggttgacccactgcggcagccagcttctgttctccctgcagggccaggagccactgccaccaccactatctgcaacaacccttagtgtacactgtgtcgtttttgtctaagttgaagttgggccagttcccacccccaactcttactacttcactagtttgaatagcacgtgagcaaggggaagatcagtaaaaatcggattcaggtttgatgggacttaaaaatgtctctttgccccaccttccctctccctctcctccagaggagtcccccgcaatgctccccactttcctgttgatgaacctgctgtccctggctggggatgtggctctgcagcagctggtccacttggagcaggcagtgagtggagagctctgccggcgccgagttctccgggaagaacaggagcacaagaccaaagatcccaaggagaaggtgtgtgaatgtcctcagcacttcccagatttatttcatacctcagctcagaactgagctgatccccttccggcaatctctgctcctctgctattacatgaagcgaagagtttctgcctctctgtggctactaccgtaggaaaggttcgtgtgaacaatgacgaaactgtcagtgatcacccaggaaggaaagatttaggtaaatgcagagtgtggagttagagacctcagcataaaacagaggctttgtgtctgaggcagggtttgttagaacacgcacgtacccgccggccttttccatcagcttccattgctggcctggccccggatggggccctgtgttccctccactagaggcaatgatgtcttgcagacaaataagacacagagccttgcagcgctggagaaaagtctgacctctgtgactttgaaccattgtctggcgtgatccatctgtttaccatatataggaaacgatgtcttccatgaggaagaggtgcagaaacacgctttggcaacttaaaacaaatggggacctcattgttcccctgcttaattcaggaatcctttctctttacagacacatttgacaattctctaaatgtttttgtagaatttgcccttcctcactttgttcatgcaaaacaaagtatgggctggaatcaaaaatgttgtctctgcttatccatgatccccaatttcattccctttagaatacgagctctgagaccaccatggaggaggagctggggctggttggggcaacagcagatgacacagaggcagaactaatccgtggcatctgcgagatggaactgttggatggtaagaaaaatggctgcactcagcagtttcttcccaattaagataacctgtcccaaacctgcagttactcttccaacaggcaaacagacactggctgcctttgttccactcttgcttaaagtctgtaacaacccaggcctctatagcaacccagacctctctgcagctgcttcacttgcccttggcaagttctgcatgatcaggtaggccgtggggttggtacccccttctcaaggaagatggggatgaaatggcttccctaatgatcctcttcttgctcttagtgccactttctgcgactcccagcttcgtcttctgttcaccatgctggaaaagtctccacttcccattgtccggtctaacctcatggttgccactggggatctggccatccgctttcccaatctggtggacccctggactcctcatctgtatgctcggtaagagacccctcacaacgtggtggcagttcccaggagccccggagtctgttgagagtcagtgtgagaatcaccagggctcttcccctaggctttggcatcaccgcgaacatctgcttgatacttgacctgtacaggcccctggctaagagtcaccccagtgggactgacacttctggttagaagcttcacctctttcccccactccagctttcaactctagacagctttctgactgcttctggagtggcagagcatgggataattgattcctgctgagggccttttctaccagtgttagggtgtagcccggaggtctcggtccccatgacccgcaattccattcctagtctccgggaccctgctcagcaagtgcggaaaacagcggggctggtgatgacccacctgatcctcaaggacatggtgaaggtgaaggggcaggtcagcgagatggcggtgctgctcatcgaccccgagcctcagattgctgccctggccaagaacttcttcaatgagctctcccacaaggtgagaggcagagaggcactgagggctggctgcagagggaatctgtaggtcacctcatctccttaacatggctctctctgtcttacagggcaacgcaatctataatctccttccagatatcatcagccgcctgtcagaccccgagctgggggtggaggaagagcctttccacaccatcatgaagtattgctccccgggccctggggcacattttccacatagcacgggcttaggaatcagacacacctgtatttgaattccacctcggctactctttagctgtacagccttcggcaataacttagcctctctttgtgcctatttcctcttcttttgaggctgatgatacttaacccttagttcttgaaaatattaaatacgataaagttcctaacatggtggcagacatacagtagcactcactccctagcagctgctcctgttaatttccattcacagtgaaaattcctgagccgggggcggggtggggtccctctctgctgaatgggacagggcaaggggagtggtgaggcagacaggggccgtggcagagaacatcagagaagacgagtgctgggggagggtccagggttggtcttagtggatggcagagctggccctgggccatcgaacatcctcatctccccttcctgcagacagctcctctcctacatcaccaaggacaagcagacagagagcctggtggaaaagctgtgtcagcggttccgcacatcccggtatgctgccctccctgagggttctttgtgctgagcggggccctgcaggggagaaaggcccatccctcaccccttcaatgcccccactgtggcatccctgggactggggaggctgatggggaaggttgagcctttactagctggatctcccagttcctcacaaagcccttcctatctgcagaactgagcggcagcagcgagacctggcctactgtgtgtcacagctgcccctcacagagcgaggcctccgtaagatgcttgacaattttgactgttttggagacaaactgtcagatgagtccatcttcagtgcttttttgtcagttgtaggcaagctgcgacgtggggccaagcctgagggcaaggtgagcagcacaggacacttcaatgcctgttgggttctgggctggctaagacatctgccggccctgggcagcatacggctcttgcagtcaccttcccgtcctccttatccccagctgggttgcaaccaaattgccagagtgacctaagaccagatctttgtctccagttctttttttattactccaaaaacacaaccaaagcagcatctcatccaattcttgtttgtttgtttttaatagtttttatttttcagagcagttttaggttcaaagcaaaattgagcagaaagtacagggagttcccttctaccccttgcccctacacatcacagccttccccaccttcaacatcctgcaccagggtggcacatttgttacagctgaacctacacttacacatcatctcctaaagtcatggtttaccttggagttcactgcacgtaatgacatgtacccaccattgcagtatcatacagaagagtttcactgccttacaaatcccctgcactccacctatttatccctctctccccacaacccctgatctttttactgttgccatcactttgtcttttccagaatgtatcattggaatgatccggtatggagccttctcaccttggcttcttagtaatgtgcgtttaaggcctccatgtcttccatggccttgtttctttttaatcagaagtaactgttttcaggcctgctctgaatctccttttctccctccaggctataatagatgaatttgagcagaagcttcgggcctgtcataccagaggtttggatggaatcaaggagcttgagattggccaagcaggtagccagagagcgccatcagccaagaaaccatccactggtacgtaaggcagcctgtgcgggcgagaccagactgggccctcccctcctgcagtgatttgtttcttcttcttttttaaatcacgttttcctgccttttctaggttctaggtaccagcctctggcttctacagcctcagacaatgactttgtcacaccagagccccgccgtactacccgtcggcatccaaacacccagcagcgagcttccaaaaagaaacccaaagttgtcttctcaagtgatgagtccagtgaggaaggtatgatgctcccgcctgttcccggccgagaaggcacacagctagggtgcagagggctggtttccataggacctgctgcgggggcctgagtgtagatgctctgccccactgccgcagaagggcctctcctgtacagcttggattttatttcttctgtgcggtgtgggattgtctcacttgttctctgatatctattttttcaccatctttgtgactcagctttttcttattcctttaattctttgcatagatctttcagcagagatgacagaagacgagacacccaagaaaacaactcccattctcagagcatcggctcgcaggcacagatcctaggaagtctgttcctgtcctccctgtgcagggtatcctgtagggtgacctggaattcgaattctgtttcccttgtaaaatatttgtctgtctcttttttttaaaaaaaaaaaaggccgggcactgtggctcacgcctgtaatcccagcactttgcgataccaaggcgggtggataacctgaggtagggagttcgagaccagcctgaccaacatggagaaaccccatctctactaaaaataaaaaattagccgggcgtattggcgtgcgcctgtaatcccagctactcaagaggctgaggcaggagaatcgcctgaacccagaggcggaggttgtagtgagccgaaatcacaccattgcactccagcttgggcaacaatagcgaacctccatctcaaattaaaaaaaaaatgcctacacgctctttaaaatgcaaggctttctcttaaattagcctaactgaactgcgttgagctgcttcaactttggaatatatgtttgccaatctccttgttttctaatgaataaatgtttttatatacttttagacattttttcc

SEQ ID NO: 11810 - DNA, 86 bp, Homo sapiens
tgagacggagttttgctcttgttgcccaggctggagtgcaatggcacgatcttggctcactgcaacctccacctcttgggttcaag

SEQ ID NO: 11811 - DNA, 2910 bp, Homo sapiens
cctacccgcccctggccctgccccgcatccccaacgtgcgtctggcgctgctccagcccgccctggaccggccagccgcagcctcgcgcccggagacctacgtggccaccgagtttgtggccctagtacctgatggggcgcgggctgaggcacctggcctgctggagcgcatggtggaggcgctccgcgcaggaagcgcacgtctggtggccgccccggttgccacggccaaccctgccaggtgcctggccctgaacgtcagcctgcgagagtggaccgcccgctatggcgcagcccccgccgcgccccgctgcgacgccctggacggagatgctgtggtgctcctgcgcgcccgcgacctcttcaacctctcggcgcccctggcccggccggtgggcaccagcctctttctgcagaccgcccttcgcggctgggcggtgcagctgctggacttgaccttcgccgcggcgcgccagcccccgctggccacggcccacgcgcgctggaaggctgagcgcgagggacgcgctcggcgggcggcgctgctccgcgcgctgggcatccgcctagtgagctgggaaggcgggcggctggagtggttcggctgcaacaaggagaccacgcgctgcttcggaaccgtggtgggcgacacgcccgcctacctctacgaggagcgctggacgcccccctgctgcctgcgcgcgctgcgcgagaccgcccgctatgtggtgggcgtgctggaggctgcgggcgtgcgctactggctcgagggcggctcactgctgggggccgcccgccacggggacatcatcccatgggactacgacgtggacctgggcatctacttggaggacgtgggcaactgcgagcagctgcggggggcagaggccggctcggtggtggatgagcgcggcttcgtatgggagaaggcggtcgagggcgactttttccgcgtgcagtacagcgaaagcaaccacttgcacgtggacctgtggcccttctacccccgcaatggcgtcatgaccaaggacacgtggctggaccaccggcaggatgtggagtttcccgagcacttcctgcagccgctggtgcccctgccctttgccggcttcgtggcgcaggcgcctaacaactaccgccgcttcctggagctcaagttcgggcccggggtcatcgagaacccccagtaccccaacccggcactgctgagtctgacgggaagcggctgaagccctgataacctcgcctttgtttttcgggggtctgtctggatgtggagaagctctgtgtgagcggtgaggggtggagggatgtcgcggagaggggaagggggaaactgaccaagaaagaaattctaaggagagcatgagagaaggctggcattggcaggaggagagcaccaggacgaggatgggaagcgacctccagatttatcaaatggtcatgcccactgggagccgtggatatgcgtggggacatcctgggtcatctcagtcatggagggagacggggatgtcacgccgtcccgcagggcccagcacagccccagacccgaaaaaagtgttctgcccaagattccgagagccctgcgctctagggcaggggcagagttttggaaacagtgcaggctctggagccagactggcgagattcaaatcctggctctatcgcttcggagccaggtgggcctgggggggcgtcgcagtctctctgtgcctcagttgcttccaggatgcgggacccttggctgcaggggttgcttccgccactagagggcgcgccggtcccgctcctggtggcccactgtggctgcccgggcgacagtacgcccagggcctgtgttccatagccatctactctcttgagcctttggacttctctccaagcccctgtgggaggcggacagcagtgaccacctccccttcttttggactgcgacctccttccctcctgggagagccctgtgacctgcatgctactcttaactgttctattcaagactgaatagaagtatttcagtcttgcagaggaggaaatgctcagagctccgaggtgcggctgtggtcgagaaccgggtgctgggccgggcgcgggggctcacgcctgtaatcccagcactttgggaggccgaggtgggaggatcgcttgagcccaggagtctgagaccagcctcggcaacatgccaagaccccgtctctatttttaaaaaagaaaaagaaccgacttctgaatcgcagctccactcatgactaatacctcattatttcagctgtctgcacctaattccccacttgcacggcagtgtagacaataaccatagctcacactcactgagcacctactgggtaccaggcaccattctcagtgtttcacctggatcaactaatgcgtccctcacctcagccctctgaagtgacagctgctattattttcattacacagatgaaaaagctgaggccagaatcgtgaagtcacttgctcaaggtcaggcagcttaggaaggggcagatcgggggcttgaacccaggtggtcaggctctggagcccacaattgtcttacccactatgcccctctctagtcatggtccccaagaggggcttggagacccacttagcaggtgaaagcaatggcagccttccttatttgattatgcacctaagaataaatggtatttgggcatgtattcccaatatgtgtatatttatttataaatatatacagatactattatctgtatgttagtaataaagcttaaattattccattttaaaattatgaatatgaatagggttttttttatgtttcttgcctcatcccaatgacttttgcacacccaggtgtgagcacccagcattcaagaccacgggttaaaaaaaaaaaaaaaaagctggccgggcgtggtggctcac

SEQ ID NO: 11812 - DNA, 2473 bp, Homo sapiens
cctgaacgtcagcctgcgagagtggaccgcccgctatggcgcagcccccgccgcgccccgctgcgacgccctggacggagatgctgtggtgctcctgcgcgcccgcgacctcttcaacctctcggcgcccctggcccggccggtgggcaccagcctctttctgcagaccgcccttcgcggctgggcggtgcagctgctggacttgaccttcgccgcggcgcgccagcccccgctggccacggcccacgcgcgctggaaggctgagcgcgagggacgcgctcggcgggcggcgctgctccgcgcgctgggcatccgcctagtgagctgggaaggcgggcggctggagtggttcggctgcaacaaggagaccacgcgctgcttcggaaccgtggtgggcgacacgcccgcctacctctacgaggagcgctggacgcccccctgctgcctgcgcgcgctgcgcgagaccgcccgctatgtggtgggcgtgctggaggctgcgggcgtgcgctactggctcgagggcggctcactgctgggggccgcccgccacggggacatcatcccatgggactacgacgtggacctgggcatctacttggaggacgtgggcaactgcgagcagctgcggggggcagaggccggctcggtggtggatgagcgcggcttcgtatgggagaaggcggtcgagggcgactttttccgcgtgcagtacagcgaaagcaaccacttgcacgtggacctgtggcccttctacccccgcaatggcgtcatgaccaaggacacgtggctggaccaccggcaggatgtggagtttcccgagcacttcctgcagccgctggtgcccctgccctttgccggcttcgtggcgcaggcgcctaacaactaccgccgcttcctggagctcaagttcgggcccggggtcatcgagaacccccagtaccccaacccggcactgctgagtctgacgggaagcggctgaagccctgataacctcgcctttgtttttcgggggtctgtctggatgtggagaagctctgtgtgagcggtgaggggtggagggatgtcgcggagaggggaagggggaaactgaccaagaaagaaattctaaggagagcatgagagaaggctggcattggcaggaggagagcaccaggacgaggatgggaagcgacctccagatttatcaaatggtcatgcccactgggagccgtggatatgcgtggggacatcctgggtcatctcagtcatggagggagacggggatgtcacgccgtcccgcagggcccagcacagccccagacccgaaaaaagtgttctgcccaagattccgagagccctgcgctctagggcaggggcagagttttggaaacagtgcaggctctggagccagactggcgagattcaaatcctggctctatcgcttcggagccaggtgggcctgggggggcgtcgcagtctctctgtgcctcagttgcttccaggatgcgggacccttggctgcaggggttgcttccgccactagagggcgcgccggtcccgctcctggtggcccactgtggctgcccgggcgacagtacgcccagggcctgtgttccatagccatctactctcttgagcctttggacttctctccaagcccctgtgggaggcggacagcagtgaccacctccccttcttttggactgcgacctccttccctcctgggagagccctgtgacctgcatgctactcttaactgttctattcaagactgaatagaagtatttcagtcttgcagaggaggaaatgctcagagctccgaggtgcggctgtggtcgagaaccgggtgctgggccgggcgcgggggctcacgcctgtaatcccagcactttgggaggccgaggtgggaggatcgcttgagcccaggagtctgagaccagcctcggcaacatgccaagaccccgtctctatttttaaaaaagaaaaagaaccgacttctgaatcgcagctccactcatgactaatacctcattatttcagctgtctgcacctaattccccacttgcacggcagtgtagacaataaccatagctcacactcactgagcacctactgggtaccaggcaccattctcagtgtttcacctggatcaactaatgcgtccctcacctcagccctctgaagtgacagctgctattattttcattacacagatgaaaaagctgaggccagaatcgtgaagtcacttgctcaaggtcaggcagcttaggaaggggcagatcgggggcttgaacccaggtggtcaggctctggagcccacaattgtcttacccactatgcccctctctagtcatggtccccaagaggggcttggagacccacttagcaggtgaaagcaatggcagccttccttatttgattatgcacctaagaataaatggtatttgggcatgtattcccaatatgtgtatatttatttataaatatatacaga

SEQ ID NO: 11813 - DNA, 199 bp, Homo sapiens
gcggccgccatcaccctcaaccttctggtcctcttctatgtctcgtggctgcagcaccagcctaggaattcccgggcccgggggccccgtcgtgcctctgctgccggcccccgtgtcaccgtcctggtgcgggagttcgaggcatttgacaacgcggtgcccgagctggtagactccttcctgcagcaagacccagccc

SEQ ID NO: 11814 - DNA, 1109 bp, Homo sapiens
gaaaataatcgagctttaggcagggcctctcagcccaggtttcacattagggtcaatgggggagttctggcaaagcaaggatgccaccggctcccaccccggagatgtggatttaatggacctgcaacctgcccaggctgccatgcttcatttgaaagctcctcggaggactctgcagttcaggcagggctaagaaccactgatctgaagagtacttggaagaaacggcggctccaaggctgcagaaccctatgtgaacgcggctcctcctgccctccagctgtctctggctgtgcagatgaacatgcaggagtcctgctggggcctctgcccatttaatagaaggctttcctgaagccctgtgctcaggtgtttcctgagtgaacaagagccagcagagactaccgatggagcaaagaatgttactgaaaagctcctaattgccaacaaaaatctaagtaatcaatagagcaactaaaagtgttgtcaggaagacacaacgtgggcccttgtgtcccaaaaaatctaagtaatcaatggagcaattggaagtattgtcaggaggcccccagggtataagagaaggagggtggtggctgtttaatccataccaggggcaaggtagggagcacaaagatgattttttttttagatcctccaccacttgccccaatattaccacctctgaaacgcagggaagcaatattcacattttaggcagcttgatggcaggggcactgcgcagaaacctgcaaaagaaatccctggattctcttgcccagcttccactgagagaatgccttcaagtaggtcagtgagccacccttttccctcaggaaacatgcagttgatccccctaacagcaataagaaaatacggaaggtttggaagccaacacctgctctcttctttggagcaaaggacagagaatgctgggaaacattcattttctccctcttgaaaactgagagtcaagctgagggctgaaaagaggcagcaaattgcaaagctcccgtggtgcttttgatatccagccatctctatagctgaaaagaaataggtgttatttgatgatattttctttctgcccaagtatttttcagtttccc

SEQ ID NO: 11815 - DNA, 2658 bp, Homo sapiens
tcctctctgtcactggtgccttctggaagatggcttccccttggggagcatttcctgcaaagactcacaagtttaaaataatttaggatatttctctgtacttgagagccaggataggatgagagttggtcctgccctgatgctgtaaggccactcctgtctcagaccctgaggtcctcaggaatggtttcccaagtactgttgtagttgtatggcaagatcactcttgattattttaggagctgattttacttttcctacctcttttaactgcttccaaaagatgaatctggccaagaagagcaggggctcattcactcatttactcactcattcctggtgcttgagtttattcctgaaggaagctgaccaagggttgagagaaaacaactttgatttttctcatgtctgccccagcaaacctcctttgtggactgattctccttctgtgcctggaagaaactgggataatcccaggacttttctggtcccttctaggtaattcagtgtcttccactaatgtggccccacacaggctgggcttgttgattagtataggtccagcaaaacagttaaaactctacatgtcttccgcatgtgaacctcttcccaacctcacctggtgctgtggcaggtgggaggctgggtgtcaggctggctgctgccccctgggttctgcccagctggtagctatggcttccaaccctccagtgggaggaacaagagggataagaggtaaggacaggagaggttctgtatggctggcatggcagagagctggcacatgaggctggcaggaaatccagagggctctgggggcattctcatggtctcctaagtgaccacactaccctggggtgtctctgccacaactggccaactcaggaggtgtatcctctccagctggtcccttacactcacttccttagccctaggtggccgtggtacctctagcctcttgccaaggtctgccctcacatctccaggaacccttctgggcaggatttaagacaacccaggccagtgttcaggcactatgaccccacctggtccacaggaaatgtgcacctttgatccactgggttagggttatttccacatgcagcctagttgcctactgggagctccaggagtcaacttttgccctttagatttcttgagtgtaagagggataccaggtctctgcccaccaccagcctcagaaggcacacagtaggcacttgcaggcctcgtgaaacccctcttggaatgaagtaaggagaaagctgcccatccctctcatggtacaggttgggtggggacagactgagagcactgcccccctctcccaaggaagccctcctgtcaaacttgagcttctctcatcttcaacacctcctctacctagatcacccagaatttcacatgggaacaattggcacttcttgtcttggggcctcagctaaaattcagactggaaaagctccatattaacatcctgttctaatgcaagtaaaaaaagagctgctatggtctttgcttcttggtatttagagtctagtgggagaatattggctacttaatgcagtctcttccattttcaatatgtaactgaggcatccttctactgataacagccaaaacttcaagaaaaaatattttaagcctttaaaaatacatttgtgggctggtaggaaattaaggaataatcagagaccaaaaactaagtgaagctgagaacccagagataactttattaaaggagaatattaaacatatacttcacgcagaaggaagagaattccaggtggaagatttgagatgcaagggggaatgaaaaacaagaaggtggtgactatatgggtaaatcaaatcaaatcaaacaccttgtgtaaaataataatggtgatataagaattttaaaaagagaaataagtatatagtcataatatgatacaaatttgaagagggtgatgagttaaaaagttctaagattcttgtgttaactttggaggatggttatctaatttgtaataaaattttcaggataatcatcaaccgtagaaatggggttgaaatttcaaactaatggaaagaaaaaagaatgagaaaatataatcaatcaaaaggaaaagactagaaagggaaaggaaaaaagaaacacaaaagaggtggaacaaaagtccaaatatatcagtaactacaataaacataaatggaataaacataacaactaaaagataaagattattaaagtggattactatatgctgtttacagaaaacacatctacactctaagggtacagaaaggatgaaagtaaaaggatgggaaagggtatactggggaaatataactgaaggaaatatgatgaatctatattaatgtaaaaaaattgattttggggtaaaaagcatcactggagatagagagaatcactatgtaatgattaaacaattcatttcatcaagcagataatataattttgaattttattctttccataacataatttcaaaatctgtaaagcaaatattgacagaactataaggaagaatatataaattcatcatcagagagaaatattttaaatactgtaactcagtattttatagaagaagtaaataaaagccagtaaaggttatagaacatttgaacaatgcaaagaaaaaaaaaagg

SEQ ID NO: 11816 - DNA, 2658 bp, Homo sapiens; identical to SEQ ID NO: 11815

SEQ ID NO: 11817 - DNA, 2562 bp, Homo sapiens
gttctgataaagaacagtaaaataagagagtcaaagaaaataatagaagatattgatgaaatagaaaagaaacatacaacagagttcttttaaaatgataaactttacaaagatctggtgaaactgatcaaggagaaaagaataagcagtattaggaatataaagaggagctattatgaacaaattaatgccaataaatttgaagtttgaaaacataaatgaaaaaattcctagaaaatataacttattaaaactgactcaagaagaaatagaaaacctgaatgtcgtaggaccattaaagaaattgatttgtttaacatcttcacacagagaaaatctaggctcagatagctttaaagcaatttctaccaaatagtaaagaaaaaaataattccattatattgaatcctgggatgttgaattggaattggaggtattggtgtgagctcatggttttcaatatataaagagagacatgaatatgtacgtaaaatgtgtgtacactcaccttccccccccaccccctgccccacacacacactgtccactgagagagcctcggaacagtgacaccctagcagcagcaatcacacctaacattcagatgttggtttctaaatgcttcctgccattaaaaggactagggcttttggggctctttcaagagctggagcagacaaagtacaaggtactttgtacttacctcatgccagaaagcaaggcagtggtcaccagggatgaagacgtgtcacaggacacagaagccgtcttgaaggggctcccgctggccaagtctgggacaatttcagcattaaaatgaataatgatagtaatgggctataccccagtgaataaaatatgattttatagggtcacatttatataaatgaatgaataagtaaataagtttttcctcacaacaggctaattaatggctataagaagagagatgactatagaaagaaaaggtgaattacaaatcaaatttggtaaccactacagtcataattcaggcaagaaatatcaattggtgctaaaattggtggtgaaaatgggatgagacaggatttttgtagtcttgaacaaaatatctattaattatgaagccgaaaagcccagcattcactgtcctaagtgatcgatcttacccgccaatagtggaataagccggcattgtgcaccccgcaacaggatgagtgggtggagcacagcattgctttgctgatactcggctggaggtgcataacttcggtctaatcacgaggaaacaccagacagacccaaattgaagggcagtctgcaaaataactcacctgtaatctccaaaaaacccagcaggccatgaaagccaaggagttactggaagggatggagaggtggcagggactaaggcagtgtggcgatggctgctgccgcagtccagcaccaccttggctgaaaggatgttattgggacactggtgaaactcagtggcatctgtggacaaggggtatctgggtgctttatatgattcttatagcttttctgtaagtttgatatcatctcaaagcataagcaggaggaacaaggaaaactaaaatggagaagttgcagggtgtttatatgagctctaaagtgagtccctggggggtcgccgcagatccccagctgctcccaccctggaggagctggggggaagagcaagtgcccagggaggcagggggagaacgggagttcgtgggcacgtggtgggccctcagcgtagccagatgtgggacagcatcgtgtgcatttgtatgtttgtgaggcaagtcacgtcttttaggagcacttgtcattttgggcagatgggccttttgcaaagagaaatataagaataaccaacaccttcctcaccgcccatcatgaccaccctgccccacagacacgggtctgagctgcagtgcgtggtcaagggcacagaggagtgggcagcggtggccgtggggaccggatgagccagcctggtggggcctgaatatggcagcgccaggcagtgatgccacgtgggccttgctgggggcggcatccgaggctcagcacacctgtagcttttgaaggccatgccctcctgctgggtctcttgtcttcacccctcaggaggccttccccagcctcacttttaacatcacagcctctgcccctctgccctgacaccaccccctctgctgctcgttctctcctagtgcttaactcgtgtgttgctgggttctgtccccctccttctctgttgtatgcccaggacaggggttggcagtggcagatgccgaagatgtggatgaccacacgggcgaacgaaggcccatgtcgttcaggaggccccgagcattggacacccaggccctgagacgtactcagttcggtctgcatctgttgatggtgaatattgcaggactgatagccactgaccgcctgtagtgatgtgtgaggacaatgaaggcaatggtgattcacaggcaggccagccccatatgggtgttagttgtaaattcatggttacataacataataaatttacctacgaattcattatttataaacaaa

SEQ ID NO: 11818 - DNA, 605 bp, Homo sapiens
gttctgataaagaacagtaaaataagagagtcaaagaaaataatagaagatattgatgaaatagaaaagaaacatacaacagagttcttttaaaatgataaactttacaaagatctggtgaaactgatcaaggagaaaagaataagcagtattaggaatataaagaggagctattatgaacaaattaatgccaataaatttgaagtttgaaaacataaatgaaaaaattcctagaaaatataacttattaaaactgactcaagaagaaatagaaaacttgaatgtcgtaggaccattaaagaaattgatttgtttaacatcttcacacagagaaaatctaggctcagatagctttaaagcaatttctaccaaatagtaaagaaaaaaataattccattatattgaatcctgggatgttgaattggaattggaggtattggtgtgagctcatggttttcaatatataaagagagacatgaatatgtacgtaaaatgtgtgtacactcaccttccccccccaccccctgccccacacacacactgtccactgagagagcctcggaacagtgacaccctagcagcagcaatcacacctaacattcaga

SEQ ID NO: 11819 - DNA, 18871 bp, Homo sapiens
ccaaccgtcacagggcagaggcagcaagagatttgcatctgagaaactaagccatggtcatcatggggaagtggaagggtatgtgctcatgctggggccctcactttggggcttaaggatctgggaagctggctagactctcagggctggtctttgtcacccttaagtcccccaaagaagggttgtccctttcaggccctctactatacagccataactccttagatgccccccagggcagagccagctcttatccctcacactggatcttttacttggcccagctccctctcccctccaccccagggcactcacctcttgtgcagccccctgggtccatagccctgcaaccttggtgacattaccctgcccacacccccctacccagagagcctacagaatgcagaccacttgcctcccatactgctgttacgtctcatccacctcttctgcgccgtcctcgctggaggaaaggtaggctgggaggtgagcctgtggactagagagcagctctttcagtatctctctgctgggtgagccccttgcccactgcccatctctgtccacacctgcaggagaacgggcagatggctgtaagtgatggctctgtgaagggcctgctgagtgtggtgcggggctggagccgtgggccagccccggacccgtgcctagtgccactggctctagaggcactggtaggtgcagtccatgtcttgcatgccagccgcgcacctcctcgtggcccagagcttcgtgccctgcttgagagctacttccatgtccttaatgctgactggccagctggtctgagctcaggccccgaagaggcccttgtcaccctccgggtcagcatgctcggtgggtatgggctcccaggctcttggggaaggggcaccatgagggaaaagcctaagtgatgatggaaggtctggatagggcagcataggaaggaaggcttaaggctgcctagaggggtctgggcagggcctgacccttgacccttccacagacgccatccccatgatgctggcatgtgaagaccggccagtgctgcaagccaccttcctcagcaacaattgctttgaacacctcactcggctcattcagaacagcaaggtgggtagggcccagcctgggggtgagggtctggaagccagaggctaggggagccacgcataggtgccaggctgctgctgagcaaacatgggctggacagagtcagtgttttgcagctggtgggatggcttgcagttcagtgggagggtgtggggcatggacaagggcccatcccttggggcctctataggactgggcttgaggcttaggacatctttgtgccccatggaagcggggcttgttatggaaggaagggagctgctctggtgccttgtttccctttccgtggccccaagtacaggggctagaggagggcaccactgctttcagatgcagtgcctgctcccacccgctcatccccccgactgcccatctgagcagggcacagggggctcagcaccctactcttccctagtgccgggcagggcacctggcagctgcccctggtcctgctctaaccccaccctctcccatcttcctcctctcttctttgcctcctccaccctgtgcctccccacttccccacagctgtacctgcagtcccgggcgccccccgagggggacagtgacctggctacccggttactgactgagcccgatgtccaaaaggtaccatcctggggctgaccagctcagacaccccctgggactccctctttgagcttttcctgcactatagctggggaaatgagcagatgtgtgtaaggcctggtgtggtctagaaatgggtgtgggtcctccatgctgtctcgcctgccttccaagtccccatcctagggaacaggacagaaggtggtctatcccctgcctggtgtttgattgggtgttgggggtctggctgtgccaagctggatggaaccttcgaaactcagccacctacctcatttctcagaaggggagacagaagcccagacactcaaggatttggctatagtcacagagaaaggggtctccctcatggtgccatttctttctgtagattcttgcacccaccctcagcgggtcactgggtgtcccccagcccctgatgatgtgatccctgattcaccttgcatgtgggctgtaggaggctgcagggtgtcagctggcagcttcacagcgggcaccctttctgggggctcaacctgtgggccccaacctccatagcccctaccctggctctgtcttcatgaggtaaccctatgtgttcaccgcatgtggtcattttcttagagcttacacgtctattcatctgcaaagcaggcagggcaaagtgactcccctctgtttttacagatgaggacactgaggcctggagggggaggactgatgccttaggtcacttggggagtcaggcaaagctgggaccaaagggcccatggagccgaatatgacctagtccctgctgagaaactctccaagccctcccaacccctgaccccctcagggtggggccaggagaggcagcagcatgcctctggctgtcaggttcagccaggctgagcctcagtgccccacctggatctagggggaaggggcaaggtgggacttaaaggtctcgaaggttcttctggttctaacatcctgtgattgattgtccctaaatctctgacccctgtcaatcactgtgggtgatggggcacttgctggcctgtctgtactcatgtgtctagctttagggagacaggttgggggtagggccctaactccactagagaaagggggactggagggtgcagtcagagtgtccaccattaatctgtcccagtgaggcccttcccagcctttgttagagtgggtcttgctgagctgctcagagagggccctaggtcatgatagggtcacagcagttggggcaaggagtagaaggcctggtgctctgacagagttgctgatccagcacatgccacatgccttggggtgcttggctctgcaccttttttactgcagggggctgccagctgtgacaccctggcccctgcctctcctgatggcccctccccaccccaaggtcctggaccaagacacagacgccattgcagtccatgtagtcagagtgctgacctgcatcatgagtgactccccctcggccaaggtgaggctgctgcactgcagctttagtaggggtgcggggtggagttcaactgaccatatccccagaacaggcctggccggtggccataagcatcctgctccctggagcaaagcaggcgagctgggaggtgactgccctgccctaaagctcactgggcaggtgtggtcgccagtctgtcctgggagctgcatcttctctgtcagggctggatggggaatggacacttgtaggcccacctccatctacagccttctgagatgtactcacgtcccccccatccctctgcagcccactgcccaccagcactgtcacccagaggcagagctacgcaagggaaccccaaaacatgatgcccctccagagtttccagggggtctgagtttgccctccggcccatgtatgtgttcacttcttccccatactaccttacacaggaggtgtttaaggagcgcatcggctaccctcacctgcaggaggttctgcagagccatggtccccccacccatcggctgttgcaagagctgctcaacatggtgagggaaggggcttgggaccagggtcccaaaggcaaccagaactgagtcagggttaccacagatggtgagctctccaccctgggggaccgtattgactgcggccagtacatactgttacctgtagcctggccatgtctgttagtgtcactggaatgaggattctggccctgtaggggtcctggaagcaactgcatgtgagcaagccccaggattatcttaggaacatgcagttaggggttaggccaacccaggctgaaaactaaggttgagggattaacaatgctgaaggactcttagtagtagtgactgtcatctgtgcccctctgactttcctgagcctcacacacaacctgtgggcaggatggagtagatcatgttgctgactgctgccgtaggcaagtaaatggagccagaaagtcccactgttgacagggtgccacagctgaccagggactgtcattctctccacccacaggctgtggagggtgaccacagcatgtgcccacctccaccaatccgcaacgagcagccggtactggtgctggcgcagtggctgccgtcattgcccaccgctgagctgcggctcttcctagcgcaacgcctcaggtggctctgtgacagctgccctgccagccgtgccacctgtgtgcaggcaggcctggtgggctgcctgttggagacactcagcacagggctagccctggaggcccgctgccaagagcagctgctggcactgctacaagcactgggccgtgtatcaataaggcccatggagctgcgtcacctgctgcgcccccggccaggattggactcggaaccaggcggagctgaggctggaaaggcccgacacgcaggtgctgtcatccgcacattatcaggcatggccaggcaccagggtcctgcacgtgctctgcgctactttgacctcacgcccagcatggcgggcatcatggtaccccctgtacagcgatggccagggcctggcttcacctttcatgcctggctctgtctgcaccctatggatacagcacctacccctgcccccacccgaccactccagcgaaagcagctgtacaggtgggtgactgccaggggccagggacctcctgccagggtgagcaggaacaagcagacataactggcttgcctgcccccagcttctttaccagcagcggctcagggtttgaggccttcttcacggcggccgggaccctggtggtggctgtgtgcacacggaaggagtatttgaccatgagtttgcccgaagtgtcctttgccgactctgcctgggtgagaccccatccttctcatgtggcccagtagagagaggggtgctgagtcccaagtatggcctaatgtgaggcttctgttctagcactgcgtggctatcgtccatgtgcctgggcgccggcccttcagccagaacctggtccatgtctacaaagacggccatctggtcaagacagcaccccttcgctgcccctccctcagtgaggtgtgccaagcaaggtttggggaggccttgggtagatgggaggacttggaacacagtgggcaggtgtagcctggagcccttgtgtcccgtgctgccccacaggccctgactttagccactggggtccatgcagccatgggggtcactgtgaggaactggttgtaggcggagccccaggttctgctgtgacctgaccgctcccccaaccccggccccacagcctttctcctcctgctgtatcggctccgctggataccgcacaacgaccaccaccacagggctgcccacaccaccagtccccgccaccctggcctacactcaccccgccctcacccgctcccagtcagtcccagcctccacagggcttggctgggggtccgggctggtggcccccctgcaggagggcagcatcgactctaccctcgcaggcacccaggacactcggtggggcagccccacatccctggagggtgagctgggggctgtggccatctttcacgaagccctgcaggcgacggctctgaggaccctgtgcaccctgggtatgcagcattctccatctctgccacagccccaggccagaagctaggggtccggggggagaaggcatctctgggggtctctcctgtggtcaggcagtctctggatggggtttggccagaggcctagcaaggtctgaagccccctgcccacctcccagggcccaatgagacggcacccttcaagcctgagggggagctgcatgagctcagcaccaggctgctcctccattactcacctcaggtatttgggggccccaggggagtggttggctcgactgtgctacttccccggctcccacactctgcctgccaccccctcctccctctgaccctggctgcctgcccattcccctatccctaggcttgtaagaacaacatctgcctggacctgtcccccagtcatgggcttgatgggcgcctgacgggccacagagtggagacctgggatgtgaaggtctgtgagcacgtgtgggtggtgtgtgcaggaggcatgaatatggggcacatgtgtgttcggagtcagctggggagcagcgctgtgcctggggaggatttggacagtccagctcaagagagcaaaacttcctttctgggtggtctgctggggtggagtagggcaggaaactggctggaaggtccccctcactgccatcctccttcccccaggatgtggtgaactgcgttgggggtatgggtgccctgctgcccctgctggagcgagtagctgcacagcccaaagaggctgaagcaggtccagctgaaacgcatgacctcgtgggtcctgaactgacctctggtcacaacacccagggcctggttctcccattgggtaaatcttcaggtaagtgttcctggtgcctatgttgtggagagggaatcttggcatggtaggggggtggaatgcccaaggtctcctggccactggcaggcccttgacacacatctgtccccttcctgatggctggcagaggaacggatggagaggaacgcagtggctgcttttctgctgatgctgcggaacttccttcagggtcacatggtgaaccaagagagcctggtgcagtgccaggggcctgccatcatcggggccctcctgcgaaaggtggggcccggtgggacaggcatgggggttaggggtatggtcagcctgtctgaccgaggggactgagtggggaaccctgtcagtcatgaagaacctcctgggagagttgccacttgagtggggcctgaaaggccgagcagggttgggtctggaggatctggggaaaggcccagcacaggtcggggcagggacccgcacagcaggcaggaggcttgcgtgtcagaggcggcaggaagcccccaaagggttctgagcaggctggtggccatgtttgtggccgtcatggctgtgcagggaagagtggcagctgaaaagctcagacagcagacaggcagagcctgagccctcactccagctcctgtcttatcccaggtcccaagctgggccatggacatgaacgtgctcatgtccgcccagctgctgatggagcaggtggcagctgagggcagcgggcccctcctgtacctactctaccagcatttgctcttcaactttcacctctggaccctcagtgacttcgccgtgcgcctcggtaggtgtgaggacctgagcaaggggccggccatagggcagctgagcactgagaagttagaactctgctctgggggatctgagggactcacctgttaggaatccagaatgccatggggcggctgaggggactatgaccctgccctggaagtctgacaggcacatggccctggcctggaggatctgaagggcccagctcagcctagtggcctgagccctctgctcattcccgctcaggtcacatccagtacatgtccagcatagttcgggagcacagacagaagctgcggaagaagtacggcgtccagtttatcttggatgctctgcgcacccactacaggtgaggccagtggggccagatgggccatggggggctgacacagtggcctccggccttggggactgggcggtgcgcttccctgactcacctgcccaccctctctccccgcctttctttgggacctggctgggtgtgcctactgacctgccagcccgcagcgggagcgccccctggctgctgacgacctacgcaccgtgcagacctccctcctgggcctggcgagggagttcctggtgcggagtctctcagcagatgacgtgcaggtcacgcagaccatgctgagctttttggcggccacaggcgatgacggtcaggtaggctggaggttggggagcgggaggcttgggtgaggggagtgggggcccgacacagtgtgagaccctgcatcccacaccgggggtgcgctggacctgctgctggccctgctgcacggttccctggtgcaagagtccttggctgtctttctgttggagccagggaacctcgaagtgctactggccctgctagtgcgggccgggtcactgcccctgctgcccgatcgagtctgcaaggtacacccagcccacccccctcccctggcatcccattcactggcgcccctgcctggggttcagggaggtacatcaggccttgggccaacgcatgaagctgccttcaagggcctcttgagccacacacctgcacggtgacttcccctcctacagtaactccttccacatgatgacagtcctccgatgacccccacacagatcctgcgcagactgcagcagaatgagcggctacctgagcggagccgccagcgcctccggctgcgggagtgtggtctccagggtctggttgcctgcttgcctgaggggactgtttccccccagctctgccagggcctctacaagctgttcctgggggcaggtacaacctggttaaggccaagtggagggggtgacatgtcagaaaaacagggcaggcaggccggaagaaggaagatagtggcataggggccagggctgggccctgccctttctagtctggtcagtccctcaggtccccccaacccatccccccagattgcctgaacctctcagatctgctggctgtggtacagctgtccctccaggctgacctcagcgttcgcctagacatctgtcgccaggtgagcatgagaggtaaaagctttgggggagggggagggtggcttctaccctctggccttccaccttgcctgtctcatgaggggtctctggagccctcctctgcaaaggccctggatgagggtctggagcaggcagttggatgcgtcctcacttgctgtgctctcgcctgcagcttttccacctcatctacggacagccagatgtagtgcggcttctggcccgacaggctggctggcaagatgtgctgacccggctatatgtcctggaggctgccacagccggcagcccccctccgtcttccccagagtcacctacctcccccaagccagccccacccaagccacccactgagtcacctgctgagccttcagatgtcttcctgccctcagaggccccctgccctgaccctgatggcttttaccatgctctctccccattctgcacgccctttgacctgggcctggaacggtctagtgtaggatcaggcaacactgctggtggtggcggcagcagtgggactcttactccagccagccagcccggcactccttcgccactggatgggccgcggccctttcctgctgctcctggccgccacagctccagtctctccaatgtgctggaggacggcagcctcccggagcccaccattagcggggatgatacctcgaacaccagcaacccacaggtgaggtgggcccaccctctgccactgcatggtacccaagggaggacacttctggtacacagggctggcagtgtagcctctccaaaggtgtggccctgtctgaccagggttgcagccactggtcaggcctattgctgtcccctcatagctctcatctgcagttgtgttcccagagggctcctggaacagggtgagtcatgatgagccacagtgggtgacaccagccaggcttcagaagggccctcaagagagcctgtagggcagacacctcacagggtccaagggcagcaaactccaaaggccctgccctgggcttctgggtttggggatgggcctctgcttgttctatgtgaactgcctcatctcctcttgggagtctggcaagaccccaggattctgcctggaactcaggtagtagttgagacccctataccattcttccaggcccttagtgccaggctcactgttagccaaatgctctgactcctgggtggctaccccaggaggggtgctgagtggggatgggtgggcgtcagcctgattccctcccttagccgcccacaacccacgcccacaccacccacctgtgcccacagcaaacctctgaggaagagttgtgcaatctgctcaccaacgtgctgttctcggtgacgtggcgtggcgtggaaggcagcgatgaggctgcctggcgggagcgtggccaggttttctcagtgctcacccagctgggggcctcagccacacttgtgcgcccaccagactgcatcaagcgcaggtgagagggaaagtctggagggggaggggcttcaggaagcctcgggggaaggagagaagatagtcaggtagacccttgagttccccactcacccgccagcctcctggagatgatgctggagtcagccctgaccgacatcaaagaggcccccgtgggggtcctggccagcctcacccagcaagcgctttggctgctgcgtctgctgcaggacttcctgtgtgctgaaggccatggtaaccaggaactgtggagtgagaaggtgcgacccctcagagaggcgtgagccacatgaacactcatgttcatgcaagcctgcagggatctggtctgggaggtggatgggtacacgtgcgcaggtgtgggtgcatcagcatgaatgcctgtgagtgtggacttgcctgtgtgcacaaaccctacctggcccccagcgcaaactttactttgctccctttccatggactcctggcctcccctggtgatgtctgttgggaacctgttttctgtggcagctctttgaaggtgtatgcagcctacttgatcgcctgggagcctggccccacctggccaacggcacagctgatctccgtgagatggcgcagattggcctacggcttgtacttggctacatcctgctggaagacccacaggtgagcacagggtgagcatgggggcagggggcgtgtgagatgtcgggagctccaagagtggctgggtgccactcatctctcttgcgcccacagctgcatgcccaggcctacgtgagattgcacatgctgctacagactgcagtgccagcccgccgcgaggaggcctgctatgtgctctccaagctggaggctgcactggggcgggtgctgaacacctcttccttggagtcagccactgatgaggcagggtccccacttgcagctgcagcagctgcagcagctgcagagcgctgctcctggctggtgccactggtgcgcacgctgctagaccgtgcctatgagccgctggggctgcagtggggactgccctccctgccacccaccaatggcagccccaccttctttgaagacttccaggctttttgtgccacacccgaatggcgccacttcatcgacaaacaggtgcctggaggttggggcccaggaagaggagtgggggctggggcccacatcgagcactgttctcctctgcccaatcctccaggtacagccaaccatgtcccagttcgaaatggacacgtatgctaagagccacgaccttatgtcaggtttctggaatgcctgctatgacatgcttatgagcagtgggcagcggcgccagtgggagcgcgcccagagtcgtcgggccttccaggtgtgccacccggggtaagggatgggaaactgctccacacatgcacccaggagatgactgacaatgtggagaaacgggtagggcaggcagcagccaggggactgacctattacccccaccccaggagctggtgctggaacctgcgcagaggcgggcgcgcctggaggggctacgctacacggcagtgctgaagcagcaggcaacgcagcactccatggccctgctgcactggggggcgctgtggcgccagctcgccagcccatgtggggcctgggcgctgaggtgggccgggcttggggcagggtcgctgtggaggggtggggcttgggagggagggagccacctggagccccagactgcctttggggtgaggccagggagggatgggggtgtctacagccttctaccgacccatgacctgggggacattctgcagggacactcccatcccccgctggaaactgtccagcgccgagacatattcacgcatgcgtctgaagctggtgcccaaccatcacttcgaccctcacctggaagccagcgctctccgagacaatctgggtgagggagtgtgctgagatgggtccacccaactcgattgtcccgtctcctgtcctgccttgcttctgctgagtacccttggccccttgcaggtgaggttcccctgacacccaccgaggaggcctcactgcctctggcagtgaccaaagaggccaaagtgagcaccccacccgagttgctgcaggaggaccagctcggcgaggacgagctggctgagctggagaccccgtgagtggggccctggagagattggactggtgtggtgggcaaggggtctgctccagtgtgtgcatgcctctgtgggatcaactccctgagtgtgtcctcttctgctgcccgactacgtccccctgaagggactgtccaaagccagatggtgagtgggagagtctcctaacagggctgagagttgctcttttaacagccaggcacctgaggacagcactgagaaacacaaaccagagcaggaagggggcccagggagtgggcaggggctgggtgaggggagcaggggacaagggttggcatcctggcaaaatattcagaagcccagtgggtggcaggtgggggacaggggctgggaccagtaggttctggaccctaggcagcccctccccatctctgggagtcatgagagtatataccccatgactcaatggcacttggatgccctttgggcttgtgaagaagggggtcccagagcctacagcgtgaggtgggttgctggtctttaggatggaggcagcagaactggatgagcagcgtgagaagctggtgctgtcggccgagtgccagctggtgacggtagtggccgtggtcccagggctgctggaggtcaccacacagaatgtatacttctacgatggcagcactgagcgcgtggaaaccgaggagggtgcgtcctggtggtgtggtttaggaggatggcagggaatggctgagctctgggtggggctggggtgagtgactcccgtacctgctgttcctccccataggcatcggctatgatttccggcgcccactggcccagctgcgtgaggtccacctgcggcgtttcaacctgcgccgttcagcacttgagctcttctttatcgatcaggccaactacttcctcaacttcccatgcaaggtgggcacgaccccagtctcatctcctagccagactcccagaccccagcctggccccatcccaccccatacccaggtacggaaccaggtgtactcgtggctcctgcgcctacggcccccctctcaaggctacctaagcagccgctccccccaggagatgctgcgtgcctcaggccttacccaggtgagagccctgggtgtgagggatgtgaagtcgggaccctgaatcacggggcagtgctggacagcccacctggctcacatcttgtctgcccctgtccccagaaatgggtacagcgtgagatatccaacttcgagtacttgatgcaactcaacaccattgcggggcggacctacaatgacctgtctcagtaccctgggtgagggtcccactctgcacccctccacccctgcccctctgacctgtcagcccttggttcccccaagtgtaggtacctgccagtgggccaagctctgagcttggtcaagggtagatgtgccaatgaagacctggcctctgttccctgccaacccccagaggtccccagcctcactcccttcccctccctgcctagcctctattcctcaaaaggaatcctgttccaggacactctgtccttctcccctgtgacccctctaagtggtgctcccccaacctgtgggcaggctctgtgcccgccttcttgagggtgtgggcagggcagggtgggctggtaggccatcagggccctcatgcagcccctgctcgggtgggtggccagttcccctgggtcctgcaggactacgtgtccccaaccctggacctcagcaacccagccgtcttccgggacctgtctaagcccatcggtgtggtgaaccccaagcatgcccagctcgtgagggagaagtgagcatgtgggcagggctgggctcagcgggtagggaaaggcgaggggagggcttctgctgacacgtccaactgtggccccaggtatgaaagctttgaggacccagcagggaccattgacaagttccactatggcacccactactccaatgcagcaggcgtgatgcactacctcatccgcgtggagcccttcacctccctgcacgtccagctgcaaagtggccggtgcggcccaggggctggtgggcagactagggggcagataaggggaggaggctggtcctccccacatcctgggcccacccctggctcccttcttccctccagccacagcatctccctccctgtctccattctccccacctcaccttggccccgtgcccctcccccagctttgactgctccgaccggcagttccactcggtggcggcagcctggcaggcacgcctggagagccctgccgatgtgaaggagctcatcccggaattcttctactttcctgacttcctggagaaccagaacggtaggtgtgaggtgctcacactggagcgggcaggtgtagggatggagagcagatggtggagtggccagggggcagtcgggatggacagggagacagctgacccagtcctctgtgccaggttttgacctgggctgtctccagctgaccaacgagaaggtaggcgatgtggtgctacccccgtgggccagctctcctgaggacttcatccagcagcaccgccaggctctggtgaggaaggaaccacaggcaaacggcaggcagccggggttctgaagatcatggggggtcagctgtccctgcactgattgctgcctccctactctcaggagtcggagtatgtgtctgcacacctacacgagtggatcgacctcatctttggctacaagcagcgggggccagccgccgaggaggccctcaatgtcttctattactgcacctatgagggtgggcagtgcgctggactccagtcagggccaggacaagatcaggtcgggtggatgcagagggcacgcagggagccctgactgctctgcctgccttcccaggggctgtagacctggaccatgtgacagatgagcgggaacggaaggctctggagggcattatcagcaactttgggcagactccctgtcagctgctgaaggtaaggccagcttagaggatagtggccagggatgcccatgccatggtgctgaccagccacttacccacaggagccacatccaactcggctctcagctgaggaagcagcccatcgccttgcacgcctggacactaactcacctagcatcttccagcacctggacgaactcaaggcattcttcgcagaggtgaaaggaagacaagacctcaactttatattctgtgaaatgggtttaaccccactgtccttaccaaccacgtggggcagatgggaatcctaatcaaggtcactgatttcaaggcaccttagaaaatgagctaaacatgggaagagtatgggggcaggaggggtgccttcttcatcagggccaggataaagtgtcgactcaacaagctctgaaagccttagggagatcaggagggagatctgtccttggaccccttccatcgccttcctagacaggaacattcctgaatgttgcccccaggcctgactttttttttaggtttccctctcttcctgcctttgggctagggggacaaggaataacagggtgagaggaccaagttgaaactaagtgtgatactctggaagcatcttccatgtctgtcccagcttctcacccactttctgagatgccctcctaaagtctctgcctgtttcttggagggaacctctgcatctgtgacacctactctatgacccctggggactgacagtaaaggaagggatgatgcttcagggagcagatagtgtaatctgatagtactcaggcatagctaggcctgcccttgcccctgcaggttgtcagtgatggtgtacccctggtgctagccctggtcccccaccggcagccccactccttcatcacccagggttccccagacctgttggtaagtgcattgtgcagagccccagctcagctccactcccccttgcctctgccagaaacccacctctgccccctcctgcctgcaggtgactgtgagtgccagtgggctgctgggcacccacagctggttgccctatgaccgcaacataagcaactacttcagcttcagcaaagaccccaccatgggcagccacaagtaggacagagggctgtgggtggggtgggctacaaatgccctgcacccggaattattcccctccctaatcagaatgtaggccagctgcaggggaaaggtctggccaggctccctgagggcctgggtctcttccatgtggcctggcctcacttgctatccccctcactgggtcaggacgcagcgactgctgagtggcccgtgggtgccaggcagtggtgtgagtggacaagcactggcagtggccccggatggaaagctgctattcagcggtggccactgggatggcagcctgcgggtgactgcactaccccgtggcaagctgttgagccagctcagctgccaccttggtatgaacagccttggagctggggagaatgaggcacacaggtatggggccgggttctgaggctggccagggcggatgtgactcctccgttctgcctgtaccctccccttcccatgcagatgtagtaacctgccttgcactggacacctgtggcatctacctcatctcaggctcccgggacaccacgtgcatggtgtggcggctcctgcatcaggtgtgcctcgtgggcagctctgtggggcccccgtagcccagacctgcagcccatccgtccctcagtggccttccagtcctgtcctcctctagtcttggacaaggccttcatttcctgagcctcaggggacagtcctaagccaaccctggtcctccacagggtggtctgtcagtaggcctggcaccaaagcctgtgcaggtcctgtatgggcatggggctgcagtgagctgtgtggccatcagcactgaacttgacatggctgtgtctggatctgaggtgtgtgtatgcatgtgccctggggagggtgagtttcctgggcaatccccctggagcccagactcctgcccaggaccctaagttgccttcctgcaggatggaactgtgatcatacacactgtacgccgcggacagtttgtagcggcactacggcctctgggtgccacattccctggacctattttccacctggcattggggtccgaaggccagattgtggtacagagctcagcgtgggaacgtcctggggcccaggtatggggaaggggtgcccagcaaagatggaggggcagttgggatcctgtccttgctgacactccctgcttcctccaggtcacctactccttgcacctgtattcagtcaatgggaagttgcgggcttcactgcccctggcagagcagcctacagccctgacggtgacagaggactttgtgttgctgggcaccgcccagtgcgccctgcacatcctccaactaaacacgtaagccccccatttatgggttcatggcccctgaaggtggtggtcattggtgtaggataaaggccctaggaacccacacaccatacatgtttgtgggcacatatttcaaggtttgttacctgtcccttcatcttcccatggggaggtcttgccctgggcctccgcttagccacagttgtgggagatttctttgtgtataagaatttcaatttaaccatccttaaaatgaggacagagagggtatatgggataagggatatctgctggtcgcaaagcccccttgcagtcgcaagttggtgtatatcccctctcccttccagactgctcccggccgcgcctcccttgcccatgaaggtggccatccgcagcgtggccgtgaccaaggagcgcagccacgtgctggtgggcctggaggatggcaagctcatcgtggtggtcgcggggcagccctctgaggtgaggatggggcgggggtggggaggcccctcgaacggggcggggcgtggcgcggcgatcccagctgatcctactcaacccttacgcccaccaggtgcgcagcagccagttcgcgcggaagctgtggcggtcctcgcggcgcatctcccaggtgtcctcgggagagacggaatacaaccctactgaggcgcgctgaacctggccagtccggctgctcgggccccgcccccggcaggcctggcccgggaggccccgcccagaagtcggcgggaacaccccggggtgggcagcccaggggggtgagcggggcccaccctgcccagctcagggattggcgggcgatgttaccccctcagggattggcgggcggaagtcccgcccctcgccggctgaggggccgccctgagggccagcactggcgtctgcggccgcagcagcactttttgcacagtctggggcggggttccccggcttccaagtcgctgtttcgtcaaagcacgagggccgcctgtggccttaattcctaacggcggccccggttctcccttctcggcaataaaccaggcctagttttgta

SEQ ID NO: 11820 - DNA, 574 bp, Homo sapiens
ttgtaccctactgtgatcttaaaactctctggtccaatccctttgtccccatagcctccacgcatctccacccatcccggagacacaggaggtatctccacctcctgttccctggctgctggaggatctggtgcccaggacagctgtggctgcctgttcacaggtggtcctgtgaacctgttctccctggtgaccctccacccctgggtcccctctctcctctcattggagggagactggccaggactttagataggctcagggtgggatatggcctggacagaggtgggcagggctgtgaaaaggtggtgacctattgggatattaaatgtctcagtgatgcccccatggagctgtgggcctggatctagagttggggcagcaactccaggaggggaggcacccctagggagctcctcgactttattttcccatagcctgggtgctgttattaaaacaaactggatttcatttctcctcccatcatatcccttgatgtcaacctgacgtcctcaagatgaaatcctactcctcccacagcctttctctccacttgccctgctgctcagcctgg

SEQ ID NO: 11821 - DNA, 3625 bp, Homo sapiens
agaagcaaaagagcagagctaccatgtcctcttggagcagacagcgaccaaaaaggtaggtccccacactacctgtcctaggcaggtttgaacgccagaccatgcggagatacaggacattccagctaacccatagaagtcacagggagcagatacaggcctggtggctggcacagatcaaccttatctgtgacagaaagactggcgcgtgcacacacacacacacccctacagaagcccaggtgggcatgggcagcagggagccgggggaggcttcttgttagaggcctggggccacagtgaccaaggctgtcgagatcatgtctgatggctgccgggccagggaagccctggaggaggaggggaagccccaggcttccaagggttgtggtgctaagtgtaaaccaccgcttcccaaggccaaatgcccaccctcagacctggccaaagcaggacacacttttcatgttcagaggctgcagtgagctgtgatcatgccagttccctccagcctgggcaactgagcaagactctgtctcaaaaacatgaacctgaacgtctgtcttcctccaagcacccaattggtcaagagtggacaaaaagaccaggatcccagagcagagaagtcttcatggaaaagagggcattggagctggggctttgaaggatgaataggagttcacatcaaaacacagagccagggagacaaggactgacccagaaaataagccagatcagaagaaactagcaagttggactgtgaataattaacagctcatgggggctaggctggtgatggggaagtgtattcatattatgcgggagttacactcagaaactcaactttcctagaattataattctccctggaacaggggccacttctggcagctgtcgggggtgagggtagaagctggaagaggaggaggaagcaactgccctagtacaggtgagagatgaggtagcatagtccaggctggtagccgcagagatgggaagaagtgggcggatttgctggtgtattttcacctagctgagtgtattttcactgtggtttagtaagcatcttctgttactgcctgcagcccagggggcattcaaccccatgtttctagaactctgttcctgctgctgctgttggcagcctcagcctggggggtcaccctgagccccaaagactgccaggtgttccgctcagaccatggcagctccatctcctgtcaaccacctgccgaaatccccggctacctgccagccgacaccgtgcacctggccgtggaattcttcaacctgacccacctgccagccaacctcctccagggcgcctctaagctccaagaattgcacctctccagcaatgggctggaaagcctctcgcccgaattcctgcggccagtgccgcagctgagggtgctggatctaacccgaaacgccctgaccgggctgcccccgggcctcttccaggcctcagccaccctggacaccctggtattgaaagaaaaccagctggaggtcctggaggtctcgtggctacacggcctgaaagctctggggcatctggacctgtctgggaaccgcctccggaaactgccccccgggctgctggccaacttcaccctcctgcgcacccttgaccttggggagaaccagttggagaccttgccacctgacctcctgaggggtccgctgcaattagaacggctacatctagaaggcaacaaattgcaagtactgggaaaagatctcctcttgccgcagccggacctgcgctacctcttcctgaacggcaacaagctggccagggtggcagccggtgccttccagggcctgcggcagctggacatgctggacctctccaataactcactggccagcgtgcccgaggggctctgggcatccctagggcagccaaactgggacatgcgggatggcttcgacatctccggcaacccctggatctgtgaccagaacctgagcgacctctatcgttggcttcaggcccaaaaagacaagatgttttcccagaatgacacgcgctgtgctgggcctgaagccgtgaagggccagacgctcctggcagtggccaagtcccagtgagaccaggggcttgggttgagggtggggggtctggtagaacactgcaacccgcttaacaaataatcctgcctttggccgggtgcgggggctcacgcctgtaatcccagcactttgggaggcccaggtgggcggatcacgaggtcaggagatcgagaccatcttggctaacatggtgaaaccctgtctctactaaaaatataaaaaattagccaggcgtggtggtgggcacctgtagtcccagcaactcgggaggctgaggcaggagaatggcgtgaacttgggaggcggagcttgcggtgagccaagatcgtgccactgcactctagcctgggcgacagagcaagactgtctcaaaaaaattaaaattaaaattaaaaacaaataatcctgccttttacaggtgaaactcggggctgtccatagcggctgggaccccgtttcatccatccatgcttcctagaacacacgatgggctttccttacccatgcccaaggtgtgccctccgtctggaatgccgttccctgtttcccagatctcttgaactctgggttctcccagccccttgtccttccttccagctgagccctggccacactggggctgcctttctctgactctgtcttccccaagtcagggggctctctgagtgcagggtctgatgctgagtcccacttagcttggggtcagaaccaaggggtttaataaataacccttgaaaactggatcggatgaattggctttcattgtgttcctagcatcttctcaaatcaacttcccaggactccagggtgaaggaggaaaagaggcatggcccaggccctggggtgtgggatatggtctccctaggggatgacagttgggatcaatggcctgtgacttctcctctcccttcccccatcctgggacctaactggaaataaaaccttgactgttgcccgggtgtcattttaccagtggatttctgccagggcttgtgtcctaggagaaggtttaagttaaaccagattgcccaggtctccaaacgatttgtcatgctgacctgagatcatcgaagggggcacctgcccccgggcaaggttgcaggggcaggatggggctgaagggatgagcagggtcccgggcccacctgctgatacagcattggccatgtgggggctgcaatcggatttggaagaccctggggcttgggggcatgtccagttttcccagctccctaaaaaatgaccatgcagcctggcgccgtggctcatgcctgtaatccaaacactttgggaggctgaggcaggcagatcaccggaggtcaggagttcgagaccagactggccaacatggcaaaaccctgtctctactaaaaatacaaaaattagccaggcacagtggcacgtgcctgtaataccagctacttgggagggtcaggcaggagaatcacttgaacctgggaggcggaggttgcagtgagccaagatcacgccactgcactccaggctgggcgacagagtgaaactgtgtctcaaaaataaaaataaa

SEQ ID NO: 11822 - DNA, 88 bp, Homo sapiens
agggggcggaggttgcagtgtgtcaagatcgcgccactgcactccagcctgggcgacagagtcagactctgtctcaaaaaaaaaaaaa

SEQ ID NO: 11823 - DNA, 3510 bp, Homo sapiens
atcattctaggggcatagacttgtatttttatgttttggggatgggatggggttatcttctgttgtaaattaggtgggatatgaacacacttattttcctggtgagtaggacacagggagggtattgaactcaaaggagaaggagcctttatttcctgttgaggcttatactttctgacaaggaaactcccaaagggccaagatactttttggttccatgatagtcaggttccagacttctttcttttctattgtatttgtatgtggaaagccattaatgaatttattttactccaagagatacacataaaagggaaaagggcatggttgggaggttgagcagtaagagaccattaatactaagtattttgcctgaaatgcttctttataattatttcagggaaggaataagataatctcagacttactggggtggggcttggggaatgtttggatgttgctctttttcttcttccttctttttttttttttttttttttggttggtgttgtttggcatttttttcttttcctttttaaagaaaatgttttcaggaaacatgaacaaacatactgccaattatagtggggctgggaaggcacaggagctggcgacctctcagctgcatagttgggacggcaaaccctgctgtgagcttctcagacttttcacctacttcacctattaagaagccatgaggagttgtaaactcttgttcagggaagaaaagagggcaggaggaagtaacccaatgcctttaaatacaaaacagatgaaaaacaaaatactcatttttccttttctattgtgggtttggggagccaaaccaagtgtgactgtgagcacgttcactgagaggcatgacaacattattgaagaggtctttccattatgtctggttctcttattttcttaagtcaagccttaactatgaacatactttaagatgatacgggtctgtcaccataaacctgtaaaagggcatcgacagcttttcagataatccaggaatgttgagacatggctaagtttctagctgatacttagtcattccctcttgatattgttgggatgggtagccaaaaggcaggcttgtgggagttaagagccaatgatacctggaaacatggaaggtagctgggggtacaagtggatgttcagactgaaggaagaggtggaaagaagacacagaaggcacccagatgccaaaaggcctggcatgaatgagagttggcatctgtcctgttgtggtgttcccattcttgccatacccatttgcccagattgttctgattctcatgttcaattgactatcccacatgagactacagtttataggcagtgaggaattgtttcttcctgggaaatgtccttccagcaacttcagaggaatgggaaagtgttaatcttacgtgaagcaaaggagcctggactaggggcagagagaaagaagcagcagcccaccttctttgtgtttgcacatgtgcctatgtcgtgtacattggtacctgactgtggctcagatctgcgtcgcagcagcgagagaagaaatcactccatatccgatgagaggaagggtggcacagagatggtgtctacaattagagacatttctgactccaccttagcctaagcaaactttatatactgagtaacatttgaaggttgtcttttaatggtggggggtgttttttcctttttaaactacagtgcttgcacaagagagggagggactcagaaaaggttagggcaggtgagggagacagtagatggcctgggatgacttgagtccatcatactattgcttggcaggtgtcctcccccatgtttgattcaaattccatgagtgacctacctttccccaggaatgggactgagagggtagtctccagcaactcagtctgcacagggctccccgttcaggctgcctttggtggttgtgcttttgtaagtttctttctctgcacttcgacttacctctgaatcagaaagcaagcccagcaggtgaatgagggatgtctgcttggcattgcccaatctaaccagggaggctggctggccacccactgtccgctagaggggagagctagcaggtgttggtatgaactcaggaatagaaacacgaggcctttttaaatacgagggagaagaatccatgatgcatacctgtaaccccctagaacccaagtgccagaattcctagatgctgcttctgtttgaacaaaatgtcactgcttttacacttgaaaaaaacacactcgaaaaatgttcaactccatgaaaaatattttttggctttaagaaattgtttggtgtttaactgtttcctttgattgccattccaccagtaaattgttggttgatttgcactgcactctggggttggggttgggaggggagggtccttatacagagccgaacctggggttgctcaggaagtgggccagggaatgtggaagtcgttgacattgcctgggccaaaagagtgggagatagtttttctcccctcagcccactcctggtagcacctgtcgccagcctggtacaaagccaggcctttttcttctgtgagcatctcatcactgtccagcagcaggtggaaaaagggggacaacaaccagacctattttttctcccccattttttccaaattttgctgtgccaaatgtttaaaattttataaatatgaatctattgaaatttccttaatcaagagcttcttcgtgtaaagtttgcttttttagctatagaaaaagaaaacagtaaatatctcttaatggcatccagccttgctgagctcaccttttttcctgaagaatgggtaggagtgaaatatttaatgtaaacatttcaccaagtccctttaccctaattttgaagctgcattaaacccaactcactaacacagggaatgattgcaccctagtcctctgtgggccaagaaactttcagaagcattaaaaaaatagttgaagtatatcacttctcaccaagtgggtagagtcagttggctgtttgtcccttgttttttatttattccataattatgtttgtgctttttgttttgtaaacagtaatggaacgtacatttttattttgtttagaagacaactttgattcaatctttcaagaactgttccattcttggtttcttcttagggggataaaaagttaccagttaatttgttttgagatatttaagcattctttgagttatagaattgtgatgcagggatttgtgaatgagacatttacatgtgaaaggtgacttcactagttacctgcttgagcagagtaaagtgtgtatatgtacataaaatgtaagtaatcttaactccattgtgcagtgccttttagatgttccgctttctataaagtcttcaaatttttgcatatatattatatatatatgatgtaatgttatagaaatatatgtataatatacatttttttgccaggggtatctgatagctctgtattttgttatggaagttgaaagaaaagggtttt

SEQ ID NO: 11824 - DNA, 3549 bp, Homo sapiens
atcattctaggggcatagacttgtatttttatgttttggggatgggatggggttatcttctgttgtaaattaggtgggatatgaacacacttattttcctggtgagtaggacacagggagggtattgaactcaaaggagaaggagcctctatttcctgttgaggcttatactttctgacaaggaaactcccaaagggccaagatactttttggtcccatgatagtcaggttccagacttctttcttttctattgtatttgtatgtggaaagccattaatgaatttattttactccaagagatacacataaaagggaaaagggcatggttgggaggttgagcagtaagagaccattaatactaagtattttgcctgaaatgcttctttataattatttcagggaaggaataagataatctcagacttactggggtggggcttggggaatgtttggatgttgctctttttcttcttccttcttttttttttttttttttttttggttggtgttgtttggcatttttttcttttcctttttaaagaaaatgttttcaggaaacatgaacaaacatactgccaattatagtggggctgggaaggcacaggagctggcgacctctcagctgcatagttgggacggcaaaccctgctgtgagcttctcagacttttcacctacttcacctattaagaagccatgaggagttgtaaactcttgttcagggaagaaaagagggcaggaggaagtaacccaatgcctttaaatacaaaacagatgaaaaacaaaatactcatttttccttttctattgtgggtttggggagccaaaccaagtgtgactgtgagcacgttcactgagaggcatgacaacattattgaagaggtctttccattatgtctggttctcttattttcttaagtcaagccttaactatgaacatactttaagatgatacgggtctgtcaccataaacctgtaaaagggcatcgacagcttttcagataatccaggaatgttgagacatggctaagtttctagctgatacttagtcattccctcttgatattgttgggatgggtagccaaaaggcaggcttgtgggagttaagagccaatgatacctggaaacatgggaggtagctgggggtacaagtggatgttgagactgaaggaagaggtggaaagaagacacagaaggcacccagatgccaaaaggcctggcatgaatgagagttggcatctgtcctgttgtggtgttcccattcttgccatacccatttgcccagattgttctgattctcatgttcaattgactatcccacatgagactacagtttataggcagtgaggaattgtttcttcctgggaaatgtccttccagcaacttcagaggaatgggaaagtgttaatcttacgtgaagcaaaggagcctggactaggggcagagagaaagaagcagcagcccaccttctttgtgtttgcacatgtgcctatgtcgtgtacattggtacctgactgtggctcagatctgcgtcgcagcagcgagagaagaaatcactccatatccgatgagaggaagggtggcacagagatggtgtctacaattagagacatttctgactccaccttagcctaagcaaactttatatactgagtaacatttgaaggttgtcttttaatggtggggggtgttttttcctttttaaactacagtgcttgcacaagagagggagggactcagaaaaggttagggcaggtgagggagacagtagatggcctgggatgacttgagtccatcatactattgcttggcaggtgtcctcccccatgtttgattcaaattccatgagtgacctacctttccccaggaatgggactgagagggtagtctccagcaactcagtctgcacagggctccccgttcaggctgcctttggtggttgtgcttttgtaagtttctttctctgcacttcgacttacctctgaatcagaaagcaagcccagcaggtgaatgagggatgtctgcttggcattgcccaatctaaccagggaggctggctggccacccactgtccgctagaggggagagctagcaggtgttggtatgaactcaggaatagaaacacgaggcctttttaaatacgagggagaagaatccatgatgcatacctgtaaccccctagaacccaagtgccagaattcctagatgctgcttctgtttgaacaaaatgtcactgcttttacacttgaaaaaaacacactcgaaaaatgttcaactccatgaaaaatattttttggctttaagaaattgtttggtgtttaactgtttcctttgattgccattccaccagtaaattgttggttgatttgcactgcactctggggttggggttgggaggggagggtccttatacagagccgaacctggggttgctcaggaagtgggccagggaatgtggaagtcgttgacattgcctgggccaaaagagtgggagatagtttttctcccctcagcccactcctggtagcacctgtcgccagcctggtacaaagccaggcctttttcttctgtgagcatctcatcactgtccagcagcaggtggaaaaagggggacaacaaccagacctattttttctcccccattttttccaaattttgctgtgccaaatgtttaaaattttataaatatgaatctattgaaatttccttaatcaagagcttcttcgtgtaaagtttgcttttttagctatagaaaaagaaaacagtaaatatctcttaatggcatccagccttgctgagctcaccttttttcctgaagaatgggtaggagtgaaatatttaatgtaaacatttcaccaagtccctttaccctaattttgaagctgcattaaacccaactcactaacacagggaatgattgcaccctagtcctctgtgggccaagaaactttcagaagcattaaaaaaatagttgaagtatatcacttctcaccaagtgggtagagtcagttggctgtttgtcccttgttttttatttattccataattatgtttgtgctttttgttttgtaaacagtaatggaacgtacatttttattttgtttagaagacaactttgattcaatctttcaagaactgttccattcttggtttcttcttagggggataaaaagttaccagttaatttgttttgagatatttaagcattctttgagttatagaattgtgatgcagggatttgtgaatgagacatttacatgtgaaaggtgacttcactagttacctgcttgagcagagtaaagtgtgtatatgtacataaaatgtaagtaatcttaactccattgtgcagtgccttttagatgttccgctttctataaagtcttcaaatttttgcatatatattatatatatatgatgtaatgttatagaaatatatgtataatatacatattttttccaggggtatctgatagctctgtattttgttatggaagttgaaagaaaaaagtattttacctcagaaattaaataaaaaaatacttttaagtaa

SEQ ID NO: 11825 - DNA, 325 bp, Homo sapiens
atagaaagactgagctttcagagctggaggatggctcagctgctgactggcgccggggtgtggatcccgtgtcctccaggaatgccattggtggaggagggattggccatcagaaacgcaagcctgacataatgcttcctctgtttgctaggccagggatgtaccctgacccccacagtcccttcgctgtctctccaatccctggccgcggaggtgtccttaatgtccccatttcaccagccctctccctgactcccaccatcttctcctatagcccatcaccaggcctgagccctttcaccagcagcagctgcttctccttcaa

SEQ ID NO: 11826 - DNA, 325 bp, Homo sapiens; identical to SEQ ID NO: 11825

SEQ ID NO: 11827 - DNA, 36135 bp, Homo sapiens
agacctgctcactctgtcaccgaggctagagtacagtggcacaatcacagctcattgcagcctcaacctcccaggctcaatcgatccttccaactgagcctccctagcagctgggactattagtgcacaccaccacacctaggtaatttttgtattttttgtagcgatggagtttcgccatgttgcttaggttggtttcaaactcctgggctcaagtgatccacccaccgcagcctctcaaagtgctgggattataggtgtgagccacccatgcccagccttacctttttattgaaagatgttgtttttataggctgtaaaattcaaagttggttccctagtccatagattaaaaaaaaaaaaaatcaaagttgggaattattttctttagatagcattctattgactcctggattttgtcatttcttttgagaagtcagctgtcatttttattgcttcactgctttttaaggttttcctctttttctttgtttttcagcagtttgactatgatgtctgtgtgttcttttctttgtattggccaaataattgggttgctgagtttcttaaatctgtgggttgatctctttcatttgttttgaacattttagtattgcttctgctctatgctgtcttctgagactcatttattcacgtcttttattccacgtcttttatgttcttatctgtgtttaccattcatttttctaattgagtttgaatattttttattgacctatcttccaaatcattaatcttgtctcctgctaagtccaatttactgttaatatcttatattaaattcttaattatagatactgtagttctcagttctaaagtatccatttgattttttttatagatttcagccaattctgtgataaaattatttatcctttcatttactttggtcttttcctctgtttcttgactttattaatcttggttatttcaaagttcttgactactaaacttcagtaattgggccatccataggtctgcttctaatgtctgttttttctcttgattactagctgtgggcatttacctccacacatgcttaaaaaacttattatataccaaacattatataaaagaatcatagtggatgcatatatcttccaccatcaaggtttgcccctttcttctgttaattaaatacttcagtctagtctgacgtatttcagggattgagctaggtcactgctgggttgcaatcctggtaagccccaaacttactttggttcatccttattagagtatggtcctccagggctttcagttgaaagcctaataggctatttgtctccttagacatgaaagcctttaggaggttcacttctgcccctaaggttttcagcttagttatttagcctaccactacttcacatcatttcaaaattgactaaatgtcttgaggaagaccccaaccaagtaagtatttcgagtccatcaaatctccagctttgttaccccagctttgaagaataccaaaatctctactgggttgtcttcagcagcagccttcttccagaagttgggtatttggaggtccctcaagattgcagttttgtctgtccagccccaggtgaccatcgaaagcattgtggtttctctttccccaatgataaccacaccctaatcccaagcccacgtccaggatcaacacatgcaccaaaggctcgtgcgcacacaccaaaggcgcgcgcgcacacacacacacacacacacacacacacacaagctattgattgttgattccctctgaacattctcagtctgttagtccatctagtccttgttgcttccacaagtattggatgctttaagaaatgatttttgtaatttatttggctttttctagtcattggcaggagtattagcctgccaaaccatactatatcctacttggaagcagaatctgtacagatgtttttgagggcttgccatgtgccagatgctcttgtagcttctaggtataggattgccctgccctctcagagcctctagtctaaactaggtaaaacagacatatacacaaataatacagcatgccaaatactgtcatagaggtgtgtacaggggtaggaaaaaggagacaaatgtgaactagcaccacctgtttagaaaattgcaagttttataaattttacatgattgcaggttagagatcaaagtggtagaataatgaaaaatgaggttggcaagacaggcagaagcctgatggtgaaaggccccgtatgccatggtaatgcttaggtatagcttctacctagaagtatctgcccttcatgcaggatggagagcagtttaagaattaagcctagagaattgcgatcagatttttcttttagaaagattacttaagtgtcattgtgaaatgtgaattcgaggagggcaagaaacaagccaaagggccagagaggaaactgtgagagttgacccaatatgaaacacattggttatcatcatcagcagatttgaaaggtgtcaaaggggtggaattgatgaaatgtagggaatgttgggattaagagagggtgaaagaaaacagagattctagggtttctagcttgactataaatcaccaagggaatatggcagaaagcgatgaggtcaatgttagacatactgtgtattcccatttcattagctctattacggtttttgttatataatctgagaatgtagtttaggaaccaccaccctgtcagggggcggaccccaagttatcttcttgaaactcctacagtgaaataagagagagagccctaggccattgccttcaccctggattttacaagacaccctctgattttgtccattttgtataccaggcttccacttaaacattgtatttgaagaaaattctccatactaaaagaaaaaaaattcctcagcagtgtaagtgtcttcttctggtgggatatgtgggtaataccctctcttgcatgttgttcttccatcttgacagaagaacatcttcagtggcatttgggggccacaatcctttatttgcagtaagtaggtgctattccactgtcttctagcatccattgttgccaatgaggagttcaaagccagtttctttttcttttatttgttatttgtcatttcctcctcaaagcatatgtgatttttctcttcatatttagagtgaaggaattttaccagaatgtggtcaggtgtgtatccttcaaggcttttcggtctccagataaatctttttgcagctaagggaaatgtttctcctttcaaattcccccttacatgctggttcttccagatctgtcctccaagtctcacagtttgcgtctctgcatccctgctttgggtaagacaggtccacttgatctactaggccactaattgggttttggcaattaactgtctttttaaaaatttcatcagtggagcttttttgtgtgtggaaaattatgcttttaattctaagagacatctttggtgtcataattgaacttggtctttttattattattattattaaaattcttatctgcctctttttctggttctgttaatctaagattcaccacctcaaggagtgctcaaatgctttttctacccatgactgctggatcccattaagcaattctctttctttcctacttcttgatccaactaccagtatctcaggcagggaggtggcaaagcagcctctggttcatcagtgtatgagccagtgcacatgggatgtcattagaccccagccaagctttgtggctgccacgcgtggcatttttctagcctgagatagggaagagtcaagcttcttcccttctctggcttcttggggccacagagagcatgagatacaccccaacgaagcctcacagtgacgaacagtgcccttcctcatagggttccagggaggtcagtagaccagactctccagcgtatcagagtctctccatggggaaatttggcaccagctctctttctggactgagcaggccttgctcacgcccgctggcacgacttgcctgccaatctatagccaccgagttcgggagtgttcatggaattgggggtagacagaagcagcacaagcactttcttatcatctcttcaaaagcccccagcaagtagagaaaaaagaaagaccacaagaccaccagactagatgatctctaagcctccatccaatgccgacattttacagttatacacatttatggtctccaactcagctcagtcctcagtacccttgggccacacttttgtaagtcttcccagcatgctctgcttccccaaagggagtatttgagacttttatttctctcctcaagccctctgtttatccttctccttgttcactgtcagcccatgactttgaatttctcttcacaaaaaaaaagacagactcttggatattgagttgttctttgctttcctgtaatcctttctcctttgcctgctcgcctgcttgcctgcctgctgtccatctttccatcctgctggactctgtcttctcctgtgtgttctgtgatagtgtgtgctcccagttttcccatctctctgggtaccccctttcgctttatgttgctgtcagtctcacccagttctgatccttctcccatattacaggctcctgggggatcttttcagtgcataaagttgaccatatcaccccttgctttaaacctcttaatgacaggaacaggcaaaacatgtctgtagtgatagaagtcataagagtggttacctccaggcaggtgaaataggaatcaattgcaaaaggacatgagggagccttctaggttgttggaattattttgtatcttacttcgggaagtggttacattgttctatacaaacacaaaaattcactgagctgtacattaagatagtgcattttactatatgtatacctcagttttaaaaagatgaaacctgaaggtttaaatccaaactcctgaaggttaaaatccgaactcctgaaaatagtccacagattcctattccttcctccctcaagtcttgcctcgagcataattttcttgtgagacccatcctggcttcctcaggatatgacttccacactcaggactgtaagcttaggcctgtcctaatcctgaagagactttattgtaactgtacatgtacttccctcactagacagggggctcagtttcattgcacccctagtgccttgtgcagtggctggcacatagaccccaggtaaatgtctgttgaatgaatgaatgcaagttcacttcatacttgctttgaacttgacatttttactgaacagtttccttcctccagcctgcaggatgtttcctcaatgaggggaaggctgctgcacaatggcagtttttgatactcctgaggaggcctttggtgtcttacgtccagtctgtgttcagctcacaaagacccagacagtggagaatgtggagcatctgcagacacgactacaagctgtgagtgacagtgcccttcaggaacttcagcagtacatcctcttccctctgcgatttaccctgaagaccccaggtcccaaaagagagcgtttgatccaaagtgtggtggaatgcctcacatttgtcctttcttcaacatgtgtgaaagaacaggagcttctccaggaactcttttcagaactctctgcttgtctgtattcacccagctcccaaaaacctgcggctgtgtccgaggagttgaaattggctgtgatccagggacttagcacattaatgcactcagcttatggggacatcattctgactttttatgagccctccattctgccacgtttaggatttgctgtatctttactgttaggccttgcagaacaggagaaatcaaagcaaattaaaattgctgccttaaaatgtttacaggttctactcttgcagtgtgattgtcaggaccatccaaggtcattggatgaacttgaacaaaagcagctgggggatttgtttgcctcttttttacctggaatctcaactgcactgaccaggcttatcacaggagactttaaacaaggtcacagcattgtcgtatcttccctaaagatcttttacaagacagtgagcttcattatggctgatgaacagctcaaaagaatctcaaaggtccaagcaaaacctgcagttgagcacagagtagcagagctgatggtttacagggaagcagattgggtaaaaaagactggcgacaagttgactatccttattaaaaagataattgagtgtgtttctgttcacccacactggaaggtgagactggaactggtagaacttgtggaggaccttcttttgaagtgcagtcaatcattggtcgaatgtgctggtccccttctgaaggccttagtgggactagtaaatgatgagagtcctgaaatccaagcccagtgcaataaagttctgagacattttgcagatcaaaaagtagtggtgggcaacaaagccctcgctgacatcttgtcagaaagcctgcattcccttgccacatctcttcctcgcctaatgaactcccaagatgaccagggcaaattctctactctttccttgttacttggttatctgaaactcttgggcccaaaaataaactttgtcctcaactctgtggcccatctccagcggctttccaaagcactcatccaagttctagagctagacgtggctgacatcaagattgttgaggaacggcgttggaactctgatgatctgaatgcttctccaaagacctcagccacacagccttggaaccgcatccagaggagatatttccgcttcttcactgatgagagaatcttcatgctcttgaggcaggtttgtcagctacttggttattatgggaatctttatttgcttgtggatcactttatggaactttaccatcaatctgtggtttaccggaagcaagctgccatgatccttaatgaactggttacaggggctgctgggctggaggttgaggatcttcacgaaaaacatattaaaacaaacccagaagaactgagagagattgtgacatctatacttgaagaatacacaagtcaagaaaattggtatttggttacctgtcttgaaactgaggaaatgggagaggagctgatgatggagcacccaggcctccaagccatcacgtctggtgaacacacctgccaagttacatcttttctagccttctcaaagccaagtcccactatttgctccatgaacagtaacatctggcaaatatgcattcagttggaaggaattggccagtttgcatatgcactaggaaaagacttctgtttgctcttgatgtcagccctttatccagtactggagaaggctggagaccaaaccctactcattagtcaggtggctaccagcaccatgatggacgtttgccgtgcttgtggctacgactccctgcagcacctgatcaatcaaaattcagactatttagtgaatgggatctctttaaatctgcgtcatctggctctgcatcctcataccccaaaggtcctggaagtcatgctgcggaactcagatgctaacctgcttcctttggtggcagatgtggttcaagatgtcttggccaccctggaccaattttacgataagagagctgcttcctttgtcagcgttctgcatgctctgatggcagcattaggtacattgagagccctttttaatgctgatgtgtgggggacaggactcagtctcctagtttgcttagcctcgttttttgcattgtttgtggtgatgctatggaggacgttttaatcattttctctccagtcccataggttatgggggggtttcactgtttatcttttatactttcagtaatctctaccatttattgagctcctgctctatgccagggtataaaccctgcagaataaatgtaaatattatttctattttataaataagaaaaactaagggtcagtgacatcctacttagccagggtcacacaattaataaatgataaaatcaggatttatgacagttttgttctttccagtatagcaaactgcttctgatgatgcatagagttagcagtatctatgctaatgaagaacagatataacgtgaattattcagtcacatattgtctagaacggtactaagagaagtttctttgatgatagaaataatctttattcgttctatccagtacagttaccactatacacatgtggttcgtgcacctgaggaactgaattctatattttacttaattttaatagccacatgtagctagtgactaccatactggacagagcaggtctagaaacttccttttaaccttttaattgtgtgagttggtttaagtttctcttcttcccactgatcctattgggtgcttaccgaagatgttagccactattagaatggcaaaattggctgggggcggtggctcatgcctgtaatcccagcactttgggaggccaaggcaggcggatcaagaggtcaggagatcgagaccatccttgctaacatggtgaaaccccgtctctactaaaaaataaaaaaaaaaaaattagccagacgtggtggcgggcgcctgtagtcccagctacttgggaagctgaggcaggagaatggcctgaacctgggaagcggagcttgcagtgagccaagatcgcgccactgcactccagcctgggtgacagagtgagactctgtctcaaaaaaaaaaaaaaaaaaaaaggaatggcaaaattttggacttcaattataaggaaaggaatccttcaactggatagtcaatctttcaatgagaaaataataagctgtatagcttgggtcccttttatttaaagagcatatttccagtatttatctcagtactgctaatagcctctgagaaggtggaatggtcactggcctcattttgtcagttgaaaaagccaagaccttgtaagaaacattctcatggaaggtaactggggcagggacagtgcactgccctgtagctaatgccatttccagtgtttgtttattcatgcatgagcattcacgttcagcataaatgttcctttttcattcattcattcaagagtgcctgccatatgtcagacactgtgctaagtaatgaagatagagcagagaaaaagacgaataaactcatggaacttccctgccactgcaagagagatgataaacaagtaaacaaatcattagacaagctcacggcagattctgataaacaccgtgaaggaaataaacacctcagtgtaacagacacaggctcctataagttcagtggtcagggagggcctctctgaggaagcaacactaaagccaaaacctgaaggatgagaaaggcccatcaacacatagggggctatcacatttatttttaagaacattcaggccgggtgccgtggctcacacctgtaatctcaacactttgggaggctgaggtgggcggattgcttgagcccaggagttcaagaccagcctgggcaacctagtatggcctcgtctctactaaaaatggaaaaaaattagttgggagtggcggtacatgcctgtaattccagctacttgggaggtagaagcatcacctaagcccagggaggtcagggctgcagtgagccatgattgcaccactgcactccagcctgggtgacagaggaagactgtctcaaaaaaaaaaataaataaataaaaattcaggtgggaaggcccagaaggaagaaggggcatgggtctttggagaatggaaaagaggcctttgtagagagtgttgcaagatgaagttggaaagaagggcaaggacaaatcctggtagggccttgaggagcaagagaaggagtttggattttattttgcagctacttggaagcctgtgtagtgggctagtcactggggagtcagccatgaataagacccacttaggcctgccctcgtggagcccctcataggactgactggttgcttatgcagactaagactggcttccatgggccaaatatatcccacctgtactgctttagcgacctatgctatgtttcaatttgaaatttttaaaatgtaggttaagaaaagccctgtgaaatatatctctcaagaggtatctgaatttgggccttcaaaattgaattgtcttagattgctgatgtcttcggtcatctctgaaggaggagtgtcaagactcctgtgtagctttgtagtgcttttaaaaaaaaaaaaatgaggtggagggagagggtctcccttgcagaaaggaaaattgaatggttaagactgactctggggcttccttggaacagaagcaaacttagagctagcttttatgaaagttttgaaataacccagaatacactcactttttgaacaggaagtagtactcaggtggagttggtatagtcactcataaatcagagtagtaccttttgctgtcatttctgtttgtcatagaattatctaactgacgtccactcttttaagatgggtgtggaaatgtgttctcagagaacttctgaaaggccttagaagaacccagtaagagctttaggaaattgagttatcattaacatagtgtgtcacatgcagtgactaaaaaagcattaggtgccacggtaagggcaagaagcatcagttaattactgcttaatcccaactgctggttagctgattattcataacaagaaaaaaatagggtagctttgaaaataagtatttatgtcacatacttcacaacttggagaatgtgctgctgcattctttttatggctgcatagtattccatcacgcgtctgcaccatagtgtatttaaccagtcctttcttggtagacattttggtcatttccagtctttggccaccacaaaaaatgctgcattgaatatctttgtaggtcattttggacatgtctcagtatattaataggatgaatttctgaaaaaaatgctggtttaaagggtattacgtttaaatttttgagagagtatcaaattgctctctaagaggttgtaccaatttaaactccatcagcaatgtacgagagtgccagttttgccacgccatcacccacactgtgtattaccaagcttttgatctttgctaatccaataggagaaaaatagcaccttattatagttttaatttgcattaaacgtgagattgagcttcttttcatatgtttaaaagccatttgtgagcaaagacattttaatgtctgtcaccagccttgaatctagaaataatctttgcagcatatctagtcttagcagtgtaaatgctgggtccaggttttaactatttgggaaccagtgccttagagtgcactaagtagctgatagacaactggggatgcagtttgaagaatgtcataatggatccctgggtgtaggaacctccggctcacacctcacacatttgctctctgatactgccagttgcctggccctgtcatctcccatctgctgctgctcttgctctgtgcagatgctctttgatgaaaaggagattagcaggtgctaaaggttatcagagtttttttcccagctgtctgcaaaaggagggcactggaccagagcagtgattttcaggctgtgggatttgttgttgttgttgttttattctttaagtattaagagccttttttgaaatgaagcctttggggaaccctgatatacaaaaataattgaaattagagctgagttgtttgaaggaatagagaccctggaacccatgcctgtagcccaccgtctcttggtgccctccctgttgtgatccatgagacatttctgtgaagccctaaggctcctcaaggcacagtttgaaaaccacgggacccagtgatgttagaagtttattctgtggtgacttaccagaggtatttgagcaccaccgaatagggaagactttggagagaaaatggccagctttctgaagcattttatgtgagaaatacaaggtgagaccatccattctcaagactctgtaaagcctgtattctgctaatgagtggtatattctgtactcagaattttgtcacttggacgtgtttgccagtcttgtgtattttttcttttgcatatactttgagcacccaatatctttgtaggtcattttggacatgcctcagcatatcgataggatgaaatcctggaaaaaaatgctggtttaaagggtttatgtttaaatttttgagagagttatcaaattgctctcctaagagtctttgtggaaccctgtcatacaaaaatgattgcagttagagctgagttggttgaaggaatagagatgctggaacccacactgggcatattagatttccagtggtgaccaatggaacatagagtctgatgggaggctcagacactgaatagtacacacaaataaatagatacgcaaatatataatcacatattgtgatgagctgatatgaagagaaagagcagagtgctatataagacatcatgtaagtgacctaagttaaacaggggagtcaagggagggccttatcgggcaagttctatgtgttctgagatgtgaaaagtgatttggagttaaccagatgtgaagtagatgggaggtattccagacacagagaacggcctatgcaagagttctgaaacaggaaaatgcttgccgcattgggggaactggaaaaggatgagttaatgggcaactgggaggccggggagccaggcagggactgaatcatgtgggggctgtgcaggccagggcagagagcttattctgtgtataaagtactcatgcctgttgttaatagccaaggtgatcattgtaacactttatttacagcccagtggttcccagacacaggtaatcttgggcacctccaagagcaaagtttaggagaagagggaagtcatttgaaccaaagaccagcagctcttgagaagagcaccaccacagctgaagacatcgaacagtttttgctgaactacctcaaagagaaggatgtggcagatggaaatgtctcggattttgataatgaagaaggtaacttgtttattttggcttagctggttttttctttctgaaacagattattgtaaaaatggtgaaacatcattacagaaagggtagaaataagaaaagttactcataaccttaccaggctaacatagctattctcctgttttgtgtaatctttttccattcttttctgttacaaaactgtttttccgtggttgcagctgtgtaccctttttgtgtttagttataagcaactctgcttattgccgttgaattttgatcattaacgttttaatagctgttactaagtgtccatcccctgtaggacatttaggttgcttctggcttaataataactctaataaacagtgctgcggtggatgattctgtgcatgtgaccttttttttttattttttttatttttttattttttatttttgcatatttctttaaattcccagaagtaggatttctgggtcaaggatatgaacataatttaatgcttgccaaattgcctttcaaaaaggttgtgtcaatttatacttttccttcggcagtgcaggatgaatactggtttcaccacagccttaccaacattggctatttccagttttcttcctaaattaataggtgaaaaatgggtcttgttatctaccttgcatttctttgattaccagtgaggttgaatgtctttataagcttctttcctaacaggttttttttccttattcccattgtctatttatatgctttgtccatttgtttgttggtgggaggagattgcagtctttttcttaccaatttatatgataaagaagaagggagttcaggctagttgaagctctggcctgttgttttattcacaagctcaatctggagcttcaggtcacggaaggattaataaattattaggatctcctctgcaaatataaaatgccaagtcataatgagcttggtggtctcagaaccatcctaaatcgaaccgagtcccaaattagtttgtgaggttggaataaaacgtttctttttctttttcttttcttttcctttttttgtttttttcctccttttggtgatctccactgtgagattctggtgaactgaagccagtacttccagcagtgtaacaggaaatagtagcttgatgccactcactacaacaaattccttctaaatagcagaaaaggcatcacagggcccaaataatgatttatgcagaattgagtcattgctctccccgaggacagagttttctgatcagaaatctatcaggctttttcttctcagatttgtttctcgagccaatccagtcctttttgtgaactgcacccttcacccaaacctggaaatgctgaagcaggggaggcattctgatccctcataatccagatttgccattcttgtttaaaatttgagcactgtcagtgaatccattccttcatgattaggatcttctggtgttagttgatgttcacgtagagcagactgaaagagtcaaacccttcttccaataacaggaaaatccacatccctcaaataagattctgcaataggtgaatttcaaacaacaaattcccctctggggaaaaaagcacaggcctatcatgcttatcattcatcaagtacacaccacacacttggcattctaaggaatgtttgcctcagtgctggcttgacatgagttttttgttttaagcacataaaagcaccttgtatatctgaggtccctttctccaagaaatccaagcattctacaaatgcattttaatttatcttttcagcatctgttagagacaggtgcagcctctactgtaagagtctgtctttccagcagagggaactgaaatgggaaaaagttaagggagcagtgctctgctcagtggaaatgagcacagctggtaatcagggttggcatgaggctgggggctgtaagtagatcaggaaaatttttcagggtaaggattttgacctgggtttcatgcaattctcaaatcttgtggtgatgtttccgtttacaaacttacatctatctcatgcaacgcagcactctagacagtgagaatgataatgactggtaatatctcatttaatgctctcagtagcatgtgaggtatacatgctctatccctttttttccagatgaggtaatgtaggatgaaagaagttgctaataggttttagaggcaagacttggtccaacctcctctaaccaaactccatgccctatgaactacaccaagctgcccttgttacctcacctacaaagataagtaaggtttgattctggccatcagaagttcttacaggctggtggagaagacagatgtgcaccccccttttaatcaaaggatgaatcaagaggagacaaaaaagtgaaggacagagcagaggccagccatggaacttcccagcttcaaggctcctccacacgagaaccctgctatctctcccttttttttttttttttgagacagagttttgctgttgttgcccaggctggagtgcaatggcacgatctcggctcattgcaacctctgcctcctgggttcaagcgattctcccgcctcaccctcccaagtagttaagattacaggcgcccgccactatgcccggctaatttttgtaatttagtagagatggggttttgccatgttggtcaggctggtctcaaactgctgacctcaggtgatccacctgcctcaacctcccaaatatcttgtttttatcttaaatattcattaatggaaatttagaaaagaccaaaggcatagggaaaaaaactgaagtcatctgttatctcattaccctgtcacttttaatattttgctgtacttcctctcatgcaaaaacgtatgtagtagtgttcatgctgcatatgcaattttgtgttgtgctttttgtctttttaagacaatattattttataagcatttctcttgtcattaaaacccatgcttagcctggtgtagtggctcatacctgtaatcccagcactatgagaggccacggcagggggattgcttgagcccaggaattggagaccagcctgggcaacatagtgagacccccatttctacaaaaaaatttaaaaattagttgggcatggtgacatgcacctgtagtcctagccactcaggaggctgaggtgggaagatcactcgaccccataagtttgagattgcagtgagccgtgttcacaccactgtactccagcttggacagagcaaggccctgtgcctaaaaaaaatagggacctcataaaatgccattatatggctatatcatggtttctgtacctattcccccttgagtggaggtgtctcagtccatttgtgctgctgtaaccaaatacctaagactgagtaatttataaagaacagaaatttaggtatctctgttttatcactcatacaacactgcccccagttgtgctctttttccagaggaacagtcagtccctcccaaagtggatgagaatgacacccgtccagatgtggagccaccactgccattgcagatccaaatagccatggacgtgatggaacgctgcatccacttgttgtcagataaaaatctgcaaatccgcctgaaggtcagtgcgcagctgcttctctgcattcccagagtagcaggactaaggtgtggcctggttggcagtggctacacggatgagcacgtagctccccttatctcctggtccacgtgtggtggccaagagaaggcatcaaaaggaatttgtctgtggggtgacagttttacatctttctgtgtctgctgagatgccaaagggagctgagtctcctgcattaaaaaccacaagttttggggattcactgaatttccaaggaaaagaaagccatgtgctttggaaaggatattattttctcagctatgtaggatgcaggttttaatactttaatgagatcattcttccaagcctgacactagcccttatctctctgttttcattctagggaaaacttgaacacttcctaatatagactggcttgctggcagtttgccaagcagcacccccatcagcaagggctgaaagcatgtagtagtgactgcaataacaggatgcagtggggtggggtagaagtggggggcagggcttttagaatcaccctggagaagaccttacacccaaagggagacagcattcctctctacccccaagcaggagtgagaaatacaactgtcggccaggcgcggtggctcacgcctgtaatcccagcactttgggaagctgaggtgggcggatcacctgagttgggagtttgagaccagccttaccaacatggagaaaccccatctctactaaaaacacaaaattaaccgggcatggtggtgcatgcctgttatcccggctacttgggaggccgaggcaggagaatcgcttgaacccaggaggcagaggttgtggtgagccaagatcgtgccattgcactccagcctgagtaacaagagtgaaactttatctcaaaaaaaaaaagagagagaaacacaactgccttagtgactcactgttagtaatgagtgtacattgccttgctcaggggtgatgggctaggaaaccctgatccacagattatctcaaatctcagcgcctgtgttgtgtggagtttgtttagtcttcccaagacagctcttagcattcatctgttgttccattcagcaagcacttacctttttacctgcacggctttaatgtaggtgcctggctgatacattcaacatactgctgtatatccttcaagaccttcctttttgtagaggatttgtagcagctgtatacataccataattattaagaacatcagtgttggagtcagacctacatatctgagtcagtccaaatcctgtttctgcctcttattagccatgtgaccttgagtaagttaattcatcatgttgagccttagcatcttcatcagtaaaatgaagatgatggtacctacctcacagggttgttgattataaatataaaacagcatgaaataagacacatacactcattcatgtgctaaatgcttattgaggactagtgcaggtcaggcagaggatgtgtagaggggatgatgcagacacaatccctgtcttcatggaactccctgtcttttgtggggagagaggcaatacacagactcatacatattggagaaaggctgtcaaggtaatagcacgttctatttgatagaaaatagtaattcacccatgcggcagatacgtgttgggtacctactcggtgcaaaaccctgctgactaagacagagcttaccttctgatttagcctaggtcatcggggaaggcctctctgaggtggtaacatttctcaaggctgagaaggaggcagccctgcaaaggggcaaggagaacattccaggcagaggggaaatgtacatctttgagtcaatgaaatataatgtaacttgtcccattaatgacagagctcaaattccaagcctgtcagtgataccaaagccatttccactctgctcccctgatcccctgctccccactgtgcagctgagctttctcttactccctggcctaattattcacccctcaatggcagggtctcttctgttccagtctcagtgtggaccagcacatagtaggcgcccagtagggtttactgctttgtgttggccggcttctctctgtcttgcagactaacgagtgcctcgccctgtgaaggttgggcgtccatgtgggagggaagcctgcgctggccgcccacgcgggagggaagcctgcgctggccgtcgtactgaccgctgcctgtgacactgatgcaggcagtctcttttcagtgagtttgagatataagagatcaggaaacaaggaaggtaaaatatcagtttatatgtagggtagcctaaccctttctggtgagattaacctgtacctcagctgcctgctgggcctctccatgtagtggtaacagaacttggtctcccctagccgcccaactttctcctcccgcgtgctccccatctcattcagtggcatctgcatctcttcagttgctacccctgaaacgaagcagctcttttcaaaccctcacttcccctccccagtatccagtccttcagcaatttaagccacgtcatctccaaaacagatatccagtcctttcacttctctcctctgccgccatcacgcggccacatcactttgctcctctcatgtggatcctaaagggcctctttgtttctctgtcacccttcaagtctcttctccactcagcagccagaatgacctttctaaaacatgaattgtatcatgtcactttcctgcttaaaacactttgacggctccccactgcacttagtacaaaataaaaaaaattcctaacaaacccctttgtagttgggccccgttttacctcttctctgtaatgctccacgctgcccttctttcacttcttatgaaagctctgttccacctctgagtcttcctcatcacggtttccagttgcatgaatcttcacagaactaactcctactcatcctttgtgtcttcttttagaagctccttccccagcgaagccttcccaacagtctgtggtttagatccttcccctcgtttctttgcatttcacctttgacttcccttcttgtcccaattgctaatcatctcttcatttaggcgttatctaattaaggtctttccccagctgaccatgaaccctgcaaaggcaaggaaacgtgtattttgtctctgtgtgtcccctcagtacctagctagtgcttggcatgtagtcagcactcagaaaacaattatccaattaatacgtttctaaatgttattctttgaaaatggtgacttgatcccaggtatctgttttcaagcctataccatctgctgaaatcgtgtctctttcaggtcttggatgtgctggatctgtgtgtggttgttcttcagtcccacaaaaaccagctgcttcccttggctcatcaggcctggccctcgctcgttcaccgactcacacgggacgcccccctggcagtgcttagagccttcaaggtactgcaccagcatcccccatggtctgttgtgagggtagagttagtaggcacagagctcaccggggccttttggattggttctcttcacccgattgcaatgtcacatactgtgaagaaagtatagaaacataagaaaagcacaaagaagaaagtaacagtctccttttgaacttgaagcagatgaactagtagatgaaaaggccaggcagtaagctcagcactcctccacaaaggagtttgtctccttacaaccactttgcaaggtaggtatattgtctttacttttggcagaggaagaaagaagctcagagaagttaaggaattttctcacaatcgaacagctagtaagtgatacaaacccagagcattgagttcacaccatatttgcactgcacaggagtcaaggcgaaggggctgaggttctagcagtgggcatcctctgcccagctgagtgatgctgacaaaacccaggaccacccattttcgtgttgggcttaggaacacctagcccacctttctcatagtgttgtcagggataaaatgggactgtttggtgaaatgctttgaaaagctaacagtcctatatatatgtaaggtattattctccctggcttagtttggcttacattagcacggatattttagcttatttatatcctttcttgttctaaaaagcccttaaggcaacctgcagagatacataccacagcgagctgccataaattagaagaaggtgcgcaagatgaggcagagagaaaagatctgtagggacacaaaatgaagctggtaatgcaccagataccgttggccaaagtagtttgatcttctgtaaattcttcagcatatactagaccaaattaaaatattaaaaattgttaatgtttttttcccaaaacaaaatgcacaaaatgatacgtgtgtgtgtgtatgtatgtgtgccaaagaaagagggagattaggccagtcgcggtggctcatgcctgtaatcccagcactttgggaggcggaggcaggtggatcacaaggtcaggagttcaaaaccagcctggccaagatggtgaaaccctgtctccactaaaaatacaaaaattacctgggcgcagtggcaggcgcctataatcccagctactcaggaggctgaggcaggagaattgcttgaactcgggcttcagaggttgcagtgagccaagatcgtgccactgcactccatccagcctgtgcgacagagtgagactccatctcgaaaaaagaaagagattaagggagagggaggtggtattgctaaatcttatccagatgtactgcagggcggggtttggtgagaattaataggttgtctgaaataacagcaagcatagaaaaatgaaaaaaaataaagatgtgtacacaataactgaggctgctttccccatgcgcagacacgatgatgacactgaggtctatagaagctgtgccattcagctgagggacctaaaatgagagccttgttctctgcaaaatgagcaaacactgtgctggttatgccttgcttaccaatttttaaagaaattcctattatcctgtatactcagtcttgtgcagcagggcaaaacatttcaatatgttctgctagagaaagtttaaaacaagacatgcaaagaaactatctgttctgaaagatagaatgagggtgatgtgcataagagattgtgcagctgaacagaaggaacaccgagtcggctgcaacttcagggaccctgccttggttcagcccagggacctcggcccagtcactaacctcctgatgcctgcatgtggcagcagctggaccatagtatttgtgtttgctcagctagctagagtttaaagcatacatattttctcaagggatgttaggaagattcaagaaatgatctatgtgaactgctttaagctcttctcttttttttttttttaacaaaaatgggagggaaatcaagatattaatcatattattcatccaacccaagattcctttgaattattccccatgtaatctgtatttatgggtagaagcagccatgccttgggagcagagacctccaaattcataactgtcagaatcacaaaccatgggcaaggaattaacagcagtaattctattttttttttcccccaagcagagacctagatgaaatcgaattaccaagcattctttagctctcttgctgccttggcaatgttcactcaccaggttggaggctgtttctgcaggttttacgtaccctgggaagcaagtgtggtgactttcttcgcagccggttctgcaaagatgtcctgccaaagctggctggctccctagtcacccaggcccccatcagtgccagggctggaccagtttactcgcacacgctggccttcaagttgcagctggctgtcttacagggcctgggccccctctgtgagagactggacctaggtgggtaccaggcagttccacctgaacacacacacttagcatctgtctcacccctgccatcatgccctctgctcagtcgtgcccccctcccctcccctctgtgtacctccttccgtcttattttggcctcatttgtccatttatcttgatgtgttctttggcgggatggagtagagagcccagagcatcttgcctagctgttgcagtttctccagacacagttggtcactgcttgtcccaaatgaagtgtaagggctgatgcttgttttgtttttcttttctgcaggtgagggtgacctgaataaagtggctgatgcctgcttgatttacctcagtgtcaaacagcccgtgaaattacaagaggctgccaggaggtacgtctgcctgatcacccgcatccctttacgtttgttctaaattacagatgatttgctaatggcaagcagagttgaggcatctctgctcttttctctgtcaccctgccaggttaagataattctttaactgtgccagcactagagatggtatttttactagatgtgtttctctttgccagtaaccttttcctctgctgcaaagtcagcaacaattccagagggtcaagaagcagaaagacggtgtgctagagaggactcagcaccctcctggttggaggggaatctgcttctaggcctggagaccaggtgcctggcacttcttcatgccttggcttcttcaacagcaaagtgaaagtgctgggttcctgatatggcatatgtcgactccacggcaggtcttagatgggcatcggtgccatgaaccctcacaagtgcaaagcaaaattgtttgtgtgcaggcaggtgcacatgtgcctttttctaataggaaccattcataggttctaataggaatctgtgacccgaagaaccttaagagttgccagactaatggcttaaagggccttttctgattctgaaactagatgattccaatttctaagagtttgaccatgcttatttgagaaaagctgtatcacctctaggagaagaagctgttgctggttactttaggactaagagctaaaactcagcacaacagcattccccagacatgagaccccaaatctactctgcccctcttctccaagctttccttccaggtgggagcagcctgcatcctggaactgccatcccagggtaggtctgctgctggggcgaaagctgggcctggcactctgtgccgctctgagccctgcagctccttcagcctcaccagcttcacgcctgcagcggaatccctgcatcttcctagcttctagaggcacatctctgatcctcttcagtggggtgggagttaggagtcaactcattccctgaggagtggaaaggctgctctgactgtgcagtgaggagagccagcttgctccttagaaaccttgcactccctgggagtgatggtaatatcttcttgaattgatttattgtcctttgctgttttttgctcttgatttcccatttccttttttcttcctgtccctttcccgtcacatcccttagtcccagaatcagtcatagtttcatgagcacaggggcgcatcctaagcagcttctgtccccaggcatttttattccgtacagaatcaatttagggtgaaaatagtcctccctgggcggtgcccctggagctgattgtgctgtgacttaaagtgcaactcaagaacataatgagtttatcttgaagtaaatccttttagatgcctattacaaccaagagttaaaggtctgattttcacattccccatccattctatttttcctacacccactccatcccatccttcaagtttagaaccatcaaataagctaatattctcaattcattatcttttcatttctagttctcttttttgctgctgaaagcaattaaacccggaattggaccttgctgaatcttgagctggtgttcagggagcctcaggtggaggaacacgcagccccaccacttgaccgcagctccctttgtttgctccagcacattccgttcaagtgttgagtcagatggcctccctcctgatgggcagggagggggaggaagagctaggtggattgcttcacacatgtcacttgcaaacttatcttgaagttgggaaaaaaaatcagtcttgatccttgatcaagagctgatttggcatcttgatgctgaaattaataagctctctaagtgggagaagaagcctgagacaataggaaacctggtctctctgtgagcctcattaccgcatggagagaggggtgggtgggtgggccacttagtatggaaaagtcatacctggcagctgggtgcggtgggtggcttacgcctgttatcccagcgctttgggagtctgaggcaggcagatcacgaggtcaggagttcaagaccagcctggccaacatgatgaaaccctgtctctactaaaaatacaaaaagttagctgggcatggtggcaggaacctgtaattccagctaattgggaagctgaggcaggagcatcacttgaacctgggaggcggatgttgcagtgagccaagaccgcaccactgtactccagcctaggtgacagagtgcagtctgtcatacctactagtactgaggaaccaagtcccctgcatgagatggagtcccatctcagcacatggccctgccatccatcctgttgtttgttcttaattcttctctttccttcacaccctacatccatgaccaaaagtaaagcccgcctacctcacttggaaaattgctctcaaaacgacacctccaaaccactaggccaggccaggccaccatcatctcccaccagaacaacagacctcaccactggtcccacttccagtcctgcccctctaggtattctccatactgcagtcagagtgacacacttacacacacttaccctcatgggagaagagaaagctgtgttcgttgcaagggcccaagtgggaaccttggcttagtattcagaaaagccagaggtagtgagtttccgaccctaggcagatgaccagcttgctttggaagtggctctcctgtctgccagagggctggtgagggaagctctcagggcaggaggctgctcccaggcctcctgtcttctggaaggagagggatgtgcaccagccctgtagaacagccatgtctgtgggcccctctggcaggtgggcttaggacctccaaggggcgccttcatcgagttggggtggaggcagacttagcagccccatgagagttcatctttatgtgcatcatgcttgggtttttccttgctcccatttgcttttcctggctccaaagaatgaccaaaccagtgtttgcttttttaatttgccatattaaatatagcctttgtggcaggcttttacatccaggcagtaaactctagaaatggacattgatcagggggtggttgatgtaaccgaggttgtaaatgctaagaacggagatgccattccagtttaatgcttttatctagcaaatgtgccttgtatggagggggcataaatcttccaactgggggaggcatgggggaggggcaggggatggtgggggcaggatgtgaccttgctgtgtgttaccaccaggtgtcactgttaactggcaatgcaaaaaaaaaaaaaaaaagccagctcccccaaagtccctctagttaagtaacttcaatggataacaaatgtgcaaatcatatttgtggtgtgggaggagggcttagcataccaggagctaaaaataagacagtgtccctgagggtaggcgttggattacagacaacaggtcagatcagccacacccccatctcagccaactgcagtggcaaactttgctgattgaaattctcagtctccaggatgtctcccggcatgccctgggccttcacagttctgtgcctttctgtccaggtagcttttgcctcctgtacgtgaaaggaatttgaaaagagagcatacaccccaaatttctgtttgtccttcaagtccatacatgtacttagcctagttgaactccattaaaaccatactccttgggccaatctcttagcagactctgagactccctggcttttgcagtgaggttttatatcatccaatgagccttttaccctgggctaaaaggaaacaaaactagacaatacttttcaaatttttgaaaagatgaagtcaggccgtgtgctgtggctcacgcttgtaatcccagcactttgggaagctgaggtgggagaatcacctgggctcaggagctccaggccagcctgggcaacatagcgaaaccctgtctctactgaacatataaaaattagccaggcgtggtggtgtgcacctgttgtcccagctacttgggaagctgaggcaggaggatcacctgagccttggaaggttaaggccatagtgagccgtgatcacaccactgcactccagcctgggcaacagagtgagaccctgtttcaaaaaaaaaagaagaagatgaagtcagtgcccaacaagtctcataatagaaaaataaagcttttaggatgcttggcctccacccccagtcctactcccacctgctaaccccagagcccagatagggatgcagggtgccagcaggtggtgaccagctggtgtaccttctggccacgcaagtcctggatgctgttattgctgtagcccctgatggggcgctggggaggttgccattccagctccctctgcctcgccattgtgtgtgagagaaaaagtagcagtcttgctttggacaaaccgaggttcagatcttactggccatgtgaccttgagcaaatgatttagcttcatttcattttcttcctctgtaaactgggggtgatgaaaactccattctcatagggtgcttgtggatgaatcacgttagtatgtccaaggagtctccaggtactgttctagggactggaattagagggaacaagataggggcctctaccctctgcttatgttctgaaggtatatttacatctgtgtacacacctatgtggggtacatgtatgtaaatttcccaaatatgttatacatgatgtgtatgttactcatacacatagacactggccacagaatttctagttgtaagcctgcttcatccttactaaaatctgaactggggatttcacctcaaaaggatctttttcatgttaattgtgccaccactgtttgcagaagtcaggaccgggtttgaaggttcatttacagactgacttccctgctctctttctagcagtaggatcccatcccatcaaagaaccagctggtgccttcaaaccctggacgaacacagaccggcacaggctcattcatttcatccctgtcagagccccaactcctctctttacccacacatgagcctattatatttgaacggatgaggagccacagaggtgatccattagttcagctgagcttgaaattagtagctcatccccttaaatggtgtgggcagtttggctgagcttggactgcaaagctgttcccccttggattgcacccagcatggaaatgaggacacacctaatattttttccttttgacacttgattaatagttgacaaatccaaacccaagtagttagctttcctattatccatcttttgacaggcattgctggttttctttttgagtcccattgttctaaaaatacactcagatctggagctgttcactgtgcatatataggcctgatttcatggtgtcaaagataagagacatctggcaggcagattacaaacaaagtgggttgctgggtttcagaactgaaggcagggacctctgggctacttaaatctacttaaattcagtgctgccaattctgtcccttcttccttggtgttgtcatgtcactgataacctgccagggtcaaccatcttaccacccggtaggaaagccaagcgtggggtgtgtgtgcacagtgcatgccgtgccaggttgggagcagaatgttctcgatgacagatcgagcctggtcgcagcaccgcctgcacaaagtgggttttggtcatcagaggctgtggtcgaccacagggtagtcatttcctcattctgcaggctctgtcatccctctcgaacacctcagaggcgtggaagtaaatgttgtctcagtactgagtaaataaagtagccagggagatgatctctatttgtcttattgtatagatgtattttaaaagatttttattgggtctcttatgatgagccaagtgctgtgttgagagttgaagattttcagagataactaccaaggcctcacattgttgttcaataacaagataaccttggcaaattaattcacttctcaaagtctctgttttctcatctataagaccgaaaaaagcatgtatgttattttgcttatttcacctactacaatgacgacaaggattcagtaaagtcaggtagcacaaaataccaccacagagtaaaagtcactaaatagtagttgtgaatcattatttaaatttcttcttattccgaaaatgacttggaacatcttataaattgtttgcaacaaagaaaaaaggaaggaagtgaagaaattttttaaatggaaaaataacagcaaaaacaagatgagaccgagttgaggttaatatagacaatacagttagagccctgcacccttgctagagaggagctttcagagtggctctgtgcttcctgacagacagcaaagaggaaaatggtacaggaagtacctgaataagagtttttaaaaagaaaaggaaagaaagcttttcagaaagaagcatggctttccttattactgacgcttgaggaaaatttctctgtgggtcatcttaaaagaacactgggtactgttgtgactaatatcctcaacgtccttgcagtaaatacagaaggacatttcctagagctgtttctgaaggcatccgtgagtggaggctgctggcttagtgccagagcacaggttacaggaaaacagttcaggcaggaggtgggcaagcctacctaggctgctatgaagatgtctttatcttcaagggtacataccttccagggaggggcaggaaacaatgtggcccgagagtgcagccagctgggggaaaggtccgagtcagccctcatagtgctcagcacagaatgccactttgaaatctgtgcccaatacactgtcgtgggatctaggcttgcagggttcctggaggcaggagaactggccagatggaaagggctgcttttaaatctcgccccagtgggatgtaaaccctcctagattctggcttatttttgaattgtctataacagattggacctctcagcgccatatccttttaaatatgcacaaagcaatggaatcattcctctgcatttatgatactttatcttgtggcacttcagaggtatggttagcatcatttgcttctactggtgtttacggttttaagtcctgcccatgttgcatttaaatatttttgatatgggtctctgtgtgagtatgcatgttggcgttagatcgatagatgaatggttttgaacaggtaaacatagttaagtcaaacgagcatgtatagctgcaaaggtaattggtagtatttatttggagagtaaatcgttgcttcaagtcataatcctccatttccaacatttagaaataaaaaacgacctccgtgcaggggaagatagctaaattgaatagcaagaaaggacaggcttgaaatactggttaaccaatgaactgagacccattagagtaaattaccaagtatagaaacatagccccactgcttgctggctaggacgcatcaacaccctgagcatccatttgtttaaaaggaaacacacagcctcctttgcagcatcagcatgcacagagtgatgggagaagagatggccagagaggaggagagtgtggaggctgtgctgccagagagggaacaacgggaacaccaaaataacttagtgagtatgcctgctttcccacaagtgagcttactttcccactgcatttaaccatgcccacatagagagagcctgtatcgtgttcctaaggagacatttctgagtaacttctttagaagccccaaataagtaagcaaacaaacagatcacaaagccacatgttctttaccactggcatttaccctgatggctcatgagagcattttataaatccagaaagagacggagaacagcagatccctcaagcaagtaattgacacaggaagaatagcctgtcacccaggagagctggaagccctgcatttcagttacagtttatttagcttcactgggccctcattggctggcggttttctagatctctctttgagcagatgttgtctagacagagatggtgagaacatattctgtaatattcgctcctgcagcagagcagagggggttctttttggttttgccatattgtggggtggggtgagtaatgatccagtgcccatgattgaaaactctcgtggtctgttggagctaccagggatcttagaactgatctggtccactcgctctttacagagaagcaacttgccgtgcctctcctcaggaagccatgcctggtgccacccgcacatcacttctaggctggcccttgcaacagtgtgccatgggcctctgtgatcccttagtctaccccagcagacagggagccctgagggcagaggcttttttgtccctctctctttgtgcctcaagcacctcagttagggcctgggctggaccaggctttagtaaacgtttgataaaccatgaagagataaaacttaaacccagctgaccagattccaggagcacgtttcctccctccccattcccacctcctcgcccccagcttgctcactaggggcacccccatactgatcacgaaggaaggagccacttctggtttggcatctggagtttattaggtacttactgatagccgtcagttgtagatagggctgaagtgcaggcaaatggctgcctgcatggagtgaaattcaataaaactgcattttaagtgaaaaatcagtataaacaccaggcttctttgccatggaaacagttgcttagaaactgcctaacagcgagttctaaattttttaaagtcaagttatcatttaagctacacggccttacaggttattgagagataatcactcgcctcaggacactcggaggcatgtggcacagctgagtgcctcccgatactctggggaccagataatctcttgataactgtgctctctggagccactgatttgggcctggggggaggagaaagaaatttttgttcaggagttaaatggtgtacatatattttttaaaaagtgtttctctttgggtttgaaaaaagatggaactggccatttggtatgttcaacagccatccctgcgcatcgcaaaatgtattgggaacattttccaggcagttaccccagtcacttcaaagcagaggtcctgtctttgtcttctggctttggcttatgcaaaaggagttttcaacaactttggctttcagctgttcactctctggtttcagctaaggctgggcaggaactggccccaggacaaagtgacaccagagtttggaacaaagcctggcgctaaggactcagatcagacctcctgggcctcaggctcagctcccaggggcttaaagccaacaagggtgcggtttggaatttgtcgtgtttagagttcagcaggccgcctgcctctcggagtgagagcacagctacacttgccagccatctggttgcatggcatggcatttgctccccacctcaggcatgcagaggacaaagtatattgcatttgtttcttcctgaaaataatgggcgaaattagaacatcattggctgagaactgggatacccccaccaagtcagtatggagaaaattatgagtgaaacaaaagacaaatgttttgcccttttcagggtatctgaaaattatccatggcatggtagtgctgctaagattggtggtgttaattatgcctcagactctgtgtccctctctctctctttctggaagaaaagaaggaatactgttttcatcatatacttcaaagtgttgtcctgcacctcctctcctcagagcctcagaaggacctgtgaggagagtgggccaggtgtgatcatctttggagaaagaggaaacaggttcatgaggcaaaatcacttgctctaagccacagaggtgggagaaggaacgtgcattcctgccattctggggcatctgcccctttaaaagcaaagaaatgagacccaaaacagtccttccaagagtttggctcttgcttaataaaagaaggtgaactttgcacaagtttttcctttgcttttctgttaatattttatgtggatatcttgcagggcaaaaagagtggcttattttcttttcctttcctgccaacaaatacgacattcatatttagcatgttaaaaagagctcagaaaatgaacattgcagcattttcatgctgtgtaagtcagagcgcagctatgactgaactgggtcgtggcaccgctttgctgggtgttgcccagataaaaatattccttgaagctgggagagcaccacgctgtagcttgagaaattgttccagctcttgaaaggggaaaaaatcaaatgaaaccatttgcattctaacagtctttggcaccagggaaaactgtcaactgtgtcacgtgtaaatagaaatctgctccccgcttttggtgcgttttttcataatttcccttgccactctaattatcaaagatatttttatttttaaacaaaaattgtctcccacgcaggcctcatctttctgcggtgaagtggaaacgatgaattagaatattctaatcacttctccaacaaccactatggaggttataaacacaagattatcctagcaaagaaaagtaaattgtttgggcacagaacaggccaggaaaaaattcagtaggccgggcccggtgctcacacatgtaatcctacactttgggaggctgaggagggttgatcacctgaggtcaggagttcaagaccagcctggccaacatggtgaaaccccgtctctactaaaaatacaaaaattagccgggcatggtgatggatgcctgtaatcccagctactcaggaggctgaggcaggaggatcgcttgaacccagaaggtgaaggttgcagtgagctgagatcgcgccattgcactccagcctgggcaacagagtgagactctgtctcaaaaaaaaaaaaaaaattcagtgcccttgtccaccctccccactcccccactgcctccctgacctccttagtgtatgtccactacacctaaggatgatatcaagactggcttcacggtaagacccaaatcccctgagggtgcaggtctttcatattagtgaaattaaaatccagaatttactccgacttagcaggcgttgaagttcctatttaatgcccagcagtatgcaagaggctccttagaataattgccaataataaaatgtgatttatcaaatagatactatgtactgttaattggtaaatagggatcacgtgctagactgtgtagggcttgatctgtgctttaaacctcagcaaaaccctgagtgaagtacatcccccatttttggaatggggaaactgaaacagggcaagctgaataatttcccaaagccacatagctagtgatgcctctgataatttgaatcctgttaataatcttccttgttccttccttggtggtgagagtttaacccctccttcagatcctttcgtagaacttaaatattctagagagggttgtcgtctaaagtcattcatgtgcaatgtagtaactcaccacgtcctcattaaaatgagaactcattgttacatggacacattgcaggggaaaaaagagaaatgagaacctgttcagtcaatattaactggatgctgaccacatgccattccaggtgcccgagatacagcaacctacagaacagatgtggtccctggtccctgcccttggggagcttatgttgtgagggagacaatcaatggtcaatatgtgctaggaaaggtgtcctgaaagagaaaagtaaggggcagccttacttgggcacagtggtgtgggcaaaatggcatggggagcccagcctccgagcaggcgatggtgagctgagatgggcagactggctgggaggccctgctcactgcaggagggccccattcttccagggattgccaagtcggactgaattgccaccatgtatgaagtttacgcttagactgcccaacacagtggccctgggcacgtgactgatctttcagaaatagtatttgagcagctaagaggcaagagttgtgaccccaaagttcagacgaagataaaaaccaccctcggtggctgtggggtgtccagtagcccagggcccttgagctctgtccctgtcatgcgtcagaggacatcagtgctctatctctgccaaaggttacagagcagagctcagccagtcctgccccaggagaataaaggaaccctttgacagcctgccaaaggcggcatattctgtggatctgatccctgtggggaaacgggctcctcacacgggagccatgagtgtctgttcacaccaccaagtatccatggctctcagccaggaagggtccaactgccgacttcagcagcgtgctggaggaccataatattaaggcttgctcagggcccccgagcaggacagggagccctgccctgggcctgcctcaaccctgggctgggcctgtgagctgagcaaagcctttaagaaagggtacactctgtcgtttttcttctttgtgaaaactcctgctttctactctggaactcaacctctttctttgccaagagcttgtttgctgtcaatattgttctgctcagactaattactggtttctgtatgtcgatggatatgaaactgttacctgtatttcggttgggctttgggaccatcctactggtcctgtcttaggaactcaagtgggttttttctactatttgaagtgacttgatattgttatcagtttcttctcaaatagcctggtaaacagcctcctggttggggctgtagcattccccgccttccctctctgtaccctctactcactcctttccatctctccacagcgtcttcctccacttgatgaaggtggacccagactccacctggttcctcctgaacgagctttactgccccgtgcagttcacacctccccaccccagcctccaccctgtgcagctgcacggggccagcgggcagcagaacccctacacgaccaacgtgctccagctgctcaaggagctgcagtgaccctgctcccccaccacagaggccaccgatccctcccctactgccagccagaagctgggctgaccccaccccggccataggcggtggcagcggcagcagagaaggtgaattagttagccaatcgatttataaattgatcgatcacacaactgcttagaaatggattgaaggaaagtagctgactattatttatgtttcataccttgtgttgtcaagtgacattgtctggtggctctaagggtttaaccccttagcctaccatctctatagccccagctccctcacaggccacacacacacacacacaagaggtcagttcccctccatctgcatacacctccctgtcttcaaataatgagatggaactaatttgttttacctaacctgatctttgggaaacaaacggaaataaagacacttcttggatgaaaagtatgatcaaaa

SEQ ID NO: 11828 - DNA, 256 bp, Homo sapiens
gagaccagcctgaccaacatggaaaaaccccgtctctactaaaaatacaaaattagctgggcgtggtggtgtatgcctgtaatcccagctactcaggaggctgaggcaggagaatcacttgaacccaggagatggaggttgtggtgagccaggattgcgccattgcactccaacctggacaacaagagcgaaactccatctctaaaataaaaaataaatctcttttaatgtgtagatttccccctccacctctctc

SEQ ID NO: 11829 - DNA, 485 bp, Homo sapiens
gtcatatttgtcaggtgtgtagctggactctctattctatgtgtggtctatttctgaactctgttctgttcatttttctttatgccaagtatacactgtcctttaattattgtatctttatagtaaaccttgaaatcagttagtgtaagttctgtaactgcattcttatttttgaagattgtcttttctattttgggtcctttgcatttctctatcagttttagactcatcatatttctgcagaaatcctactgggattttgattaggattatgctgactctaccaatggtaccaaatccagggacaatttttgtccttgacaggacatctagcaatgtctggagacatttttgtttgttacacctgggttggtgctactagcagcagatagatggatggccaagatacagaggccaaggatgctgctaaatgccctgcaatgcacaagacagccctccaccaacaagtaattatcccacccaaa

SEQ ID NO: 11830 - DNA, 25857 bp, Homo sapiens
cagctttgggatgtcggaagatcctagaggtcccaaggtagctgacttgcgaagctgaggctccagccgagggctccaggcctctgaccggcccagcagtgagcgcggctgcccgacgcttcagggccgggagcagggagcgtgagtcgccatggcgacgccggcgggtctggagcgctgggttcaggacgagctgcactcggtgttggggctgagcgagcggcacgtcgcccagtttctgatcggtaccgcacagcgctgcacctctgccgaggagttcgtgcagcgcctacgagacactgataccttggatctcagtgggccggcccgggacttcgccctgagactctggaacaaggtgtcggcaggggtggggaggggccctgtgatttgtcccggtgaggctggcctaacggtccatcgagaagttaagaaagctcagttcacaagcacttattctttgtccgttgtcgcgtaggtactgtgctagctgctggacgcccagctcagtggagaagattgaggagggcttaggtgtgtcgggttaagcgcaatagaacggtgtttctcgaactcttaacatgcatccaaggttcttgttaaaatgcagattgcgattcagtagggatcttagtttctgcatttctttctttcttttttttttttttgagagacacagtctcgctcgccccgtcgcccaggctggagtgcggtcgtaagatcacggctcactacagcgtcgacctccctggttgaagcgaccctcccacctcatcttccccggtagctgggactacgggcgcgcgccaccacccccggctaatatcttttatttttatttttatttttagagatgaggccttggtgtgttgcgcaggctggtctctaactcctcagctcaagcaatcctctctcagccccctcagagtgctgagattacaggcgtgagccaccatgcccggcccccctcatcttctgaacttcctttcagtcgtttaattaacagagggggccgggtgcagtggctcacacctgtaatcccagcaccccgggaggctgaggcaggaggattacttgagcccaggagttcgagaccagcctgggcaacatggcgaaaccttcgtcctacaaaaaaattaaaaattagttgagcgtggtagtgtgcacctgtgtttctagctacttaggagcctgaggtgggaggatcccttgagcccaagagggacagagtgaaaccctgtctgtaaaaaaaaataaaaaaccccattcaggatgatgaagatggggtgaagccatgaggaagaaagagaatgaatgctggttagctggtttaaaactaagtaattgtgcccgggtgcggtggctcatgcctgtaatcccagcactttgggaggctgaggtgagtggatcatgaggtcaggagtttgagaccagcctggccaacatggtgaaacctcatctctactaaaaatacaaaaatagtcgggcgtggtggcatgtgcctgtaatctcagctacttgggaggctgaggcaggagaattgcttgaacctgggaggcggaggttgaagtgagccgagatcacgccattgcctgacagtggggccgggccgcgggggcaggaaagactaagtaattgcttaaattaggaacagagctaagtgggagggcagagatcaggagttgctcagacctccttatcttcccctctactgacaggtaccacgaaaggcagtggtagaaaagccagctcgggcagcagagcgagaggcccgggccctgctggagaagaaccgatcttataggttactggaagacagtgaagagagcagtgaggagactgtgagtagggctggaagcagcctccagaagaaacgtaaaaagcggaaacacctcaggaagaagcgtgaggaagaagaggaggaagaggcttctgagaaagggaagaagaaaacagggtaagtcagaagcagggtgagagaggatggggcaggctgaagtgttctctatgcccttatttaatcccctggatgggctgcagggggagtaaacagcagacagagaagccagagtcggaagatgagtgggaacggacagagcgtgaacgccttcaggacctggaggagcgtgatgcctttgctgagcgggttcgacagcgggacaaggatcggactcgaaatgtcctggaacggtcagacaagaaggtgaataggagcagcatgttctgtaaatccccaagatcccagggtgaaatctgaggttggctgtgagtgcagagatagtgatctctgggaagacaaggggctgtctctagtgagatgttcacctctgtggtgagagaagccctgtgcatcctgtggctaagacaactgtctgctgtacctgcaatcagagagattcctcactgagaggggacattttttgtgttagggcgcatctgaatgatccttgtgattctagaggggagcagctgtcagtgtgggggctctttggcctcacacccctccattcttgttttttcttctaggcttatgaagaggctcagaagcgcctcaagatggccgaggaagaccggaaggccatggtgagtcccagggcctagggagccaagatcagaagacaaaaggaaagactttctgatagagtgtatagggagagaggatacagaggaagcacagtgtggatgctgatggggtggtcaggtttctagaagaggggcttggttgttaggagccagctgaggatagacttatgttgttgagggaaggatccttcttaagttgtagggggaaggaggctacccataagtcctccttgactcttaactttaggatcaaatatactctattagtgaatgaaattgtgagctttccctattcctgagtcctaatgagatatgaggcagctggaatgttgtcaagaaggttgctggagggcaagggcagggcagcagtcccactgtacagggatgtgctgaccattcagcttaggcacaccatctccaaataccttcccaccacctaattcctgcaccccttatgtggctttgtgatctccctgtgtcttctcactggacagggacagagcccttgtaattcataaactggactttttatggtgtgaaactaggtagggtaagctgttttccaaaggcctggtcttgtcaagtaaagtcacacttagattccccaataccccaatagaattttgagactcttgaagttcctttttttttttttttaaaccttttttcttttttttgaaacggggtcttgccctgtcaccgaggctggagtgcaatgatgcgatctcggctcactgcaacctccgcctcctgagtagctgggattacaggcgcacaccaccacgcctggctaattttttgtacctttagtagagacggggtttcaccatgttggccagggtggtctcgaacccctgaccttgtgatccacctgctttggcctcccagagagctggaattacaggcgtgagccaccatgcccagccttctttttatttgttttgttttattttttatttttatttatttatttttgagatggagtctcactctgttgccaggctggagtgtggtggtgcgatctcagctcactacaacctgtgcctccctggtggaggaatcaagcgattctcctgcctcagcctcctgagtagctgggactacaggcctgcagtaccacactcggctaattttttgtatttttagtagaggagatttcatcatgttggccaggatggtcttgatctcttgaccttgtgatctgcccgccttggcctcccaaagtgttgggattataggcatgagccactacgcctggccctttttactttttaaaattcatttatttatttttttgaaacagagttttgcacttgttgctcaggctgaagtgcagtggcgtgatcttggctcactgcaacttccacctcccgagttcaagcgattctcctgtctcagcctccagagtagctgggattacaggcatgagccacctcgcctggctaattttgtatttttagtagagatggggtttctccatgttggtcaggctggtcttgaactcctgacctcaggtgatccacctgcctcggcctcccaaagtgctgggattataggcgtgagtcaccacgtgcccggccaacttttggagttctaagaatggcctactggttcccaggtctctcctgaccaatttatctcatatctcttcctgaaattgactgtggttaggcttctgggacatctcagtgcagttgtggtggtagtggtgttactgttttggcctgaatttaatttttcgggttttttttgagacagaatctcattctgtcgcccaggctggagtgcagtggcatgatctcggctcactgcaacctccgcctcccgggttcaagtgattctcctgcctcaacctcccgagcagctgggactacagacatgcactagcatgcctggctgatttttgtatgtttagtagagatagggtttcaccatgttggccagtctgatctcaaactcctgacctttggcgatccacccccctcggtctcccaaaatgttaagattacaggcgtgagccactgtgcccagctgtaatttttctttttcgattacaaaaatatttaagcacatagggaagttgaaagaatagaacaaagaacactcatagacactattcagattgaaaaatggttaatactatgggtagtatttgcattgtaattgtaaatgtggtatgttttttcttttcagaccatttaaaagagtcttagacatcatggcgttttatctctaagtacatcagtgtgtacctgctaaggataaagatattgtcctctaaaatcagaatgctcttgtcacagtcaggaagttgaacagtaattcttatgtatcgactaagatctctctacaataaaagataccctcattaccctcaaaataactttaatgactgctttttcctaacaagaatgcagtcaaggttcatgcattgcatttgggtcttagatgttaagtttgtttctctctctgtctgtctcaccttgcagtgtcctacattctggatttgcctgattcttatcttgtggtgttaagtacttctctgccctgtgctttctttgaagcaggaattgggtctaaagcttattgacactcagattaaacagttgtggcaggaacacttcttgggcggtgatgtgcacttcatattatgtcatatcacggggacatactatccagttgtgtatctatatattagtattaatatcctttctaccaatagcctttcatcaaatgcttttagaagccactggtaatcctttcctgaacatgttatttttattggggattgcaaaatggtgatttttttttttttttttttgagacagagtctcgctctgtcgcccaggctggagtgcaaggtgcgatctcggctcactgcaagctctgccttccgggttcatgccattctcctgcctcagcctcctgagcagctagaactacaggcgcctgctgccacgcccggctaattttttgtatttttagtagagatggggtctcaccatgttagccaggatggtctcgatctcctgacttcgtgatcctcttgcctcagcctcccaaagtgctgggattacaggcgtgagcaccgcgcccggccgaaatggtgattttttgattctgtcattcctgttacgtgtattggctagaatttgtctataaagaagagcttttcctcaacaactaggaacaagctacagttccttcttaaaaagggtaaatgtttgtttccttttaaatacgaatttttagagtaaggcgtttgctgtaacagtcatttcactggtgacagatttttttcccttgttttttgtttgtgtgtgtcaaattggactcatgaatttttatttttcagtattttataatctcacatcattattctttttaatgctcaaatggctctgattttttgcccatattaaaaaaaaaatctatctggctcttccatggaaggaatatttgactgtggtacccagattaggtcatgatcataaactgcattttaagtctttacagaacaaacaagaaaagccaaacaactaaatagaaccaggccccttaagggtagaacagcagaggggctttttttttaaagatgcagttttgttcttgttgctcaggctggagtgcaatggcgtgagctaagctcactgcaacctccgtctcccgggttcaaacgattctcctgcctcagcctcccgagtagctgggattacaggtgcccactaccatgcccagctaatttttgtattttcagtagagacgggatttcaccatgttggccaggctggtctctaactcctgaccttaggtgatccacccacctcagcctttcaaagtgctgggattacaggtgtgagtcaccacgcccacccagccaccagaggggctttgaccttgcagtagaggaagttgtgatcacagagaggatgatgtcatagtgggaggactcctggcaggaaagggccttatagatattgccagttttctgctgtcatccataatgtgtcctgaaaagtttgtatcaaaggtaaatgtgtagaaactaagtgagacacagcatggtgaagagaggttagtaccagaaagccaaacatccctgattacatttgccttacagaaacactctgatgctgtagtcctaactttttataatcagtttttctcccttcctcaaactacagtcattccgtttaagaccaaagaacatctaactggggctgaagattgcctcctgttggccccctcactggtttctatctttgtctgaattgttttcggtttgagtcctgtgcttctaaacgctggattagccttttattttccccctttccactaatttgaataaaatggcaagagtaaaatataagctacgcagacatctccctagtgcatctatattaacaaagatgataatgctgcctaagaggactttccagctggattctgctgcaggaagatacgatgtggggtcagcatgtagcatccaaagaggcccagatttgagtatgtcattgttttggttgtgcattgcagagggaaggtagagggtgcatcctgaggttctcatgcctgcctgtcaggggatttttcccttgtagggattggtagagaaaggggttgctcctccagcaagatgaggattcgactgtcctttcccaactcaggtccctgagctgcggaagaaatctcgccgagagtacctggctaagcgggagcgagagaagcttgaggacctggaggcggagctggctgatgaggagttcctttttggggacgtggagctgagccggcacgagcggcaggagctcaaatataagcggcgagtgcgggatctcgcccgggagtaccgggcagctggggagcaggagaagctggaggccaccaatcgctaccacatgcccaaggaaacccgaggacaggtgaggtgaagcggcgtctgcttcagccttggtccccaagacaagttgtggggaaggcttcaggggattgggcaacacgtgggtcatcccctttcttgccttgccgttcccaatgggcagtgggcgggggtagtaatgggaagaggggagagggcagagaggacatcctgtttttgagtcttcacatatcccctctctctgtagccagcccgagctgtggatctagtggaggaggaatcaggagcccctggggaggagcagcggcgctgggaggaggcgcggcttggggcagcgtccctgaagtttggggcccgagatgctgcctctcaggagcccaagtatcaactggtgctggaggaggaggagaccattgagtttgtccgggccactcagctccagggtgatgaggtaagaggggagctgggagactttctgaggaagacccgtagcgagctatttagctcacacctccttctctttccttaggagccgtcagctccacccacttcaactcaggcccagcagaaagagtccatccaggccgtccgccgcagcctcccggtgttcccatttcgagaggagctcctggctgctattgcaaatcaccaagtcctcatcattgaaggcgagacaggctcagggaagaccacccagatcccgcagtatctctttgaggaggtacagtcatctcacccttcagcttgccagggcacctggcatcaatgtcctcattcctgtcagagctccttttacattatatttttagtagtcacttacctatcttttccactaaattgtgaaattcttgagagtaaagaccatacccttttcacatttctgttctcacttcctgcattcatttcatttggaaggacgggtagatggataggtggagtggggcgtgtataaatgtggacctccctatgctccaacgtggccaaaaaacaaggagttaaaggactattttcctgcctttttgttagttttttttttttttttttggagacggagtcttgctctgtcacccaggctggagtgcagtggtgcgatcttggcttactgcaacctctgactcctgggttcaaggaattctcctgcgtcagccttcagagtagctggaattacaggcatgcgccaccacacctggctaattttttagtagagatggggtttcaccatgttggccaggctgctctcgaactcctgacctcaagtgatccagccacctcagcctcccaaagtgctgggattacaggtgtgagccactgtgcctagcccctgccttattttggagacaggctcttgctctgatgcccaagctggagtgatgtggcaccatcatgactcactgcaacctgggactcctgggctcaagagatcatcccacctcagcctcctgagtatctgggaggtgcacaccaccatgcccatattaaacattttttgtttttttttgaggtggagtcttgctctgtcaccaggctggagtgcagtggcgcgatcttgactcactgcaacctccacctcctgggttcaagtgattctcctgcctcagcctcctaagtagctgggactacaggtgcgtaccaccacacccagctaatttttgtatttttagtagagatggggtttcaccatgttggccaggatggtctcaatctcctgacctcgtgatctgcccacctcagcctcccaaagtgctggagttacaggtgttagccactgtgcctggcctgaaatttttttttttttttttttgagacagagtcttgctctgttgcccaggctggagtgcggtggcatgatcttggcttactgcaacctctgtctcccaggttcaagcgactctcctgcctcagcctcccaagtagctggaaatacaggcatgcaccaccatgctcggctaattttttgtatttttagtagacggggtttcaccattttggccaggctggtctcgaactcccaacctcaggagatccgtctgcctcggcctcccaaagtgctggaattgcaggtgtgagccactgtgcctggtcaaaattttgaatttttaatttttttgtcacactatgttgcccaggctggtctcgaactcctgagctcaagccatcctcccacctcagcctcccaaagtactaggattacaggcatgagccactgtgcccagccttcctgcttttttaccttagctggctctgtctcagctaatctgttcttttccagctcaagtctagcagagtcatgaacttaattacccagagctgggtgaggaccccctttgagggccctaggtctgtcatcctatctatttgcccttcttttctggttttcagcatctgtcttttcctccttttctcctgcctggtttttacaacttctttctctgaaatgtacctggtcccagggtgcatatttagtaaagggcaaacttcttcttttttctttgtcattcagggttatacaaacaagggtatgaagattgcctgcacccaaccccggagagtggctgccatgagtgtggccgcccgagtggcccgggagatgggtgtgaagcttgggaatgaggtgagatttctagggaaccggggggtagagtctggggtctgtgactcagtctacagttccctcaggtccctacagcagaagtcttggtgctgccccacttcacctttccccaagttcctttcagggcacaccagcccacacttggttgctaatggttcccttgaccaggttggctacagcatccgctttgaggactgcacatcagagcgaactgtcctccgctacatgacagatgggatgcttctccgggagttcctctctgagcctgacctggcgagttacaggtatctctaatctctggcctttctctcccttcttcccacccagccaattcagccattgtcttctgattaatccacccgttcttgaatctttgtggttcaaatggtccttgaactgacctccaggtaccacggagatggggctggaggacagaagagattgtagagaaagcctcttctttccccattcatctccagggtttagaaaacaaccaggatagcagagcattgctgccgagacttgaaataccgtgtgaagaccatttgaaaacacttggaatgctcagctcagagggagaaacaggaagcatcctggttccctctaaatatgtgaaggctgttacatggaaagaaggatcagattgttttatgtgaccctacacgacatagctaggagccatggggaggttacagggagacagattccaactcaataccaatggctgagtaaccctcagagtggtggagattgcagggcctgtcagagtggttggactctgggtcttggccctccacacaagtcttgggtagcttggtctgtgaataatgagctcttagtgctggaaatggccaagcaggggttggttgaacatgtgttgagggggaaaagggattcatgaatgtaatgggggtggggtcaggccagctgaacaatatgtgcctttttgactcttcagaggctgtgaatttctggtcttggaagatcacagtggagcaattggacagataggattttatccttcatatcccttgcaaaagatctctaagaacccatggagagccagccagcgcaagagtgtctgatgcagatgtttttgcccatcgagccagcctgctttgtggaatggctggggacttcaccatcacagttagggttaggcacaaagagttgaggtcagggaggtgggtaggggaagatggggatgagttcctgggacttggctgccacccagaaaagccaaagaacaaagagaaagaaggtgtcatgcacataactgagttaggaggaaaccaaggagcatgcagagtcctgtgagagttgaggtagaaaggcttaacttgctcctgtctccaaaagaagaaacagtcaagaatgatgccagcagcagttgtcccacaggacaccaggagcttctaggctatttgaatcacagcagctcaggtctattacccccagtcagccttgctggcccacccttattgaaagggaccctgccttccactttttttttcctttaaaacgtatcagccgggcgcggtggctcacgcctgtaatcccagcactttgggaggcagaggcaggcggatcacgaggtaaggagatcaagaccatcctggctaacacggtgaaaccccgtctctactaaaaaatataaaaaattagctgggcgtggtggcgggcacctgtagtcccagctactcaggaggctgaggcaggagaatggcgtgaacgcaacccaggaggcggagcttgcggtgagccgagatcgtgccactgtactccagcctgggcgacagagtgagactctgtttcaaaactccgtctctactaaaaatacaaaaaattagccaggcacagtggcaggcacctgtagtcccagctacttgggaggctgaggcaggagaatggtgtgaacccaggaggcggagcttgcagtgagctgagatcatgccactacactccagcctgcaacagagcaagactgtctcaaaaaaaaaatccttccactttttcttttttctttttttagatggagtctcgctctgtcacccaggctggagtgcagtggcacgatcttggctcactgcaacctctgcctcccaggttcaagcgattctcctgcctcagcctcccaagtagctgggactacaggcgtctaccaccacatctggctaattttttttgtatttttagaagagacggggtttcactgtattggccagactggtctcgaactcctgaccttgtgatccacctgcctcggcctcccaaggtgctgggattacaggcgtgagctaccaccatgcccagcctaaaacatatccttcaactttttctagtaagagcagctgctgagtctaagcagactcttgactgaactagagggtatggctaacttgtcctggcctcagtgtgcagcctctacatcttgtctcctattatctgctgaggctgggataggttgcagatcatggggccctggccttctctgactttctgttgctctacataagtgggatggctgacttctccttagagccccctccgtcaacagtcattcttgaactctttgtgtccattactcccctctcatccagttaaccctggtgtctgatactgcattgcctagcgctcttccctcattgctctcctattccctccccagcgtggtgatggtggatgaggcacacgaaaggaccctacacacagacattctctttggattgatcaaggatgttgctcgcttccgacctgagctcaaggtcctggtggcttcagccacaatggacactgcccgtttttccaccttctttgatgacgcccctgtgtttcgaatccccggacgcaggtttcctgtggacatcttctacaccaaggtgccccctcagggaggatgggcttaagtctgtggcagaaaagctgaggcctttggagaaggttatcctgtggagggaaagatggaatggaaggttcaaaggggaactaggataaagtgtatgttgaattgggaggagaggaaaggtttgcctaagcaggtggccctcctgtgaccccatctctttctgctctccaggctccagaggctgactacttggaagcttgtgtagtatctgtgttgcagatccatgtgacccagccccctggggatatcctggtgttcctgacaggacaggtgcctgacatggtggggagaggggatgatgtatcccaggggaagacagggccggcatgttggccttctgtgactctgggacccctgctgctctccctaccctctatccaggaggagattgaggctgcctgtgagatgctccaggatcgctgccgccgcctgggctccaaaatccgggagctcctggtgctgcccatttatgccaatctgccctctgacatgcaggcccgtatcttccagcccacaccacctggggcacgaaaggtcagttggagaaacccacactcttcacccctatgcttcccacaactagtagtgaaaaagctgtgtgcctgccccatgcaaggtgagtcctgcgcactgctgcacacagctgaggagcagccagtcccttgttcctgggactgaagagaggagaaatatggtgtgaaccaagagagagccaaatatgtgatctggaaagtatgcacagtagattcagtggagaagggaagtccttgatgtgctaagaggtgggatttgatatggacctttaagagaaatgtctgaggtcaggtgcggtggctcacgcctgtaatcccaggactttcggaggctgaggtgggcggatcacttgaggtcagtagttcgaaaccaggctgcctaacgtggtgaaaccctgcctccactgaaaatacaaaaatcagcagggcatggtggcgtgcgcctataatcccacctgtttaggaggctgagtcatgagaatcgcttgaacccaggaggaggaggttgcagtgagctgagattgtgccactgcactccagcctgggtgacagtgcgagactccatctcaaaaaagaaaaatggctgagaagtcatcagaggaaggcccaaggtatgtttgaggtcagagtgtgagctagtaggcttagtgggaggttcatgtggtgaaggagtaggagacaaggctaaaaacaatttggggctaagattagggagggcctttgatgacaggaaagtttggactttatttatttttcttttttgagacagagtctcgctctgttgcccaggctggagtgcagtggcaagatctcggctcactgcagcctccacctcccaggctcaagtgattcttgtgcctcagcttcccaagtagctgggattacaggtgtgtaccaccaccccaagctaatttttttttttttttttttgagatggagtctcactctgtcgcccaggctggagtgcagtggcaccaactctgctcactgcaacctctgcctcacaggttcaagcgattctcctgtctcagccccccagtagctgggattacaggtgccctccaccacgcctggccaattttttgtatttttagtagagatgaggtttcgctattttggccaggttggtctcaaactcctgacctcaggtgatctgcccaccttggcctcccaaagtgctgggattataggcgtgagccaccatgcctggccaacacccagctaatttttagtagagatggggtttcgccatgttggccaggctggtcttgaactcctggactcaagtgatccgcctgccttggcctctcaaagtgctgggttacaggcatgagccactgtgcttggcgaagtttggactttagacagctgagtagcagtcaaaggattttgagcagagatataactttcattcaacaaatatttaatgagttccttctgtgtgtcaggtacacaggggttgatgatacagtgatgaacaaaacaaagtccttagcctaacaaacttgcacttgtggtctatcggggaagcagtggatgcataaatacatattgtcaatttgtggccagtgctatgaagagatacaaggcagcatagtaggatggaacttgactctgtggggtgggagtgaggactggcatgaaggtattttccttggggtgtagggagggcctcttcagtaaggggaaagtggaatagagacccaaaccaggtgagggagggagccaggctgatatctgggagaagagtatgccagacagagggaatagctgatgcaaatgatccagtgaggagtgcacttacttgggcagagcaaagcagtgtgtgggaggagtgagggaggtggtggagtgctagcagatgaggtcagaaaggcagctggggtaggtgatccaggcttttaaggggcttggattgaattctagagtaggataggaagccactgaaggatggggagtgatgtgacaggtttgtattttaaaaggaccatcctggatgccatgtgacagaggctaggagcagaagcagggatacacgttaggaggctcttacaggaagtgttgtgtgaagacgaaagcggtgatggggaggatggggcaggaacttgaacacccccatttcccatctctgaaaaaaaaaaaaaccctaaatcctcttctccatttcctttcctcctatggccctgctgactcccagcccccacttccctgtcccctgtcttctggccttgtcccctgctcctgaccttggatactactaattccctcagctcctgccccttactgcaactgcttcactactcctaactttccaagattactttttctgggtaactaggtaggtggggtcactgggtgaccccatatcctatcactcaggtggttgtggcaacgaacattgctgagacatcactcaccattgagggcatcatttatgtgctggatccagggttctgtaagcagaagagctacaacccccgcacaggcatggaatcgctcactgtcacaccctgcagcaaggtcagcctggggatgcatgggagtgggggaggtggagttggcccacagagaaggtccaactcagaagcagggtgggggcttcctagggaaccgggatgagcagtttgcatccttccagatttcttgcataaatactgcctttttcttttccctgaccaaattgtcagccagcctgttcccctttctttccaggcctcagccaatcagcgagctggcagggcaggtcgggtggctgcagggaagtgcttccgcctgtataccgcctgggcctatcagcacgagcttgaggaaaccacagtgcctgagatccagaggaccagcttgggcaatgtcgtgttgctgctcaagagcttaggtgattgggctacctgagagaggagggaggggctggagtcactgtcctttgaagggactctgttccatccatcacacctctttctagggatccatgacctaatgcactttgatttcctggaccctccaccatatgagacactgctgctggctttggagcagctgtatgctctgggagccctcaaccaccttggggagctcaccacggtgagtcggggggcagcatgggtggaggcaggatgataggggtcaggatggctccagggacccctgtagtagtagcgggaaacctgagggaggactgggctcaactctctctctcttctccttagtctggtcgaaagatggcagagctgccggtggaccccatgctgtccaaaatgatcttagcctctgagaagtaagccctcgcctccacctgggcccccagcacacaaacaggccaggcctcctctgtctccagggtcccctttgtctgtctttttctgttcatcatactatcccttaacacataataaagtattagataactctgattgcccccttttgaggcccacaagggtaagacacttgatcctatccttgattccactgcgcccggccccttgaggaacttacttgttcctaaggtttccaactagaacatttagatgtagctgtggagggatgacctttaaatgccattcctctgctgtcagagatcttttccaaatgcacatagtgaatgcacactttctgcagaagcctcagaattccccggtgtttcctgctcctgcctccatggatgtccctcctttgtgactgtgtttcatctatggcccctacttccttgacccccaagctgctgccagaatctatctgctggctgctttgtagccattatgccaaccagccttccccacatgaggaaacatccatcacacagtgatcactccccactccaccatatctgttcctatgtgtcttgctttgaactcatgctttccccttcctgtcccaggtacagctgttcagaggagatcctgacagtggctgccatgctctctgtcaacaactccatcttctaccgaccaaaggacaaggtcgtccatgctgacaatgcccgtgtcaacttctttctccctggcggtgaccacctggttctgctaaatgtttacacacaggtcactgggcttgggtgagtgggaatgagagacactgggggactttagtcctgctgtatacttaattatctctcctttctttttaactgtcttcccagtgggctgagagtggttactcttcccagtggtgctatgagaactttgtacagttcagatcgatgcgccgagcccgggatgtgcgggaacagctggaagggctcttggaacgtgtggaagttggtctcagttcctgccagggggactatatccgtgtacgcaaggtcagcatttcttcagcctcctgctttccacccccagtaccttcccaggagcaagcttctctgggggcatgcagcatttcctccagcgtgagagcatgccctcttccccttgtgtatgacgtgtcctcccagggccctttcttccccagaccactgaaggttcattcctgggaagttcttcatgcattccttacctctctagttttcctgaagcctgaactaaaaaggtagtgcattcttagggtccccagatgtctgccttttccattgattttctttcctgcccgctccttaggccatcactgctggttacttttaccacacggcacggttgactcggagtggctaccgcacagtgaaacagcagcagacagtcttcattcatcccaactcctccctctttgagcaacagccacgctggctgctctaccacgaacttgtcttgaccaccaaagagttcatgagacaggtgaggagaacatcctgtgcccacgcaggtggagactatgtagagagatggtgtcctggcaagctaagaacccaggttcaagttgctgggactggtacagaaagaggaaggtagggtaaaatagaaagacatcctttgtttttttttgttttttttgagacggagtctcactctgttgtccaggctggagtgcagtggcgcaatctagcctcactgcaacctctgcctctggggttcaagagattctcatgcctcagcctcccaagtagctgagattacaggcgcaagcctccaggcctggctaatttttgttatttttagtagagatgaggtttcaccatgttggccaggctggtctcaaatgcctgcctcggcctcccaaagtgcagggattacaggtgtgagccaccatgcccagcccaaagacatcctttctaacaggtgtgtcagcatcttccaagatctgagaactagacacttattcaataaatatttgaatggctactgtataggtgctggggctataatgaacaaagcagtctctggtctcacagagtatagtctttatgttctaggcttttcttttttttgagagagttccgtgctgttgtagcccaggctggagtgcagtggcaccatctcagctcatgcaacctccgccttcggtttcaagtgattcccctgcctcagcctccagtgtagctgggattacaggtgcccaccaccacgcccagctaattttatatttttagtagagactgggtttcaccatgttggccaggctgatctcgaactcctgacctcatgatccgcctgccacggcctcccaaagtgttgggattacaggtgtgagccactgtgcctggcatgttgttctagacttttcttgggaatagcttatttggtatcttgaataacatacagaggtgtatctgccctttgggtatataataatagagccaggcacctttacacctagccctgcagtcaaagaggaaagataacttttgaccatacacataaggatctaggttggggctgggcatagtggctcatttttgtaaaccatcccagcactttgggaggccaaggcaggatcctagcactttgggaggccaagatcagcccaggcaacatagtgagaccccaactatacaaaaaattaatggtgcactgtgatgtgtgcctgtagtctcagctacttgggaggctgaggcagtaggactgctttgagccatgatacgccactgcagtccagcctgggcaatagagcaagactctgtttcaatttaagaaaaaaaaataacaacaacaaaagatctatgttggaaagaagggaactccattgatcttttctctctcctaggtactggagattgagagcagttggcttctggaggtggctccccattattataaggccaaggagctagaagatccccatgctaagaaaatgcccaaaaaaataggcaaaacacgagaagagctagggtaagagaaggacgtaaacagaacctgacaccagctccttttccttctatacattatttaatacctattaaataaaattatttttggaataaagcttgtgggaacatttgggatctagagaaagtgatatgtgaaattctatctcatatagtcagttaaactttattatttacaagttaaattacacagcagctttacacagcatgagatggaaaggaaggaaggagagaaacgaggagaggaagctggctcctgagattcttggctgcctccacctccttctcttgggcgtagcagtcttcagtgctgcctccactccaaggtcaaggatcagggcttggaacacaggtttaagtcaggttctggctctgacagccccagggccaccagggctcccactagcagcttcttcacaggcgttggaggtgagtgtgaaggcatcagctgcagggagaaaggttaatgccagttgggggaggcacacaaatgttctaccctttaccccacccagccctacctaggactcactttatctagacgatggcgacaaatgaggccactggaattcaggtagaaagtggagtaggcatcataggtcctggggaatagagggaggcttactgagggagaaggtgactggtcccaaagctgaattcaagcatttgtttaaacgagtagtccctaaattctgctacatattagatcacctgggcaacttacaaacatctcagtgcttaggttgtgccctgtctcaattaaatcagagtgtttggcgtcaatattttttaacgatccttgggcatttctactgtgcagcagtttgggaactgctggtttaaaaacttatatccaatgtttgtggctgagtctaacaatttattgggattctactcccaggcggaaatttaccaggttgtaaggctcaacatatgagacaggacttttcatttgttcagtacttttgtgtgtgtgtgtgtgtgtgtgtgtgtgtgtgtgtgtgacagggtttcactctgtcacccaggctggagtccagtaatgtgatcacggctcactgcaacctcaacctcccaggttgaagtgattctctcatctcagcctcccaagtagctggaactacaggtgtgtaccaccacactgggctaatttttgtatttttttgggttttaccatgttggccaggcaggtctccaactccttacctcaagtgatccgcccacctcggcctcccaaagtgctggcattacaggcatgagccaccacacccagtctgttcagtaagtatttgagtacctaccatgtgctaggcactgtataggaagaaactgaagctcagaggtttttctaatatacccagtctctattttttttttaacattaacataaactaaacaggatccctgtccttaaacagtcaagtgaggataggtcaagggttgtctgggagactagatcatctgtaatctcagcactttgggaagctaaggcaggtggatcacctaaggtgaggagttcgagaccagcctggccaacatggtgaaaccctctgtctactaaaaatacaaaaattagccgggtgtgatggtgtgcctgtaattccagctacccaggaggctgaggctggagaattgctggaagccgggaggcagaggctgcagtgagctgagatcacgccactgcactccatcctgggtgacagagtgagactccgtctcaaaaaaaaaaaaaaaaggaactgattatagtttgggtcctttctcatttctctcttaccggtaatgctcgtctttgtcacgcttgtagaaccgcaaaaagagcaagtggacgggcagccccacaagccgccaccgggcttgcagggtccagttctcagggtggcgggtcagctgtaaaacctccaaacgaaggtgtgcaaaataattccaggccaggaaacggcagagggtcagtgaaagaatgtaccatgtccggcccctgtgaagaagggatgggaaagaaatctcatgatggcagaattagaaaaccaaactggcttctaaggaatggggaacagctgtgagaagcagtctaggaacttctctgggaagtgaaaagggtcatgtatatacctttgggtgcttttcctccccagtgccctacctgtgccccaattctcacttggtacgtatgttgaggatctcattgatgaattccacatccaaggaatacagactgtagtcgtgggactgaaggaagagcttgggaagctaggtggaagaagatggcatcaacccagtgggaaagaaaagataatcctatttttcagttttctaatttttttttttttttgagacggagtctagctctgtcgcccaggctggagtacagaggtacaatctcagctcactgcaacctccgcctcctaggttcaagcgattctcctgcctcagcctcccgagtagctgggattacaggcttgagatggagtctagctctgtcgcccaggctggagtgcagaggtacaatctcggctcactgcaacctccgcctcccaggttcaagcgattctcctgcctcagcctcccgagtagctgggattacaggcacccaccaccatgcccagctaatttttgtatttttagtagagacggggtttcactgtgttggccaggctggtcttgaactcctgaccttgtgatccgcctgcctcggcctcccaaagtgctaggattataagcgtgagccatgtgccaggcccagttttctatttttaaggcctccttactcccatcttggagtgaaagatctcatcccatgattaacctcccttaacccaaaatgaggaacatcattttctttctttctttttttttttgagacggagtctcgctctgttgcctaggctggagtacaatggagatacctcctttcactgcgcctcctgggttcaagcgattctcctgcctcagcctcctgagtagctgggattataggcgtctgccaccatgcctggctgatttttgtgtttttagtagagatggggtttcaccatgttggccaggctggtcttgaactcctgacctcaggtgatccacctgcctaagcctcccaaagtgctgggattacagcactttgagccaccgtgcctggctggaacatcattttctcaggaaaatgtttataatatatttctatgcctgcctcatggttccaaaaaagaatccagttgactatccctgtacgtccaaggattacccacatccttcccactgtagacgaaggccacttttgcactgacttacctcttgtctcagtctctcatacatgacagacagatgttcctccatactaggatctcctgacggggtggcaggggaagggtgggcagttccagggacttggaaaggtatccaagccccaggataggggcagggaggtccctcaaaaaggcttctaagcccatccaggcagccgctatgcaactcaggtcctggtccctcctccccctttcctggagggagaaccacccatgctgagctgagggcctggatctgagggagaggtagtgggggaacctggggaagacgctgggtgggaaggcgtgggggcaggggagaccagaatagaggagaagatggggaagtggttgtcgtggagtggggccaaaggggtgggaatggtagagtccctggataaagctggtcctaaggagaaagaacagaagggagaaagataagaatccacttgtctaacaccccttgatcccctggatgctcaacaggcttccaatacctattcctcctgacagaatggatggaattactataggaaaaaagggatggattcatctccatctctactgaaaacaggaggaaaccattttattttattatttattttgagatggagtctcgctctgttgccaggctggagtgcagtagcacgatctcagctcactgcaacctccgcctcccgggttcaagtgattttcctgcctcagcctcctgagtagctgggactacaggcgcgcgccaccatgcccagctagtttttgtatttttagtagagacaggatttcaccatgttagccaggatggttttcatctcttgacctcgtgatccacccgcctctgcctcctaaagtgctgggattacaggcgtgggccaccgcgcccagccgagcaaactgttttatgtgacataaataccggcacctcccaaaacctagcagacattttacttttttttctttttttgagacgaagtctcaccgtcgcccaggctggagtgcattggcgcgaactcgggtcactgcaaccgccgcctcctgggttcaagccattctcctgcctcagcctcccgagtagctgggattacaggcacccttcaccacgcccggctaatttttgtatttttagttacagatggggtttcaccatgttggccaggctgttctcgaactcctgacctcaggtaatccgcccacctcggcctcccaaagtgctgggattacaggcgtgagccaccgtgcccggcccagtgttggaatcttaaagaaatgtggccgggcgcggtggctcacgcctgtaatcccagcactttgggaagccgaggcgggcggatcacgaggtctaggagttcgagaccagcctggccaatatggtgacaccccatctctactaaagatacaaaacaattagccgggtgtggtggcgggagcctgtagtcccagctactcgggaggctgaggaaggagaattgcttgaacccaggagacggagattgcagtgagccgagatggtgccaatgcacttcagcctgggtgacggagcaagactccatttcaaaaaaaaaaaaaaaaagattccaacactgggggcagtttcacctctcttatcgcaagaatcatgtaatacatacttgatgagttaacgaataacaggttttattgtactgtggattaaatgctgtggcctgtacatctccatgattaagtgtgcgaggcaaatgtacagagaaaaaagaatatccagctgaagctaggaatctgaattctatcatgtaactttaggcattctcattccctatgcctccgcttcctacaaatgtcctataaatgagaacaataaagcctcactgggttatgaggcctatatgaaataatgaatgtaaacaaaacgtagcgacctagaaagcagtacataaatggaagctattatcatttcgggcccctctaatgacagacacaacctcaggagacagttaaaggctggccttcactctcctgggtttaccgacgttgaaactgcaaggggaggtcacccaaagttaggcctcacccgagtccctccgctcccaaggaaccccccaggggatcgtctcactgcagggaaggcgggcggaccgctcgggtacctcggtccccgatggtgtcctagaggcgccgtctctgctgggggcgtggccatcttgccagcccgggcgcaggggcccgaaccgggtgcacactggccggccttcctgccaggaccgctctccgagtgcaagacgggcgggctgctgagggcgccccgcgggtctggtctgggccggggaactccgggacggcgccgcagcagggctacgaatctctcggcccctgcccttcaaatcacctctaggcacaggtaaccgcggagagtcgggcgcaacgcagacgcgccccgctgcctggccttgaccccgcctgaccgccctcaaacctgggaggaccgacgtccttgcgcgacaggcccggcaacgcctccctcccgctcccgcgacccctagcctgtccacgcgctgcagggcacaggtgggaaggggcggcgggtgtctctgcgcctgcgcggaacccagcgcgcgctccgccccacgcaccggctttgaggagggtctctccccgccccctctcctccctccctcttctcctccgctcacctggggtcgagcctggtaggcgcgcaggcaagggccgagacgccgggccgcaccccggctgggctggtacatgatcttccgggagtggagaaggagcctcctgagtccgacctccggcctcctcacaggggtgagcgcgccccagagccggc

SEQ ID NO: 11831 - DNA, 134 bp, Homo sapiens
ccagctactcaggaggctgaggcaggagaatcacttgaacctgggaggcggaagttgcagtgagccgagatcgtgccattgcactccagtctgggcaacagagcgagactctgtctccaaaaaaaaaaaaaaaa

SEQ ID NO: 11832 - DNA, 20247 bp, Homo sapiens
atgtcccgcgcttgcgcactgcaggctcgagggaagcggctgaagcgctctgtcggctgtaagcgcgcctgcgcccgcgggctcggagactgcctgagtgcgcttgcgcaagttacagcctcccctgcccccccaagcgctgtattcacagctgaggcctttgagcaaaaagctgagcaaaaacagggctgaaggctgaatgggtgcaacgacagtgaggggtgaggcggctgaaataatgagtcaaatttttcaacagctcttgtgataaaaataaatacttttattggtctggttaaaagatacaaatgacttgaatctgataagcctgctgaatgaatgaatgaatgaatgtatccatctattatgagggttgggctttggctctttcctgtagtgagggagaaataatactttgaagatgtttgacggggctgcggtcaccaaggcctggtgctgcgacgttcctgcaggtttcgaatgaacctggcgttgagtatgtccccacccactgtccaggactgggctggcggggccggggcctgtggaggagctgtgtgcatgggcttctccccagacccatcctgtgacaaggcctgctcctcactggcagacctggtaggtggggagatggagagtgggttataggaatactaaagaggaaattaagattacagactcttcaaggtctcgggccaggttttaatgtaggacacatgatgggtatgaagctggaaccattagtgctatgtccaaatttaaaacctctcagagaatccgtattccaaagggaagtaccagagttgaacctgtgggggaaaggggcttgcaggatgtaaggtagaaggaattgtgggaggagctggtgtccagttcatacgataagatttaagagtaggaagtgactgagaatgatgttaggaagggagtcagatggtggtgggaggctgttaggggaggggtttagacctcacctattctttgtttcctgttctccctgcttggagtcttggttgcctgtggaaatatcaggcatgtgaatgggaaggcaggagtagacagtgaatgtggcctacttgatttgagggtagggaggagtgaatacttacctgtattgggggatgaggaattcacccccccatggcggctgtagcagcagctttgggctaccagacctgggggagtccccctgtagaagaaatgggagatgatggggaggaggctactggatgaaagatgggtgggtatggaggaatcagaggagaggagtaaaaggaatagcacaggaacaaagagaagggggtaattatcattcctaacaggttttaatcaaagctgtgccccagaaaagggcgggggaagttcattttatacccaagattttctggagtgcttctgatttattgctctattctttctagttgaggtaatgtgttaaatctatggctaggtgtgatccaaatcatgtcagaagaacagactcacatgtggtcaaaaatgtgttggatcgggtactctggtgtttggtttggaaaacagggttaccttaactataagattccttagaccaggctgggcgcggtggctcaggcttgtaatcccagcactttgggaggccaagacgggcagatcacgtgatcaggagatcgagaccaacctggccaacatggtgaaaccccgtctctactaaaaatacacaaactagctgggcacggtggtgcacttctgtaatcccagctacttgggaggctaaggcaggagaatcgcttgaacccaggaggcggaggttgcagtgagctgagattgtgccactgcactccagcctggcgacagagcaagactccatctcaaaaaaaaaaaaaaagattccttagaccagagggaaataggaagtgacaaggctgaattttgaatttaggaggaaaaggaagggggcctctgtaaatagggtgacagactgtgttgcactctcaatggaggtaagggtttgtcttgagagagatccagcggtttagtggagcagacgtcaggtaatcagagtgggaagacgaatacaggaggcaggaggtaattagtggatccagagatgttggtaagctttgacatcttggcaaaggcacgcccagagtaaagggtagaagtcactggggagagctggaggttcctggagggaatgagggagtagatacggaagcccacacacagggatccagcacctacatgaaaggagacacagaatctgcaggaggactaacagtgaagatggggataggcagacaccagactcaggagctctgaggctcctgggtaaaagatgtgcagatctcagaagtgagaaatgagagggacagaggtcctgagatcctaggaaaataagggatgacgcacaaatgaggctgacaacttttttttttgtgattctttttttcattgaaaatgtcaatttagaaaacacaaaagatttcacactttattcagacaacactgagagaagaaaagggaagagtgagtaggggagatggggagatccggctcccaaggatttcaggaaacacagtggggcacctgatctagcacacattcagagggtagggaggggaagggatctagctatactctgggcatggagcagggaaggtcgtccttgctatggaggaaaggagagaggaaggacagaggaagagtggtcccccatctcatctcgacaatctcacaagacaggagtatatcgggacctagctaccagggagggatggatgcaagaagggattccaggatctaacagatccttgacactctggatctactctcaagaaacaacctccctcagagaatctggatctgggggaaatggtggtgtcagccaatctcctttagagaccccaaagcaacaccagtttggggttccctgacacctacacaaaatgtggaaatgaagagtttggcaatggtgagtagatccctttgggaagctggtaagtccctgttctacctaactagactgctctgaagcagagcttgctcactagcggccattcgcaggctcaaagggcaagtgtggcaggcagcacaaagcagtattagagccaccagtagacactagagggaatatggggtttatcccatagataaaattccttaaaaagtttccctggcacaggatgcccttagaccttccatggtgttctaaagtttgacagcaagcaagagtgtgcttctctagataaatgtatgagccatctaactaagaagtctggcaacagatcagacttcctgttgggaaagtattcagagcccaagttaggagagaaggggtgcttttgtgttaagaaaagctacaaagtgttaggcagtttgagaccctgacatccctgctgtctaagaaagtagaagagggaatcctatgggctctgtcaggttccactgggtcctacaggatgcaatggaagagtgggtctgaggttctcagggaggggttccctgcccaccccaggtctcccagggcagggagagggtagctgttagtatcgactctcctcagagcggggaagggagctgtggaaggatgttatggatgggaggaagggagatgggaaatggcggggggcgggggagagaaaaacagagaagtcagaggtgaagagaaagggagagaaataaaggaaatgcccactccctgcctgctgcgatggactcttggcacacaagccagtggcttcccactctctgtcagacactgccccttccccagcaagtattaagcgaagattttcccaatcttagaaggctctgttcccccaacttgatggatctcggtgttcttcctaccattccacataactctcacattaaagccagggtccctaggctccatataaggtcctattctgctccttcactgcatttttttcccagatcacttgcacaaatatttttcttgaaaggtttcaggaccccccccaagccacccatcttattgatccatctctctgatggattcaaattgccctttgccatttctaacatcctcttttatagctgtgaggctccttagcccttcaactcctattacctggtgcgacgacgttgagctgggctgcccccagggtcagcagccaacagaaggcgggcggtagggtgtggggggcagaggcgcaaggaacgcagcagctcctgctctggcacaaaggggcggaggggacctcgttctggtgagtttcccaggctgctggagcgggggggtgggtgggctggaggtgtggcgcggcgaggggccctgtttaggggccaaggaggctccacagctaccttcagaactggggacagggagaatgaagagcaagacagaaaaagaagaaaaacggaagagagtcatgacagcaaaggttttggtagaaaaaaagagaaatctgagtctttcttttttttttttttcttttttgagacggagtctcactctgtcacccaagctggagtgcagtggcacgatcttggctcactgcaacttccgcctcctgggttcaagccattctcctgcctcagcctcccaagtagctgggattacaggcacgtgccaccgtgcccagctaatttttgtatttttagtagagacggggtttcaccatgttggccaggctggtcttgaacccctggactcaggcgatctgcctgccttagcctctcaaagtgctgggattacaggcatgagccaccatgcccagcccaagaaatctgagtctttagagagaacgaatcctttccctgggtcccctgagcattctcttcccttgtgttaaggtaccccaggcccagacaccccacccttgcccctcttacattctcggtcactagaggagtatggcttgatgtctccctctgctctcttgggtggcagcttccttgctggagctggcagtggaggggacataggcagggtaagcgttaggagacatactttgcacccctcctcccagccactataccccaaccccaaacctctgctccctgacaccacagttcctcctgagaacttgcaggagcagcaccatggcaatgccagcacaccaaaagggaatttgaggggaatgtggaacactgttgaggaaagccagaaggagtaggccaaacacagagctagggagaaagatcgaaggggagactctgggggcctgggagatgcaggagaagggcagccaaggggagtgagctcttactgtcagtgggtgctgtcacggccccctggtattctggggcagtggaatggtcccagccgggccaacgaggaccctgggttcctctggatgagatggacaaagcccttggttaatcaggaattgctctggagaggtcaggggaggtttggaaggagggcacaatctctccttcctatacgaaaatgggaagagactgaagttttattaggttaaaaaaaaaaaaagaaaataaatatgggcatctgaaagggagctatcagagtaagcaggaggctgatgtaatgtccaaagttcagcctccccctcctcacttctctacttgctcccggctttccctctcaagagattctccatcatgtatgtgtggcaaatgaaagacttctcagcaaattcacttaagctttatccacagcaccctcccctgcaggcctgagacctcaccatccttgttggccctcagtccctctcacagcctgtggttctgaacaagctaaatgggagaagccttggaaaccaaagcgagttgaggtgcctctcagtgcctgacactgtgatgctcatagctggttacagactgctgtttggatggtggttacatcctttcctggccacagagccagctcaggaagggggctcttctgtgcaagcaagcactgtacagctgtcagaagttggtaaggtggaggtggtgaggaagaggaaggagtggggctcagactgtcagtaagtgtgtttgtgtgtgtgtgtgtgtgtgtgtgtgtgtgtgtatatgggatggggaatctggacagcattttagtgcctctgaggtttggtttctccatatcaatttcattatctggttggaaatgttataaactctgagtgttatcttctaaaagtaacatttaaattttgggccatttgtgtcactattctgtgactgcaaatggaagggctgtttgcaccagcctgtccctcactggctaacagaagcctggggtttacaaaggagcctgactctggcctatgttgacggacctgaactggcaagagggtccattgatatcagctgtcaaacaggctcccaatgagcttgcttagttaaaagtcttgccaaatataaaatgcactgagctcccatgagggcaaaggcaaacagtcatgactgctggagacttgggttgctttagaattttccaaaattgcccacagatggcactgtaccccgtggcatctagagtaagtagccatcactgcactacagttccaccccttcaatacaggctttaccagcgggcgtgggatcgactgcagcagcacgagagtgtcgagttgccctcagagagggagcagggggccctgtgaggaaggaagcggcggggcccctcagtgaggggccggcaggaccaagagtccagctctttcctttccctcaccccgactacgtgaccaacaaaatgcaaaaacttacgatgttgatgggcaaagaagccttcaaagatcacaaagttgttcacctggaagatgaaacaaacaaaatacaatcatgcatcacttaacgatggggatacattctgagaaatacgtcattgggtgatttcattgtgtgaacatcacagagtgtacttacacaaacctagacactatagcctacaacacacccagactatatcatacagcctattgctcctaggctacaaacctgtacagcatgttactgtactgaatgctgtaggcaattttttttttttttttgagaggcagagtctcgctctgttgcctaggctggagtgcagtggtgccatcacagctcactgcagcatcaacctgggcttaaatgatcctcccacctcagcctcccaagtagctaggaccacaggtgcatgccaccacatctggctactaatttttttttaactttttgtagagatgggggtctcactatgatgcccaggccagtctcaaactccagggctcatgtgatccttctgcctcagcctccaaaagtcctgggattatagacgtgagccaccatgctcagccagctgtaggcaattctaacataatggttcagctgatgtatctaaacatacctcaacacagaaaaggtacagtaaaggtcaggtgcggtggctcacgcctgtaatcccagcactttgggaggccgaggcgggcggatcatgaggtcaggagatcgagaccatcctggctaacatggtgaaaccccatctctactaaaaatacaaaaaaattagccggacgtggtggcgggcgcctgtagtcccagctactcgggaggctgaggcagcagaatggcgtgaacccgggaggcagagcttgcagtgagctgagatcgtgccactgcactccagcctgggcgatggagcaagactccgtctcaaaaaaaaaaaaaaagaaagaaagtgaaaagacaatctacagaatgggagaaaatgtttgcaagtcatacatctgataagtgcgttctatctagaatatatgaaaaactctcagaacaaaaaagaacacaatttaagaacagacaaaggacttgtataaacttttctctaaagaagatacacaaatggccaataagcacataaaaaggtgctaaagtccaggttcagtggctcacacctgtaatcccagcactttgggaggctgtggcaggcatcacttgaggtcaggagttcaagaccggtctggccaagatggtgaaaccctgtgtctattataaatacaaaaaattagccaggcatggcagtgtgcacctgtaatcctagctacttgggaggctgaggcaggagagtcgcttgaacccaggaggcggaggttgcagtgagccgagatcgtgccactgcactccagcctgggcaagagaatgagactccgtctcaaaggataaataaataaataaaaaattcagcagggttccaaggggtggggaaagtcaggggaagacatgctggaggccaggatgctactttgataactagtaactattaattttagagttacttcattatattttcacatttaatttggccttcacaatcctggaagtcactatttgaaagaaggttgggggaaatacagccttggagacatggcttcgcttggccaatgccaagtagctacaagtggcagggctgggcctcaactttcagacttctgattccagctgcagtgttttagccaggaaaatagtgtagccattaagagtttactcaagaggagagcttgcagtgagccgagatggcaacactgcactccagcctgggcgacagagagagactccgtctcaaaaaaaaaaaaaaaactcgggggccaggcgtggtggatcacgcctgtaatcccaacaatttgggaggccaaggcgggtggatcacttgaggtcaggagttcgagaccctgtctctactaaaaatacaaaaattagctgggtgtggtgacgtgcgcctgtaatcctagctactcaggaggctgaggcaggagaatccattgaccccaggagggagaggctgtagtgagctgagattgcaccactgtacttcagcctgggtgacagagtgagactccatctcaaaaaaaaaagtttaatgggggctgggcatggtggctcatgtggatagcttgagcccaggagttcaagaccagcctgggcaatatagcaagacctcatctctacaaaaatatttttaaaaattagccaggcgtgggccgggcccagtggctcaagcctgtaatcccagcactttgggaggccgaggcgggccgatcacgaggtcaggagatcgagaccaccctggctaacacggtgaaaccccgtctctactaaaaatacaaaaaatcagccagccatagtggtgggcgcctgtagtcccaactacttgggaggttgaggtgggaagatcttttttgagatggagtctcgctctgttgccaggctggacttcagtggcaagatctcagctcactgcaacctccacctcctgagttcaagcgattctcctgcctcagcctccggagcagctgggactacaggcatgcgccaccatgcccagctaatttttgtattttcagtagagacagggtttcaccatgttggccaggatggtcttgatctcttgacctcgtgatccgcccgccttggccttccaaagtgctggggttacaggcgcgagccaatgcgtccggcctttttttttttttaacatggaatctcactctgttgcccatgctggagtgcaatggtgtcatctcggctccctgcaacttccacctcccaggttcaagctcttctcctgtctcagcctcctgagtagctgggattacaggcacatgccaccacgcccggcttatttttgtatttttaatagagatggggtttcgccatgttggccaggctggtagggaagatctcttgagcctaggaggtagagactgcagtgagccgtgatcgtgccactgcactccagcctaggcaacagagcaagaccttgcctcaaaaagaaaaaaaaaaaaaaagttcactgggtgcaaatggctatgggttcaaatgtggactctactatttactggctgtgtgaatttggttaagtcattaatttgtataaacccaaaataggtttaataatagtacctacctcaaaaagatgtgcaagaatccactgagatgatgcatatagataccacatagagcccatgaaatgtgaattattatttacactctatactgctctggccttacatgttaactgggtaatgtgtttcatatcgaatactgtgctccaggaccgggtatggtggctcacggctgtaatcgtagcactttgggagaccgaggtgggcggatcacttgaggtcagaagttcgagacgtctggccaacatggtgaaacctcatcaacacaaaaattagccaggtgtggtggtgggcgcctctaatcccagctactcaggaggctgaggcaagagaattgcttggactcaggaggcagaggttccagtgagctgagattgtgccactgcactccagcctgggcgacagactgagactccatctcaaaatacaaacaaacaaacaaaaaaaaactgtgctccttccactgctctctgttgcctcttaatggaaaaatatactgtaggaagaccctgcctatcccttgccttgaccttgttgtaatgtctaccagcccatcctcatcacccccaccccccaacaagcacatgcccagcactccaaccacaccacactgcttgtagtgtcctgaaaggtggtttatttttatttatttatttattttttttgagacagtgtcttgctctgtcgcccaggctggagtgcagtggcatgatctgggctcactgcaagctccgcctcctgggttcacgccattctcctgcctcagcctcctgattagctgggactacaggcgcctgccaccacgcccagctaattttttttgtatttttagtagagacggggttttaccgtgttagccaggatggtctcgatctcctgaccttgtgatccgcctaccttggcctcccaaagtgctgggattacaggtgtgagccaccacgcctggcctgaaaggtggtttaatacctttctgcctttgctcatgcctgttcctctacatgaaatgcactttagccttttgtccacctgacaaacacttgcctttcaagattagacatgtcatctttctttacccaacccccagcccaagatagcactcaaatccatgtccttatgcctcctctgtaatcacatctatcaaatcatgttacaatggattaactgtccatgttcctatccaaggctaacttgtcaaccaaatctcaacgcccccgccgcccattcaatgacatcacttcaacagttctccccactttctctgacataataatattttctctctactgaatcattctaatgctatttgttctcccatctgcaaaagatcaactcttttgatccacttcactctccagctcttgctctatttctattcccattaaagcaggatttaaaagagtagcttattcttgctgtgttcctagcttctcagtctacaagacccactgcatccaggcttccaaacaccgctgcaccaaaactgctcattaagatcaccaatggcctaacgcagataaatccaatggtaacttctcagacctctttgctccttgatcagcagcatttgaccaagtaaaccattccttcctcctggaaacactttcttcagtggcctttgaggtcaccttacttttcagttttcttttctttttttttttttttgagatggagtttcgctttgttgcccaggctggagtgcaatggcatgatctcggcttactgcaacctccacctcccagattcaagtgattgtcctgcctcagcctcccaagtagctgggattacaggcatgagccacctcgcctggctaattttgtattttttgtagagatggggtttcaccatgttggtcttgaactcctgacctcaggtgatccacccgactcggcctcccaaagtgctgggattacaggtgtgagccaccacacccggcctcagttttcatctacttcactagtcactctgtggttgcatttgctggtcttcttctcttccttaacttctttttgttgctgttagaacaactcagcaaaataaaatttgggtttattgttgcacaatattgtttcacacatacatcaaataggcctaaataaataagcagccatttcatagacaaaaaaggcaaataaatgaaacattttatctttggcctttttaaccatctcacacaaaccaactacttatggtacaactaactacatacactaaagaagctactggaatgctcagaacgagactttttgttgttgttgttgtttttgagatgtagtctcgctctgttgcccaggctggagtgcagtggcacaatcttggctcactgcaagctctgcctcccgggttcacgccattctcctgcctcagcctcccaagtagctgggactacaggctcccgccaccacgcctggctaattttttgtatttttagtagacagggggtttcaccatgttagccaggatggtctcgatcttctgacctcgtgatccacccacctcggcctcccaaagtgctgggattacaggcgcgagccaccgcgcccaggctttttttttttttttaaacaaggtttttttttttttttttttcctcctttgagattataatgaatatgatcacaccacaagtaaagtcagaagtaagacagagaaccctccaaaggctggcttggtcatctgagatcattaaaaatgactgaacctggctgggcgccggtggctcacgcctgtaattcgagcactttgggaggccgaggtaggtggatcacaaggtcaggagatagaaaccatcctggccaacctggtgaaagcctgtctctgctaaaaatacaaaaattagctgggtgtggtggcgggcgcctgtaatcccagctactcaggaggctgaggcaggagaatcacttgaacccaggaggtggagcttgcggtgagccaagatcgcaccactgcacttgagcctggcgacagagctagactccgtctcaaagaaaaaaaaaatgaccctaacaatatgtacaaaaatataaaatgtaaataaaaaatacaaacaaacttcctttttaaagtacttttaaaagagcaagaccttggaagttttggttcttttttcctcctctgttgcaaattctctggtttgggttgggtggtggtgagtgcctgtcatctgcagtggcactgtctgtggagggcaagcaggcctctcgagggcgaccatgtttagattctgagatgggaagtggagggtgaataggtcacggtggccttaatttaaagtttaacttttctttttttgctgtctaatcatcctcactggccttctgctgcttggtatcaacatcgtcatcttcatcatcatcagctgcccatttgtccataccgcctcagctgcttcgttttcatctccgttcttttcttcaccatcaccttcctcttccttctcctctttctccccaccctgttcctcttcttcatctacctcgttgtcagcctcctgctccccattttcctcattagcgttcccgttagcatgggcgtctcttccactttctgcctcctccacaacttctccttgaagtccttggtggtgatcacggagcttgtgtccacaactgcctctgacatggtggggcacagcggtgatccgatgcaagggattaagaagaaagtgagagtttggggactatgtcgattaagctgccagactctgaggcagcagaggaagtgcatggcggaggtggctgtggtgagcaggacaccgaaccaggaacaatgcaaagatggcttttcagagcagccagttgggggtcctcacttcttaaagagggcccaaaggggcagcttctctatctataatctttctatggtgatcgcatcctgtctgttggctttagataccagatgtatgctgaaaactctcctccccaaacctcctccctgatctccagggaagtatccaactgtctactcaaacctggacatatcacagacatctccaattaacatattaaaaatgtactcctagtatttcccccaaagctggtctacctaccatctcagttaaagcaacttcattcttccagctgctcaggctttggcattgtcctaaagtcctctttctccacatacaatctgtcaggaaatcttacttgctttaccttcaaaatatttaaaatttgaccactctttaccatcactactgctaccaccttggtctgagccaccaccatttttcgccaggattgttgctgcctaattagtctacttgcttctactctggctcccttattgccgtttccattttttttttttttttgatatggggtcttactctgtcaccaggctagagtgcagtgcagtggcacaatctcagctcactgcaacctctacctccctgattcaagcaattcccctgcctcagtctcccgagtagctgggattacaggcgagcaccaccacacctggctaatttttttttctatttttagtagagatggggtttcaccatgttagccagactggtcttgaagtcctcaggcaatccacctgcctcggcctcccaaagtgctaggattacaggtgtgagccactgtgcccggctattgcctgttcttaacagccaaagtgatcttgttaaaaaggaaaaaatcaagatcacagccaaaatgatctttttcttttttctttgatggagtctcgttctgttatccaggctggagtgcagtagtgcgatctcagctcactgcaacctctgcctcccaggttcaagcgattcttctatctcagcctcccaagtagctggggctacaggtgcccgccaccacacccggctaatttttgtatttttagtagagatggggtttcaccatatggccaggctggtctcgaactcctgaccttgtgatccacctgcctgggcctcccaaaatgctgggattacaggaatgagataccacacctggcgctatttttttttttttttttttttaagaaggagtcttgctctgtcgcccaggcaggagtgcagtggtacaatttcagcggctcactgcaacctccgcctcccggttctagtgattctcctgcctcagactcccaaacagctgggattacaggcacctgccatcacacccagctaattttggtattttcagtagagacctcaggtgatccacctacctcggcctcccaaagtgctgggattacaggtgtgagtcgccacccctggcctgatcttattttttacttaaaataaaagccagtctttgcagtagcctataaggcccctcctccgcattacctctctggtctcatctcctaccatactcctccgctgactcatgctgctctggacacagccaatttgctctttcaggcacactcccacctcacggccatacactggtggtaccttctgtctgggatgctctctctccagatatttcttggctcttactctttttttttgtttgtttgttttgagacagtctcacgttgttacccaggctgcagtgcagtggtaccatctcggctcactgcagcttcgacctcctgggcttaagcaatcctcctgcctcagacccccaagtagctgggaccacaggtgcgtgccactacacctggctaatttttgtgttttttgtagagatggggtttcaccatgttgcctaggctagtctcgaactcctgggctcaagtgatccacccacctcggcctccctaagtactaggattgcagatgtaagtcaccacgcccagccttggtttttattctttttttttgagatggagtctcgctctgtcacccaggctggagtgcagtggcgcgatctcggctcactgcaagctctgcctcccgggttcacgccattctcctgcctcagcctcccgagtagctgggactacaggcacccagctaatttttttgtattttttttagtggagacagggtttcaccatgttagccaggatggtctagatctcctgacctcgtgatccgcgcgcctcggcctcccaaagtgctgggattacaggcatgagccaccgtgcccggccagtttttactcttacttcctttcagttattgctcaaatgacactttctcagtgatgatcccctttcaacctgcaatcccacatactcccatccccaccttacttgagtactcccaaacccttacttgctctcatttttccagagcacttattaaccatattgtttattatgtttgtttgtctctccagctagaatataagctccaccactaagacagggacttttgtctgttcccttctttttctgtttttttttttttgttctgagacaagagtctcgcttcgtcccccagggtggagtgctgtagcaggacctcggctcactgtaacctctgcctccggggttcaagcaattctcctgcctcagcctcccgagtagctgggattacaggcgcacgccatcatgcccagttaatttttatatttttagtagagacagggtttcactatgttccacatgctgatctcgaactcctgatatcaggtgatcctcctgccttggcctcccaaagtgtggggattacaggcatgagccaccatgcctggccctttttctttttcttttttgagatggagtcctcactctgtcgctcaggctggagtgcagtggtgcaatcttggttcactgcaacctctgcctcccgggttcaagtgattctcctgcctcagcctcctgggtagctgggattacaggtacccaccatcatgccccgctaatttttgtatttttaatagagacggggttttaccatgttgaccaggctggtctcaaactcctgacctcaagtgattcgcccacgtcagcctcccaaagtgctgggattacgggcatgggccaccgcaccgcacctggcctttttttctgtttttgttttcatttttggagacagggtctctctctgttgcccaggctataatgcagtggcgcgatcttggctcactgcaacctctgcctcccaggctcaagcgattctcccatttcagcctcccaagtagctgggactacaggctcgtgccaccacgcctggctaatttttttttgtattttttgtagagacagagtttcgctatgttgcccaggctgttgtctgtttcattgagtaaaccattcctagtgcccagaacactgccaggcactcaatgtttattggatgaatgggtagcattagtaacattttgctgcacttagttataaacaagacttccttccctatattaggccaaagctccatgaggacagggaatgcatattattctggacccttaataaatactgactgaccagatgagtaatgaactatgtgaaaacaaggaggtgaaaatgagctggctatgtttgggttgaaaattagtcataaggggtcgggcacggtggctcacgcctgtaatcccagcactttgggaggccgaggcgggcagatcacaaggtcaggagatctagaccatcctggctaacacggtgaaaccccatctctactaaaaatacaaaaaattagctgggtatggtggtgggcacctgtagtcccagctactcgggaggctgaggcaggagaatgccgtgaacctgggaggcggagcttgcagtgagctgagatcgtgccactgcactccagcctgggtgacagagcgactctgtctcaaaaaaaaattaggcataagggttgtgtgcggtggctcacacctgtaatcccagcacttttgggaggctgaggtgggcacatcacttgaggccatgagttcaggaccagtctgtccaacatggtgaaactccatctctactaaaaatacaaaaattagctgggcatgatggtgcatgcctgtaatccctactactcaggaggctgaggcacaagaatcacttgaaccccggaggcagaggttacagtgagctgtgatcgtgccactgcaatccagcctggacgatggagcaaggctacatctcacaaaaaaaaaaaaaaaagaaaaattaggtgtaggaaacaacttgtggtaaagaatcaaaataagtctgggtacagtggctcacgcctataatcccagcactttgggaggctgaggcaggtggatctcttgagccaggagttcaagaccacccagtgcaacatagtgagacctcatctctacaaaaaataaaaaattagccaggcatggtggtgcatgcctgtagtctcagctactcaggaggctaagggaggagtatcgcttgagcccagaaggttgggctgcagtgagccaagatcctgccatagcactccagcttgggcaacagcaggagactctgctttgaaaaaaaaaaaaaaaaagtcagatgcggtggctcacacctgtaatcccagcattttgggaggccaaggcgggcagatcacaaggtcaggagtttgagaccagcctggccagtatggtgtaactccgtctccactaaagatataaaaattagctgggtgtggtggtgggtgcctgtagtcccagctactcaggaggctgaagcaggagaatcgcttgaaaccaggaagtggaggttgcagtgagctgagattgcgccactgtactccagcctgggcagcatggcgagactccatctcaaaaaaaaaaatcaaaatagatgagaaagaagtcactacaggatgagagatggtaccacaagagaaagaaagagcctggttgtagaaaatgaaacctatgtgataggaaataagtcactacttctttgccataaataacaaataaattcaatgggaatgctcagtggggatctattctctgaaacctctaacctgtgggactgtggtctccagattgtagtgcttattcaggaatttcagcagcttctgtgagggtcggtcaattgccagttggtgcggttccactcgctccttctgcagggaaaaggagactcagggtaggaggaagtatggggaaagcatgccaacaggaagccagaagcctgggaagggaatagaatgacatgggaacatggggggtgggaggcagggcttctggaagggctcagggcaaaggagcccctagtttggatgaaccagtgaagaggtcagtgatacctgcaacatatactggaagagttctcgcccatggccatggcgttgcacagactcatggatgtaaaagtccaggatgcaaagtggttctacctcattatgagcctcacgatcatcctaagagagaaacaataaaaatgttttaggaaccccggcatctctgctgccccctaacctccagcacttttgttctcagaaaccaaggtatacgaactcctagcatccaataacactcaccagtacaaagagcttcttgtatccaactttgatgaaaccaataatggctccttttccagccctgtaggacggggaaaataatgaacaggctagtggtatctatctgcaagagatagtcaaagatgggggaagggctgaggaaggaaggaattaagtatgggatggaagagcatgtggcactcacggtcgggctgaactgtctttgagaatataaacaacatggcggttactctgcatccttgatgcactagtgataggagcggaaagattctgggcctgcagggaagattaagtcagactttctgcaagtctctccgaaggacccaggcctcccttatataccatccccacagaggtcctccctttactccatctaaaaactctccagtaccttggcagaagccttgcccagttcatctataatggtcataatttgctgctgtagatcaacactagagaaagagaagaaataaagagtcagatactcactaaattagcgggtcctaggcagtcagtcctgggaacctgggccacaactccaacccaggtttaacactgaaggctccctgcctttgcctgggagtcttccaatctgatttcccaccccacccttctgaaacccaaacttctgtcacacctttcaaggtggcacactccctcctcccttaaggttattgtgaggaagcagaaaggccaggtcaaccacatcctttgattgggacattttgggcccggggtgaaaggtcacagatccaagcgctgatcaatcccactaggcccagggtcagaggtcaccaaaaaggcaggcctggacatcaaaaggggcgatcactagtcagtgagaagggggcgtggtgcctggaccaggtttggagaggaaccgggagaaaagggccagagggtgggtttgagctgtcaccgggccggcgttgtggttccgggtcggcgggctgggggcctcaggtgctggtccagcaccgtgatccgctccgggaacagcgcgtccacatcgaacgggaactccatggcccattgtgcgcggtcggacccgccccacacgacgtcact

SEQ ID NO: 11833 - DNA, 38771 bp, Homo sapiens
  misc_feature (7892)..(9416): n equals a,t,g, or c
gtgacttgtagctttaacaaaaattaggttccctagttgcagctgccagggaaagctagtctaatatcaaagcaaaccatccttcttctcaagcacagagtttttaagataggagtgtgtgtgtattgacattttcctagcagtggctgaagtcaaggaccaggagatttagggcccacttggagttcttatggtgaaacagtagtagcttcctagagacctttaaagcttatctgtaatttgtatagttcagaagatactgtatacatcattatttctccctgctttcaaaacaggaagggggtgtggagagtaacacactaaaaaaaggataagtaattaatttctgggtaagaatttccttttggcttaaaatggactgatggtgtaagttcctccctttgcaagcagaagctttgaagatagtgagctagatgaagctctggacatcttgaatgaagtattctgtataagaaccaagtgtataataactgttagtaatagaggctgctcatagaaatgtcattgcattataattgtagggacagtttgtcagagagtaggtagaagattatcagacccaggttttgttcttggctcacatgaagtcatcaagtaggctatttaaatgcttcactttaaccataggctaagattaaattaaaaataaaaagcttttgtcatggccgggcacagtggctcatgcctgtaatcccagcactttgggaggctgaggtgggtggatcacctgaggtcaggaatttgagactggtctgaccaacatggtgaaaccctgtctctactaaaaatacaaaaattagccgggcacggtggtgcacgcctgtaatcccagctactcgggaggctgaggcaggagaatcgcttgaacctgggagggggaggttgcagtgagccgagatcgtaccattgcactccagcctgggggacagagtgagactccgtctcaaaaaaaaaaaaaaaaaaagcttttgtcaattaaagatgcttgtcagtactgagtattcatgttgctatggcacttttataagaaaactgtacacggtcatatctgcttccgaaaataatacatagtgagatagtaattttacaggcaattaagaatttgctggccaggcgcggtggcttacacctgtaatcccagcactttggaaagccaaggtgggtggatcacctgaggtcaggagtttgagaccagcctggccaacatggcgaaaccctgtctctactaaaaaaaaaaatccaaaaaattagccgggcatggtggcaggcgcttgtaatcccagcaacttgggaggctgaggcaggagaatcacttgaacccgggaggcagaggttgcagtgagccgagatcgcgccattgcactccacctgggcaacaagagcaaaaactccgtctcaaaaaaaaaagaatttgctataatagaagatccatgtgtacattctgtatgcaaatcttaggaagatattagatcccagaaggttaaagttccgatctctatatatttgtatatgctttaaggagaagtggcatccatgtagatgtggtaaatggcttataactctcgaggtttccaatttctgctgtggtagcaattctaaactcagatggacttggacactactctggattactgtccctaaatatcaactactgtttataagccagcagaggccaactgaaatagtacacataaagttcctacagcatatccctcagtcagaagtggaaaagattgattaaagttggagtataaacatatggggccctgaccaaaaatattgaaccgtactactagaaatccccattctttagctaaaggataatctgacttcacttttaattcttcattgactattggtgctctgaaagaataggaaataatagcaaaacatgggaactcctagatagcatacatttatttttaaaatgtataccatcggccaggcaccatggctcacgcctgtaatcccagcactttgggaggccaaggtgggcggatcatttgaggtcaggagttggagaccaccctgggcaacatggtgaaaccccatctctactaaaaatacaaaaactaactgggtgtggtagcacacacctgtaatcccagctactcaggaggctgaggcagtagaactgcttgaacctggaagacagaggttgcagggagccaagatcacgccactgtactatagcctgggagaaaacaaacaaaaaacatatggtcaacttcccaagtaaactgaccaatgtcagtttaggttcagtcttactgtaggagtgcctgccgtaggccagcgcctctcaacctttccactaagtacattaagatcctaacagtaatcattgggaccccaggtcatcgtctcaacagaagctccagatttcttcaagtcttggccctcttgttttatatcaaaattttatgtatattatttttatattttcaaaaattctccccagatcatcaagtaatattgagatgctgacatagaaaaaagtagatttccagctggtatgatcagtgataaattggacttcatcaaaattaaaagcttttgtgcaccaaaggatactatcaagaaagtaaaaagctatcccacagaataggagaaaatatttgtaaatcataagtctagtattcagatgtctaaagaactcttagaattcaacaataaaaagataacccagtttacaaaatggatatgaatagacagttctctaaaagagacatatacatggccaataagctcgtgaaaagctgtttaatatctttagtcattagggaaatgcaaatcaaaaccacaatgatatatcatttcacacctactaggatggcaataatcaaaaacacacaaacagatgttggtgaagatacggagaaattggaaccctcaagcattgctggtgggaatgtaaaatggtgcagccacttgtggaaaatagtttgtcagttcctcaaaaagttcacagttaccatatgacccagcaattccattcctagggttacacccaagggaactgaaagcatagattcacacaaaaacttgtacacaaatgttcatagctttattataatagccaaaagtggaaacaacccagttgtccaccaattgggacaaattgaatgaatacacaaaatgttatatccacacaatggaatgttattcagccataagaaaacaatgaaatcctgatcacatgctgcgacacagatgaaccttgaaaaattgtgacatgaaacaagccagacacaaatggccacatattgtatgattccatttatatgaaatacccagaataagctaattcgtaaagacagaaaatagattggtggttgctaggggataagaggaagggtgaattgggaatggccactatgcggtacagggtttctaatgttctggcattagatagcagagatgaaaatgttctggcattagatagtggagatggttgcataacactgaatatactaaaatccactgaattgtacacttaaaaaaatgaagaaagaaggactatgcatgatcaaagaaaaaaatgctttgtgctcaagtagggatagaataaacagtaagactggaaagactgtgaagggccttgaatggcaagctaaggaagttagctttcatcttatagatcgtaggaagccaccagagtattttgagcaggggtggcatgtttaaggtagtgttataggaagtttaatttgtgaaatgagaaagagatactatcagccaggagaggtagaaggttctataaagtcaaattgaacacccgaagtttcagatttcatgaatgaccctgggtatgtgtgtatacacatatgtatgggatttgtagtcatctggggaaggctgaggtgctaatatgaatactgaaaactagagagggtaatatagcagagtagttaaaaatgaaaacactctgaacccacatgctgtctgggttcaaattccagctgggctaccttccagcactgtgaccttaggtaagtcactaaccctgtctgtgcttcagcttcctcttccgtaagataaggatacctactcatcaaggttgttttgaggattaagtgggttaatacatacaaagtgtttacaatgtcaagcttaaagaaaggtccccaaaaatgtcagctgctagtctgaaactccagagcaggtttgagagtaacccgctgttgttctctgccccggataaactatgaagtaacagtcctaaagtgttaaaagacaaaacaaatttttctttgtgaaaaatgaccctttaaaaaaactccatctactaataatgaagcttagtagtagtaaaatgatgatttttagccataaaacgggttttctatatcttcacaaatatagtgtagagtttcacaatattctttgatatgaaccagtctctcatactttctgtatagcactgattcgctaagtaagatgccaaggcatgacctcccttcaggaattgggaatctgcatttttaataagcatcctaggtaattcttttttttttttttttttttttgagacggagtctcgctctgtcgcccaggccggactgcggactgcagtggtgcaatctcggctcactgcaagctccgcttcccgggttcacgccattctcctgcctcagcctcccaagtagctgggactacaggcgcccgccaccgcgcccggctaattttttgtatttttaatagagacggggtttcaccttgttagccaggatggtctcgatctcctgacctcatgatccacccgcctcggcctcccaaagtgctgggattacaggcgtgagccaccgcgcccggccgcatcctaggtaattcttatgcatgatacaggttgagaccagtgccatgtacagaagtgggaaaaatggcttatgaaactcagttgtatttagcacactgtgttagacataaaatttgaaaacccaacctggacaacacagtgagacccagtctctactaaaataaaataaataagtgaacattgaaaaccaatggatagtagaatgtattcagttcagtgagacatgaaacaatatttttgcttaattgaatcaaacatatgttaaaaaaaaaaaaaaaactcaccctactcccaaagcactcaataaattcttcagagaaaaggaagagctttttgtactacattgcctctaaaatcttctgtaggataagacattttaagatcacttaaaatcttgttttaagtttttaagtctcattttaataaccaaataaaatggtttttatttgagccagtttcaagttcttaaagtgacacataggacttaacaaaatccattagttgtcatttgtgctttgcccatttttactgatttcttcatactctgaaggaaaaaaaatgctacaaatgtatgttggtatataagagagtgcattccataaatattagaaattttttttttctttttttgagatggagtttcactctttcgcccaggctggagtgcagtggtgccatctcagctcactgcaacctctgccttccagtttcaagtgattctcctgcctcagcctcctgagcagctgggattacaggcgcccgccaccacgcccagctaacttttgtatttttagtagagatggggtttcaccatgttggccaggctggtcttgaactcctgaccttgtgatccacccacctcagcctcccaaagtgctgggattacaggcgttagccactgcgcccggccagaaaaatattttatagaattcaaacttgtattttcttttgaagggatataaaaagggtgagagaacccaacaaccacacttattcaaatttataaggataattaggagtattctcatggttatctttagaatcttagcagggtaaaaaagagtttattgtttcatttgctgaaactcctgagaagaagtctcaccacatttgtatttacagagattagatttggcaactctaaagacaagagaaattactcatgataagtgtttggaggggttggagagaaaacagctaattaggcacttggcagtgtggcagggcaacctttgggcaacccagtccagattaggttagaagaggagcacggaccttttgtccactgcaaaccagtgccacaaatgaagtgggaagagacaggttaccacatactggttggacttgagagagaaccagaaagtgtacaatcccataagcataaaaaatggggataaaacttcaagtgtatataagggtaagaacaggaggaagcagtaacagagagggcaggagagaaagatcagaaggaatcggacgcctgagaagaggaactgggggctgagtcctgtcctggcctggccgctccccattcctccctctgcctctgagggcttcagttttcccaagtgagaaacagctgtgctagattgcttctacagtcctttccactcctggaccgaaacagttgcccctgcatctaaaatacgtagctctagcatataaaatgcaggttacctcaactcccccccgactcccacatctcactcccttcctttccctgcctgccctaattctggctgcgttctgttcttgcctcatatggactctttttctcctccccttcttttccaatgtcatgcagtctcttaacactgggtttcaaccactatacagaaaaatgttagtgaaaaaggaagaggggttccatgctgcttgattctccctaaccaggcacactaaactaggggtgacagtgtatcacaaagtccagactcacagtcttgctgccccttctcctcttcaaagtttgtttccgaagtaccaccccttgcacctcacatcccagccaactctgcctacctgtcagccccagccctcctcaggcctgcctcagcctcacagccaggatcctaccaacaccaacaccgcgccaaataacccctcccaaaagcctcaccggaactaatctggggactctgcctattattaggaacaccttggatgaagcccctacccgcagaattctggcagtagcagcagaattttcaggcatgtgcctaattttgttggggtggtggttgattattttttttaaatctaggatttctgggatctgaagcttatacaatcttggatatcttctttaagaaaaagaatacaaaaatatcttctataagttttacaaaaatatatgaccatgtgagcacgttgctagctcccgcccccaccccaccccccagagccttggaaggggagtgaaactgaagcttttttagcttcatggcaaatatgcttcttcctgagagtactgggtacattcacagacctttattttttactttctatagatttaatttagttaagtcagttcgaagcgggcaaaggccaaaatttctcacccctaggtggctcaaatttctgagcctgagattttatatcttaaaatccattaaaagaatactcaattttcggccgggcgcagtggctcacacctataatcccagcactttgggaggctgaggcgggcagatcacgaggtcaggagatcgagactatcctggctaacacggtgaaaccccgtctccactaaaaatacaaaaaattagccaggcgtggtggcgggcacctgtagtcccagctacccaggaggctgaggcaggagaatggcgtgaacccgggaggcggagcttgcagtgagccgagatcgcgccactgcactctagcctgggcgacagccgtctcaaaaaaagaatactcaatttttaagaagttaggtgtaggtatgcttatataaaatatttagacatgcataagtattttaagtggcctgaaggaagtacatgtatgctacttttgcaaatattttcgctttttttttttttttttttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcacgcctataatcccagcactttgggagtctgaggcgggcggatcaccagaggtcaggagttcaagaccagcctgaccaacatggtgaaaccccatctctactaaaaatacaaaaattagccaggcatggtggcacacgcctgtagtcccagctacttgggaggctgaggcaggagaattgcttgaacctgagaggcagaggtttcagtgagccaagactgcactactgcactccagcctgaggaacagagcgagactctgtctcaaaaaaaaaaaaaaaaaaaaagaatgtaagtaatttgcccaagctgcagagctaaattttaaactagataattctgattccaaagcccagataatctggctagaagttgcaccaggggattcactgatttacaaagaattagaatgtgataaaattccctgagtacaggcaagtgtgatttttatctttgctagtaaagccatttagatgtcttaaagtgcctcaatctgttgcacctgttctactaaaacaaagaaatgagtcaacggcctcttttagctttaacattctctctgtctatacatttttatagaataatttttagttattgcagcaggtttcaccagtcagccaacgggtgtgtataacattaatcactagcactacacctcagaagtcttgcttattaagagcactcagcttaagtgaagaaattaaagaattttggtaggcctttgggacagttcaagtttaggttgtttggctgggttgagagagtaaaaaactaacatttcttaacctaaccctttttctttctttctcacaggtaacaactatccaatagcttacctttaaaatgtcccctctattgttcctccctcagacatttttgatcacttgtcccagtttccatgagtcctgtatcacagctgtcacaatgcttgagctatttaggtggaggtaactttcagaaatgaactgctgaagggtgcagagtgctcaagaattagattaacaaagaaagtacacctaaatttagcattaaaatgaacttttaaaatatttttcaataggaggataagcaaacataaaaatgggtgtgcttatgtctataaacaggtgctggagcatagattgttatctggacatcaaagaataatagagctgtagctttaaaagagcacacagctggttattagtgattcactcccaggtcactgccaagtgccaaggcatgtggcaagaatagtagaatggaaatcaggtgatgtggattctaatttgagctctgctctgttaaccttgggcatgccagttatcccctttggaccttagtctcttatctacctaatgaagggtttggagcaggtaattcttcagttctaagtaagaatctgtattcatgaataactgttcagcatatgactcagcccaaggtgtacaggattgctggagtgtggaaggtatgttggctcctgcctgtactagcaacaaggcttaatctagtgaacagaaaggatcaaaggtggctatatccccacctaaatgtccatgatctacaagtgctcttctagctggcagagtgggtcagtaatgagattttgtatctcattatatgaagttctaagcactgaacctaatcagttacccatcacttaagtagacagtgtcaggcagagcttaactctccttcctattttcctttgtcttccttttctctgtaagttctctaacataaggaacttccattttggtgaaagaatagaaaagttgagggacaggccaggtgtgttgtaagtaagactgatccagctgattggtttgccatttagattgcatggcagacatctgccataagcacttaaaacacaccttcaataggcattagaaagcacacacacggccaaacatagtagctcacacctgtaatgccaatactttgtgaggctgaggcaggaggattgcttgagcccagcagttcaagaccagcctgggcaatatagcaagatgccatctctacaaaaaattttaaaattatctgaatgtggtagtacattcctgtggtctcagctactcaggggtctgaggtcggaagatcacttgagcccaggagatcaaggctgcagtgagccatgactgtgccattgcactccagcctttgcgacagagcaagaccctgcctcaaaacacacacactgactagggatggtggcttatgcccagcactttaggaggctgaggcaggcagatcacttgaggtcaggagtttaagaccagcctggccaacatggtgaaaccctactctactaaaaatacaaaaatcagccatgcggccaggtgcagtggctctcgcctgtaatcccagcactttgggaagctaaggcaggaggatcacctgaggtcaggagttcgagaccagcctgaccaacatggtgaaatcctgtctctactaaaaatacaaaattagccccgtgtggtggcgcctgcctgtaatcccagctacttgggaggctgaggcaggagaatcacttgaacccaggaggcagaggttacggtgagccgagatcacgccattgcactccagcctgggcaacaagagcgaaactccatctcaaaaaaaaaaaaagaaaagaaaatcagccatgcatggtgacacacagttgtaatcccatctacctgggaggctgaggcaggagaatcgcttgaacctgggaggcagaggttgcagtaagccaagattgcaccactgcactccagcctgggcaacagagtgagactgtgtcttgaaacacacacacacacacacacacacacacacacacacacacacacacacataatttgctgttgttttgggggcatggcggcacatacctatagtcctagctacttgggaggctcaggcaggaggatcacttgaacccaggaagttgaaactgcagtgagctgtgattgtgccgctgcactccagcctgggcaacagagtgaagtactgtctcaagaaaataaaaaaataaagaaataaaaacataaggtttagatggcaactttaaaatgtgaaaggaggatatacagtttttcaaaattcttctaggagctatgccagcaaaaaggtttgaagacctgaagaccattatatcagtggcataaacatctttaatttgtccttttccttctcctacacctagtcaattgattttttttttcccatttatcaatttcagactctgcctggtttttcactttcccatccattttgttacaatatttttcctcccttgaaattagcccagtctcttggagtgaatgccccatgctccttcctaccgctgtgtctttactacattatcctcccttggaatgccgtcatctcttctctgttcaagaactacttctcccgaccactgtggtcgagattgatttctctttaacctctacaacattggctattccatacagttagcccttagcatagaacatcattgtttgattttgctccttaagaatagaaagcacctcttaaaattctaccatattcccccaatgcctaatgcaatgctaaccacatagtgagtgcttaataaatattgtattgactgcctagagtacagagcacttgttcactcattgttcggccattcagctaatactttttgagaaattttgtgtaccaggaactgtactatgcactggggtacggtagggactaaagtagatgataatccctgctttgaaagactgaaaagtaagatatatggtatgtcaaaaggtaataagtactgagaagaaaaatagaaaaagcaggaaagaagaacaagaagtgtgtgatgggggagggttacagggtggggaggggtagtgttgtatacacttctagataagatagggaagtcctcactgatacttatggtgacattttacaaaggacctgaggtgtaggaaggatttgagcttatctgtgcaaagagccttccaggcaaggaacttaccatgtgaaggcaccaaggctggacctgcttaacattccaggaagggaaagctttggggctggagcagaagggtagaggccagattgagagatgagtcagaggacagtggggcccgggcagagggacagaacctgcgggtgctggcaatcagccttttgatctgagtgagaatagaggccttgagagggctttgagcagaggagtgacctgctgacttaagttgaatagaaccctctagatgcttcattaaggctagactgaagggaggcaaaggcagggtgagatcagtcaggaggcaagtatataatgataatacattgaatataataatgatatattaataataataatccagagatagtggcaactcagaccaggggaagcagtagaggcggagagaagtggtcagattttggatttattttgaaggtagaacagacaggattgctgactctgttgagtagtcagctgggagctattgatggtttctgagcaggagctgaaggaagattaccccggtataggactgctgggaagacgtggtgcaggcagagatcaggtaggaggccattgcaaggatttaagggtgagatccataagggttttaactgcaaatcagcagaggaaaaagggagtggtgatggtcatggtgacagtgatggtgagagagactggaaaggaggaatcaacaggatttcatgactagataacagagaaccaatatgaagaaggaaaacactttttttttttttttgagacggagtctggctctgttgcccaggctggagtacagtgagacgatctcagctcactgcaacctccgcctcctgggttcaagcgattctcctgcctcagcctcctgagtagctgggattacaggcatgcaccaccacgcccggctaatttttgtatttttagtagagatggggtttcaccatgttggtcaggctggtcttgaactcttgacctggtgatccgcctgccttggcctcccaaagtgctgggattacagacgtggagccaccatgccctggcaggaaaacacacttttgaatgttgtgtgacctggagaatggtaacactgttaatttaaaaaaaaaaaaaaagcccagagaaggctgatttagggagaaatttatgccttagttatacagagtttgagatggtaatgaaatatcaaattaaaactgtccagcaaggaagtaggaaatgtggaactgaaaaagaagttagaactaaagatgtggatctgtctttggcataaagattatattaagttacttgagagtagatgagtttccaaagaagcagtgtagcaagaatagtggagggccaagactggatcctgggggtcagcaacatctaggagccagaaaaaatgccttcggtgaaagaaacggaaagatgggtctattcaaattgtagtcagccaacccatgccagaagtaagcacagaaagtaagagtgaacattggccaagcacagtggctgatgcctgtaatcccaacactttgggaggccaaggcgggcagattgcttgagctcaggagttcgagaccagcctgagcaacatggtgaaactccaactctacaagaaattagccggtcctgtgcacacctgtagtcccagctgctagggaggctcaggtgggaggatcacttgaacctagaaagttgaggctgcagtgagctgtgagcatgccactgcactccagcgtgggcaacagcccggtggctcacgcctgtaatcccagcactttgggacgccaaggcaggtcgatcacttgaggtcaggagttcgagactagcctggccaacatggagaaaccccatctctactgaaaatacaaaaattagctgggcatggtggtgcacacctgtaatcccagctactcgggaggctgagacaggagaatcacttgaacctgggaagcggaggttgccgtgagccaagatcatgccactgcacttcagcctggacaacacagagagactctgtcccaaagggaaaaaaaagaaaaagatccaggagatccattcctaggtatatacccaagagaattgaaaacataaaaacatatgttcacacaaaaacttgtacatgggctcatacctgtaattgcagcactctgggaggccaaagcaggaggatcatttgaggccaggagttcaagaccggcctaggcaacatagtgagaccctgtctctacaaaatgcatgaatgtttgtagcagcattcttcataatgttcctaaagtggaaacaacccagttgtttgtcagctgatgaatgggtagattatatgcagagtatccaggctgggcgtagtggctcatgcctgcaatcctagcactttgggaagctgaggtggacagatcatttgagctcaggaattcaagaccagcctgagcaacatagtgagaccttgtctataaaaaatttttaaatgttaaaaaaaagaatgcagagtatccatacaacgggatattattcagccataaacaggaatgaagtactgatacatgctacaacatggatgaaccttgaaaacatgctaagtgaaataagccagacacaaaggtctacacattgcctgacgccatttatatgaaacacctagaataggccaatctatagagacataaagtagatgaatggttgccaggctctgggagttaagagagaatgggaaatgactgccaacatgtatggggtttctacttgaggtgatgaagatattctgaaattagatagatagtggggatggctgcacaaccttttttttttttctttttgagatggagtctcgctctgttgccaggctggagtgcagtggcgcaatctcagctcactgcaatctctgcctcctgggttcaagcaattctcctccctcagcctcctgagtagctgggactacaggcaggcaccaccacgcccagctaattttttgttagtagagacagggtttcaccatgttggccaggatggtcttgatctcctgacctcgtgatctgccctcctccggctcccaaagtgctgggattacaggcataagccaccatgcccggcgacaaccttttgaatatactaaaaaacattacattttacactttgaagggtgaattttatggtaaattatatctcagtagaaaaaaatccaggaaactgtgtatagtcagccctccatatttgtgggttccacattcatggattctaagctaaataataatacaataataaaaatataaataaaaaacaatatgctatatagcagctatttgcattgcatttacattatattaggtattatgagtaatccagagatgatttaaagtgtatgtgaagatgtgcataggttacatgcaatactacaccatattatataagggacttgagcatctgtggtgtctgctgcgagtactagaaccaatccttcatggacaccaagagataactgtattcaaaaccaatgaaaccagtgaaagagaagtttcaaaaagattgaaaacacagcagggcagtcaaggaaaccagggagaaaggaaagactagtggatttgggtattagaagatgaaagattaaaacaaatcattccatatcagcatgcagtccatagactactcctaaaagttcctgagacttctttaaggaatctctttggggtaaaaattattttcatgatactactaagatgtatttgtcttttccctatgttgacacttgcactgatgttgcaaaatggtggtaaaactgctggcgccttagcacaaatcaggacggtgacaccaaactgtaccagtggtcactgcattctttactgccatgcactcacaatcaaaacagagccagtttcacttaagaatcgttgatgaagtggtaaattttttttgttttttttttttgaggcagggtcttacccaggctagagtgcggtgggggcatcacagctcactgccgcctcaacttcctgggctcaggtgatgctacctcagcctcctgagtagctgaggctacaggtgtgcaccaccacacctggctaatttttgtttttgttttgttttgttttgtttttagagatggggtttcactctgtcgcccaggctaaatattgttaattgtatcaaatgtcagtccttgaataaatcttttttttttaactggtatgcaccaccacacccagctaatttttgtatttttagtagagacggggtttcgccatgttggccaggctggtctggaactcctgacctaaagtgatctacccgtcttggcctcccagagtgctgggaggtgtgggccaccatgcctgatcctgagtacatctttttaaacttgtttgaagaaatgggaaatatgcataaaccgcctctgctgcacactggtagagtacggtggttgtcacaaggaaaagcatttgggcgattattcaagttgcatattgatttagcagcttcttttttcaccgaccaccatttttacttgaaagaatgatagacaaactatggttttagacttaggcatctggcagacagtctcttgaaactgtatgaagtgagcctgtcacttcaaggtaaacaaatgacaatatttgtagccagtgataaaatttacactttcaagtaaaaattagaattttggaaaacttgtatccactcccatgagcttgaccacttttcaatatatacagacttttctgctgaaatcaatggtgaaatttaaggaatatgattttttgatatgtattctaatgaaatatgtcagtatttagaagatctgcctaacaacagggaaccagtattttgcagtgatctatgtgtgatgttacaaagtcatgcatggtaaaatatccattcaaagtgcaagagaagccaatgggttttattataacaaaagttcctaactgttaagaaactactacttgtcaagttttgatgtagcgctaaagaatatccaaaattatctgaaaatgcagatactttctctgtctgtgtaaagccagattttctttgtatattttaaccaaactaacatattacaacagattaaatgcagaagcagatttgagaatccagtcatcttctattaagtcagacagaggccataaatttatgaaaatgtaaaacagtggcattcttctcattagatggctttatttctttgattgttttgggaaatatagtggtttacatttaaagtatgttatttatattaatataatgtgtagtagttttactgttaatatttttactgaattaatcatatcttttactttttttttagttttattttcttccttttttttttttttttgatttggagtctcgctctgttgcctagtctggagcacagtggcgtgatctcagctcactacaacccccacctcctgggttcaagcgattctcctgcctcagcctcccaagtagctgggatcacaggcgcctgccaccatgtctggctggtttttgtatttttagtagggtttcaccatgttggccaggatggtctcaaactcctgacctcaagtgatccacccacctcggcctcccaaagcattgggattacaggagtgagccaccacacccagtttttagtcttattttctaacacagtagacattgatatatagttcccacattaacaaaagttgtttggggtgctcaatttatttatttatttatttatttatttatttatttattttattttaattttctttttgaggcggagtctcactgtgtcgcccaggctggagtgcagtggcacaatctcggctcactgcaagctctgcctcccaggttcacaccattctcctgcctcagcctcccgagtagctggggctacaggtgcccgccaccacacccggctaattttttgtatttttagtagagacagggtttcaccatgttaaccaggatggtctcgatctcctgacctcgtgatccgcccgcctcagcctcccgaagtgctgggattacaggcatgagccaccgtgccccgcttatattttttttatttttatttatttatttatttatttttgagacagggtctcaaaaaaaacaactttgttgcccaggctggagtgcagtggcatcatcgtagctcattgtagcttctgtctccccagactcaggtgatcctcctgcctcagcctctcaagtagctgggactacaggcacgcaccacccaccccacccaactattttttttattttttgtagagacagagtcttgctatgttgcccaggctggtctcaaactcctgggttccagtgattctcccgtctcagcctcccaaagcactgggattacaggtgtgagccaccactcccagccaaatttaccagacttaatggaaacagtccatttctgtttcttcagatgaaacctcacaactttaggattaataagtaatctcacaactattgtacaggaaataagaaaacgttcccgctaacaatgcacgttgtgatagatctggtccctgacacaaacagcacttggaactgagtgaagtccagagactgaataatacagttctatccactccctgtgcttgactacaacccctgaagagggcttgtacaaattaaatgtatcccagcagctgcttgaaagaccacagcattggccgggcacggtgactcacgcttgtaatcccagcactttgggaggccgaggcgggcggatcacgaggtcaggagatcgagaccacggtgaaaccctgtctctactaaaaatacaaaaaattagctgggcgtgatggcgggcgcctgtagtcccagctactcggagaggctgaggcaggagaatggcgtgaacccgggaggcggagcttgcagtgagccgagattgcaccactgcactccagcctgggcgacagagactctgtctcaaaaaaaaaaaaaaaaaacacgcattttgaatgtccctagcattagggattataaaggtcccattctagtagaagatcctcaggtttggagtgtactaaaggtcatcatccttcgcctgctaataaatttctgaagtccctgctttaaacaaacaatcaaaaagaaggaacagttacagtgctgccaaacaagttctttttttttttttgagatggagtttcgctcttgttgccaggctggagtgcaatggcgtgatctcggctcaccacaacctccacctcccaggttcaagcaattctgcctcagcctcccgagtagctgggattacaggcatgcactaccacgcccagctaattttgtattttttttagtagagacagggtttctccatgttgaggctagtctcaaactcctgacctcaggtgatccgcctgcctcggcctcccaaagtgctgggattacaggcgtgagccacggcgcccggccaacaagttcttacaaacctctgggttgttacaaacccatctggtgctaataaaggtaaggcatcaaccccaatctccaagctgagaattttatcctcaggactgagcactgcggcctgcattcggatgttagtggggctgtcagaaccgtgtctcatgctgttaaaagtggaagtccttcccactcagacccacggaagccaactctgatgagtgggagggtgagcagaaggggcttcggtcattttttatagattcttcaggtaactctagccaccatattaagcattggctcccacaaaaaagcattaaggctcagaaacatcttgtagggtcacaccctccctaaaaacagcacatccctgaagtggtggctgggcagccaggctccaaagcccgctgagctgagcggcagccaagaacaaggtttggtgtttacatactcaaaatcagcctgggttgtcacagcaactcacctcagcacagttcttccttctccacggcggcttgcttccaggctttgctgttctccgtcaccgtcttaacgttcctgctaacctggcctgctgcattctttttatttttctcccaattcctccgccttcttctcatgtgtttgctagtgtgcaatacctcacctgtttggaactcaacaacgtcccctcctgcaaaacgcacctgaaaacaagaaatagcacacaaggcctctaagtggccagaacagatgttaccaggcctaagtccataaggaaagcacccaagccccttgcttttgtcttaaatctttttttttttacacctttaaaataaggttatggtttctaaggcctgccgtaaattaggagtagggagaggaactattgccaagcaccccaaaagttcaagaggtgactgttgatcccagagtagcaaggaaagggacagacaggctataagaagtggacacaagaactcagaactcaggacagtgtaggccttgttagagtcaggcagacaatttcacatacctcagaacgtcataaagccatcatgactttactctggaatagatacgatccagacacctagaaaatgttaaattagattcaacttaaagaggcagagtaatatgtgtggtgttttttaatttcgagcattccaaatggttaagggttttcatgcttaaagagagaaacttagctacctagaacttatttatgagtgctctagataattatctactgttttatatttttttatttataccccgttactaaaacaaaagtaaaaataaagcaaaagattgaaggcattgacatttagtctatatactttctagttcctggctctagttcttagcaatatttgctgctaacctggtgttctgtctctgccaaatttctgcccatgtgaaatatatgagacttgatcctatttccttgctcattgatctacctgaaagggtcatagatgtctccacctccctagagctagtgatcctatatcccatcatctcagccagctagaaaacgaaccatcacatgccacctcctacccaattacgtgcttcataaacagaatacctggcatatagcaggcatttactaaacacttggtgaatgaatacatgagccagtaatccataagatatctgtagaattaattacagttgagccttgaacagcgcaggtcctatgggatcccaccccttgtacagtcaaaaatcctcataaaacttttttttcttttttttttgagacagaatcttgctcgttgcccaagctggagtgcaatggcgtgatctcagctcactgccacctccgcctcctgggttcaagcaattctcctgcctcagcttcccaagtaggtgggattacaggtgcctgcaccacgcctaactaatttttgtatttttagtagagatggggtttcaccatgttggccaggctcgtctcaaactcctgatctcaggcgacccacccgcctaagcctcccaaagtaggggattacaggtgtgagctgccgcacccggccgacaggtgtaactttttttttttttttttttttttttgagacagagtctcactctgtcaccaggctggagtgcagtggctctctctgctcactgcaatctctgctcactgcaacctctgcctcccaggttcaagcgattcccctgcctcagcctcctgagtagctgggactacaggtgtgtgccaccatgcccagctaattttttgtattttagtagagacggaatttcaccatgttagccaggatggtctcgatttcctgacctcgtgatccacctgcttcagcctcccaaagtgctgagattacaggcatgagccaccacacccggccacatataacttttgactctccaaaaacttaactactaatagaagacttaccaatagcataaacaagttgattaacatatattttgtatgtcatttgtgttatatatgtatttcttaccataaagtaaactatagaaaagaaaatgttattaagagaatcataagcaagaaaaaatatgtttactcttcattcagtggaagtggatcagcataaaggtcttcctcctcatgatcttcaggttgagcaggcaaggaggaggagaaagagaaagggttgccatctcagcagtggcagaggcagagggaagtctaaggggacccttgctgttcaaaattgtgttgatcaagggtcaactatacttgcatgaagctataaatttaagagcctagcctattatgggaacagcaattaaaaaaaaaaacaccagttggccgggcgtggtggctcacgcctgtaatcctagcactttgggaggccaaggcaggtggatcacctgaggtcaggagttcgagaccagcctggccaacatggtgaaataccgtctctactaaaaatacaaaaattcactgggcatggtggcgggcacctgtaatcccagctacttgggaggctgaagcaggagaatcgcttgaacctaggggccggaggttgcagtgagctgccaagatcgtgccattgcactctccagcctgggtaaaaacagctaaactccatctcaaaaaaaaaaaaaaacaccagttgatcctggcaccaggaagatcaaatggcatttgtttgtttgtttgttttgagacagagtctcgctctgttgcccaagctggagtgcaatggcacgatctcagctcactgcaaactctgcctcccaggttcaagtgattctcctgcctcagcctcccgagtagctgggattacaggcacccgccaccacacccagctaattttttatatttttggtagagatggggtttcaccatgttggccagtatggtctcaaactccggatctcaagtgatccacccacctcagcctcccaaagtgccttggtttacaggcgtgagccactgcaccagccagtacagttttttgttttgttttattttggttttttgagacggaatctcgctctgtcgcccaggctggagtgcagtggtgccatctcagctcactgcaagctccgcctcccgtgttcatgccattctcctgcctcagcctccctagtagctgggactataggcgcccgccaccacacccggctaatttttttttttgtatttttagtagagacggggtttcaccgtgttagccaggatagtctcgatctcctgtcctcatgatccgcccgtctcagcctcccatagtgctgggattacaggcatgagccaccgcgcccagccttttttttttttttttttttaatgtatgggggaaaaatgactagaaggacagaaaccaacatataacatgattgtgtgcatttacttatttaacaaataattgagcaatttatttctgtatgatactattctaagcgttttagagttaagcaaactcacagtaaactgtattgcccatgataaaaactgcagttacataatttaaaagcaagaatcgcagcaattcatcaggcacagtgactcacgcctgtaatcccaacactttgggaggccaaggcaggaagattccttgagcccaggaggtcaaggccagcctgggcaacatagtgagaactcatgtccacaaaaattacaaaatagccaggcatggtggcaagcacctgtggtcccagctactcaagaggctgaagttggaggatcacttgagcccaggaggtcaaggctgcagtgagcgatgatcgtgccactgcactccagcctgggtgacagagcaagagaccctgtctcaaaataaataaaaataaaagcaagaattgcagaaagtataaaccatgaccaactcaagagaataatcaatgaaagaataggcagaatgtctttccaaaaagcagttgagagatccccatcctccacatatgcactagtgcagtggggatgttgccaggcatggccgccagacctctagatagaacactgaaggtgagtctgcagtaaagccatggaatgtgctaattttagtttaggaataccaaattttattgaccgtttttaattcaataagcaacccttggccatgtataatcagttcatgacccatcagaagatcctctgtggttcactcatggcctttggactatactctgaatcatggctttagaagacatttttttagtatacttaaatggattttataacttggttgatgcccagattacagactgtgaggagtatctccacataacttgtaactgctatatatgcagtcagcaattccagtatttagcctgatattaatttatatttttcctcataatctgataatacagtgctagcaagatagatcacaaagtgtaaatgagtgtttctggagcatagatgggtacgctcaaatctttgtatcttgttttttaatagagacggggtttcgctatgttgctcaggctggtgtcgaactcctcggctcaagcaatccccttgcctcagcctcccagagtgctgggattatacatgggagccaccatgcctagcttccttgtatcattttttaaaattcaagtaagagaaaatgtctggcaatagttcataagctataaatgaaacctagtcttaggacccagctttatattgcctcaatcaaatattaatatctttagttcaaaatttgtatttacaaaaaacttttggttcttggggataccgttattgccttctctgttgccatccatataatgtatgttgttttttttttctctctccctctgggctgcgtttcatgccagataaacttccaaaccaaactgggatggcaccaggcacaaataacactcttcttatcttttcccccatctaggttacccctttgctttgttttatcggcattaccttttctacaaggagacctacctcatccacctcttccatacctttacaggcctctcaattgcttattttaactttggtgagtaaactaaattagcagtgacaccgcaattagtgggaacctggaaggaacagacttgaacaaaatttccttgagagaatctaataggtagggaagttataatgctcccacttgcaaagagggttgtatgaagaggaacacagcttaacttttcctttttttcttttatgtacattcttctgtcagataaaaacattttgagggtggttacccttgccatacctcatcaacaaagaatcctcagtttctctgtgctgtggatgtaactgaatgaccgagccaagcagtccccacttagattcattcttcacttcagacattcaaaaatacagtaacaagctgggtgtggtagcccggaattcaaggctgcagtgagctatgattgagctactgcactcaagtctggacaacagagcaagtcgcatctctaaaaaaacaaacaaaaaaagaaaagaaataaaataacaccctaataatcttttttattttaataaataatttccatcctctcctccaaaacatgaggttattctgaaaaaaaagatcctgatgccaacattttttctttatatattacgttgtgattggaagtctcaggacggtgggagtgtaaaaaccaggctaaattctctcttcttgcatccaggaaaccagctctaccactccctgctgtgtattgtgcttcagttcctcatccttcgactaatgggccgcaccatcactgccgtcctcactaccttttgcttccagatggtaaacgtctttcccttagcagctcaggctacagctgacagcggttcaggggacaggggtaggcaggggactgtggtatagaaattagcagacctaatttctaacccctctcccagcacttagcagtatgacttcaggtaggtggcttatcacaggcccaagtgttccatccacagattgtaatggtaactctttgcctgcctcaaggaagggccaccagctaaccctttgcatactgtgccattaggctctttggtttaacccactatccaggagcagagtcacttcaaggcaagacagaaaagcaacttagaatgagttaaagaacctaagcctaggccaggcaaagtggctcacacctgtaatcccagcaccttgggaggccaaggcagtcagattgcttgagcccaggagtttgagactaacccgggcaacatggtgaaaccccatctctacaaaaaaaatacaaaaattagccctccagcctgggcaacatggtgaaacaaaaaaaattaaaaattagccgggtggggtggcatgcacctgtggtcccagcatctaaattctcatctcagtttagccctcattttgccaagaagccttgagcaacgctcttcccattacaggttttcagcacctccatttgtaggaatttattaaggcttttaatgatgggatgaggagaaaggaaaaaggaaagagaacattgaatttcagagcaaggagaagaaatagtagtgatgctagaataaatacttctgcctctcctaggcctaccttctggctggatactattacactgccaccggcaactacgatatcaagtggacaatgccacattgtgttctgactttgaagctgattggtgagtgatggtcactgcctgccttccttacatgtaggtccctcccccatctcactaaaaacttcctcggcaccccccctccgccccccgccatacacttctggctgcactcagtctacaggccacatcctcagtgtcctctcccaccaccctacccatccgttctctctctgctcaggtttggctgttgactactttgacggagggaaagatcaggtaagtacccattcatcggcagagaggttcaagacttaatgaaagggaagaaaaaagttgttaacaaaagactgaacccaaattccagagcggagcctctccctcattccccagcctgtgcaatctccctttcagatagcactgagcaaggatcaacaaatctaatttgcccaggatccagctcttgcacaaagtccagagatcaatgccagcaaggcatttgctaaagcagcaacagccagctatgcacacacatacgcatttccacaagaagcaactatttgtcatcccccaaagagaaggctatttgaagaaccccagtcagtggggcacacaggtggggaacactcaaagtggctcttgtggggagattcaaggctatcctgaaccatgcattctcttcttggcatagaattccttgtcctctgagcaacagaaatatgccatacgtggtgttccttccctgctggaagttgctggtttctcctacttctatggggccttcttggtagggccccagttctcaatgaatcactacatgaagctggtgcagggagagctgattgacataccaggaaagataccaaacaggtaattgcccctcttggtccagatgtttgtgtaggtatttcactcactctgaagtgactcttctgaaagctgcattctccagcatgaccctggcatagagacctgagtcatgcaggccctggactgttgtaacaggcactctgtgccaggagtgggccctttttagtttagggttcttccagttatccattctaacactagtacaaacataaaaatccacatttatgccacaggattttgcctgaaccagtcacatttctgcctttaaagcctattttcatgtatatatgaaatatatttatgattgataggtaggtaggcaggttgataggtaggtaggtagatagaggctgggcacagtggtttcacctctataatcccagcactttgggaggccgaggtgggaggatcacttgagcccgtgagttctagaccagcctggcaacatagagagactctgtctctacaaaaaaatacaaaaattatcagacatagtggcatgcatctgtagtccaagctacataggaggctgaagtgggagaattgcttgagtccaggggaggtgggtcaaggctgcagtgagctttgatcacaccactgcactccattctgggcaacatagcaaaatcctgtctcaaaaatatttatcagtaggaaatgcaggagggcacagtggctcatgcctgtaatgccaacgctctgggaggccaaggcaggaggatcactggaggccaggagttcaagaccagcctgggcaacatagtgagaccccatctctacaaaaaaaaattatccaggcaaggtggtacatgcctatagtcccagctactcaggtggccaaggcaaggggatcgcttgagcccaggagttcaaggccacagcgagcaatgactatgcctctgtactctagccggagtggcagagcaaggccctgactctagaaaataaaaattaaaatggtaaaaaaaaaaaaaaaaaaaaagtttaattgccagaagaattccttcactgagaacttgtccatcctgtgtttcagcatcaattcaaccaagaaatgaaggagcagattcaaagtggttatttttattatcttacctccactgggttttcagtcccaatggagattgtgagacctggcaagaccttgagatcagtagcatccctgaggggtaaacacaagactggtccactgtctgctgccctgactttcctacaactcttaagaggtttgcagtccccattcctcatagccagccatagaaatctttccctgaaacaggaaacactttgggcagcagagcttctcatcccattccaggtagacaaccacacccctaaacactcctctccataactgaaggtcagagggtgaagggaatagtctctgctctctgtgaccaggaacttcactcgttcctttccagcatcattcctgctctcaagcgcctgagtctgggccttttctacctagtgggctacacactgctcagcccccacatcacagaagactatctcctcactgaagactatgacgtgagtgtctactaaagcagcagcagcatgactgcaccagagctagaaaatggacaggcaaggatccctacagatagcagagaagtaggaaatatcatctacaagtgcatgttggttttgctctagatctgtgagttgtcaatgccagccgtgctgggacatgttcatcagccagcactgaacaaccttcgcgggcacagggctgtgccaggtgcacatttagcacccgttgccttctctaggagccgctcctagcttgccttatcacatccacgtgacccctcagagcacagcagcttctgattctccatcctattttcttctcttgactgatacatttgggcacttctagggaattcagaaaccaagggaaggggggaagtgctggcttttgctcctgcccagctgaaaggcttgaaaacagttcagtaattctgggcaggtttctctccttaaattaaaatccaatatgggcccctctgtacttaacattccaaatgctcattccaaacactttgccaacgaaggcaaacagtagagaagttaaatacagtgctgcccttgaggctctccaagggaaaggcgaatgaatattctccaggccctctgcttattcctctctgcctattgtgaaggcaatcaggccagactattgagggcatctggcagcaggactcaggcaggtatgaagtagccagccacaagtgtgaaaaggaagagtgctgagagaaactgcctagtcatgtgatatccctaatgcactgtgctttcttccctcaagaaccaccccttctggttccgctgcatgtacatgctgatctggggcaagtttgtgctgtacaaatatgtcacctgttggctggtcacagtaagtagaaaagttgaaacaaggtcctatttagacaagccatgggggccagtatggggagtggcaagagccctaactgagctattccctctcaggaaggagtatgcattttgacgggcctgggcttcaatggctttgaagaaaagggcaaggcaaagtgggatgcctgtgccaacatgaaggtgtggctctttgaaacaaacccccgcttcactggcaccattgcctcattcaacatcaacaccaacgcctgggtggcccggtgagctgctggtggggagcctggaccctggttccttccttccactgtcttcccagattggagggcaggggtgtaccatgtcacccctatgcgtctttcccatctgggcagaaccccctgtcgctcacactgactttgacccccacctatacccccctcccaaaaaaaccattactgtcatatttgaaaaaaaggcaagatataaaagtgcgttaagacctgggtgttactccagctctgccaatggacttatgtcctccactgccctgtttatcaacagctttacttgtttgtccccaccactagagtgtgggcagcttgagtagagtgtctggttcaccactgatctcagcatcagcctcagtcactgctgctgaaccaagtggctcgtgcgcacacggtctccagctccgccttgggtctgctttccatctctaaaagtaatcagtcagcactgcctcctgtaccctctgggggctacacgtgggaacccaccagcactccaatccaatcctcagggtgaggacccagaggcaggtggcgggatgcaaggaccagtcagtttgagggtcgccccacccacccttttctccagctacatcttcaaacgactcaagttccttggaaataaagaactctctcagggtctctcgttgctattcctggccctctggcacggcctgcactcaggatacctggtctgcttccagatggaattcctcattgttattgtggaaagacaggtaggcctccagggtgggggtgaaggggaatataagggacaagatgctgatgagctcctcctccctccccaggctgccaggctcattcaagagagccccaccctgagcaagctggccgccattactgtcctccagcccttctactatttggtgcaacagaccatccactggctcttcatgggttactccatgactgccttctgcctcttcacgtgggacaaatggcttaaggcaagtgaaggcctgcttgtgagactgggagggactcactgcaacctcaaaggttgcaaaggacactccaggcctgtctaccttagtggcctctctctccacaggtgtataaatccatctatttccttggccacatcttcttcctgagcctactattcatattgccttatattcacaaagcaatggtgccaaggaaagagaagttaaagaagatggaataatccatttccctggtaagttaatacagctaaactaaaactaccaccaggttacagaatagagcaacagactggaaaaaaacaatagtattagaaatctggggtgaattccaaggattagcctggctactaaggaacacagtatgggcaatgactactgtgacttattgaggcatgctaggaaacatctggaagggctatagaccaggaattacaggagtaactaaccagccttccaaactcctcttgtcttgcaggtggcctgtgcgggactggtgcagaaactactcgtctcccttttcacagcactcctttgccccagagcagagaatggaaaagccagggaggtggaagatcgatgcttccagctgtgcctctgctgccagccaagtcttcatttggggccaaaggggaaacttttttttggagaaggcgtcttgctttgtcacccacgctggaatgcagtggcgggatctcagctcaccgcaacctccacctcctgggttcaagtgattttcctgcctcagcctcccaagtagctgggaatacaggcacgccaccatgcccagctaatttttgtattttcagtagaaacgggatttcaccacgttggccaggctggtctcgaactcctgaccgcaagtgatccacccgcctccgcctcccaaagtgctgggattacaggcgtgagccaccgtgcccggcccaaaggggaaactcttgtgggaggagcagaggggctcacatctcccctctgattcccccatgcacattgccttatctctccccatctagccaggaatctattgtgtttttcttctgccaatttactatgattgtgtatgtgccgctaccaccaccccccccatgggggggtggagaggggtgcaaggccctgcctgctccactttttctaccttggaactgtattagataaaatcacttctgtttgttcagtttttcaccactagcattcctgactgctctctttcacagttcttctccatcatcagggttctctcctttagcacatgggaatctgggagctaaagcctgccttcaaagcatggaaccaaactgcaaactctgtaacctcctatctgtccctgaagtcccggggaacaaacagttttacaccactggatactttaggaaccccaaaacaaccaggtttgcaagaacagtattcataggataaacaaatagcaaatgtacagccttggcttccccaaactccacagtctcagtgcagaaagatcatcttccagcagtcagctcagaccagggtcaaaggatgtgacatcaacagtttctggtttcagaacaggttctactactgtcaaatgaccccccatacttcctcaaaggctgtggtaagttttgcacaggtgagggcagcagaaagggggtagttactgatggacaccatcttctctgtatactccacactgacctaagaaaagaacagttttgtcagccaactctgtcactcagtagctgtttcagcccttctttagggcaggaaaactatggctgagctagtatttcagctgtgctgttgaatatcaaatccctacaaaggatgaagaaggtcctaactgtgacttccaattatggcagcagccctcaaaggatgtgccctggggcagggtgtggaactgtcatgtgtcttctagctcattgtaagcattgttaaaatgcctactgctctgggaattctatactaagttcagctctaccaagaatttcagggttgagcccagaccttaccttgccatgggcaaaggcccctaccacaaaaacaataggatcactgctgggcaccagctcacgcacatcactgacaaccgggatggaaaaagaagtgccaactttcatacatccaactggaaagtgatctgatactggattcttaattacctaaagtaaaaaagagagaaaagtcagccccagaaacattcccagaaccagccttcaactaacaggtttcaatacctcaccttcaaaagcttctgggggccatcagctgctcgaacactgagcttgtgtaaaagttgaactagaagggggaaaaaagagttcagagctagatggagaccacagtccttctgtccagtcatcgaacaaggaaaaccccatggataagatgagttccctgtgtgctttatatctagactggactcctgaaatgttaggaacaaacagttgccaagcatatggctagctgtacagtgatgggttcagactccctctttcactcagccaggaagctactgcaagaacaggagtggagtttccacaaacatagaaaaataataacagtccttgtcctggtattaatcatgttgttctcccattttctcgcttaaaaatccacatttagttctcccttttcctcttcctcccttcttccctactgacaagttcattctaactttgttctaaggcttcttacccatgaggccacaaaagcggtcaaaggttctgggaattcgggtctggggattcacttcaatcagaacattcttctgtgtatggatataaacctgtagcaagccagctcggttcaggggactatccatcagcatcagcaaactctgagcaaagcagaaaccgagacatggttaaggctgaagagaggcagcactcagctgccaacccttccatacagaggctcaaagggttgtgagcactgtccctggagttacctggtgggtgatatctggccgcgcttccccagggtcccgtccattcttcaacaatatagacttgtgcttgtcacagttgagtagctcatatgtcttccctacctgaagaacagggaacatgacgagagaacagcataagcttctgttacctagccccgtggttcttcaagtgtggtccccaaactaccagcagcagctgcacctggaaacttgttaggcaaattctcaggcccaccctagacctactaaaccaggaacactgggggtggagcccagcaagcccttcgggggattactgtgcagccttatttgcactccccagtgaatggtctgagagggaaacaggaggaagggcacaacctgtgacttcacattatctactaatacactggatttaattaaaaaacctgtggctgttaggcaaggccaatgagacatcctggaactaggcaggagttagtagttagcaaggctgaatgctgtgtttattacaggagcagtaagtaggtactgtgcaaaatatcgagtcaccaccctcagtttgcgtacaccaaacatgcactaagtgaagagctgcaaatctgaacaagaaatgtgaaggccgggcgtggtggctcacgcctgtaatcccagcactttgggaggccgaggcgggcagatcacaaggtcaggagattgagaccatcgtggctaacacggtgaaaccccatctctactaaaaatataaaaaattagccgggcatggtggcaggcgcctgtagtcccagctacttgggaggcagaggcaggagaatggcatgaacccaggaggcggagcttgcagcgccactgcactccagcccgggcaacagagcgagactccatctcaaaaaaaagaaatgtgaaaactaatgatgcaggaggcagtttaatcaaagaaaactctcagaagtaaaaggaagaggggttattcccagttttaagacgggcatgggggcagatgcagtggctcacggctgtaatcccagcactctgggaggccaaggcaggcaaatcacttaaggtcaggagttcaagaccagcctgggcaacatggcgaaaccccatctctactaaaaatacaaaaattagctgggcatggtggcacatgcctgtagtcctagctacttgggaggctaaggtgggaggatggcttgagcccaggagacagagattgcagtgagccaagactgtaccactgcactccagcaagaccctgtctcaaaaaaaagaaaaaagaaagactggcatgagcaaaggtacagatggaatcaagacaaagtagccaggtgtggtggcttatgcctgtgatcccaacactttaggaggccgaggtggaaggatcacttgagcccaggaatttgagaccggcctgggcaacacggtgggaccctgtctcacaaaaaaaaaaaaaaaaattagccaggcgcagtgccatttgctggcagtcccagttactcaggaggatgaggtgggaggactgcttgagccagggaagtagaggctgcagtgaaccatcacaccactgcactctgttgcccaggcaacagagcaagaccctatctcaaaaaagaaacaaaaaagaaaaagtggaaacgaagaaaggaaattttgaggaaaattgggagctgagacactaaagggcagtgattatatatgaagctgctttgtaaaccacagaatcctaatgtatcaagcacaaagccaaaaataattctggagtaagcagggcaggatgggaatgactgacagacactatcctaacaactctctgtacactggaaaagacatcagaagtttgatgttaaagaagtggactacatctgtagcagctaaaagaaataattccaagttgcaatttggagtcccaaggagcattagggtggtcagtaaaaagtctaaaaacaaactgttatatacaaatacaagttttggaaggttaagtttttatgtatcactggaatgtatatgtctagcaacattcttgagatatatggctccaaaaagtctgcgaaaaaagggatgtagattttgaaattgaatagttgaagtaatgtcacagagagcacaaagaacaaatgaccaagaactaagtccatgagacacccttagttatagaagaaaaaaaccttcttgaatgaataatacagtttcaacccattagtaggatataatcatgttttctattcttttaatagattacaggcgcaggcctgtaatcccagctactctggaggctgaggcaggagaatcgattgaacccgggaggcggaggctgcagtgagccaagatcgtgccactgcactccagcctggtagagactgagactccatctcaaaaaaaaaaaaaaaaaaaagtgtatttagaacgaagattaaaatcctggcctgacttctaaaccaatgcgatttcttctgggcctattcaattagttctaacgggtaagagaaaggaggaggaagaacactgcccaaggctttaagatagagaactgctggttctattacatgtggggaaagagatgaatgatagataaaaatgcagatgtaaaagttttaaataataaccaggtctggacagtgtatcataggtggatattagagagaggtgactatggatactaatgaattgaaacacgaagcccttacaaaaagtgtgggcagactaggctacataactacgtttctcatctgcccagtaacttgtcttgggatgtggaatgacgcaaggaacgaaactttcctctgcttagactactataccacagaatcctggtaaaccaattggaagcaaggaggtgagggctagaatatcattcaaaaagagcaaaagaaaatgagtactaccggccgggcacagtggctcacgcctctaatcccaacactttgggaggccgaggcgggcggatcacttgaggtcaggagttcgagaccagcgtggccaacatggtgaaaccccatctgaactaaaaatacaaaaaaattagccgggcgtggtggcacctgcctgtagtcccagctactccagaggctgagtcaggagaactgtttgaaggcgggaggcagaagttgcagtgagccgaggtcgcgcaactgcactccagcctgggcgacagagcgagactccgtctcaaaaaaaaaaaaaaaaagaaagaaaaatgagtactaccatcccaggatgtcaaatcaacgcaaagccaaccaagccaccttccttcaaaagcatctttcacccctctctgctttctacatccactctgggccccttaccctcattccacggagtcccaacctatcgatttactacttctccacttcctgtcccaaactaccttgactgtctccagactggccccttccagcaccacaataagcctacggcctccgatcttgtttcctgcccctagtcggggccgcttgggtggcagagcatcccagtcctgtgcctgctccccaccgcttcgttcacgaggcttgaatccatcactgggcgcggccatcttgcaacaataccggaagttgcgctaacgctcttaaataagaacagcgcggcttctaatcacaaatttccttc

SEQ ID NO: 11834 - DNA, 170 bp, Homo sapiens
tcgggcgcctgtagtcccagctacttgggaggctgaggcaggagaatggcgtgaacccgggaggcggagcttgcagtgagccgagatcccgccactgcactccagcctgggcgacagagcgagactccgtctcacaaaataaaaaaaaaataaaataaaataaaataaaa

SEQ ID NO: 11835 - DNA, 109 bp, Homo sapiens
ggcgtgaacccaggaggcggagcttgcagtgagatgagatcgcgccactgcactccagcctgggcgacagagcaagactccatctcaaaaaaaaaaaaaaaaaaaggac

SEQ ID NO: 11836 - DNA, 184 bp, Homo sapiens
cgtggtggcgggcgcctgtagtcccagctactcgggaggctgaggcaggagaatggcgtgaacctgggaggcggagcttgcagtgagccgagatcgcgccactgcactccagcctgggcgacagagcgagagtccgtctcaaaaaaaaaaaaaaaaaagaaaagaaaaaagaacaaacaacagc

SEQ ID NO: 11837 - DNA, 147 bp, Homo sapiens; identical to SEQ ID NO: 11627

SEQ ID NO: 11838 - DNA, 235 bp, Homo sapiens
  misc_feature (230)..(230): n equals a,t,g, or c
agatggagcccatcctggctaacacggtgaaaccccgtctttactaaaaatacaaaaaattagccgggcgtggtggcggacgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaanaataa

SEQ ID NO: 11839 - DNA, 143 bp, Homo sapiens; identical to SEQ ID NO: 11629

SEQ ID NO: 11840 - DNA, 170 bp, Homo sapiens
gccgggcgtggtagcgggcgcctgtagtcccagctactcgggaggctgaggcaggagaatggcgtgaacccgggaggcggagcttgcagtgagccgagatctcgccactgcactccagcctgggcgacagagcgagactccgtctcaaaaaaaaaaaaaaaaaaagactg

SEQ ID NO: 11841 - DNA, 171 bp, Homo sapiens
aaaaaattagccgggtgtggtggcgggcgcctgtagtcccagctgctggggaggctgaggcaggagaatggcgtgaacccgggaggcggagcttgcagtgagccgagatcccgccactgcactccagcctgggtgacagagcgagactccatctcaaaaaaaaaaaaaaaa

SEQ ID NO: 11842 - DNA, 196 bp, Homo sapiens; identical to SEQ ID NO: 11269
  misc_feature (106)..(106): n equals a,t,g, or c

SEQ ID NO: 11843 - DNA, 183 bp, Homo sapiens
aatacaaaaaattagccgggtgtggtggcgggcgcctgtagtcccagctactcgggaggctgaggcaggagaatggcgtgaacccgggaggtggagcttgcagtgagctgagatcgtgccactgcactccagcctgggcgacagagcgagactccgtctcaaaaaaaacccacaaacaacaaa

SEQ ID NO: 11844 - DNA, 175 bp, Homo sapiens; identical to SEQ ID NO: 11635

SEQ ID NO: 11845 - DNA, 159 bp, Homo sapiens; identical to SEQ ID NO: 11637

SEQ ID NO: 11846 - DNA, 207 bp, Homo sapiens
aaccccgtctctactaaaaatacaaaaaaatagccgggcgtagtggcgggcgcctgtagtcccagctacttgggaggctgaggcaggagaatggcgtgaacccgggaggcggagcttgcagtgagcccagatcccgccactgcactccagcctgggcgacagagcgagactccgtctcaaaaaaaaaaaaaaaaaaaaaagactgcg

SEQ ID NO: 11847 - DNA, 189 bp, Homo sapiens; identical to SEQ ID NO: 11639

SEQ ID NO: 11848 - DNA, 207 bp, Homo sapiens
aaccccatctctattaaaatacaaaaattagccgggcgtggtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaaga

SEQ ID NO: 11849 - DNA, 162 bp, Homo sapiens; identical to SEQ ID NO: 11641

SEQ ID NO: 11850 - DNA, 267 bp, Homo sapiens
agatcacgagtcaggagattgagaccatcctggctaacacagtgaaaccccgtctctactaaaaatacaaaaaatcagccgggcgtggtggcgggcgcctgtagtcccagctactcaggaggctgaggcaggagaatggcgtgaacccggtaggcggagcttgcagtgagccgagattgcgccactgcactccagcctgggcgacagagcgagactccgtctcaaaaaaaaaaaaaaaaaaaaaagaaaagaaaagaaaagaaaaac

SEQ ID NO: 11851 - DNA, 246 bp, Homo sapiens
gatcacgaggtcaggagatcgagaccatcctggctaacacggtgaaaccccatctctactaaaaatacaaaaaattagctgggcgtggtggcaggcgcctgtagtcccagctactcaggaggctgaggcaggagaatggcgtgaacctgggaggtggagcttgcagtgagccgagattgcgccactgcactccagcctgggcgacagagtgagactccgtctcaaaaaaaaaaaacaaaaaaacaa

SEQ ID NO: 11852 - DNA, 100 bp, Homo sapiens; identical to SEQ ID NO: 11270

SEQ ID NO: 11853 - DNA, 193 bp, Homo sapiens; identical to SEQ ID NO: 11643

SEQ ID NO: 11854 - DNA, 177 bp, Homo sapiens
cataaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaatgagtc

SEQ ID NO: 11855 - DNA, 140 bp, Homo sapiens; identical to SEQ ID NO: 11644

SEQ ID NO: 11856 - DNA, 187 bp, Homo sapiens; identical to SEQ ID NO: 11645

SEQ ID NO: 11857 - DNA, 1714 bp, Homo sapiens
aactagtcagtcctatgcttgaaacgagatgccccttcaatttttgagacttactatccaagttatggtttcagatctaacacttcttgtaatcagtgtgcaataaatgatgaaatgacattcctggaaatcactaagcgatttacttactctttttctagctcaggctcagcagactttttctgtaaagggccaggtagtaaatgtttgaggctttatgggccacagactatctctgttgcctcttcttatttgtgtctttttttcgaccacttcaaaaatgtaaaaatcattcttagctcacaagccataaaaaacagactgcaggccagatttggcccatgggccatagtttgccaacccgttttaaacactgaggttcgagtctcccattaatggtggcattctctgggataacgcctaaaacattggagttttaattaagttgtattaagtcaccattatcgaaaagatgtattagaaattatgacccgtacagactgggttaaaatgtggcttgtgtgtcttctgcagcttgcacctgcctgcccgcccaggtgattttgcaggcacaatctgaggtgctagaacctggggctttctctgcctctgtctagtcctgctggattgtaagctccatgagggcaggagcttgcttgttgtttgctactatgttcccagcacacagaacactgctgggaaatatgttcggggctggttctcatttgtcttgatagcatccagatttttccaagtagttggctttccgtatgtccattttactctctgtccatatatatacacaacattacatagtactcatgcaccagttaccattcccagggattatgtaattcctcagtacagccctgtgtggtcttgtgtctccatcttacagatgagaggccatgatcaggcagctagtttgtagaaagctgccagggtttgcacccagccattatggctacactgctgggactcttagcgcccctaaagggaagcacttgagtggctcgttgtttatgtcaccatcaggcttccatctcccagcagatgtcagaggatctctggttttcacttctgtaacttttcaaagctctatcaccctttggagaatataagaacattctgagacagacatacagatttgtcaaaactgccgagtttgtccaaactcactgaactgtacccttaaaatgggtgtgttctattatatataagttgtatctcagtaaagttgatttttaaaattgttctcatcacaaagtcaaatggatttggaaagctttaattagagaagaaaaaaagaaaccttttttaatcagaagagtccagcctcttccaacaaaagttgtaattgctttgttttccaagctagctatttaaaaatcaggagttctggccaggcatggtggctcacgcctgtaatcccagcactttgggaggcccgaggcaggcagatcacgaggtcaggagattgagaccatcctggctaacacgacgaaaccccgtctctactaaaaaatacaaaaaattagctgggcatggtggcgggcgcctgtagtcccagctactcaggaggctgaggcaggagaatggtgtgaacccgggaggcggagcttgcagtgagccaagatctcgccactgcactccagcctgggtgacagagcaagactccatctcaaaaaaaaaagaaacaaaaacaagagttctt

SEQ ID NO: 11858 - DNA, 246 bp, Homo sapiens
atcacgaggtcaggagatcgagaccatcccggctaaaacggtgaaaccccgtctctactaaaaatacaaaaaattagccgggcgtagtggcgggcgcctgtagtcccagctactcaggaggctgaggcaggagaatggcgtgaacccgggaggcggagcttgcagtgagccgagatcccgccactgcactccagcctgggcgacagagcgagactccgtctcaaaaaaaaaaaaaaaaaaaatgga

SEQ ID NO: 11859 - DNA, 114 bp, Homo sapiens; identical to SEQ ID NO: 11646

SEQ ID NO: 11860 - DNA, 173 bp, Homo sapiens
ggcgtggtggcgggcgcctgtagtcccagctactcgggagactgaggcaggagaatggtgggaacccgggaggcggagcttgcagtgagccgagatcacgccactgcactccagccgggtgacagagcgagactctgtctcaaaaaaaaaaaaaaaaaaaaaaagaaaagaaa

SEQ ID NO: 11861 - DNA, 63 bp, Homo sapiens
ccactgcactccagcctgggtggcagagcaagactccatctcaaaaaaaaaaaaaaaaaaaat

SEQ ID NO: 11862 - DNA, 153 bp, Homo sapiens; identical to SEQ ID NO: 11649

SEQ ID NO: 11863 - DNA, 202 bp, Homo sapiens; identical to SEQ ID NO: 11650

SEQ ID NO: 11864 - DNA, 203 bp, Homo sapiens
ccatctctactaaaaatacaaaaaattagccgggcatggtggcgggcgcctgtagtcccagctactcgggaggctgaggcaggagaatggcgtgaacccgggaggcggagcttgcagtgagccgagatctcgccactgcactccagcctgggcgacagagcgagactccgtctcaaaaaaaaaaaaaaagaaagacatgtaaa

SEQ ID NO: 11865 - DNA, 190 bp, Homo sapiens
atcactgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaaaaaaaaaagaaa

SEQ ID NO: 11866 - DNA, 108 bp, Homo sapiens
ctgaggcaggagaatggcgtgaacccagaaggcggagcttgcagtgagccaagatcgtgccactgcactccagcctgggcgacagagcgagactccatctcaaaaaaa

SEQ ID NO: 11867 - DNA, 191 bp, Homo sapiens
aaaaaacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaagtta

SEQ ID NO: 11868 - DNA, 193 bp, Homo sapiens; identical to SEQ ID NO: 11654

SEQ ID NO: 11869 - DNA, 195 bp, Homo sapiens
aaatacaaaaattagccgggcgtagtggtgggcgcctgtagtcccagctactcgggaggctgaggcaggagaatggcgtgaacccgggaggcggagcttgcagtgagccgagatcccgccactgcactccagcctgggcgacagagcgagactccgtctcaaaaaaaaaaaaaaaaaagataattctaacaaaca

SEQ ID NO: 11870 - DNA, 182 bp, Homo sapiens
tactaaaaatacaaaaagttagccgggcgaagtggcgggcgcctgtagtcccagctactcgggaggctgaggcaggagaatggcgtgaacccgggaggcggagcttgcagtgagccgaaatcgcgccactgcactccagcctgggtgacagagcgagactccgtctcaaaaaaaaaaaaaaa

SEQ ID NO: 11871 - DNA, 141 bp, Homo sapiens
agtcccagcaactcgggaggctgaggcaggagaatggcgtgaacccaggaggcagagcttgcagtgaggcgagatctcgccactgcactccagcctgggtgacacagcaagactccatctccaaaaaaaaaaaaaaaagag

SEQ ID NO: 11872 - DNA, 115 bp, Homo sapiens
ggctcaggcaggagaatggcatgaacccaggaggcggagcttgcagtgagccgagatcgcaccactgcactgcagcctgggtgacagagcaagactccatctcaaaaaaaaaaaa

SEQ ID NO: 11873 - DNA, 183 bp, Homo sapiens; identical to SEQ ID NO: 11273

SEQ ID NO: 11874 - DNA, 202 bp, Homo sapiens; identical to SEQ ID NO: 11660

SEQ ID NO: 11875 - DNA, 192 bp, Homo sapiens
aatacaaaaaattagccgggcgtagtggcgggcgcctgtagtcccagctacttgggaggctgaggcaggagaatggcgtgaacccgggaggcagagcttgcagtgagccgagatcccgccactgcactccagcctgggcgacagagcgagactccgtctcaaaaaaaaaaaaaaaaaaagaagtagacaaaa

SEQ ID NO: 11876 - DNA, 153 bp, Homo sapiens
gggcgtggtggcgggcgcctgtagtcccagctactcgggaggctgaggcaggagaatggcgtgaacccgggaggcggagcttgcagtgagctgagatcaccccactgcactccagcctgggcgacagagtgagactctgtctcaaaaaaaaaa

SEQ ID NO: 11877 - DNA, 150 bp, Homo sapiens; identical to SEQ ID NO: 11662

SEQ ID NO: 11878 - DNA, 135 bp, Homo sapiens
ctactcaggaggctgaggcaggagagtggcgtgaacccgggaggcagagcttgcagtgagccgagatcgcgccactgcactccagcctggatgacagagcaagactccgtctcaaaaaaaaaagaaaaaaagaca

SEQ ID NO: 11879 - DNA, 142 bp, Homo sapiens; identical to SEQ ID NO: 11664

SEQ ID NO: 11880 - DNA, 181 bp, Homo sapiens; identical to SEQ ID NO: 11275

SEQ ID NO: 11881 - DNA, 122 bp, Homo sapiens; identical to SEQ ID NO: 11665

SEQ ID NO: 11882 - DNA, 123 bp, Homo sapiens; identical to SEQ ID NO: 11276

SEQ ID NO: 11883 - DNA, 214 bp, Homo sapiens; identical to SEQ ID NO: 11667

SEQ ID NO: 11884 - DNA, 177 bp, Homo sapiens
ccgggcacggtggcgggcgcctgtagtcccagctactcaggaggctgaggcaggagaatggcatgaacccgggaggcggagcttgcagtgagccgagatcgcgccactgcactccaccctgggcgacagagcgagactccgcctcaaaaaaaaaaaaaaaaaaaaaaaaagaaggtc

SEQ ID NO: 11885 - DNA, 187 bp, Homo sapiens
aaaatacaaaaaatagccgggcgtagtggcgggcgcctgtagtcccagctactcaggaggctgaggcaggagaatggcgtgaacccgggaggcggagcttgcagtgagccgagatcgcgccactgcactccagcctgggcgacagagccagactccgtcccccagccaccaaaaaaaaaaaacaatt

SEQ ID NO: 11886 - DNA, 166 bp, Homo sapiens
ggcgtgcgcctgtagtcccagctactcgggaggctgaggcaggagaatggcgtgaacccgggaggcggagcttgcagtgagccgagatcgtgccactgcactccagcctgggtgacagagcaagactccgtctcaaaaaaaaaaaacaaaaaaaacatgtaggcag

SEQ ID NO: 11887 - DNA, 142 bp, Homo sapiens
cctcagctactcgggaggctgaggcaggagaatggcgtgaacccggggggtggagcttgcagtgagccaagatcgcgccactgcactccagcctgggtgacagagcgagactccgtctcaaaaaaaaaaaaaaaaaaactta

SEQ ID NO: 11888 - DNA, 5775 bp, Homo sapiens
cgggtccgtagtgggctaagggggagggtttcaaagggagcgcacttccgctgccctttctttcgccagccttacgggcccgaaccctcgtgtgaagggtgcagtacctaagccggagcggggtagaggcgggccggcacccccttctgacctccagtgccgccggcctcaagatcagacatggcccagaacttgaaggacttggcgggacggctgcccgccgggccccggggcatgggcacggccctgaagctgttgctgggggccggcgccgtggcctacggtgtgcgcgaatctgtgttcaccggtgagcaacctccgcctgctcgccggacgcttccagtccctcccccaaaccccttgccctgtccccgcgcccctccacgggcctagcatttcctctgagcagcggcctggcctgatcaccacccatctccccacagtggaaggcgggcacagagccatcttcttcaatcggatcggtggagtgcagcaggacactatcctggccgagggccttcacttcaggtaatggcgggcagagcctgctgaccctgacctttcacccttgacgccgacccagcagtggctatagtcggacgtgcaacaggattcaacgctgctcttttcccaccctcctcatccctgcccctaggatagtgggtgctgcgagaacctccagcagcatacaaactgttgttttccagagggacaagagaatctctccttgtctgtggtcgtggagaggagcaggccaaaaaacgcgtggtgaggggaaaccgggcaaggctagtgaaactgcggccttttctttttttttttttggagagggagtcttgctctgtcgcccaggctggagtgcagtggcgcgatctcggctcactgcaacctccgcctcctgatttcaagcgattctcctgcctcagcctcacgagtagctgggattacaggcgcccgccaccacgcccggctaatttttgtattttagtagagacggggtttcactatgtagatcaagctggtctcgaactcctgacctcaaatgatccgcccgcctcggcctcccaaagtgctgggattacaggcgtgagccaccgcgcccggccgaaactgtggcctcttaatacctatccctgtcctctccaggatcccttggttccagtaccccattatctatgacattcgggccagacctcgaaaaatctcctcccctacaggctccaaaggtaggtctgagcacttggtaatcacatggcaggtgggatgatcaaggtagctggcaagaaaccccaggggaatatggtagtgtcaggcctttaggcctctttccacatctgcaagagctgtaacaaaaatacctgcctcctggggtcaaagcagcaaattctgaacacactgtgtttgcgtgctttttactgtctcctccctgacgtgtattcaataagagtattgtttgtccctcgtcttgttcactgcctagatcaaagctttgttttaaagccttttttttctaactgcttgacttactatatctacagttacatccactagtacactctgttctggagaagtttgtccctaagcttgactagttcacctgttctctccttctagaccatacataaaagccgtgcctttgagttccccagacctcttcctcctccccacccacgcacacatatacaccctgggtcaggtagctcacctgtaacctgtaatgtacttctttgtgctatacctagtgcaggtcgcttattcatttactagactgggccctgggaataaaagattcattaaacacaattcttgtcccccaagtccttacaggagacatgattacggtacagcacgaaagcgcccacgttagaggttgcacagagtacagagggggaaagagtagtcagctctgctggtgacggggtttgcagttcaaggcttcacagtgggtgagggtgcatttcagctgtgctgcgtcttgtcttccttgtcagcctgattaactctcctccccccagggtagtgccaggctgtacaccattgcacagggcatacagggaggaacatgaaggagaaaatgcttgggaaagggtgtttggccttgaccagccactgctgacctcaatctcagacctacagatggtgaatatctccctgcgagtgttgtctcgacccaatgctcaggagcttcctagcatgtaccagcgcctagggctggactacgaggaacgagtgttgccgtccattgtcaacgaggtgctcaagagtgtggtggccaagttcaatgcctcacagctgatcacccagcgggcccaggtctgactcccaccaccatctgcgtggtgtcagcctttccttcctaggcccagagtattgggaattaggaaaggcagcttattagaaaagcattgtcaccctagtgccatttccacctaaaagctgtgctaattgccactgtgaaataaggagagccagcattagaactcgatagcactcggtgttaggaagcacagaggaaaatggccaagtcttggcttttcctgcacctcttcgagcagagaggcttatgttacaggtttgcctgacaggaagctaaggcagtgcatgttgtattgagagtgaagggttaggggtcgcaaccttcctttcagctccccagtcccctcaaaccacccctcccttcccctcttcacccctgccctcaggtatccctgttgatccgccgggagctgacagagagggccaaggacttcagcctcatcctggatgatgtggccatcacagagctgagctttagccgagagtacacagctgctgtagaagccaaacaagtgggtgagtcgcaagagccgtggggtgagggcttctgagatgcaggaggaggaaagactccatgggtggggctcctgacccaggacagggtctccctgactctctcccaccacagcccagcaggaggcccagcgggcccaattcttggtagaaaaagcaaagcaggaacagcggcagaaaattgtgcaggccgagggtgaggccgaggctgccaagatgatatccttctgctggagagatctcagcccagcccctagggcacctgagttccccattctccttcatgggcaggctgatgagactaaggcgaatgcgactccgtgctctctggcccttggctccttgttgggggtggggactacagatgagatctgaaatcttagtggtagtacctgagccatgactccccactgtaaggccagatcaatagcattggtggccttgccttcatttctggtgctgcccctagttcctggcagcagcctgcagggaggcccacaggtggggtccacggtagggctgggcacaagccacctgagcgcaaccttggatctgacagcccagaggaggactggagcaagggagtgtggtaaggacagggccagggattgagacctgcccttgcgtgtaccttaaccctcctcaccttggagaagcactgagcaagaaccctggctacatcaaacttcgcaagattcgagcagcccagaatatctccaagacggtgagtgtgtcagcccagcgtctctgatggggctgccttgagaaagtgctttcagttaaggcacattgaggtgagggaattcgaaccttgcttgttccggtttctactcagattggcttctctggccggcgcggtggctcacgcatgtaatccccgcactttgggaggccaaggtgggtggatcacctgaggtcaggagttcgagaccagcctggccaacatggtgaaaccccatctctactaaaaatacaaaagataatgagcccgctgtggtggcgtttagctatattcccagctacgcaggaggctgaggcaggagaatcacttgaacccaggaggcggaagttgcagtgagctgagatcatgccactgcactccagcctgagcaacagagcaagactccgtctcaaaaataaataaataaaaaattggcttctccgatactcctcctgtcaagaatgattcctctgggttccctgaccttttgttctaatcatagctgctgctcagcgctctggatccctaagtgcgagcagaaaccatgtgttactcattgctgcacccctgccctaatctgcatgtgttccatgttaagtagctgctgaattgcaggggtcggaattgaggtctttgcttaatgcaagcatctgtcttatttcctgccctgtagatcgccacatcacagaatcgtatctatctcacagctgacaaccttgtgctgaacctacaggatgaaagtttcaccaggtgagagatgtggccacactgtggggtatcaccaagaacgtgggacctgagtctggttgtttgggctctggagcctgctacagctattcatatggctcagagacattgaaccaaaattagaaaagggggtggttgacagtttctatcttgcatctcataggattgattttatgagatcaaataggattattcacataaaaagcactttaattataaagttttcatctaaccaaaaagtgatgaaagatgatactcagttttcttactcaagagccctcaaactcctctggtgaatggagggatgttaggaaaggagatgagaaatagcagtggccatgagaacatgcctcctcctttcatgagcctgagattcctggctgtcaaccctgtttatcttttctcttgggagcaaaggagggttcaaagctgagtggggcctgaagctgtcaattaacatgtgcatttctcttctctgtttcttgttcatctggcgatctggcaccacaggggaaggtaagctgttgttgcttctgtggggtcctgcaggccaccttctccagtacccgcctcctaccctaccccctttcccacctccccgaagacaaaccctcaatcagggtaggagggtcgtagagggaatggcctagagtgtcctgcctctcacatttatgtcccctaataatgtcattatctatcttttttttcctacagtgacagcctcatcaagggtaagaaatgagcctagtcaccaagaactccacccccagaggaagtggatctgcttctccagtttttgaggagccagccaggggtccagcacagccctaccccgccccagtatcatgcgatggtcccccacaccggttccctgaacccctcttggattaaggaagactgaagactagccccttttctggggaattactttcctcctccctgtgttaactggggctgttggggacagtgcgtgatttctcagtgatttcctacagtgttgttccctccctcaaggctgggaggagataaacaccaacccaggaattctcaataaatttttattacttaacctgaagtcaaggcttcacgtgttcatgaactgggtaactggcagcaagcatgcgcacgttcacatgtgcgctcctgggtctgtctttgtgtgtgccagcagggggcgcaaaagaatctggctggggcggctaaggggaagcaaggcctgggctccgaaacaggacccaagctgggaaggctggccctgagttctcgaggcccagctgtgctcttcacacaccctccatttctcccacatcacccatttttttaaggctggacagccatggctttgctgagccagattaaaaatctgatgaccccaacaggagctgcttccttggcagcagggttccttgtggctgtggggagcctgcctgtgcctgttgaggcacttctgtgcccagaagcccagtggatcgcgtggc

SEQ ID NO: 11889 - DNA, 738 bp, Homo sapiens
ctggagcccggggtcctccgctcaactcaggacgttgaggctgcattgagccaagatcatacctctacactccagcatgggcaaaagagcaagattctgtctcaaaaataaataaataaattttgtttttaattagccaggcatgatggcatgcacctgtagtcccagctattcaggagaccaaggtgggaggatcatttgagcccaggaatttgagactgcagtgaactatgatgatgccactgcattccaacctagatgacagaaggagacctcatctctaaaaataaatatatatattttttccaaccactttttatctataccccaatgtcttacattccataaaacatcatgttttgaattccagtataactttatcgttaaacatgtttctttgcagaagcatgtataagttagggtccacaagattatttgcataagctaatttacaaaaaaaattatataatcactgacatgaaagcatgtctgggcagccatgggagctcatatgaggcgtccagttcagtcgccttttaaaaatgatatttgcattagctgggcatggtagcatgtgtctgtagtcccagctactcaggggactgaagtgagaggatgcaccagagccccagaagtcaaggctgcagtgagccatgatcacatcactgcaccagcctgggcaacaggagtgaggccttgtctcagtcagtcaatcaatcaatcaataatggtatttgg

SEQ ID NO: 11890 - DNA, 268 bp, Homo sapiens
cggccgaattctgccctccgctaacgagctatagctttgtggaaatgggcgagtggcgtgcccttgtgagcctcagggccgcatctgtaaaatgggcataactgtcatgcctgtctttaagaacagccttgggggtaaatgagtggaactcatggaaagatctcagcccacaaccttccacagaacaggcgcttctcacacagtaagtagcaggagtgcagaggctgcaggcatgaatccagccagactgcctgggttcaagtcccag

SEQ ID NO: 11891 - DNA, 368 bp, Homo sapiens; identical to SEQ ID NO: 11673

SEQ ID NO: 11892 - DNA, 131 bp, Homo sapiens
ttttttttttgagatggagtctcgctctgtcgcccaggctggagtgcagtggcgggatctcggctcactgcaagctccgcctcccgggttcacgccattctcctgcctcagcctcccaagtagctgggact

SEQ ID NO: 11893 - DNA, 2925 bp, Homo sapiens; identical to SEQ ID NO: 11674

SEQ ID NO: 11894 - DNA, 534 bp, Homo sapiens
ctttggcttcccaaacctttggggattacaggccactgctgcgcccagccctgggattcctaaattgaccatacattattactgtcacctggaggtcttgttaaatagattgctgtgcctacccgcagagttctggttctgtaggtctggaatggggccatagaatttgcatttctaacaaggtcccaggtgatgcggactctggggcaacaggggacactttgagaactactgacctaacaaaagatttggaagagtctctcctttctctgaaggccagtttttctactggaacccagccctaaggaagagacaagacccttaggaacacgcttgccctgagagtcagcttactgcttcagcccacccaggggcaagcgggaggcagaggccactccctgtggggacagagactgcctgcagctagacgtcggccatccagtcttatcagtcaggttagggaaggcatccagtattatcagtcaggttagggaaggcacattgtctcccctcccactaacatttgaacttttg

SEQ ID NO: 11895 - DNA, 4706 bp, Homo sapiens
tattattatactttaagtttcagggtacatgtgcacaatgtgcaggtttgttacacatgtatacatgtgccatgttggtgtgctgcacccatcaactcgtcatttagcattagatatatctcctaatgctatccctccccactccccctaccccacaacagtccccggtgtgtgatgttccccttcctgtgtccatgtgttctcattgttcaattctcatctatgagtgagaacatgtgctgtttggttttttgtccttgcaatagtttgctgagaatgatggtttccagcttcatccatgtccctacaaaggacatgaactcatccttttttatggctgcatagtattccatggtgtatatgtgccacattttcttaatccagtctatcattgttggacatttcggttggttccaagtctctgctattgtgaatagtgccgcaataaacatacatgtgcatgtgtctttatagcagcatgatttacaatcctttgggtatatacccagtaatgggatggctgggtcaaatggtatttctagttctagatccctgaggaatcgccacaccgacttccacaatggttgaactagtttacagtcccaccaacagtgtaaaagtgttcctatttctccacatcctctcagcacctgttgtttcctgactttttaatgatctccattctaactgttgtgagatggtatctcattgtggttttgatttgcatttctctgatggccagtgatgatgagcactttttcatgtgttttttggctgcataaatgtcttcttctgagaagtatctgttcatatcctttgcccactttttgatggggttgtttgtttttttcttgtaaatttgtttgagttcattgtagattctggatattagccctttgtcagatgagtaggttgcaaaaactttctcccattctgtaggttgcctgttcactctgatggtggtttcttttgctgtgcagaagctcttcagtttaattagatcccatttgtcaattttgtcttttgttgccattgcttttggtgttttagacatgaagttcttacccatgcctatgtcctgaatggtattgcctaggttttcttctagggtttttatggttttaggtctaacatgtaagtctttaatccatcttgaattaatttttgtataaggtgtaaggaagggatccagtttcagctttctacatatggctagccagttttcccagcaccatttattaaatagggaatcctttccccattgcttgtttttgtcaggtttgtcaaagatcagatagttgtagatatgtgacattatttctgagggctctgttctgttccattggtctatatctctgttttggtaccagtaccatgctgttttggttaccatagccttgtagtatagtttgaagtcaggtagtgttatgcctccagctttgttcttttggcttaggattgacttggcaatgtgggctcttttttggttccatatgaactttaaagtagttttttccaattctgtgaagaaagtcattggtagcttgatgggaatggcactgaatctttaaatgaccttgggcagtatggccattttcacgatattgattcttcctacccatgagcatggaatgttcttccatttgtttgtatccccttttatttcattgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgcacattgattttgtatcctgagactttgctgaagttgcttatcagcttaaggagattttgggctgagatgatggggttttctagatatacaatcatgtcatctgcaaacagggacaatttgacttcttcttttcgtaattgaatgccctttatttccttctcctgcttgattgccctggccagaacttccacactatgttgaataggagtggtgagagagggcatccctgtcttgtgccagttttcaaagggaatgcttccagtttttgcccattcagtatgatattggctgtgggtttgtcatagctagctcttattattttgagatacatcacatcaatacctaatttattgagagtttttagcatgaagcattgttgaattttgtcaaaggctttttctgcatccattgagataatcatgtggtttttgtctttggttctgtttatatgctggattacgtttattgattttcgtatgttgaaccagccttgcatcccagggaggaagcccactagatcatggtggataaactttttgatgtgctgctgtatttggtttgccagtattttattgaggatttttgcatcaatgttcatcaaggatattggtctaaaattctcttttttggttgtgtctctgccaggctttggtatcaggatgattctggccacataaaatgagttagggaggattccctctttttctattgattggaatagtttcagaaggaatggtaccagctcctccttgtacctctggtagaattcggctgtgaatccatctgttcctggactttttttggttggtaagctattgattatttcctcaatttcagtgcctgttattggtatattcagagattcaacttcttcctggtttagtcttgggaggatgtatgtgtcaaggaatttatccatttcttctagattttgtagtttatttgcatagaggtgtttatagtattctctgatggtagtttgtatttctgtgggatcggtggtgatatcccctttatcattttttattgcgtctatttgattcttctctcttttcttctttattagtcttgctgtctatcaattttgttgatcttttcaaaaaaccagctcctgaattcattaattttttgaagggttttttgtgtctctatttccttcagttcttctctgatcttagttatttcttgccttctgctagcttttgaatgtgtttgctcttgcttctctagttcttttaattgtgatgttagggtgtcaattttagatctttcctgctttctcttttgggcatttagtgctataaatttccctctacacactgctttgaatgtgtcccagagattctggtatgttgtctttgttctcattggtttcaaagaacacctttatttctgccttcatttcgttatgtacccagcagtcattcaggagcaggttgttcagtttccatgtagttgagtggttttgagtgagtttcttaatcctgagttctagtttgattgcactgtggtctgagagacagtttgttataatttctgttctttgacatttgctgaggagtgctttacttccaactatgtggtcaattttggaataggtgtggtgtggtgctgaaaagaatgtatattctgttgatttggggtggagagttctgtagatgtctattagttccgcttggtttagagctgagttcaattcctgggtatccttgttaactttctgtcttgttgatctgtctaatgttgacagtggggtgttaaagtctctgattattattgtgtaggagtctaagtctctttgtagttcactaaggacttgctttatgaatctgggtgctcctgtattgggtgcatatatatttaggacagtttgcttttcttgttgaattgatccctttaccattatgtaatggccttctttgtctcttttgatctttgttggtttaaagtctgttttatcagagactaggattgcaatccctgcctttttctgttttccatttgcttggtagatcttcctccatccctttattttgagcctatgtgtgtgtctgcacgtgagatgggtttcctgaatacagcacactgatgggtcttgactctttatccaatttgccagtctgtgtcttttaattggagcatttagcctatttacattcaaagttagtattgttatatgtgaatttgatcctgtcattattatgtcagttggttattttgctcattagttgatgcagtttcttcctagcctcgatggtctttacaatttggcatgtttttgcagtggctggtactggttgttcctttccatgtttagtgcttcttccttcaggagctcttttaggacaggcctggtggtgacaaaatctctcagcatttgcttgtctgtaaagtattttatttctccttcacttatgaagcttagtttggctggatatgaaattctgggttgaaaattcttttctttaagaatgttgaatattgccccccactctcttctggcttgtagagtttctgccaagagatcagctgttagtctgaggtgcttccctttgtgggtaacccgacctttctctctggctgcccttaacattttttccttcatttcaactttggtgaatctggcaattatgtgtcttggagttgctcttctcgaggattatctctgtggtgttctctgtatttcctgaatttgaatgttggcctgccttgctagattggggaagttctcctggataatatcctgcagagtgttttccaacttggttccattctccccgtcactttcaggtacaccaaacagacgtaggtttggtcttttcacatagtcccatatttcttggaggctttgtttctttttattcttttttctct

SEQ ID NO: 11896 - DNA, 129 bp, Homo sapiens
ttttttttgagatggagtctcgctctgtcgcccaggctggagtgcagtggcgctatctcggctcactgcaagctccgcctcctgggttcacgccattctcctgcctcagcctcccgagtagctgggact

SEQ ID NO: 11897 - DNA, 1548 bp, Homo sapiens
agcagctcttgcagtgggtgggcgacttcgtgctgtacctgctggccagcctacccaaccaggtgcgccatgctctcccctaaggccccgccccccacctgggcccccatctcatcaggaccccgcttccctgcccctgcccctcaaaaccacctcagccccgcccctagttggagtcccgcccctacttggagtcccgcccctacttggagtcccgcccctgcttggagtcccacctcagccccgcccctggttggagtcccacccctacttggagtcccacttcctgagtctgtctcttcttaaacccccacttcctagccctgccccacttcctagccctgccccacttcctagccctgccccacctcggagccctgccccatctcggagccctgccccacctcggagccctcccccacctcggagccctcccccacctcggagccctgccccacctcggagccctgccccacctcggagccctgccccacctcggagccctcccccacctcggagccctcccccacctcggagccctgccccacctcggagccctcccccacctcggagccctcctctccatgaagcctctgctgtaagaagcctttccttggccacacccttcctgcccattctcaaagccccgcctcccaggccctgctccttctcagccccacccctacacgaaggccggttcgccttgctcctgctgctgctgcccccaccccttaccctccccagctccctgcgcctggggtgggcggccttgaaatcaagtctccatccacacctccaccttcagttttgcggcttgtgcgcccctgaccagggctccaacctcgcccccacccccccgccggtacactctgtcctgccccagctgtgatttcttctgccccacccacccggcttcatcctgccctggggcccgcccttctccaccgcgcccatcacggacggtttgaagtccctctcttctttttgtggggctttaggctgccaggggccacccctggggcctccccttccctggtcctctcagctcccagtacagtcaccaggggcccgggcccgcagctgtaggagggggcggctgctcctccacgtgcaggtggggatattggcctcagccagagcctcgtcttagtcttgtggactctcagggatgggacgactctgcaaatggggctgtcctgggccctgcagggctctgagcagcgtccccggcatccacccactcggtgccagaagcaccccagtcctgaccaccacaaatgtcccagaccctgcccattgccccccggtcggggttccaccgaccccaagacacttcatcccatcgccatctgccccccgccgccccagccacaccgatgcctctttcgggcagggttccctgctgaggccgggccacagctttctgcgggacggcacctcgctgggcatgcttcgggaattgatggtggtcatccgcatctggggccttctgaagcccagctgcctgcccgtgtatacggccacctaggatacccaggacagcatgtc

SEQ ID NO: 11898 - DNA, 4704 bp, Homo sapiens; identical to SEQ ID NO: 11676

SEQ ID NO: 11899 - DNA, 1090 bp, Homo sapiens; identical to SEQ ID NO: 11677

SEQ ID NO: 11900 - DNA, 2125 bp, Homo sapiens
tatctgtaataattaccagtttattactctggctaagagatccagaggtaattggaggtttacatttcatttttacgcttctgttattgagagtttattaagtgtttcattgccttccaaaggcgattgacaagttcttttactgtctactttagggttttttgtgacacaagtaatatacacacataaacatatattcattttttggcaagtgagaagatgcagataggcaaaaagaaaaaaaaagagatcacacagagattcactgttaacctttggtgtataataaaatcagacactttcctttgcattatgtcacatagaaatgtacaaataaagtgtacatatatacacacatatatgtatacactgttttgcaactcgttattttcactttgcaatatacaatgagcatttttccatgcaaatgaatgagacctcttattaaatgaataagattgggtcaaaagatgagatgttgacaagagtcatatgtaaatctcagcaacatcgaatgactggagtaaaacgatagcaaatatttatcaagaaagtgcagacaaacagaaagcagtggcaacattaataacagaaaataattgaattgtcagagaaattaattaaatgggataaggacggtcccgagaatgcctatggttagaatgcagagccctaaatttctttctcagaccccttatctcttccaaacacctttccatctcatctccctcccttgtcatttcttcatctttaaaatgcctatagtctatgtcctctttaaattcttcgagagactgaagcagcctctgtctaaaattcccttctgtttgctggcgttcaaattctccatacgggcgtttttcctccctctttggcacgctgcactttggctttccttcgttttctttgcagggtttttgcatgatgttgttgttgtttcctgcttaactctagggagaaaatgtaaagacaaattgcttcattacttttgaatcacgattgtcagtttctctctgaggcaagatactttcccatctctgccccacaggtccagacctcataagtctgcggcagttccctccaccctctcatctcccccttttctcccctcccacctcaggaacccaccgtttccccagcagacaaagctaatggcctctccaataggcaggagaggcggagcagaaaaggagatggactgcgaagccgcaaatttcgcctagcttttgccccttcccgactcctatcctcagagatctcagtctaagtgcctctctcatactgacctgtgcggggtagtttcctgctccttttcttcccccagatgtctgtgaacacagatcctgggacctccaaacaaaaaggaaggggcggggaggaaggagctatctgtggatcaaccagctccagagacaagacagacgttattattttgaacctgggattctcatcatcaccgtcatcgccccccggatttctacctcctggcccctccttcctgtctgtatcctttccttcaggatttccgtttccactccccactcctcaccctcaggcctgggccttgcaaggcccgcgtctccctccttcgccccgtcccgcgccccaccccaccaccacaggccggcattgagtgaggtgaactattttcaaatgatctctaaatttctgttgtctccatcccgggatttcagcctttctccacacaccaacacataccccaggcctaaaattttctcttaacaaaattggagaaagatgaggagaaggataaaaagaaagcatgccagggtgagagaagccgattatttcaaagctgtcactaaatctctaggtgtctctcaaaagatttcgacctacccccttgcttccccctgcaaaagatacaattatctccgacgattttgcagcggttttgggaaagcaagtctggacctattccagtcattagattcacccactactgaccccgggggtccagtggttccttcactccaacctgctgggatttaaggaatttacctcttccttcccttggccacaagcacgcacggcacgcttgtctgcagggcagtaaggagctggtacccagaggagaaagaagcccgggaatataaggacttcg

SEQ ID NO: 11901 - DNA, 7963 bp, Homo sapiens
gctacataaaagtcatttgcagcaactattcaatttccagaattaggttatacttgtgtttgtggttgttttcctgaggaaataatctaataatcagaaaagctaatatttatttgtgtttataagagccaggcactgtggtaagtaccaaccatttaatccttaattgtgtgaggcgtagatactcttctgatgctcactttttagacaaggaagctgcggtgtggggagattacgtaactggctcaaggtcacggggttcgtggtggcatctgcagcttctgggtctggccaactctggcgctcacatgctcacattctttcttcaatattttactcaaaacaatggttggggccaggtgccaccacacctataatccctgcactctggtaggccgaggcaggcagattacttgagcccaggagtttgagaccagcccgggcaacatggcaaaagcctatctctacaaaaaatacaaaaactagccaggtgtggtggcgaatgtctgtagtcacagttacttgggaggctgagacaggaggattgcttgagcctgggaggtggaggctgcagtgagccgagatcataaccactaccctccagcctgggtaatgggagtgagaccctatctcaaaaacaaaacaaaacaatggttggaatagctagtgtatctcccatttcttatgtcatccactactagaagcctgatcacaaattttcaggaatagcaagtgttatttccttttattaaattgtgaagtgtcatgctttgtcacagaacaaatgctagctctccataagatcattggctcatgcgttatcctcatctggagtccaaatagaccattaggtggaagtttcaaagatgcagattttaaatctagtcatgaaaaagtgtcatagccaccagagctggggcatggcatgtctcaggaagccatgcttgtcacagaggaatcactccgaggctaaaggaacatctgggcaatcctacttgtgtactcattggattcattcagtgaccttgttattatccttctagctaaatgctctgggtcttaattcacgactccaaggttgctcttgattttaaggaacattttggcagaatagagagaagttgagcaaatattaacagatgtccaaaggggcagtgtgatttattatgtcaagagaatcagttttatgtcgagggaagaattttggtagaaatacactgtattttttggaaaatatcatatttgggttttttcattgtataagtaatacatggatacatgcttatataaagaaaaattcataatatagaaacataaggaggaaaaatgagtcatttttctcccatagttcactcctttcccctccctttcagtaaccagtgctaacacgggtgtgtctttccagacgttaaaagcagtcatacatatctctaagggaaagtttgcatttgcttgttttttcttcctgtattaataggatttgtgtatatatatacacacacgtaatatattttgtatctgtatatatagagcatatttctgtggtgcgctttttaaattttatgacaaatcctacagctcttccatgtcactgcatatagatgtatccacattctttttaaaaccacaaagtattccatggttagacttttccataattcagccattttcctattaatgacatttatttgttacagcagtgttcacaatagccaagatacagaaccaacccaagtgccaacaacagatgaatggataaagaaaatgtgatagatatacactatagagtactattcaatcattgaaaaggatgaaatcctgtcattcatggcaatatggatagaactggagacaattaagtgaaataagccaggaacaggcagttaaacactgcatgttctcattcatatgtaaaagcttagaaaaagttgatctcatagaagtaaaaaatagaacagagaatactagaggctggaatgggagggataggtagagatttgttaaattatacagaattacagctagatatgaggaatgagctctggtgtactatactattgtagatgactatacttaacaataatgtatagtttcaaatacctgaaaggaggatattgaatgttcccaacacaaataataaatgattgagatgatggatgtgctaattaccctggtcttagtcactgtacgttatatgtttcaaaacatcactgtgtactctgtgaatatgtgtcaattaaacagacaaaattcaattgaaaataaaatcagaaattaaaccttcatctagtttccttttcatagtgatttatctgcattagaaagcaatactgggagtattccaataattacatttagtcagaatcgagacctcctgtcctagctagttagccagagacttgaaacagaggtcttctgaaattcctagtctctggggaaatagaatcacaaccactaggggcaaaaacccatggcttttatgtcatcattgtgttccgttctgttgcatactttgtgtgtgggtgtgtgttttatacttttttccctttaaccgtttatgctccttcatgttggtcctatgtccgtttgactcagcccattcatctttgatagtttcgttgctttctgacttaaattttatgcttcttgctgcagatcaggaatcagccattcatctaaggaactcaggttctgtttaggaggaatgatatttagcagccacagcatagttacataatttgcttgttgctattgtgttgtcatttttcagtgaatagttctaggaaataggtattattaaaagaaaaaaatgtgatcatgttgttatttccaattcaaatttaacattacaaatgtttacatctttgattttgtacttgtatcttttctcttacactgaagatcttggttcctaaattacattaacataattcctcccttgcattaataaaatagttccaaaagagcaacattgctgtcacaaacaaactacaaaatgaagtttggctgggtgttgtggctcacatctgtaattccagcacatttagaggctgagacaggtagatcacctgaggtcaggagttcgagaccagcctggccaacatggcaaaaccccgtctctactaaaaatacaaaaattagccagacatggtggtgcctgtctgtaatcccagctacttggaaggctgaggcaggagaatctcttgaacccgggaggcagaggttgcagtgagctgagatcacgccatcccactccagcctgggcaacagagactctctcaaaaaaaaaaaaaaaaaaagaagtttaagatttgtctttgttttgttttgttggaattttgtttctatttttatccttagcatctattctaaaatagatactttctatgctgtcttatagacctttgaaataattcctctagtcagtcttacttgtttgtgtcttgtttgtttgttttttgaaatggagtctcactctgttgcccaggctggagttcagtggcacgatctcagctcaccgcaacctccgcctcctgaattcaagtgatctgcctcagcctctcgagtagctgggattacaggcatacgccaccacacctggctaatttttgtatttttagtagagatgggatttctctatgttggccaggctggtcttgaactcctgacctcaggtgatccgcccacctcagcctcccaaagtactgggactacaggcatgaaccaccacgcctggccagtcttaatttattttaatttgattttcaatttttaggatttgctattttgttttattttttatttttatttttttgagactgagtcttgctctgtcgcccaggctggagtgcagtggcacaatctcggctcagtgcaacctccacctcctgggttcaagcaattcttgtgcctcagccttcccagtagctgggattacaagtgcccgccaccacacccagctaatttttgtattttttgtagagacgaggtttcaccatgttggccagggtagtctagaactcctgacctcaggtgatctgcccgcctcggcctcccagagtgctgagattacaggtgtgagtcaccatgcctggcctaattttatttttgaatacgtaaaacacctatgtctctaaagtagaaattctataacaagatacactcagagatgcctcactcttccttgtaccctcctcccttcttcaaaatgaaattgattattagggtttggtttattatttcattgttctttgtgcaagggcgaacaaatccatgtatactcctgccctacacacacacacaggtagcgctccatctgctattctgtgccttgcttttttcagacgcgttaggaaaggccacatcagtcatgacatacacaggcttctttactcacagcactcattgtcgctttcatatttcttgctttagtctgagttttttaattctataagtaaaaacattttttaaatccagaattcaaaagtgatcataaaagttattcctccttttatcatatactctcagccgtttatgtggagtaggagtgtgagtgtgtagccttccagacccttctgtgttacagaacagaggaatttcttattgaaatttaactttgaattgttatactcgtaattttcttagttactatgctaatatctcattatttaccggttcctagacatcagacaaaaactgataaattctcaaatacagagtaacagacaaagttgtttcatagtgtctggtatcaagatgataaagcatacacccatcttcctcagcttcatttctaaaaatggaactgaggaaaccaagttatgaaatataatcaaattattaaatataaatttaagcatatattattaaatataaattaataaaatacatttattgattataaactacttaaatataatccattgagttctatctttgggtctgtcatcaccttatagaactttttagacttttgtctcgaaaactggaacagaaagatcaggttttattacatatgaacatttttaccataaagtgtaattcagaaaacttcctagtttcctccttttttcaagatactaggaaaatcaggctttagttttatgctttccgctctgtactcccaaacaagagctcttaaatatttatacttctgttacccccaaagtttactgctgtgatttggagaagtaccaagttcatgtatctgtttgctttatttatcctattttttttctttctaggtattttttgatttaatgagagaaattcgagcgagaaagatggaagacagcaaagaaaagaatggaaaaaagaagaggaaaagtttagccaagagaatcagagaaagatgctgcattttataatcaaagcccaaactcctttcttatcttgaccatactaataaatataatttataagcattgccattgaaggcttaattgactgaaattactttaacattttggaaattgttgtatatcactaaaagcatgaattggaactgcaatgaaagtcaaatttactttaaaaagaaattaatatggcttcaccaagaagcaaagttcaacttatttcataattgcctacatttatcatggtcctgaatgtagcgtgtaagcttgtgtttcttgggcagtctttcttgaaattgaagaggtgaaatgggggtggggagtgggaggaaaggtgacttcctctggtgtttattataaagcttaaattttatatcattttaaaatgtcttggtcttctactgccttgaaaaatgacaattgtgaacatgatagttaaactaccactttttttaaccattattatgcaaaatttagaagaaaagttattggcatggttgttgcatatagttaaactgagagtaattcatctgtgaatctgctttaattacctggtgagtaacttagaaaagtggtgtaaacttgtacatggaattttttgaatatgccttaatttagaaactgaaaaatatctggttatatcattctgggtgtgttcttactgacaccaggggtccgctgccccatgtgtcctggtgagaaaatatatgcctggcacagcttttgtatagaaaattcttgagaagtaactgtccgctagaagtctgtccaaatttaaaatgtgtgccatattctggttcttgaaaataagattccagagctctttgatcgcttttaataaactgcaagttcattttaaatgaagggccagcatatatacttgcaagataattttcagctgcaaggattcagcaccagttatgtttgaatgaaccctccttttctctgagattctggtccctggaaatccctttctgctagtggtgagcatgtaagtgttaagtttttaatctgggagcagggcataggaagaaaatgtcagtagtgctaatgcattttgcactagaacgcttcgggaaaatattcatgcttgccatctgttcatttctaaatttatattcataaagttacagtttgatacaggaattattaggagtaattcttttctgtttctgtttataatgaagaacactgtagctacattttcagaagttaacatcaagccatcaaacctgggtatagtgcagaaaacgtggcacacactgaccacacattaggctgtgtcaccattgtgtggtgtacctgctggaagaattctagcatgctacttggggacataatttcagtgggaaatatgccactgaccgattttttttttttcctctttgcagtggggctaggacagttgattcaacaaagtatttttttcttttttctcagtcctaatttgaacaggtcaaagatgtgttcaggcattccaggtaacaggtgtgtatgtaaagttaaaaataggctttttaggaactcactctttagatatttacatccagcttctcatgttaaatatttgtccttaaagggtttgagatgtacatctttcatttcgtatttctcataggctatgccatgtgcggaattcaagttaccaatgtaacactggccagcgggcccagcaatctccatgtgtacttattacagtcttatttaaccaggggtcctaaccactaacattgtgactttgctttgagacctttcctctcctgggtactgaggtgctatgaagccaactgacaaagatgcatcacgtgtcttaggctgatgccactacccgatttgtttatttgcaatttgagccatttaaagaccaataaacttccttttttaaaatgtttgtggtgttacttgatgtttacaatgtaacatgtaacattcaaatgtatcaaatgaggcatctttaccaaacaactaaatcttttgagctctcagtttggagacttcttttgtgtaatgccagatttcctaaataacagtgtcagcattgctcagatttaatcaaggctcagaaatggaaggactcgtgtacaactacattgaagatattctatgccgtcatgaaatgacaaatgtgtacattacttttagaatgctccaaactctagaatgaataggtgacagctttatattcattttctaatcagaatgacccccagagacaatttccaaattgtgggaagaatgacaccctgtaccatttcaccaagcttcaggccaacgtttgatgtctggagggaagcgtggcctattaactatcgaatagcctgcaagttagaaacaatccagcccaatattgagcacaacctttcaaaatctggttcattttaatttcgtaactcataagcagtgctagaatgagcacatttaagtaataattggcataattttaaatctcattgtgtgtacagatccttaacaccaatatggaatatgatgttaaatactatgcgtcataatcccagcattttgagaggccaaggcaggaggtttgcttgagcccaagagttcgagaccagcctggacaacatagccccatttacaaaaaaattaaaaaa

SEQ ID NO: 11902 - DNA, 435 bp, Homo sapiens
tttatgggtaaaacagtcatttattctgcttatacattctgtggccaagaatttgaacagggcacagtggaaatggcttggctctgctctacagtgtctgctgcctcagctgaaagcttcaagtctaggcactggaaatacctaaacttaggttctgaaggcttgttcgcacatgtctggctcagccagatgatgctggccattatccaaggatgcctcagttcctctccaggtgggctcctccatgtggccttttccatgtgtgctagtttaggcttcctcacagcacagtgggcagagtctccaagggcaagtgtcacaagagaaaaagaaccaggcagaaaccatacggccttttatgacatagtctctgaagttatgcagcattatttctacctcattctacaggttggagatagtcacaaagtctcacct

SEQ ID NO: 11903 - DNA, 965 bp, Homo sapiens
ttagaataaggtggattgggaatttagtcacagttttataataataagtcatgtgtctaatttaatgtattggggaatttttttttccatattaaattttctagcattcttcagtctggttctgatcagtgtattattgtggacaggaatggtagtgtttaggagcttggaccctggagtggaactggttggatttgaatcccatctctatcactgctgtgtgacctcaggcaacttacctaactttcctggccctcagttttcctacacagaaaatgggaataataaaagtatctgcttcataggattattacgagaattcgctaactcaatatatgcaaatctgttggaccagtgcttagcacataacagtcaataaaggttgagtgtcagcttttattaacagtaataaaattggctttctctccagtcagctaaattaattaggattttactttattcttccagttttataggaacaataccaaacctacctgagtttttgcgaataacttagtgacagcaataatcaaaataaccagtaaaatctaacagcaatagcagaacctacaagaaattattttcttcttggggctgttgaccagtgtcataaagactgttgaccagtctttatgaagtcacattggatttatcttgtgggtaattttttcatttgggaacttaattttgattaactgaaaacattattattaaatatcttttttataattgtatgcagcataaaaagcacaagtcccttttccgtgccaaatttttatttcagcctgatgatgatagagattaaaccctgtcaaatccttttgatatcttaggttttgctgataattgatattctacaaatgagtgggtaaatgacagattgtatttgaagcatatcagacaaaaagtagttattgaatctctacttgatacccagcattgtaccaaaaaaaaaaaaaaaaaaa

SEQ ID NO: 11904 - DNA, 965 bp, Homo sapiens; identical to SEQ ID NO: 11903

SEQ ID NO: 11905 - DNA, 2272 bp, Homo sapiens
gatgcgcctgtgccggggagggcagaacgctggtgcctggcacaggtgccacaacacatacgggtgaggacactgaaaacccctcagttcccccgactcatggccacttgtcccagtgacacagccatgctctcccactcacccacaatagggtctgaatgtgccccccagattcacagtgagaaactcattccccagagcaacagtgtagagaggtggaacctgatgggagccccgccctcacagacaaactcctgtagctgtcaagacagcttgggcatggattcctctctgccttctgccatgtggacacgtggccttcctcccctctctcctccggggaatgcagtgtttgggcgccatcttggaagcagagatcaggcctcaccagacaccaagcctgctggcaccatgaccctggactcccaacctccacagctgggaaagaactctgctccctagaaattacccaggctcgctcaggtattctgttacagcagcaccaagagacattcactcgcttactccctcactctctaacccactcccattcaccctctcactccctctctaacccactcccattcaccctctcactccctcgctaacccactcccattcactcattcactcactcactctctagcccactttttttttgagatggagtcttgctctgttgcccaggctggagtgcagtggcgcgatctcggctcactgcaacctctgactccgattcaagctattctcctgcctcagtctcctgagtagccgggactacaggcatgcaccaccatgcccagctaattttgttttttgtttttgttttgagacggagactcgctctgtctcccaggctgaagtgcagtggcacgatctcggctcactgcaagctccacctcccaggttcacaccattctcccgcctcagccttctgagtagctgggagtacaggcgcccgccaccacgcctggctaattttgtttttgtatttttagtagaggcagggtttcaccatgttgaccaggctgctcccgaactgctgacctcagatcatctgccctcctcggcctcccaaagtgctgggattacaggcgtgagccaccgcgcccggccctctttagcccactcattcactcactccctcgctctctaacccactcctgctcactcactcattcactggctcactcactctctaacccactctctctcattcccttgctcgttctctagcccaccctcgcacactcattcactggcccgccccttaggtgtgtgctcctgtaccaacactgaaatccagctgtcacaacaggcacccactgactccagcctcatggaaccaccattcaccaggcttgaggggaggatgtcacggcgcgctgctcccttcggtgccagccaggatggggccgggtgggtgcagctggtgaaaagaaatgcagccccccagcccctgcagaccaagccgaacagcccagctcgcgggtggatcacagggcacccagcagccgccttccctccggaagagccaagaaggcttccaagaccagaaatgcccccagtgtggctgtgcctgtccccggtgccccgccagctggggggcagcatacccaaacagatgcaccctgcccatgatggcaccccagggacccccatcctcaggaccctccagtcgttcaagctggaattggcaggtttctgcctgtataggcatcggcttcagagtctcaggtgctgcttggcaggaaaatgcagggcaggaggggctgggcctcagctcgaggctcccaggtgcagccccccactccactgcagggcccaggggggccaagaacagccacaacaacaacaaaagccaaactgggaacggaatcgtggaaaaaaccctcataggcttttgggaacttacaaagaaatgcccacatccattctactaacatggcatctactaacgtggcatctactaggatgccacaaaacagacaaatccttccacgtaaggctggacacgtgtcagggcggtgtctcaaagctgggccacaggcagcatccacggccaggccactgggtggaggagacggtgctggggaggagccggagggaggggccggggctgttcccttaggcagaacggctcacctgtggtgtgcgcacagcaggattgtggggacacaagatgcccccttcattcatcagttacttgtattctttgtatgaaacacctgccgataaaatgtgaaaaaggggcatttcctaaagtactttc

SEQ ID NO: 11906 - DNA, 2272 bp, Homo sapiens
gatgcgcctgtgccggggagggcagaacgctggtgcctggcacaggtgccacaacacatacgggtgaggacactgaaaacccctcagttcccccgactcatggccacttgtcccagtgacacagccatgctctcccactcacccacaatagggtctgaatgtgccccccagattcacagtgagaaactcattccccagagcaacagtgtagagaggtggaacctgatgggagccccgccctcacagacaaactcctgtagctgtcaagacagcttgggcatggattcctctctgccttctgccatgtggacacgtggccttcctcccctctctcctccggggaatgcagtgtttgggcgccatcttggaagcagagatcaggcctcaccagacaccaagcctgctggcaccatgaccctggactcccaacctccacagctgggaaagaactctgctccctagaaattacccaggctcgctcaggtattctgttacagcagcaccaagagacattcactcgcttactccctcactctctaacccactcccattcaccctctcactccctctctaacccactcccattcaccctctcactccctcgctaacccactcccattcactcattcactcactcactctctagcccactttttttttgagatggagtcttgctctgttgcccaggctggagtgcagtggcgcgatctcggctcactgcaacctctgactccgattcaagctattctcctgcctcagtctcctgagtagccgggactacaggcatgcaccaccatgcccagctaattttgttttttgtttttgttttgagacggagactcgctctgtctcccaggctgaagtgcagtggcacgatctcggctcactgcaagctccacctcccaggttcacaccattctcccgcctcagccttctgagtagctgggagtacaggcgcccgccaccacgcctggctaattttgtttttgtatttttagtagaggcagggtttcaccatgttgaccaggctgctcccgaactgctgacctcagatcatctgccctcctcggcctcccaaagtgctgggattacaggcgtgagccaccgcgcccggccctctttagcccactcattcactcactccctcgctctctaacccactcctgctcactcactcattcactggctcactcactctctaacccactctctctcattcccttgctcgttctctagcccaccctcgcacactcattcactggcccgccccttaggtgtgtgctcctgtaccaacactgaaatccagctgtcacaacaggcacccactgactccagcctcatggaaccaccattcaccaggcttgaggggaggatgtcacggcgcgctgctcccttcggtgccagccaggatggggccgggtgggtgcagctggtgaaaagaaatgcagccccccagcccctgcagaccaagccgaacagcccagctcgcgggtggatcacagggcacccagcagccgccttccctccggaagagccaagaaggcttccaagaccagaaatgcccccagtgtggctgtgcctgtccccggtgccccgccagctggggggcagcatacccaaacagatgcaccctgcccatgatggcaccccagggacccccatcctcaggaccctccagtcgttcaagctggaattggcaggtttctgcctgtataggcatcggcttcagagtctcaggtgctgcttggcaggaaaatgcagggcaggaggggctgggcctcagctcgaggctcccaggtgcagccccccactccactgcagggcccaggggggccaagaacagccacaacaacaacaaaagccaaactgggaacggaatcgtggaaaaaaccctcataggcttttgggaacttacaaagaaatgcccacatcccttctactaacatggcatctactaacgtggcatctactaggatgccacaaaacagacaaatccttccacgtaaggctggacacgtgtcagggcggtgtctcaaagctgggccacaggcagcatccacggccaggccactgggtggaggagacggtgctggggaggagccggagggaggggccggggctgttcccttaggcagaacggctcacctgtggtgtgcgcacagcaggattgtggggacacaagatgcccccttcattcatcagttacttgtattctttgtatgaaacacctgctgataaaatgtgaaaaaggggcatttcctaaagtactttc

SEQ ID NO: 11907 - DNA, 2881 bp, Homo sapiens
tgcttttaatgaaaataataatgtgaacatttccattaaagtctttcatggatgtgcaagactttgaatgaccctggcagtcaagggtgagtgtcatccacaggagagccggccagccacgggctccatgggcagttgccccgcaccgcgcccacgcaggcccactgtgcagcccccaagtcaccagagttttcgagaaccacttccaaaagacaccgtcgtgaccggagccattagcaaatatcaggatttttcaaaccacacttcaatacatccttcactttaatttataaaacaaattactgaatataaaagtctcccctctgatgagcacagcattactcacatattgtgtacaagaacggccaaactggtaaccggcacgctactggcaacacggcagtatttaggtaagtgccttcaatatttaacaaatcaaggaggctcatggaaagcagtttgcttgttaaccacttctgggatacactgggggtctcccactcaaggtggggtcccggcagccctactcacccggcaggtgtaacttcagcggccgcaggctgggcctggccacctgggcatccccacgctggtctgggacacctgtgtgagacccaggtcggctcctggactctgccctggggtttctaactttccgtctttggagttgagtctcaacagctaaggttgggagtgtggctgaaacccgtctccacattccacctagaagcctgagctggccgggggggggcgggtgtccagggtctcgggccggggggaatgggccggcagtatgcccagcgctggcattcttgtcctggcacctggggcttgggtgtgaatccaccatgtcgtgctgagcgccaggcacggagtggcaccctgagaaacctgagtgtgtagggtgggccacgctcacctgctggggatgaccttgaggcaaggcaaggcgcggcacagacctcctaacttggggttttacgtctctcttccccaagccaccagccgcacaatggggtggagcggcccctgagtcatggaggcctggggtctctgcgcctggccaagagggctgcgtggcaatttccacacctgtgcaccaggcctcactcagaggcatgaggtggcgcgaccccctctcccagggagctcagaagacggctctgccacacctgacacctggcagctggcagccctgcctctaggaagcctcagctctggacagctgtgccttcacctgaggggtgggtggacggagagcgcgggtgtgttcccgggagcaggaggtccgcgccgctgggaagagtgcctgtgtttctgggtgtttgtagggtcatcacgttcaactttaaggctggggtccgtcacatgcacatcttttagttttccctaactctcagtgctgtgtgacagataagaatatcttccaaaaatcaaatgcgtcgcacgaggcatcgtgcaggcactgcttagtgtggtcagaaatgatttgtgcagatttagtgttcagttttttctcttttttggtctactgtgctttggtgggccacgttttagaatctctatgatccaatttcccccatcggtccagtgagctggctggcccagctgccatctgcttaaggtgtcacttcaccctagaccacagcggctgggacacactctgcaggaagaacaacaggaacttaccggggtttttaggaaacaattcttgattgcggtgtgtccccacaggtacttcaactcccgcccccacctgtgtcccgctggctcctaagctgcccccctacgtgtgggttgcgtctgagatgtggggcaggcgccactcacggaaaaaaggcatcagaggagcttccacatcatcggaacattttattcctcaggacgctacacgctcactttcctggcggagcaggtcagtgcatcgagttctgtttccgtggaaaatgtgcaccttggaaaccgcatgacagccccctcggcagggtccccgcggatccgccgcgacgcaggcacagcagcaagttcctccagcacgaagctggcctgcccgggcccaggtgtgagggactgttctgctcccagcagcgcccgctgacgcttccctctgcggtctcggcgcaagcgtctgtccctggccgccctcggagccgtgcccagcctggcatgcatatgcggtggttaaggatacagttaaagggtcaatcacgcgtgtccacgacagagacgcacgcggcctcacaccgactcctcggtggacagcaataatgggttgatatactcaaagccttcgaactctgactggtcgatcctctttatggcatccctgtgggcaaaggtggcaggggggaggggggtgaccgtgtgttcattcccttgggggaagcggagtcacgttcgcataagaatcctcccccaacgcccactggagagatgacaccaggcgggtgggactcaagggcaggctgggtcaccagctgcccaaggtgccggcctgccatggggctgcccgaggggtgctccagggacccgcacccagtgggactcactcatcgtctggggtcagctgcacgggctcgctggtgaactgtgtgtcaaagttgtccagaccgtagtcgtctgtgatctgtggctggaatggagggagcgcctgcttcttctccagcttggaaaaacaataggagaagggtcagctccgcgcgggcatcatccctaccagattgagtgttttgcacgcacttcaatcacaaaatgaaacagtgagaaagtcagcatttcaatctgcctagtatttgactgccaagtgttttttcttacaacacaaaatctagaaaatatccaaagtcagaaaaattgttgtcgagctgagaaatgccagtgt

SEQ ID NO: 11908 - DNA, 2888 bp, Homo sapiens
aaacacctgcttttaatgaaaataataatgtgaacatttccattaaagtctttcatggatgtgcaagactttgaatgaccctggcagtcaagggtgagtgtcatccacaggagagccggccagccacgggctccatgggcagttgccccgcaccgcgcccacgcaggcccactgtgcagcccccaagtcaccagagttttcgagaaccacttccaaaagacaccgtcgtgaccggagccattagcaaatatcaggatttttcaaaccacacttcaatacatccttcactttaatttataaaacaaattactgaatataaaagtctcccctctgacgagcacagcattactcacacattgtgtacaagaacggccaaactggtaaccggcacgctactggcaacacggcagtatttaggtaagtgccttcaatatttaacaaatcaaggaggctcatggaaagcagtttgcttgttaaccacttctgggatacactgggggtctcccactcaaggtggggtcccggcagccctactcacccggcaggtgtaacttcagcggccgcaggctgggcctggccacctgggcatccccacgctggtctgggacacctgtgtgagacccaggtcggctcctggactctgcctggggtttctaactttccgtctttggagttgagtctcaacagctaaggttgggagtgtggctgaaacccgtctccacattccacctagaagcctgagctggcgggggggggggcgggtgtccagggtctcgggccggggggaatgggccggcagtatgcccagcgctggcattcttgtcctggcacctggggcttgggtgtgaatccaccatgtcgtgctgagcgccaggcacggagtggcaccctgagaaacctgagtgtgtagggtgggccacgctcacctgctggggatgaccttgaggcaaggcaaggcgcggcacagacctcctaacttggggttttacgtctctcttccccaagccaccagccgcacaatggggtggagcggcccctgagtcatggaggcctggggtctctgcgcctggccaagagggctgcgtggcaatttccacacctgtgcaccaggcctcactcagaggcatgaggtggcgcgaccccctctcccagggagctcagaagacggctctgccacacctgacacctggcagctggcagccctgcctctaggaagcctcagctctggacagctgtgccttcacctgaggggtgggtggacggagagcgcgggtgtgttcccgggagcaggaggtccgcgccgctgggaagagtgcctgtgtttctgggtgtttgtagggtcatcacgttcaactttaaggctggggtccgtcacatgcacatcttttagttttccctaactctcagtgctgtgtgacagataagaatatcttccaaaaatcaaatgcgtcgcacgaggcatcgtgcaggcactgcttagtgtggtcagaaatgatttgtgcagatttagtgttcagttttttctcttttttggtctattgtgctttggtgggccacgttttagaatctctatgatccaatttcccccatcggtccagtgagctggctggcccagctgccatctgcttaaggtgtcacttcaccctagaccacagcggctgggacacactctgcaggaagaacaacaggaacttaccggggtttttaggaaacaattcttgattgcggtgtgtccccacaggtacttcaactcccgcccccacctgtgtcccgctggctcctaagctgcccccctacgtgtgggttgcgtctgagatgtggggcaggcgccactcacggaaaaaaggcatcagaggagcttccacatcatcggaacattttattcctcaggacgctacacgctcactttcctggcggagcaggtcagtgcatcgagttctgtttccgtggaaaatgtgcaccttggaaaccgcatgacagccccctcggcagggtccccgcggatccgccgcgacgcaggcacagcagcaagttcctccagcacgaagctggcctgcccgggcccaggtgtgagggactgttctgctcccagcagcgcccgctgacgcttccctctgcggtctcggcgcaagcgtctgtccctggccgccctcggagccgtgcccagcctggcatgcatatgcggtggttaaggatacagttaaagggtcaatcacgcgtgtccacgacagagacgcacgcggcctcacaccgactcctcggtggacagcaataatgggttgatatactcaaagccttcgaactctgactggtcgatcctctttatggcatccctgtgggcaaaggtggcaggggggaggggggtgaccgtgtgttcattcccttgggggaagcggagtcacgttcgcataagaatcctcccccaacgcccactggagagatgacaccaggcgggtgggactcaagggcaggctgggtcaccagctgcccaaggtgccggcctgccatggggctgcccgaggggtgctccagggacccgcacccagtgggactcactcatcgtctggggtcagctgcacgggctcgctggtgaactgtgtgtcaaagttgtccagaccgtagtcgtctgtgatctgtggctggaatggagggagcgcctgcttcttctccagcttggaaaaacaataggagaagggtcagctccgcgcgggcatcatccctaccagattgagtgttttgcacgcacttcaatcacaaaatgaaacagtgagaaagtcagcatttcaatctgcctagtatttgactgccaagtgttttttcttacaacacaaaatctagaaaatatccaaagtcagaaaaattgttgtcgagctgagaaatgccagtgt

SEQ ID NO: 11909 - DNA, 828 bp, Homo sapiens
ttttttttttttttttgatacattgccctttttctcctctctatccaatattcagttgctttttttttttttggaaacatagtcttgctcttgtcacccaggctggagtgtaatggcgcgatctcggctcactgcaacctctaccttccaggttcaagtgattctcctgcctcagcctctggagtagctgtgattacaggcgtatgccaccacgcccaagtaatttttgtgtttttagtagagacagcgtttcaccatgttgtccaggctggtctcaaactcctgacctcaggccatccacccaccttgggctcccacagtgctgggattacaggtgtgagccactgtacctggcctcctttcaactttatattcacctatttttatcttttttaaaagcaccacttgcctttgttttaattctctgtcaagcaattaattgagatttcatcctgctggcaaccactctagttctgcagcatcctcaatgagaagcaaggtccacttctcatttgtcttcctttcaactgtttctatttccacactttcactagcaatattaatttcaaccaatttctaagacaagaagtatgccactgaatgtataactgatcttaacaacagattaacaaattgttgattccctgccattttcaaaatatcaaatatacaagacagtaatttttttaaaatattttttcatctctgagggaaaggatgatttgaagactcctttcaaattcccaagaaagcctctcaatattatctgtgtaaactactgattcacaggaataaatatttgttatttaatataaactaaaatgaaaa

SEQ ID NO: 11910 - DNA, 393 bp, Homo sapiens
ccaggccagttacacaaactgagggttttattttcctgtctctgattcctcttcattctttctggggctgcacttttatctacttacctaggattgtttaccacctccactactgagaaagagaagggaaactcaaaagtcagttgattctattttgaaatgtgtattttttgaaatgcctcctatttcaaaggaaagcctatacacgtcaacagttgggcataaatgttaatgcttgttaattttgcttagaaacgccatgttttactttgattagtatgatgaataactgcaaaggtggcaaaaacagtatctcaataaactgatttcacaaatgaaggaagattagaccaggaagtcatacaacggttggattttcattgttacccttac

SEQ ID NO: 11911 - DNA, 793 bp, Homo sapiens
cctggatatatttacagtggtgtttgttctttacagtcagagtgtccaagaactgtggaaggtctttgtattactacttttgacaaaaatttatgatgactgaccacctttctttcctgttaactgacatttcaacttgacaaatgtgatctttaccacatttactcatttgagtggctgagtacattctacatgtatagtattatgctgttttctttaagccattttgaggagcacaataaactggaaaaatgatttaccaaatatatggaattatatgtagtctgtttccttaatcctgatgctgtgttgttggcatgtgatccttcagaagtgaatatcatctttcatggggtggcaaaaatgccactattttgagaaagtctttttgattcctgggtacctgtaatgacctaaagctcttttatgccttttggaaccttgtatcttgtattgtttatttttgttttctccattaagtcatctggctccaaacagcagttttaacctcattcgtctctgtattttgctttatcccctctacactgcattgctgtagtgggcactcagagtgtgaatgttggtagtggatttttactttttgttggcaaattgcgctgatctgattccagctatggaaaacattaaaaaaaaaattcaacattgtctttacactcacaggaaatcctaggtaactattgtcattaatttttagatgacaaaaaggaacttggagcagccagaagaagtcagtattacatgaaatatgggaatccaaattatggaggcatga

SEQ ID NO: 11912 - DNA, 3769 bp, Homo sapiens
tctttgttaagaaacgatcttcgtccagctaacaaacttgctaaaggaaataggttattcatgagatttgctacaaaaggtaaatgtaatatttggtattgttttatattttcaatcaaaatgatttattatggagtgacatccttcttttttgaatagaagttagatcaagtaatctcaaagttcccttcaaactataatattctgcgcttatgaaataattgcttgccacctgagttggaatttctgactttaaaagtgaatattaactatttgtatatttctgtgacttctggctaaagttattttctgttgaaactggtttgcctcatatattttcagccagttaccatctgaattatgaaaactttcaaatgaaactttatttattacagcaacgtcctcctgaacattgccagtgtaccattcggttctaattcccttctcataagattgtttacacatggtgacttttggtgggcatttaaaaatgtgtgtgtatgtgtatatatgtatgtgtatgtatgtgtatatatgtatatgtatgtatgtatcgcgtgtatgtgtgtatgcatgtgtatgtatgtatatgtatgtatgtatgtgtatgtgtatatatgtatgtgtgtgtatgtatatgtgtgtgtatgtgtgtgtgtgtatgtgtgtgtgtatgtatgtatgtatgtatatgtattatacacatatacacatattggtttttttaatcatttgagagttagttgaagataaaaacccatcacccctaaatgtattccaaagaataagaacattgttttatacatagcacacttaacaaaatcaagaaatttaacattaatacagtactgttacctaatccgtagtcgattttcaaattttgtcagttgttccaataatgtcctttatatattccccgcccagccccaggtctaggatccatccaggactgagtgtgtaagtatgtaatgtttccttagtcccccttaagctgaaactacttctatcctcccatgttttccaagaatataggtttactattttatacaatgtccctcagtttgggtttgtctgatgattcctcctgattgaatttgggttgtgcatttgagacaggcgtgccacagaagcgatgtcatgtcatttccagagcatcatgtcaggaggccctggatacttactcgtcccagtcctagggacgttcactttattcacttggttaaggtaatcatcactaggtttttccgctgtaaagttgctattcttccatttgtaatttaaaaattggtgggctggctggttacagtggctcgtgcctgtaattgcaacactttgggatgctgaggcagaaggatcacttgagcccaggagttcgagaccaggctaggcaacatagcaagacctcatccctattttaaaaaataaaaaaatgattaaaataaaaaattggttggcagatactttgagatcacgtaaatagcctcttgctcatcagagcttcatgcctttctgactatatcatttctttaccagtagacaggtgctctaaggaagagccttctgtttttacctgtttgtttatttacatcagtttagaatcatggattctttattcagtgggttatcatccatggatatcagtatttaattttatttatttttttgtatgttttgagacggagtgttgctctgtcactaggctggagtgcagtggcgcgatcttggctcactgcaaccgctgcctccctgcaacctctgcctccctgcaacctctgcctcctgggttcaagcaattctcctgtctcagcttccctagtagctgggactacaggtgcatgccaccatgcccagctaatttttgtatttttagtagagatggggttcaccatgttggccaggatggtctcgatctcttgaccttgtgatccgcccgcctcagcctcccaaagtactgggattacaggcgtgagccatcgcgcccagcctaatatcagtattttaatttacaaattgtcttggatttggccagtagagccccttcaagctgttttgacatactccatgattctttaagcactttctttctttatggcacaacaaaacatcttgcttttccagactcattttgcatcttacctgctccacatctggaatcagccatttctccaaggagctggtgggcatggtttgaggggttcgggggttgggggctatacatactggtttgtgttgtcacgtttacctacagccctggatatatttacagtggtgtttgttctttacagtcagagtgtccaagaactgtggaaggtctttgtattactgcttttgacaaaaatttatgatgactgaccacctttctttcctgttaactgacatttcaacttgacaaatgtgatctttaccacatttactcatttgagtggctgagtacattctacatgtatagtattatgctgttttctttaagccattttgaggagcacaataaactggaaaaatgatttaccaaatatatggaattatatgtagtctgtttccttaatcctgattctgtgttgttggcatgtgatccttcagaagtgaatatcatctttcatggggtggcaaaaatgccactattttgagaaagtctttttgattcctgggtacctgtaatgacctaaagctcttttatgccttttggaaccttgtatcttgtattgtttatttttgttttctccattaagtcatctggctccaaacagcagttttaacctcattcgtctctgtattttgctttatcccctctacactgcattgctgtagtgggcactcagagtgtgaatgttggtagtggatttttactttttgttggcaaattgcgctgatctgattccagctatggaaaacattaaaaaaaaaattcaacattgtctttacactcacaggaaatcctaggtaactattgtcattaatttttagatgacaaaaaggaacttggagcagccagaagaagtcagtattacatgaaatatgggaatccaaattatggaggcatgaaaggaattcttagcaattcatggtgagtccaaaaccttcaaatgcaatagtatttgagtttttcttaatccttcagttggtattccgtggtgaaatgtctaaaccctgtgtaaactggaaggaaaacaagagggaagaattcaagattcttagatgtggtaaatgatggggaatgctgaattgtagttacatttaaaatatctgtgttagtacctaacattgtgtcaacgtgtagttgaaatgaattagcaagcccagacacggtggctcacgcctgtaatcccagcactttgggaggccgaggccagcagatcacctgaggtcaggagttcgagaccagcctggccaacatggtgaaaccccgtctctactaaaaatacaaaaattagccatgcatggtggtgggcgcctgtaatcccacctactcgggaggctgaggcaggagaattgcttgaacccaagaggcaaaggttgcagtgagctgagatggtgccattgcacttcagcctgggagagagattgagactccatcccaaaaaaaaaagaaaagagaaagaaatagtggatttcaaggtccttcctatcagtttttgattgtgtgcttattttggcattcttgcaggaagcgaagatatcattcccgtcgtattcagcgggacgtgatcaagaagagagccctgattggggatgacgttggcttgacgtcgtataaacatcgacattctgg

SEQ ID NO: 11913 - DNA, 13554 bp, Homo sapiens
  misc_feature (983)..(983): n equals a,t,g, or c
  misc_feature (1012)..(1012): n equals a,t,g, or c
  misc_feature (1047)..(1047): n equals a,t,g, or c
  misc_feature (1315)..(1315): n equals a,t,g, or c
  misc_feature (3312)..(3312): n equals a,t,g, or c
  misc_feature (3319)..(3319): n equals a,t,g, or c
  misc_feature (4123)..(4123): n equals a,t,g, or c
  misc_feature (4225)..(4225): n equals a,t,g, or c
  misc_feature (4367)..(4367): n equals a,t,g, or c
  misc_feature (4748)..(4749): n equals a,t,g, or c
  misc_feature (4752)..(4752): n equals a,t,g, or c
  misc_feature (4778)..(4779): n equals a,t,g, or c
  misc_feature (4783)..(4784): n equals a,t,g, or c
  misc_feature (4790)..(4790): n equals a,t,g, or c
  misc_feature (4888)..(4888): n equals a,t,g, or c
  misc_feature (4911)..(4911): n equals a,t,g, or c
  misc_feature (4922)..(4922): n equals a,t,g, or c
  misc_feature (4976)..(4976): n equals a,t,g, or c
  misc_feature (4989)..(4996): n equals a,t,g, or c
  misc_feature (5019)..(5019): n equals a,t,g, or c
  misc_feature (5792)..(5795): n equals a,t,g, or c
  misc_feature (5800)..(5800): n equals a,t,g, or c
  misc_feature (7670)..(7670): n equals a,t,g, or c
  misc_feature (8097)..(8097): n equals a,t,g, or c
  misc_feature (8500)..(8500): n equals a,t,g, or c
  misc_feature (9556)..(9556): n equals a,t,g, or c
  misc_feature (10250)..(10250): n equals a,t,g, or c
  misc_feature (10346)..(10346): n equals a,t,g, or c
  misc_feature (10363)..(10363): n equals a,t,g, or c
  misc_feature (10510)..(10510): n equals a,t,g, or c
  misc_feature (10541)..(10541): n equals a,t,g, or c
  misc_feature (10698)..(10698): n equals a,t,g, or c
  misc_feature (11152)..(11152): n equals a,t,g, or c
  misc_feature (12619)..(12619): n equals a,t,g, or c
  misc_feature (13212)..(13212): n equals a,t,g, or c
  misc_feature (13226)..(13226): n equals a,t,g, or c
  misc_feature (13398)..(13398): n equals a,t,g, or c
ggagtctttgttaagaaacgatcttcgtccagctaacaaacttgctaaaggaaataggttattcatgagatttgctacaaaaggtaaatgtaatatttggtattgttttatattttcaatcaaaatgatttattatggagtgacatccttcttttttgaatagaagttagatcaagtaatctcaaagttcccttcaaactataatattctgcgcttatgaaataattgcttgccacctgagttggaatttctgactttaaaagtgaatattaactatttgtatatttctgtgacttctggctaaagttattttctgttgaaactggtttgcctcatatattttcagccagttaccatctgaattatgaaaactttcaaatgaaactttatttattacagcaacgtcctcctgaacattgccagtgtaccattcggttctaattcccttctcataagattgtttacacatggtgacttttggtgggcatttaaaaatgtgtgtgtatgtgtatatatgtatgtgtatgtatgtgtatatatgtatatgtatgtatgtatcgcgtgtatgtgtgtatgtatgcatgtgtatgtatgtatatgtatgtatgtgtatgtgtatatatgtatgtgtgtgtatgtatatgtgtgtgtatgtgtatgtgtgtgtgtatgtgtgtgtgtatgtatgtatgtatgtatatgtattatacacatatacacatattggtttttttaatcatttgagagttagttgaagataaaaacccatcacccctaaatgtattccaaagaataagaacattgttttatacatagcacacttaacaaaatcaagaaatttaacattaatacagtactgttacctaatccgtagtcgattttcaaattttgtcagttgttccaataatgtcctttatatattccccgcccagccccaggtctaggatccatccaggactgagtgtgtaagtatgtaatgtttnccttagtcccccttaagctgaaactactntctatcctcccatgttttccaagaatataggtttnactattttatacaatgtccctcagtttgggtttgtctgatgattcctcctgattgaatttgggttgtgcatttgagacaggcgtgccacagaagcgatgtcatgtcatttccagagcatcatgtcaggaggccctggatacttactcgtcccagtcctagggacgttcactttattcacttggttaaggtaatcatcactaggtttttccactgtaaagttgctattcttccatttgtaatttaaaaattggtgggctggctggttancagtggctcgtgcctgtaattgcaacactttgggatgctgaggcagaaggatcacttgagcccaggagttcgagaccaggctaggcaacatagcaagacctcatccctattttaaaaaataaaaaaatgattaaaataaaaaattggtgggcagatactttgagatcacgtaaatagcctcttgctcatcagagcttcatgcctttctgactatgtcatttctttaccagtagacaggtgctctaaggaagagccttctgtttttacctgtttgtttatttacatcagtttagaatcatggattctttattcagtgggttatcatccatggatatcagtatttaattttatttatttttttgtttgttttgagacggagtgttgctctgtcaccaggctggagtgcagtggcgcgatcttggctcactgcaaccgctgcctccctgcaacctctgcctccctgcaacctctgcctcctgggttcaagcaattctcctgtctcagcttccctagtagctgggactacaggtgcatgccaccatgcccagctaatttttgtatttttagtagagatggggttcaccatgttggccaggatggtctcgatctcttgaccttgtgatccgcccgcctcagcctcccaaagtactgggattacaggcgtgagccattcgcgcccagcctaatatcagtattttaatttacaaattgtcttggatttggccagtagagccccttcaagctgttttgacatactccatgattctttaagcactttctttctttatggcacaacaaaacatcttgcttttccagactcattttgcatcttacctgctccacatctggaatcagccatttctccaaggagctggtgggcatggtttgaggggttcgggggttgggggctatacatactggtttgtgttgtcacgtttacctacagccctggatatatttacagtggtgtttgttctttacagtcagagtgtccaagaactgtggaaggtctttgtattactacttttgacaaaaatttatgatgactgaccacctttctttcctgttaactgacatttcaacttgacaaatgtgatctttaccacattgactcatttgagtggctgagtacattctacatgtatagtattatgctgttttctttaagccattttgaggagcacaataaactggaaaaatgatttaccaaatatatggaattatatgtagtctgtttccttaatcctgatgctgtgttgttggcatgtgatccttcagaagtgaatatcatctttcatggggtggcaaaaatgccactattttgagaaagtctttttgattcctgggtacctgtaatgacctaaagctcttttatgccttttggaaccttgtatcttgtattgtttatttttgttttctccattaagtcatctggctccaaacagcagttttaacctcattcgtctctgtattttgctttatcccctctacactgcattgctgtagtgggcactcagagtgtgaatgttggtagtggatttttactttttgttggcaaattgcgctgatctgattccagctatggaaaacattaaaaaaaaaattcaacattgtctttacactcacaggaaatcctaggtaactattgtcattaatttttagatgacaaaaaggaacttggagcagccagaagaagtcagtattacatgaaatatgggaatccaaattatggaggcatgaaaggaattcttagcaattcatggtgagtccaaaaccttcaaatgcaatagtatttgagtttttcttaatccttcagttggtattccgtggtgaaatgtctaaaccctgtgtaaactggaaggaaaacaagagggaagaattcaagattcttagatgtggtaaatgatggggaatgctgaattgtagttacatttaaaatatctgtgttagtacctaacattgtgtcaacgtgtagttgaaatgaattagcgagcccnagacatnggtggctcacgcctgtaatcccagcactttgggaggccgaggccagcagatcacctgaggtcaggagttcgagaccagcctggccaacatggtgaaaccccgtctctactaaaaatacaaaaattagccatgcatggtggtgggcgcctgtaatcccacctactcgggaggctgaggcaggagaattgcttgaacccaagaggcaaaggttgcagtgagctgagatggtgccattgcacttcagcctgggagagagattgagactccatcacaaaaaaaaaagaaaagagaaagaaatagtggatttcaaggtccttcctatcagtttttgattgtgtgcttattttggcattcttgcaggaagcgaagatatcattcccgtcgtattcagcgggacgtgatcaagaagagagccctgattggggatgacgttggcttgacgtcgtataaacatcgacattctggtagttgcctgctcagctcttgggtagacacatgtttggctcctgaaatcatatttttattcttaatgcaatcttttaaggttccaaactttatcatcctctcttccttgccctcaccctctgccaacatataggaaagtaagtcaagtcacaattaattttaagttgcccaaagaggtcaaatgattttataaaagctgttctatcaaaaaaggcaaaatatgacataggaaaaattaaaacaaaactttccttaggatcctaatttttctactattaatatcaacagctgcatgaaaacaattttttttttttttttaagacggagtctcgctctgtnctctcaggctggagtgcaattgcttgatctcggctcactgcaactctgcctcctggattcaagcaattctcctgccttagcctcccgagtagctgggactancaggcatgcgccaccatgcccagctaacttttgtatttttagtagagatggggtttcaccatgttggccaggctggtctcgaactcctgaccttgtgttccacccactttggcctcccagagtgctgggattacaggtgtgnagctaccgcgcctagccaaaaacaatttttgaaattattttatcagatgaactgattgtattgttctttttctgtattaaaaataggctgctgtgttgagtgctttgtgcttgttggtttgtgcatgtgaatgcctcagaagagtgggatatcatgacttgggtttctttctcctttttttggtgcttattgtaaaagaaccattttatttatgttttataaagaattgttcttgttttgagcctaatctatggaatcttctacatgcctaatagaactagtcaagtcagcatacaaaataacatatacacacatttatcattgtaatggggacagaaagggatgaagtctggatgttttatttaatgtgtatatacaaannatntgtatatttgagatctacatgttaanntaanntacacnataggatgggaacagtggctcacacctataatcccagcactttgggaggccaaggcaggaggatcacttgaaaccaggagtttgagaccagcctgggncaacatagtgagaccttgtcgtntacaaaaaatntaaaaaattagccagaccaggcatgatggcacatacctgtggtcccagctactntgggaggctgagnnnnnnnnattgcctgagcctgggaggtcanaggctgcagtgagccaagattgtgccactgtattccaacctgggcgacagagcaagactttgtctcaaaataataataataatacacatactttactgttacacagttacacttctccaatttgagttactttaaaatattttcatcatatactttttatatccatattaaggaaattaaaaagcaaattgcccctatttctagtaccctgtatgatgactgagttcatcttacatttttcccatttgttttcataataaatagtataactcttgggaacatgtactttatattctacttctttcgtttattgtatttttccattttcattattcatggtgcttatgttctataaagtcactgtgaacactgaagtagcaaatactgaatcgtacatagcctctggccacatcatttttgtcagttgatcaatatgtaaccttgttttacatatgtttctctctttttttttttttttgagacagagtcttgctctgttgcccaggctggagtgcagtggcgcgatctcggctcactgcaacctccgcctcccgggttcacgccattctcctacctcagcctcccgagtagctgggactacaagcgcacaccaccatgcccggctaatttttgttgtattttttagtagagacagggtattagcatgttagccaggatggtctcgatttcctgacctcgtgatctgcccacctcggcctcccaaagtgctgggattacaggcgtgagccaccgcgctgggcccatatgtttcnnnntcttntaagacaccttatttaagacacattgttgattcgttaacattgagttcacagccagtagccctataactcatgcctgaatgccttacctgatatggtatttttccacaaggcacatcacagcccccttgcatctaggaacactaggcagcacttcggcacgacactcagggccattttaagcagtgaaatcactagcagcaggcacagaagtgtgaaaaatgtgccactcggtggactgaaacagacgcttgtttacagcatgagatgaaacaggaaggtggagtgttgctttgtttgacctccactgggagtgtgtgtgcctggtgactcagatttttttgccactctgtgcgtgccagcaaatgaccatggaagcattgcacgtattcattttggagttacaaataaatttggtaaatttgcaaatacaaaatctgtgaataataaaggtcagttgtattttaaatgactttatggtatttggttaggctgctgcatcatactttacctagccatcctcctgttgcagtatcagagtaatgtccatttggcactattatagatagtgctccaataaaatgtcagggatgggaaccccaccttttaaaaaggtcaccgatgtagagtagaaaatcatacttgttaattttagtgcttttcctaatgttttctggttaaatttcttcagggctagtgaatgttcccgaggaacccattgaagaggaggaagaggaggaggaggaggaagaggaagaggaagaagaagaccaggacatggatgcagatgacagagtggtggtagagtaccacgaggagctcccggctctcaagcagccccgggagcggagcgcgtctagacgatccagtgccagcagctcagactcagatgaaatggactatgatctagaactgaaaatgatttccacgccttcaccaaagaaaagcatgaaaatgactatgtatgctgacgaagtggaatctcagttgaaaaatattaggtaaaaatttgttttatcaaagctagcttttaatttgattttaaatactagtataacttcttaattcctcctaattttataatatcttttatctattctgatttcagtcccttgtaggagtttaataaacgcatccagtatttcctctatacaagcagtgattcttgttataaaaacaaaagacaacatagaaagtgaaaatcatctgtattcccattctttctcaacaataactactgttagcaatttggcgaataacctttcagctatttgtgtgtgtgtgtgtgtgtgtgtgtatggcacagggaaaagctgtagatatatttgtataaaagtatactttttataaagatgaggttatgctatttatagttttgcattgtgcatttttcacttaatatattgtagacattatttttttcaactgtatatagtctgttgtttgaaagtatcatgatttatttaacgaattcctttttgatggactttaggtttctattttcttacaattgcactaactcaataaattcctcaaagtccagttattacacaaaacaatatgtgtttaaaaagatggtaagtattgctttatttttttccagaagggttttttgtgtgtttttattttttttttgagacggagtctcgctctgtcacccaggctggagtgcagtggcgcgatctcggctcactgcaaactccgcctcccaggttcacgccattctcctgcctcagcctcccgagtagctgggactacaggcgcctgccactactcctggctaattttttgtaattttagtagagacgggtttcagcatgttggccaggatggtctcaatctcctgacctcgtgatccacctgcctcagccntcccaaagtgctgggattacaggcatgagccaccatgcccgggctcagaagggttttaatcccagaagggttttaatcactcacattaccacctgttacctacaagctcaccagccttagctattaccattctttctaatgctagctagtttcatgaacaaaaaaaaaatagttattttaatgtgcatgtctttgattactactaggggtgagcagattctgtgcaggcagaatccacagttctaagggttagagtctagggatgctctgtgtaacgtagtatgtttgtggggaggggaaaagaccattcaagctgatttgtttgtatggccttgttcaccacgttctttttttttttgagacggagtctcgctctgtcgcccagcctggagtgcagtggagcgataacacgatctcggctcactgncaagctccgccttctgggttcacagcattttcctgcctcagcctcccggggagctgggagtacaggccaccacgcccagctaattttttgtatttttagtagagactgggtttcaccatgttagccaggatggtctcgatctcctgacctcgtgatccgcccgcctcagcttcccaaagtgctgggattacaggcatgagcctgttcacattcttatttttggttttcagagagctttctggtagagaatgctgccggaacggtgctggcacctagcatgatagcatatctctttgaaagagaagtctgccctttaaagagagagactgtagactatactgtgtgttgactacagccacatcacagcatgtgtaagtggaagccccaatctctttgtaggccntctacttaacgtttgtcccagaaaagggggacttgtagttgtatgctgtgtaatagcacatacacatgtggaaaccaccttcgaaaacctgctcaccagaaccagtctctttagagcaggcagatcatggtttccataagcaaataattataagtttatggatttgtaagtgaatgttggccatgtaagacaggatttcttaaattgtttcctccaaagtatgagattgttgtttgggtcttgtctcacagttgaagttggttaactgtgccccatcctaccccctttttaaaggaactccatgagggcagatagtgtatcttcaagcaatatcaaaaaccgaattggtaacaaattaccacctgagaaatttgcagatgtccgacatctattagatgagaaacgtcagcactcccgtccacggccaccagtcagcagtactaaatcaggtactgttcctcacttggattcctggctggattctgagctccggaaagcagactggggcagagagaggttcctgagtaaaacatgcgatgtgtgaactgatttagctgtcctggttcatcatgtctaaattgtgggctaggtgttggaaattgaggaaatgaaaaataatcagacttctgaaaaactagctttaaatgtttttattccaaataattacagttgttccttggtatgtctgggggcttgcttccaggaccccctccccgccccctacagataccaaaatccattgatgcttaagtcccttatataaagtgacatattatctgcatataacctacacacatcctctcatatactttaagtcatctctagattatttacaatacctaatacggtataaattcttatcctgtgttgtgtaaaatttgtattattttttgctgtactcttatgtcttactttttttccacatgtattcgatcagcagttggttgaatctatagatgtggaatccatggatgaggagggccaaccatattttcctctgtatgacactggtatactttatatacaagaataatagaaattaagttcggtggttgntctgaacagttaagagtttgaactagataatttctatgttcaaacactgattcagcaggtctttagccgtacctgctatgtgccagaccctggtctaggtgctaggaatgtgagaagcctttggaggggacgcagagccgtcatagatctactcgggaagttgtgaaagacttcttagagaaagtagcattagagccaggccttggagagggtaggatctctgttggcaaacctgatttttttacatgagaagtaacctgatcttacatctattttagaaagacaacttgagggtggagtggggtggggtagagagttaaaaaagtaacaagagcctgaactaggtcggtggagacagaatggataaagaacaggatagtcttgtgaaggaagactcagtgctaggaagtgttggaggaaaggagctcaggtctcagtgaccagagaccagggtgctgctctctgagagaagctaaagtgagaggagacctcggcacagggcctcaccaacgaatgtgtttctgttgttgctgtggtggttagggggaactcaagaggacaggccgatttctggggggattgagggaaaaacacatttgatcctttgccttttccagtctctttatatttactggttaaatgtaataagtttattgggaactacttgtgtgttcaaagattgtgccttccactnttccgggagctcacaggattttttgttcgctgaaacttttgtaaattacttagtcttcttgattctgcttaaagaaaaaaaaaaaaaggttgtttncttcagaaatatagttnctggagtaatcagttgaggatttttcctctgacagcccctatgtccgaattttcctaaggaaatccagactgattacaaaggaagaatacttagcagcctgattgtcaggccctgtgtcctcggggcaggggttagcgccagatccngttagaggtgtcaggcggctggtgccgagcnataaagcacacacacggtcactggtgcactttttctcttttttcagatatacgccagcggttaggaaaaagaccacattctccggaaaaggcttttagtagtaaccccgtcgttcggagagagccctcttctgatgtgcatagtaggctaggtgttncccaggcaggatagtaaaggcctctacgccgatactcgggagaagaaatcaggttggtaacacttaaaacggatgggaatggggattcagtgagagcagaggacagtgggtgtattggagaaatactttcttagcagaaggcaagaaacagcccacgccaaatataagtgattattccttttccattatagttatcgtcagcatcagcatcagcatcatcccaacagttaggaacgcttagaaaatagaaaaaaatagcacactcctggctctttctgtttggcacaaatctttttagtttcatgtgagctattctggtctttgcccacatacaaatcctagttttttcatacagcattttatcgtagttgtttgccacattttataatctttataaataaaacttttaggccaggcatagcggctcaacacctgtaatcccagcaatttgggnaggccgagacggggggatcacttgaggtcaggagttcgagaccagcctaaccaacatggtgaaaccctgtctctactaaaaacacaaaaatgagccgggcgtggtggtgggcgcctgcaccactgcacttcagcctgggcaacagcaagaccttgtctcaaaaacaaaaacaaaaacaactttgaattgccttataatgtggccgtctacaaaattctaaacacgtatttctctattgttaaattttcataaaatatatttcaaaaattaatggaagggatctgggagtggcctacttctggcagaatggattggcacacagggtggtgtctcagcagggaagggcaggagtaggaggaaacggcctctcaggtgattctgatgtgtctggtgacagggagggacctgacctgtccccccacggtgagaatcccgtgctgggtccagacccttccgtttgcgggcaggggctgcggcccgggaaatgagattttgcctgcccaaggctgcactgtggtggcaggctccacagactgctggcgtttcctgcacagcaggtgttggcagtgctgctgccccctcagtgctaccctggttcttagcgctgactgcgaaagtgaaatgccatctcatccaaacaggtaatttatggactcgcctaggatctgcacccaagaccaaagaaaagaatacgaagaaagtggatcacagggcgcctggcgctgaggaagacgactctgagctgcaaagggcatggggggctctgattaaggagaaagagcagtctcgccaaaagaagagccggttagataacttaccatctctccagattgaagttagtcgggaaagcagctctggttcagaggcagagtcctgatgcccctggggcctatggcagctgccctaaagcctgacattcttgcacagggtggggcgcgcagtaggaacctcccccgcaggagctggcgccctctcgctcctgctcacacagtcaccctccgctcttgctacttcggcaagacatcttaagaatgtgacacattttcaagggcatctctatctttcgctgcagagttgtagttctgggccctcgattcctttcccaccaccccacaggctttaccctttgagaaaaaggcagccctccagattttgtagacatttttcttaatatttttaacattgtgtcttttaaaagaaatgttttacacagttcatccaaagagcagagaactgaacttctcactattgccttggccctgacagctgttaccagcacccttttcccaagaaaagtcaattcccaggtgcttattggacatccttcgagggggaagaggagggaagcggccagctcacccttccgggaccctagtgtggggcgaatctcacggacctgacctcagaggtgcaccagtgccgcccaggtagataagagctgcagcattgactgtgcttccgttcttnccctcggggattgctcatggcatgggcctcttacgtgctgtcagcttgatgtgaagatcaagttcagtgctgtgggatttttaggaacaaaaaactgtgacgtctggatttggggttgatttttgtgctggggtgggattatgggtcaatgttgaagaatttttaagtctgtattatgtttaaaacatgaatgatttgaaagtttaaatttttaatttttatatgtggaaattcttcctgttggctaaaggggaagctcaagtggtgtcgtcttttgtgctgttaaatatatattctattctttggaagaaggcagagagaggagtcttattatttttaaatgctcctagttgtatagtctgtctgttgtacatagagttcagcttgttttttggctccagtaggaaaaaaaatccatccatctgagatggggtcctgttgtttattatcactctagaagttatacattgatatttattctttctgtccccacgttgtggcacctgaagacatcttcaaaattggcagaaaagataatagttataaaaattttagttcatttatttttaaactcctttcagattattttaccnattaggaggaggtnagattgtttcgtcttcctgtctgatttttgttttgtagtatttaattttgtattcctctgcagttttaagaaacagtgtttttcttcggtttgctggaacatgggcgttagagatggtaataaaccgtggtcctttttgcgatgtcacgactcttcacctgcctgggctgtntgtgcacacagtgcagcctggatcctgtcgatctttacttgtggcggagctaatggtcacattgatagttgattacactgtggcacgaattaatgcagaacactgttattaataaaggaagtaaagggctgcaagatttgagagctgcaacaaaaa

SEQ ID NO: 11914 - DNA, 1111 bp, Homo sapiens
cagttgttccaataatgtcctttatatattccccgcccagccccaggtctaggatccatccaggactgagtgtgtaagtatgtaatgtttccttagtcccccttaagctgaaactacttctatcctcccatgttttccaagaatataggtttactattttatacaatgtccctcagtttgggtttgtctgatgattcctcctgattgaatttgggttgtgcatttgagacaggcgtgccacagaagcgatgtcatgtcatttccagagcatcatgtcaggaggccctggatacttactcgtcccagtcctagggacgttcactttattcacttggttaaggtaatcatcactaggtttttccactgtaaagttgctattcttccatttgtaatttaaaaattggtgggctggctggttacagtggctcgtgcctgtaattgcaacactttgggatgctgaggcagaaggatcacttgagcccaggagttcgagaccaggctaggcaacatagcaagacctcatccctattttaaaaaataaaaaaatgattaaaataaaaaattggtgggcagatactttgagatcacgtaaatagcctcttgctcatcagagcttcatgcctttctgactatgtcatttctttaccagtagacaggtgctctaaggaagagccttctgtttttacctgtttgtttatttacatcagtttagaatcatggattctttattcagtgggttatcatccatggatatcagtatttaattttatttatttttttgtttgttttgagacggagtgttgctctgtcaccaggctggagtgcagtggcgcgatcttggctcactgcaaccgctgcctccctgcaacctctgcctccctgcaacctctgcctcctgggttcaagcaattctcctgtctcagcttccctagtagctgggactacaggtgcatgccaccatgcccagctaatttttgtatttttagtagagatggggttcaccatgttggccaggatggtctcgatctcttgaccttgtgatccgcccgcctcagcctcccaaagtactgggattacaggcgtgagccatcgcgcccagcctaatatcagt

SEQ ID NO: 11915 - DNA, 246 bp, Homo sapiens
gacagagtctcgctctgtcgcccaggctggagtgcagtgtggcatcatctcggctcactgcaagctctgcctcccgggttcacgccattctgcctcagcctcccgagtagctgggaccacaggcgcccgccaccacgcccggctaattttttgtatttttagtagagacggggtttcaccgtgttagccaggatggtctcgatctcctgacctcgtgatccgcctggctcggcctcccaaagtgct

SEQ ID NO: 11916 - DNA, 235 bp, Homo sapiens
  misc_feature (36)..(36): n equals a,t,g, or c
ctctgtcgcccaggctggagtgcagtgtggcatcantctcggctcactgcaagctctgcctcccgggttcacgccattctgcctcagcctcccgagtagctgggaccacaggcgcccgccaccacgcccggctaattttttgtatttttagtagagacggggtttcaccgtgttagccaggatggtctcgatctcctgacctcgtgatccgcctggctcggcctcccaaagtgct

SEQ ID NO: 11917 - DNA, 556 bp, Homo sapiens
cagaaaggcagctttaaagatttttacttctcggagttactggccttattagtttctctaaccctcctgcccactctcagtcactcagatcttgcaacatcttgagtgtgtcctgaatgatgaggccttttctttggagtttaagagtaagaatggatagtcaggacaggcccgtggcaggcagctgggcgtgattttaccctggacactccccacacatgtgggcacagggctgcacactttgtgtgttcctcttagtcttatgtgtaggagattttacatacatgtttgctgcttgatgataattgcagatacctcatttgtttcccactctcctctctggagagttaccaggtacccaggataatttgtggcgtcctcaggatgtagtctcctcctctggcccccttgtagtctgatcctgtgaacccctctccgttcttcagccactgccctttccagctgcatttgtacagcagcctcttcactggtctctgccctgtctccattctgcacactgcagcgggatgaacctttgttgttgttaccagcttaa

SEQ ID NO: 11918 - DNA, 7399 bp, Homo sapiens
cacatttttagaaattttgcatcctagttactaaaccagtggtagattgaaattgaccatgagggagcatgagcatttacattgagctggcaaatgctgtatgtcaggattcctcctccagagtctgctattaaacatgtaccagccaccattatatatatgctagatacactgcagttattaagaattatatatatgtacacgtatatatactattgatacagtgtaattgttaaacatttaaaaaaatgaaatacaactttcagggcacatttcagccaaattcatatttattccagtctctaacactctgttgttatgtctgctgtaagatgatcaggagttagtatgaagtattcttctctacgcaccaaagaaaacaaacaaagcaaacttcaagtcagtgaattagttaccacagttaaaatgcatttgattttgtccttttcctttttcacaagaacgacagctgaatactctttcatgtgatgcctgatatttttctttttctttttctctcttttttgagacagggtctttaagatggggtctcgctctgttgcccaggttggagtgcagtggtgcaatcttggctcattgcaacctcagcctcctgttttcaagtgattcttctgactcagcctcccaggtagctgggattacaggcatgtgccaccgtgcccggctaatttttgtatttttagtagagatgggggtttcaccatgttggccaggatggtctcgaactcctgacctgaagtgatccacccgcctcggcctcccaagtgctgggattaccggtgtgagccactgtgccaggctctgatgttgatatttttctgttacagtccttagcccaggcatcctgtagcactctgtgtcccagactttttgatgcagaaacaagactgaaggaagattgtccaatataggaaagattcaacttttcctctatgtgtttgtccgctggtattcctatgaggcatttgagttacaggtagcagcacatcagcaaatgactccgctccctctctcagcacacatagcctaattgttacagaaccccgaagggacacctgaatgtcctttctttcaaggcaatatgtatgacacgctttcaaatctcctcctgcctactctgcttacctaaagggcaaggggagaaaatccagcactgacatagagtctgtaggttgaataaggcagccaagattagagagatgtaagtgaagaaacccactttatctggctttggagagagctagtgacttaaggcaggatgttcatctgtatcatgttgactgggacagtcctggttgttcccagtgcagctccattatcatccatctggcagtggggagtctctgctgcccatgtggtgctggcatatgcagttctgctcatgctcctaacgtgaatgcataaaacacccctgcagtgccacagcactgctatgagttcatggaaggcgtaggtgaggatacaaggcaagagtgctctggcaccaacacttggaggggccacctgagcataagttttcttagaggctcagaattcaaattgctaataggctcttggagcaaaattgcaaaggacagataggcttgttggtggcttctgttttcttcgctaacaatccaggttagttctgatttccttcctggtcacttaaaacaccttagtaagtgtgttaattgacttttagagttgcaaagggctttttattccattcaacccctgttcaatttacaggtgaggaaactgaaataaggtacttaagtgacttgcctaaagtcacgcagctggcgagaggtaggagcaggctttctgacacactcatctggcattcttgaggctatccctacaaatcctcttgacctctggtagaaattccacctccaccaaatatctttctaaatacattcatagctgggtggctggatatggactctgaagcagaagatgcttcatgaaatatttttggtttatctaataactttggtccaaatacgtatacagaactatatactgaggtagcattactgaatttgccatacgaaacatcttcactttcatccatcaggtcagaatttgggagtcaagtcacagactacttaaattgggtctttttcttcttagacaaatttatacgacttttttacatttttggccatcttcctatttaattcttttatgcgatgaatgtatatttcatgaggcaataattaaccttcaccaacttggcaggttgctttgttagtcaattataaggctaacaaaatataaaggtcatgactttgggagaagaaatgccttgtgactctaagaggttcagtgactgctgatctacactttaggacttgtatgatcaccccctttttatactagaatttaggctgtttggagttgacttttactatttcagctatcagaatgatgcagcattgaattcctcccaagtggctaatctagtacgaatacattagcaacccaaatcagcctataaggaatcaagttaaatgatcttatactcatgtccttttttctacacttgggattttcacgcaaaaataaagactgacttacttggtaatattatgattacagaatttgagttgcttctaaaaaataatgcagagagaaatactgaaaatgatgaagactttttcaaatgttataatacggtcatttataaatgactatttatatatgtcagttacatacatagtgacagttatagtaaaacactaggaacctgtacttaaaaagaaaaaacaaaatcctgtacacaaaacaagcatacatatataaggatttgaatctatgtatatatattttacatttttcaacatttgtgttttattccattaacataaccatttacagttattccagaaatttcagtcatacacagtgctcttgaatccaaagagtggtctagtgtgttggcattttcatcaagtacagtcctagaaaatgtcaagttgaacaataagatattgaggcacattggtcactgtgtattctgaattctttagtatggtcagaggaagtagttaatatatttcatgttgattctttggctactcttgatttttgctttgggtaacatcctcatcctgggaacattcattaccacttaatagcaagataacattaaaaaaaaatccttcattgccacatttaatagcatgtttaaaaaggcagaggttgcaatgagctgagaacgcactactgcactccagcctgggtgacagagtgagacactgtctccaaaaaaaaaatgtttaaaatgagaccaaaccctcatggagacatttctctgttctattagaaacgcaatggcattctcatagatcctctttcttttttatgatcacttgtctaaccagagctgctatgtcaggcctgatgacttcaatgggctcctctggcctccagaacttcacaacttgaccctcagggttgacaagatacttccaaaaattccaccttggttccttctttgaagaatctaaaatatccagaacatattttcatgagcataattttattctttgtcaagattttcacttctattagtatctgcataaatgataactttagtatcaagttctaggactgtcataatataaaaaacaaaacacccaaacgaagtgaaactcaaggttagagtaaccagatttcaatatacttgatgacttcacctatgagtctactcatctagtatgtgatcttagtatcaagaaatgaagcaaagtaggctgggagccgtggctcagtctgtaatcccagcactttgggaggctgaggcgggtggatcacctaagatcaggagtttaagaccagcctgcccaacacggtgaaaccccatctctactaaaaatacaaaaaattagccgggtgtggtggtgtgcacctgtaatcccagctactcgggaggctgagacagtagaatcatttgaacctgggaggtggaggttgcagtgagctgagaccacaccactgccctccagcctgggggacaagagtgaaactctgtgtcaaataaaattaaaagccaaaaaaaatgaagcaaagttgtaatcccaaattgctgggattacaggtgtgtgccaccacaccaggcaaatttttgtattttgagtagagatagggttttggcctcccaaagtgaataatcaccttattttgaaaagcaataactttttttttggcagggtctcgctgtgttgcccgggatgggcttgaactcctgggcactaaagtgatcctcctgtcttggcctcccaaagtgctgggattacatgcatgagctaccatgcccagccatgatatccttttgataaatcttaatttatgtaagaaatgtagattttttttctatttataccactcaagatttatgttcattttattgactaacatgaggaaaaatataataattataactaaaatttatgaagtgcttactatgtgccagattaatgtatgctccgtgcttcaaattgatcctctcttttaatcttacagggaccctatgaggtgggtattattatcatccccgttttgcagatgagataaatggaagcctagacacaaggtcacgtggctaatgagtggttgagccagggttgatatacgggccttttactccagagctcatgctcttaacctttgggctctatgatccttcctatctaagtggaatgacaccttaactcactgttacctttttgattacacaggctaagaagggttttagaaggtttgtagtgataaagagaaataacctatgagctattgcacccacgtatctggctgctgtaactgaagaatgattagttcaatggcatgtgcttgggcttttctttcctcagtggaccttcaaaataagaggaataaagacctcactgtggttgccatttatggcgttaggcattatatcaactttccctagaaattaaatataatgtttttagaagattctgacttcacatttatgtgaaatattatagatcactatttggtttgttggattagaagcttgattgcctgagtgaggtaatagtttgatcaaaactcaacttatttacagtgaaaataggactgaagatgtcatcagaataagttagatgagagaacattagctaatgtcctttatttatttatttaagatgcaggcttgctctgtcgcccaggctggagtgcagtagcgcgatttcagctcactgcaacctctgcctctgggttcaagcgattctcctgcctcagcctcctgaatagctgggattacaggtgcccaccaccacacctggctaatttttgtactattaatagagatggggtttcaccatattggccaggctagtctctaactcctgaccttaagtgatctgcctgcctcggcctcctaaagtgctgggattacaggcgtgagccaccgcgcccggccttttttttttttttttttttttgactaatatggtttagaacagtgtctggcacagagcaagcagtgtataagtactttatttttactattaacagacttaattccaaacaatcttaagaaggcggtactattgatagcccattttacaaatgagaaacaggcacagagaagttaagaagccacatagcaaaaacaaaagagcaggggtttgaacccaggtagcttgaggccaaagcctatgctgtctgtatgcctcatgacctttgtgctaagtgaccttggcaagtctttaaacagatttctgtagctagcttaattggagaaatagcctaacactactgccctctgaaaaaaccaagttatatgtttttggattttagcaaaaatctggtaagctgacatattcatctttgagaatattgtttcagataagaaagacaacataaaattagccacaaacatatgttaactaataatgcccagcactattcatgagagctgtgtggctataatgacgggaagggacatttctccagatgctagttacaagagaggagaattaagatattttgtgaaaatagccatgggcacactttaagtaaattcttcaggaagatggtaataaggaataaaatatattggaatagaattcttttaccatctaagaagctaaaacattgatttcaggggagcataactcctagaagttacaaaggatgagattctggctctttgatgatagttttatgaagctttcccgatacaacgtttcaaatgaaataggaaagtattgtcctggtataattgtttaaaaatgaaaagcaatttaaaacagcatatgcaaggcagatatttaccaacaagaaatctaaatgcaggttctccttcagatcctagaatcttaatcttgtggaagatggggaaagttactccgtagttttttcttgcaaaagattctacttccttgcttgggcggggctccgattctccaaactgattgcagggaaaagccaacacgctgaagtgggatggtccaaactctttgtgcagttccttcagccctaagtaatttctgtctgtgagttggcagtcactggccacgtttacaactagtgaaacctcccggaaaaagaaaaaaatccaaccggaaagtgaagcaaaagattttaaaaaattctgcaagtagttaaaatcctaaacaatttgggggggactataacctctgattgatgtttttttcatatttttggacatacacagttctattgaaaactgtaacctagatgcctgggttaaggccctgaaatagtactgccattaaaaaagcattagatactcatgaaagtttatttttaaattaaagataaaactatgatccttgataagttctttttaaagttattagattatagaaccaatacttttattaataaatgtcatcatgttcacattactaactataagtattttccaaacaactttacatgtcaattcagcacaaaattaaagcattttaaagaaaacgagataatcggaatttattatttagaagcaaactatcagaactgtaataactaaagtgatgtactaataccattactctgaagactaaattccaacttatgaccatgtaacagcaaaaaattgattttattaagaggaataaacagagacaaggaaaaatgataacaataaaaatcagatgatgcaacttactttgcctttatacttttccagagaaacagttcttccttttgcatccttcacttcaaaggcataaaagctgttgattttaggtttgaggaattttagttgtagaagaaatagcgttactgtgcatagaactatagacagcaaaactgcaaatacctttgctctgggcccggaacattttagcgggtaagctgcaagaggctccatgttggaggattctagagggaagtc

SEQ ID NO: 11919 - DNA, 521 bp, Homo sapiens
taaaatgccaactttattttattttagatccagggggtacatgtgcaggtttgttacataaatataataggcgatgctggggtttgggcttctagtgaacctatcacccaaatagtgaacattgtacccaatagatagtttttcagtccttgtattccttccttctaccccttctggagtccccagtgtctactgtttccatcttcatgtccatgtgtacccattgtttagctcccacttagaagtgaggaacatgccgtaattgattttctgtttctgaaaatgccaacttaaatttttttaagttttcttttttagaacttttgattctgtagggaaaccaactttatattcaataaacagaagacatttaaagttgtggtttagtctcatattatcgagatgatgagaaaagagggaaggaatggaatgaaataaaaatatgttaaagaaataaaaaatatgttaaagagatgaatgggttaggaggaaagtgaagatacaaattaaaagagaaaatg

SEQ ID NO: 11920 - DNA, 3453 bp, Homo sapiens
ataataacataatgaaagccatatctccatgatatatatgtgcacatatatatacatacatgtgcatgtatgtatcatattaaggacccatggtactcttaaaacactgtagaactctgtgacgcagtaaggaaggggcagatttgtacaaaaacttttctagattccatcagcaaaaaccaacacaggttgtcacgctgcatgtctggccagctaatctcgggggaaaagctacaagttatttattttattttaagagaataaagtaggtaataatttaagggatcaaattcaaggaggaatgtgcaattttagagcaaagatttgtttaaggcaaatgagactttgggagcatcccattccagttttgtcttttttttctctgaaagaaaaaagcaaaaaataaaataaaattccacttataccttctgacaagtccctaaaggtcttgaaataaaaggttctatgcaagtgcaaagttttatagttatttttattgctgattattactattactatctctgttgtcttaagagtatgtgctgatttcagagacatctcaaattgaaagaatatcagattgcttttaaagtagctgaacgagccacagaatatctgaaattattcattgttgttcctccaccaccccctttctcatggtctgatttttagaagagtggcatcctcgttctaaaatgtaatgatcaccaaatacggccttccatcaaatttgtgaaaactacaacagtataacagtgacaaacctaattctctagcccaaacctggtctgacaatcatttccatttagaagtcattgaatagttttccaaacactttccatgtgtgttagcaaattattcctattttgtgtagatgaggacgttgagactcagagacattcagaggcacgctagaggtctccagcctagcttccagcaccattgggactgaatccaagtactctcactctgaacttcgtggttctgtccactagagactctaatatgcaaacaagcagttcaggaaagaaagcatgctaacacattcatgaagcagtatatgaagttagaagaacaaaaggaaatacaggagatgacaagcaactgagatattgtgatatataatcatgctcttagcttcagctaaattcagctaaattcttgtacactgaaccaatgtcataatcaggcttatttagaaaacactttgaactatgctataaaagattatatcagaattcatattatacatgtgttcacatcagcgctacctgtgatgttttcatgtatttatgtatgtgttataaatacttgatttatacatatacaaatgcacatacgtagtgtgtttgtgtgtttatgtataaatttataggcacacaataatagaggtaattataagtaggatgcggtatgaataatttgcttaaaatatgctaaataaccaaaactgtttaacgtcatgttgctgttagtgcttccatactccacgtgggtaggactacatcacacttttcaactctgtgcagtactgcatgggtggaagacatatttaagataatgtgcttcccaaaacaactgaataaaagccatcccactacattgagtgctttctctggctccttgcaaagaaagatactttttgtaatggtccaggaaaggaacattgctttctttttgtctttcagcacatttgtattatgctcaccttgtctctgtctcactgtgacccctttacacttgagttcagagttcaagcattccaaatataaattggaatgttggcagcccagtggcttgaaggccaatgatgagcagtccaagaccccacagcgagatgagcaactcttaggaattcccacatcctagagtgaatgcaccaactaacagtatagaatgctgtccttttcaaagcgtcctaacagcaggattacctggtcaagtatggactttctttgaatctttcttttcacaaattggactgcctgtaataccaataacattgttgtatctaactaaataaatgactgcatatacacacataccctcaattctcttgcttccccattttctttttcatcccctgtctcaggacttttattttcaatgttgacctttggtttggccatatatcactgttataggaaatctcatgagaggaatggctagtgacccaactctccaaatgtctaagttagtagttacagctgattttttatgatgcataattggaatgtggagcctctgaggttgtgatagcttgtacatgaatttcaaatgtcattctaaagaatgaggggtgggagggatttatagttagaaacgacagtgcaggaaggggtattttcttgttgtcagggctggaatgaatcactgctgctcaagtcaaaggttcttgaatatccttagtttttgcatttcccctccttttcctttgacctttatttatttaattatgtatttatttatttatttatatacttttgctccattcagcacaaacacaaagcaaagcaaaaaaaaaaatatatatatatatatctgtatatgtgttgtaggcaaaacactgtgaatttcacaacaaccaccaccaagcaactattttgccatcttaacatacatctcaggagacgaaatgagaaaagatggggatgtcattttttagtctatgcgtttgaggccaggtccatgtttatttatttctttagtctatgcattaatgaaaatgatcctgagtggaggttagctgaacgttcaatgtactggagcaagcatcataaaagctgctagtagccatgtgtttgaacaggaaaaatattacagaaaatgaaatgtaaaggcctatatcttgcagcttgtatatcttactattgcttaaaaaatgtataaagcagctggaaatgttttaaatacaaggtctttgaattaaatgtggattttaaatatgtaatcccttgacaaatgaccaaattatggtgaactattgctccctgcgttctttgatcattacctatgacttacaaatctgcctggagatgtggacattctgcatttgcttctgtatctggagagatgtttgtatatatccaggccgtatacacacacatttccatatctctctacagatatatttccccttcaatcgtgacctggtatttggaactctccttttcatttggcttatcttccttttaatgtgatgtctctgtgctaatacttaccagttcttgttttgcaatctgttttgaggtccattgctttactaagacccactgcatcttggctgatttcaaagtgacacctgaatacagtgtttaaaaaaaaaaaagttttgtttgtaaatcatgtgaccagcttctctcaacctgacatggaaagtctcttgtactacagtgtatttaataaaaatgatgtcttacaataaataacatactccaaaagagagactaaaaa

SEQ ID NO: 11921 - DNA, 519 bp, Homo sapiens
gaagatttattatgaaccgcaatatgggaggaacaaagacaaccactgggatcagctggtgtcagtccctacttaggaaatactcagcaactgttagctgggaagaatgtattcggcaccttcccctgaggacctttctgaggagtaaaaagactactggcctctgtgccatggatgattcttttcccatcaccagaaatgatagcgtgcagtagagagcaaagatggcttccgtgagacacaagatggcgcatagtgtgctcggacacagttttgtcttcgtaggttgtgatgatagcactggtttgtttctcaagcgctatccacagaacctttgtcaacttcagttgaaaagaggtggattcatgtccagagctcatttcggggtcaggtgggaaagccaagaacttggaaaagataagacaagctataaattcggaggcaagtttcttttacaatgaacttttcagatctcacttccctccgacccctaacttccatgcccacccgtccttttaa

SEQ ID NO: 11922 - DNA, 41867 bp, Homo sapiens
attatccattactgtttgttggatccaactacacagtatcaccaagtaagactgcacaaatatttgacttcttttgaaagactgtgaggtctaataaatttccatttgtaaatctcagtaagtaatatgtttcttttcccccaactgttaatagcttttggtcagtgtagaccagaaacacttgtttgaagcacgcagtggaatcctctcaatccttcatatgatcatgtcctctgtgacactgctttggagcatactgcatcaagctgattcttcagaaaagatgactattgccgcatccgcatctcttaccactattaatcttggagctacaaaggttagacaattcatatttaatctgtagagctcaagagtctgaggaccttcccaaagattatattcagaatatgtgaataatttgtgtagtatttacaggactctgctaattatcaaataatttttaacagttttcctgggctatggctgacgtatcatagaatttgcccatttttaagtatacaattcagtaatttttttagtaaatttacagagttgtgaactatcaccccagtccaatttttgaatatgttctttaccacagattcctcatggccatttgcactcactccctgttcccatccctaatcccaatcaaccacgaatctattctctccatatattgatttgctttttctgaaaaagttcatataaatggaatgataacaatatttggtcttttgtgtctagcttctttcacgtgacatatttttaaggttcattcatacatgttataactttattccttttttttttagggcattttaaattgacattttaatatgcaaagccctcctagaaaacaatttagcaatatgtatagagagctttaaaggtttcatagtctttgacctagtaatctactttaggaatgaattctaaggtaattgaaattatacaaagatgtatatacaaagtgttcattatagtattatttaatggcagaaaaaacagagatcctaaacaattaattagggaatgtttaaattatcctttcaatgtttcattacatagccactaatattcatggttttgaagaattcttattggatggagaagggctcaaaagctcagtgaaacagggatgttacataattgaacaaataccatattttcaattatgtaaaaaatgttatctgcagaaaaaggaataaagaaagtttgcattttatcagtaattatctcaggatggtgggataacttattgatttttaaattttttttcttccttgcactctgatattttccaaatgctgtgccatgtcaagctgtcaaattgatatccttcaataacctaattttgctcctagaccagaccacctggatcagggatccaagggaacacatagggaagtgggaaaagggtaagggtgggaaccattagaacatttgatctaagttttgatgcttggattaaactatactttttatgtttcgttttacttaaataaaacagaaggtgttttataattatagaatccctcacctttttttaaaggactctatatcagacttactaagttgaattttatatgtgttgtgtttttctagtatcttttcacagtgaatagacttttatttggctgattggtagccgtcattttataggatttgtttttcttttagaattatagtcatattgtagctcttaacgttattaaagtttcctctagtgttatttagatagtaaaacctataagtactatattatttcaaagaaaccaaaaacgcagtctagttgtaaatgttttttcattttttaaaagtttcactttcatttgcttcaaattgttttagaacttgagacaacagattcttgaattgttgggccccatttcaatgaatcatggtgttcactttatggctgccattgcatttgtgtggaatgaaagaagacagaataaaacaaccaccaggaccaaggtatgtatttagacatttggcactttttgtttttgcatttggtgagtacatgctaatttccacttctccatatattgcagtggggccggggtagattcgagtgtaaagcaaaagtctgtcgacagctttagataaattgttgccttaatttctttaagtattgattaaaatttgaggtcaaggctaggcacggtggctcacacctgtaatcccagcactttgggaggccgaggagggcggatcatgaggtcaggagatccagaccagcctggccaacatagtgaaaccccgtctctactaaaaatacaaaaattagccaggcatggtggcacacgcctgtagtcccaggtactcgggaggctgaggcaagagaattgcttgaacctgggaggcggaggttgtggtgagccaagatcatgccactgcactccagcctgggcaacagagcaagactcttcctcaaaaaataaataaataaagataaaaataaaataaaatttgaggtcaaatataaaagatatgtgaaaaaagagaaattagtatgatattaaaactaaatagaaatggtaatatggtacagtatatttttcaagtgctagtcatttagggtacaaagcaaggatatggagaaaagttttcatcttgactatagtttactatgatgtgatagttcaaagagttcttgtttctaaatataattcacaaatttttttttctactttttttggtagagatgaggtctcactttgctgttggtcttagctgagttatatatgtgaattttgttgctttctgagtttcaaagctcaagagaaatgctctatattgaaaacaaatcatggcacattagaatagtaaggctattatataacttacatttatataaaatatatgattttttccacctaacaattcctgattttgtgctgattttacattacatttttaaattaatcaaaataaacattcacaccatattacattattttgcatgtgaagattcagtagtagatatcactcacattgaaaatttaaatcctggactacttaaaagcagtaaagaacatttgatttaacatggcatgttgaagccaggcacagtggctcatagctataatcccagcactttgggagaccaaggcgggaggattgcttgaggccaagaattcaagacctcatgagaccctgtctctacaaaaaataaaaatagtgaagtgtggtggcatttgcctgtagacctatctactcaggaggctgaggcaggagaattatcaggtatattacagctgataatatgtaattcacatagagcaatgcctagcacttaataatcactgtgtaaatattagctatattattcctcatatttaaatagaaatagagagccaaggattaccagtcacataaagtctctaatgtgatagacagactgaaacaactagattttaaaaagtcaaacagtgcagataacagaagaaaatgtaaataatagtaatgtccttaagtgggtgagaccatgaagtagaaagggagatcataggaaagaccattcccaaaattaaaatttttcatggatattaaaaattctgcaacagaaacaaagcaatatttttaggagggttggaacagaaagtggataaatatcagaaatggaatacaaatttaaagatacggaaaatacgagaaaagagataagaatattagaggagtgatactagagacccagtatctttctgcagaatttaaaaacaagaggagaaaaatacaaagaaataatacaataaaagtcctcaggaatgaagtaaatatgtttccagattgtgcctaccactgtgaaaagagatctgcacaaagattagcatgtaatttcaaaacactggagataaagaagagatcctaaaagcttctaatgaaagaatactggtcacattccaaagaataaagatgagatttgttaacagcaacactgggaattttgatgggaagttagtttcaacccataattctatctccagccaaactgtcactcaaacattttcagctatgcaatgtctcaacaacaacaacaacaaggaaaattgccatgagttcactttttcttggctactggaagatgtaactccaccggaggaggaataaaccaagaatgaagaagacaggggatccaagaaatgggctgcaacacaaaagagaaagcaaggggaatctctgggataatggtaacaggagagatatcaagatgacactgtgtagcaaacctagagagtatcaacccagggtagaataaaaagacatctaacagaaatgtctcaaggaaaaaagagaagagagggaggaaaagatacaaattaattacctgaagtatttgaatatgtaattagagatttacagttgaagtatgtagggatgaatttttaataggtacagagaaaatgaagcaaacaaagcagtttattagctctaggaaaaacaaaaagttgtaccataaaacaaatgcaatgctagtacaatgcacattgcaaccaaaaataatcatgtgaacattggatatggatttaaataaaaatatgatataacaatgttgagaggataggtagaaaagtataagagagctacatctttgtcttccaaaataagtaatgaatagataatgtctaaaattgaaaataaaatcaggaaataggaaaaatagtagtatatgttatttagacgtaatggaaaagaacataaagagttgagcatggttgctttggggcatgggaagggatataggacaatactattttttcttataaagcttattgttctgttttattttttgaggtgatgtacctttattgatgaaaaataaataaattttgagcctgggcaacatagggagactctgtctccacaaaaaaattaaaaaattatctgggcatagtggcatgcctgtggtctcagctactcaggaggctgaagcaagaggatcgcttaaacctatgaggttgaggctgcagtaaactgtaattgagccactgcactccagccttggagacagagcaagaccccatctcaaaaaatatatacatatattgtatatatatatatatatgcaaattttacttttatatatataatatatatatttaaaagtatatatataatatatatatataataatatatatatatataatatatatatatataagtaaaatttgcctaaagtagtcaagggacttgaagaggtctttatattaaatagaggccagggctgggtgcagtggctcatgcctgtaatcctagcactttggggggctaaggcaggaggatcattttgagcacaggagtttgagaccaggctgggcaaaatagcaagacctcatctccatttaaaaaatataaaaaaagaagagatcataaaatactctcttctgtaacttcccctaaaagacttatatacatacatacatacatacaatgatttattacctaggtcattcctgcagccagtgaagaacagcttttattagtggaattggttcgttcaatcagtgtcatgagagcagaaactgttatccagactgtaaaagaagttttaaagcagccaccagccatagccaaggacaaggtaagaaaaaactcttcttcacatgtgtttacaattctgtttcagaaattatgctggtaagatttttttttgtacaataatgtcctttcaatatagtacagattgcagagatgactgcatgtggccctcacactgcttcaatcaaaacaattatcaatatttgtagtgacttgctattctgattattcggtagccagtgaagagcagttaactgctcatatcttcatatgtacctcaaaggtagtcagggaccatgtgactaaattctcaggagagatttttctggtcatttaaagaacataagccagagctcaagatttgcttctctcagttgttgccatttttcatagcttctttattgctttcttttctgaatgaatctcttaattctgtgaactccccaaattttgctataaccttagttctagtcaatgtcatttcttgaccatgtataatactgtgctatgcaagtgctacactatgaatgacatagtctctgcacacacattgctgtgtttctaggcaaaaataaaagtctacaaattaggaatattacggacttttctactttttctgctctttgttcaagcaataccaagaggtcatattttcccagaaagtatttaccaactacaaacattagactttgagccaagccaaaatagacctaatcacatcctttaaagaattatgatatatatctgaaaatgttgaatgatgttttccttttatcttgtgtttccaaagggagtaagatgtgtgtgaatagtcagtgtccttattaagtttttaataaaaactggggcatttgtcataggatttttagtttgtattttgagtacctatttgtgccagacattgagcaacacatgagggatatgaaaacaaattagagccaatccactgtcctgccccaccaacctgtgtccccttattaagttctgaatctattagacacttgatttttggacaggaaaccttcaaggaaatagttgggactaaaaaagcacaaattgataaacgtcagtggtcatcaatatcattctctggcctcttgttaatttccaagggcaggtgttttatttttattatatattacactcaacactatctttaatttagtggctatatttaaagctcttaggaattgatcacaaatttgaactacactaattgaacagatatgtgtaataagactcaaatacacatttcattaaaaatctcaacctcattctgatagcaccaagcataagctacctaaaatagtgttgatacttatagagtacatgaatcatttaaaagtgagtggtggactatcaacttctgatatatggaaggaaaaattgacagtctttccattccttccatctgttttcaacttttaaaatagctcatgtgttctgaatttttcctactgagtggaagagaactgcatggctcattaatgaaaaattgatgattttgttctttcaatttttttaattaaaaattggcagtaagatacagagtagttgcaacaatgaaaaagcaaaggcagtattcttcttcactacaaaattgatttcttttatttatagaaacatctttctttggaagtctgcatgcttcagtttttctatgcttatattcaaaggtaagattactgatattgatctgtccttactatgttgctagaaacagagaaacattatttatggatatattaatataagtaatgagtgtcttaacgacccagccatgtatatcctacaaacctaaagacctaaggatattgaagattcctagatagtaaaacactgaattgtgataaaatcatttaaacataaatgaaaagttgaacctactctcgaaactatgcatattgccactgaatccattattttggtataggtgaacatacagtaattcattctgcttttttaatgttaggaatgattacatgaaatatcttcttactatcatattccattttgcgtttaactgacctgtgaacagaagttatgatttgagtttttataacttcttactcaagaacctgactcttcatcctcctttataagataattccattttattcaccaaactcagcctccatttgtaatctatgactagcattataaggtcaggctattgagtgtatttaaactggttgtgacctagagcaagcactgcctaaaatctgaacttatatacagagaggtgttagggttaaggtcagactgaaacaaagatagtcttcattatttttacaggttaaagactaatgttcagttgacagccctccataatatgaggtagagacgtacaaggtgaaggaaaaagaactaagagggaaatggagagaccaggctagggagtacatgactgtggtatcagtagttaaactgagaattactgcagttgtattttacttttgagatcccatgtgataaatgggatttcaatagaaaaatttctagattaagaaattgcaggctaggggcggtgactctcgcctgtaatctcagcactttgggaggccgaggcgggcggatcacgaactcaggagatcaagaccatactggccaacatggtgaaaccctgtctctactaaaaatacaaaaattagctgggcatggcagcgcacgcctgtagtcccagctactcaggaggctgaggcaggagagaattgcttgaaccggggaggtggaggctgcggtgagccgagatcgcgctactgtgctccagcctgggcaacagagtgagactccatctcaaaaaaaaagacaaaaaaagaaaaaagaaattgcactggggccagatgcagtggctcatgcccataatcccaacactttgggaggccaaagcaggtggatcgcttgatcccagaagtttgagaccagcctgggcaacatggtgaaattccatctctgttttaaaaaaaagaaagaaattgcattgatatttcaactgtgttggtttactaattaacgttagtaaaaatgtaaagtttttaggaattttgttctatcattgtctataaaaatttagagaatgttccacaaactagtagaaaaccatagtttattgtggcttttgtataaactatattatcttgcagaattccagtgcccaatttagtggatagctgggcgtcactgttgatacttctgaaagactctatacaactgagtcttccagctccagggcagtttcttatacttgggtaagcaatttcacttaatattatttcaaataaaaggataatgttaattgtcctagttgccaagtattagtaatagatattttaggtgacagtgatctctctaccttctcatagtgttcttgagatgcaaaactagatgtataaggcctgtttaagaaaaaaaaaagtgggaggcagggtgagaggaggaaacagtctatgtttatacatatacaaaatgtaactacactaacataaaactgttacaacagtagctgtttccgtggtggtggagagtatggaatggaaaggggagggggtgatgtagcatggctgaaggggaacttcacagaggagggacacttgagctgggccccaaacctaaacagcctgggaaaatttttctctttgtgtcttgaagttttctgatttatcttagtgatttatatgattatttgataaatgttagtcacctatgactgcaagtactgggatgtcatagtcagtctctctttcttgcttgccattattcttgattcctaataggtccccagtaaatacttggtaagtgaatagaggtggtgggcacagaaagcctttgtgaaacaggaaggggaagggtattctggggcaaagtaccttgtctgatttggtaatagagcagggcacaggcagtggtatagtggaaaataagactgaatgaaaagggagatgggagctagatggggcaggatcttgaattttattttaaagaatgtggtcttgaaagggagtgggagcggttgcaggtttttgaggagagacatgactggcatgttagtagtagtaggctagatcagaggggaaagaggctagactaggaattctatttcaagtgggaagtgtggggatggtttcaactattgatgggattgaaagaacaggataaagaaggagaaggggccagcaaaggagatagaaagggaagtatcaaaaagaagaaaaccaggcatttgattgtccagaaccaaagggaggttaagagagcatggttaacacctacagagaggttaaggaaggtgaggaataataaaaggctatgtttgttgacaatctggacaggcatcctaattgtccaatcaccagttatctgatgattttggagagagggtttggagaggtagcagcacagatgtgttaacagcaaatgcttagtgtgggaaagtaagtgttgattcttctttgaggatatttgatcatgaaaagaaagaagccacatgcggtggctcatgcctgcaatcccagcactttgggatgctgaagcaagaggactgcttgagcccagagtttgagaccagcctaggcaacatagggagactgtgtctctacaaaaaatttaaaaattagccaggcatagtcacacgtgcctgtagtcccagctacacaggagttgtcataaggttcagagagggaatgtatgtacaggtgttggaatcatcaccaaataaccctgctggctaatttcatcaaaaaattaagttcatttgttgtgatctgtagctgttcccctttccttacatgccttttcttcctttcagaatgaaggatcctcttccttttcaacatgtgcatattctgaatgttaaaacaaaaagttgaaagttgaacattttcagttatactagaaactttatttccttttaaaatttgtcagtttacctttttgccaaccattgtactgatcctctaaaattacctaattaaaaaatagatattgatatgaaggttgctctttagtttcattttacatattagtttggaagtaattgtgcatataatttatcttttaaaaaaccatgtcagagtgaatattgagtagactcttagcaaataatgaaaatggaaatttttttcttcatgaactatttttaatgtgttatgggaagaaatcatttctgtattacaatttaagattttttaaacttttctgtttatatataaaacacacatagaaaaatacacaaataattagtacacaactctacaaatgcaaagtttgtaaaaagtcaacataccactatatcattacaaacccaaattaagaaataaaacaccatgtgtccctccacacctctcccaattactattcttttatctccccaaatgtaaccactattctaacaccacagatggattttgccttgtttttgaactataagtatatataaatattttgtgtcggcttcttttgttcaacatatgtttatgagattcatttatgtaattcacatatctgtaatttttcattgttgtttagtatttgaacattctgcaatttgttttttctttgatatgggatcttgccaggtttcccaggccagagtgcagtggttattcacagcatgatcatagcacactgcagccttggcctcaagcaattctcctgccttagcctaccaagtagctggaactacaggcatgcaccaccacgcctggccacattccacaatttatcttttctgctcttgctggacatctgggttccttccactttggggctcttacaaaagatgctttgagcatctttatacagtgtcttttcatgagtatgtttatgaatgtcagttgagtcataggatatgtatatatattaaatatttaaaatggaaatcaagaccattaagccgcttaactcatcgtgagaaattagatcgcattagtttcttttagcctgatatttcccgtttctgttttctctttggcccttttagggttctgaatgagtttattatgaaaaaccctagtttggaaaataaaaaagaccaaagagaccttcaggtaaggcagtctaagagctgttgccaaaactgtttctcagtgccctcaatttgaaaatgagagagtcaaataaaataaactgaagtttctttcaactctgaacattctatgggaatcaacaagtctattgtaaaatatctattatcagaaatataaactacagaagttcataactagtgtgcatgtgtgtaccatacatagttgttcttccttatttttttaggatgtaactcacaaaatagtggatgcaattggtgcaattgctggttcttctctggaacagacaacatggctgcgacgaaatcttgaagttaagccttctcccaaaataatggtagatggaaccaatttggaatctgatgttgaaggtattcttgtcaaacatttaggtttattatctgtaagcaggcatatatttactaagaaatcattttgcctagcactataagtaccacaaatttatcccttttctcatgtctaacaagtaactttttttcagtgggaaaaatatatatatacatatacatatatatatacatatataaaaataatacacacacacacacacacacataaaatttattttcagtgggaattagccatatctttaattttctcttatttatagatatgttatcacctgcaatggaaaccgcaaacataactccttctgtatatagtgtccatgcattgacattactctctgaggtaaatattaagctttttcacatgaactctcaagtagactgtttcattattaaaaattagcaagtaatttttatagaggaatttctaatttgagaaactattttgtgcttctagaaatcactatatagaattaatataaagttttggccttgtatgtatttggattatttagtttgccaaacattagtgataaatttagatactgcttcccttctccatgtcctattcttttttatgtgtttttttctttttcttttttttttttttttgagacagtttcactcttgttgcccaggctggagtcaagtggggtgatctcagctcactgcaacctctgcctcccgggctcaagctattctcctccctcagcctcctaagtagttgagactacgggtgtgtgccacaatgcccagctaatttttgtatttttagtagagacggggtttcatcagtttggccaggctggtctcgaactcctgacctcaggtaatccgcccacctcggcttcccaaagtgctgaggttacaggcatgagccaccgcgcccggcctggggaggggtggaggtgatctaaagcctgccactataatgtattttacaatttaccaaacattttcatgtacattgtctgacaggttcttttttataccctattatacacatgtcattttgtttcctctttgcagatgtggatagtgacctttacaaagatcagaacaataggactaaggccaaatagctgttaattgacagtgttggaatttgaacagcccagttcaattgtttgtttttttttcctaaactacattttagctgagtcagggaaaaagaatactatagtttctagtactaaattcactgtttactcactgtcacagaaggttcttgaactcttttcttttttgtacttccctatctcagttggaaatggcaagatttgcccatatttatatcctatagtaacaatgtacaaaaaagcagatggtggcaaaactcattaacataaaaatgattcaggaagatttaattttagatttttctaattttaagtagtctaggttttctaacaaactgaaaatcagtaccttgggatgatgtcagtttcacctcatatgttactcttcattttttatgttttcataggttttggctcatcttttggatatggttttctatagtgatgaaaaggagcgggttattcctttacttgtaaatattatgcattatgttgtgccctacctcagaaatcacaggtactatcattatttaaatagtttttaaaattaattcatagcctgttagaaacaagttctgttcccttattgccatttctagaattatcataaaatggcatttttaccttgaattataattgtttaaaaaaattcatatattatttttcttatggtgctttctatttcatatcttcatgtcactgtcttaggtaaatgtgaacatttatgtataacttgataggatgattaaagttaggacacgtaggttaaggtggtttttcttccttgtagtgcacataatgcccctagttatcgagcttgtgtccagctgctcagcagtcttagtgggtatcagtacacacggagagcttggaaaaaagaagcttttgacctctttatggatcccagtttctttcagatggatgcctcttgtgttaatcagtaagttgccctcttatttgtattcagcatgatgcacctcacagtctgatgaaatcagctactcccctggaaagttagaatactgttctttaacagtaacaacataattacatgttgtaatccttatctctttcagttggagagcaattatggacaatctgatgacacatgataaaacaacatttagagatttgatgagtgagtattacgggatgacaatccaagttctttcctgtacatggttccttcttactatttacttgtactcttttctggagactaggagactactgaattagctctttgtcaagtgtcagtggggatatgtgctctagggaaagcacactactttctgtacgctatgggaatataatcttaaaatttacagaggacaacttaagtgataagtaataagtaaaactatttgtccttttgcagcaactagtggagggaagggtccatgtctaatttgaatctaaattatttcctcagtacacagcatcatacccagcacataataatagcactcaataaataattattcagtgaatgagagactgacagatggtgaagtgcaaaaggcaggcagtcgaatccagcctatcagacaagtcactttaaatctctggggctctgtttatttcatctgaaggaagaaagaggggtgccaagaagggcagaatcaccccccaccccctctttctactcttgattgtttttatagtttaggattccatttagaatttcatctgaaaaaaaagagttttaaaaaacgtttgaaagttattaaatagcagtaacattgtatgattctgtaatattttttaacaaattctttagctaaagctacagttttctcatttggaaaaagggcaggatatctgttttatcttcataaggttgttttaaggttcagatttatccattcaacaaatttttattaaaagacaacagtgggccacgcattgcgctaaccttaatcaaattttaaaagttgtgaaggaaatagggcaatgtgtgatggattttaaataacagctaaatagctcatatacaaggtgaaactaaagaagccaaccatgagaaggcctagggtcaaaatattccaggaatagggaacaagaattacaaaggttggctgggtgcagtggctcacgcctgtaatcctagcactttgacaggccaaggcactaggattgtttgaggccaggagtttgagactaacctggacaaaatagcgagaccccagctctacaaaaaaaaaaaaaaaaattaaactggccaaatgtggtatgtacctgtagtctcagctactcaggaggcaggaggattgcttgagcccaggtggttgaggctgcagtgagccatgattgtgcccactgcacttcagactgggtgacagaggaagataccatctcaaagaaaaatacaaataaattgcaaaggtcttgggatgggagcacgcttggtgcactgagagaatgacaagcaagacagtgtggctacagcagagtgagttgagggtgagtaatgacttgaggaaggagaggtaggtaggcaagctacaccagaaggtatttttaaagtaacgagaaggatttaagcagatggcctcaaatattaaagggtttcctcagggttttatataaatggtattagtggttttaccttctaaaacctacagttctaaattttcctctccatcacaattcctaccattttggtcctctggcttatatacgttggatctgtttgccagcctgtctgccccagagaggggcatcaagttttgtaccccaagctcctctcagttttggatgtcatagagcatctagctattttaaaaaacaacagaataatctttcttcagatgacagtgtcacagtctctttcacttgctttttcagctcgtgtagcagtggctcaaagcagttcacttaatctctttgcaaaccgtgatgtggagctagaacagagagctatgcttcttaaaagattagcatttgctatttttagcagtgaaattgaccagtaccagaaatatcttccagatatacaaggtaaaaaatgaaaaaccctttattttttctctaactacaggtttttggttccttagaaaatacttctctaaatactaagttggggtaaaatatatcaagtgtagatcaatcgggaattagaaatttttctactgaaacaatgaaaattatcaatgctggcatctaaaagaaatcatcactgagttgtaggacttgcctaaatgtggtctctattttattgtttagttcaaatttcttaggaattcatgtttgaggatgaggtataagatgattttgctgcgggcagtcatgttagcatgttctccttgtggacaagaatttgtgtactctgagaagaccaaaatataaggcaaagccaggaaattgtggctagaagtaacacctggagatctgtaatttggggactgcatgggggattatgtaacattttcggtaacttcatcaagtgggtttggtgaccttctgtatccagaaggatatcagtacacgtgtcatcaccctgtaccaccaaatagctccacaatggggatttatccagaacagaattatttgctgctcgagtcagcatactctaaagcctccagcctcaggagccaacatgggaacatgatagttgtcatctctctagggagaattttcttttctcccagaagacaaatgattccttgtttcctaaccttttacgcctaatttcagatatgcaaaatgtacactatttgtccctacaattttttttgtttaagttgactagatcagtgctactcaaagtatggtccatggaccagtaaccagtctgttatcccatccataagtacaaaactttagagtaaacattttaaacttttatttgctatttgacagaatctgcttaataagaaaatgacatttgtattttgtgtatctttgtttaattggagttctcttattcgttgttttatgaaaatatctacaacagttttgaatttttttaaagtttatcctttactacagatagtttgagagtactggaccgacaatatagaaagttttatgtgataaagattatttagttattgaaaatgctctgcatttctttcagagagattggttgagagtctccgtttgccacaggtgccaactctccattctcaagtgttcctgtttttcagagtgttacttttaagaatgtctccccaacatcttacctcactctggcctaccatgattacagaacttgtgagttaattttaattcagtcaggttataaatctaaatgataaaacagtgattagtttccatgtgcttactagatattaacgaatattgggagagaactgagctgtagttaaaccagttactgatgctttttacagttgaaaatagtaaaacaagtcagattccatttccatacagcttaaatttacaaacatgcaacatagatggatggccagctccttgtgaatgattactttcttggatctggtttagtgtttagtctgtactacactacatttttaactctgtcatggcctacagtcctgacaatagcagctggacccatttacaatagctgtagcaatacctctagtgatagagatggctgagctggatttaactgctctgacatattacatatactcactcttgaagtgcagcacctaccccatttaaacttgcttcagagagactttcacaaagattttgtaacctaccaaacggtaaaaccttcccaagtcccacctacacccttctgttcccctcctcaaaccgtacacagtcatccttatcctcctcagaatgatttggggagttaggaaagaggaatgagtaaacaatggaaaaggaatctctctctgaaaatctagctttatagtttccctgcaaatataattgctttaatctttcttttatttttccttttttttttgttttttgagatggagtctcgctctgtcacccaggctggagtgcagtggcgagatctcagctcactgcaagctctgcctcccgggttcaggccattctcctgcctcagcctcccgagtagctgggactacaggcacctgccaccacacccagctaattttgttttgtatttttagtaaagacggggtttcagcatgttagccaggatggtctcgatctcctgaccttgtgatctgcccacctcgacctcccaaagtgctgggattacaggtgtgagccaccacaccagacctatttttccttttttaataactaactctgttccataatcactaaaaacaaaagctcaccttcatctcactggatttcaccaaatgattagcaaggctctgtgtggctaaatttgcagttttaccttcagaaactaagtataatttaaaagattctgaaaatgtattctaaaatttgtttttgcgttaatgaaaatacaacttaaagataacttgaaaggattaaatatccagtttaaataaacatttaacatttcaccattttcaggtacaagtatttttactgatggagcaggaactcactgctgatgaagatatttcacggtaatatgtaatttaaatatattgttgtccattttttaataccctgaaattattcagaatattactcagcatctaggagaatatagtctttttctgaatacttatttattattatctaattgattacgtttggatataatgtagttttacttattccttaagccctttagattggattaagccatcagcattcattgccctgggcccctagacacaaatttaatttaaagcagtacagtattgtttcagctacatgagctaggctggttttggtaagtcacatctggtctctgaaacattgcaacatatagccaaccctgttatggtaggtaacctggaaccaggctattcgtatatgcagatcttccagatggtcccaatttaatatacttttattctttttaatagaggcagtttattaatgtatgactaaatacaattttttacttacacaaatttataaattgaaaagttcctttaagaccaagtttcttgaatatattttcttcttcagtagtagatttataaaaaggatctcctgtactaataactttattattatagagaattttctcatccttgcagaaactgagtaaaaaagtttctcgcttttacagtttttatttttatatttcttgaacataatataagttatgtactacttttttttagacagggtctcatcttttcacccaggctggaatgcagtggtgtgatcctggctcattgcagcctcgacctcccaggctcgggtgattcccccacctcagcctcctgagcagctgagaccacaggtgtgtgccaccatgcctggctagtgttttttttttttgtctgtgtgtattttttgtagagacagggtttcatcatgttgcccaggctggtctcaaattcctgggctcaaacattccacccgccttggcatcccaaaatgctgggattacaggcagaagccactgcgcccagtctatgtactgtttttgcattctcaaagaagaaaagtgaatttttgatttgaaaacagtgacatttcatcatgaccttgcttagcaattactggcacatttatctcaggatgattatgaaaaatattagctggtacttttagatctttccaggaattcctgtgagtaaatgggtccagctgctgacagcactgtctcctgcttacaggacttcagggccctctgtggctggtctggagacaacgtacacaggaggtaatggcttctctacttcatataacagccagcggtggttaaacctctatctctctgcttgcaaatttttggatttggctctcgcattgccctctgaaaaccttcctcagtttcagatgtaagtaaaagcaaggatattaaatggttatttttgaaagtgcatttgctttggtcactgacatctatgactaattaaaaagttttttgtgtaagttgaaatattcctaatttttactaaaatgtaattcttttggcacagcagagttatcggaagtaaatggtcaatgtggatatattaacagactattcagtcaacagattgagtacctccagatgtgagacaatggggtacataactcacatgcttcaagtccagggaaggagacatactcatactatggtggctcatgcacaagacacactgaggccacatagcagagatccctactagctctgaaggtcagagcaggccctgagggcagtcttaacctgaggtggtgaagaatgacagctgggagagtgaagatagaggcagctgcagacatgatacgtctgaagtgtggagagattggtattgctggagcagaatgttaagaagaagctggaaagggattaaaccatgtaagaccttgtaagctgtgttagagaacttggacagctaaggaaagaagtgatattattaggcttgaattttagaatgcttattttggctatgtagtgtggagaatggactggagctgggcaagcctagaatgaaggaggcagttttatcttagatgataatgaattgaactgaaaagaataggggaaaagttgataaaagcatatataaattttaaaaataatgggcaagctatgtaagattgttttatcaaaatgtagttaaggtaatatgagaatttatccacaagatcaaatatgtattaatttattatattgtgtcttatttttcttctggaacagaaataataggataaagagtatgctactgagctttttctcttttttatttggacatgctccaaaatttgctattttacaagcttacttttcattaaacttaatggtaagaactagaaattacttttagagtcattctagttcctttaattttctcttctacttgaaaaccatatatatatatatatctactttttgatgaatttcagttgttgggtatctgttacacagatgttactcctaaggaagtccagaaaagaatactaaacagaatcgtaggaatgtggccaatattaaccaagacacttaccttcacaaaagtgataactattctgtggtgcttttggagggacatgaaatagtatgctcatgatactgactttttatcttccatgacaagaaccaaaatcagtttatcctctttgtcaagatgttagttactacaaaagggaaggaaacatgccgttatattaattagttttttaaaaacttacatctttctaaaaataaaaatctataaagtagaaagtgtaaagattttaattatcttgaaagagtaatatcttagcatgatccatatttggaaagttcaaaatacttgataagtttactgtatataaatttaaaagtatccatgtaactaaaaggtactataaagttcgaaagatagcaatgaattggtaaaagatattttcgatgtatatgacaaaagtctaaaatgcataatgtataaaaataacctggtagaaaaatgagccaatgagcaagacagttaataatttataggatggtttctaaacataggaaaaactgctcagttgttctcctgagtttccgattaaaattatagataaccatcagaatggtaaagatctgaaagttgctttccttttacttttagtaacagaagcattcttattcttgttggaagtatacactgatattgtccaattgttcagaggttatatttaccaaaatttaaaatatatatctttaagcctataattctgctacatccaaggatttatcctgtctctatattctcagatgtgcacaaaaataaataagcattacttaagagtatccactgtggtactttgtaagtgcaagaagttggacaatctaggacattggctgtggtgtactactatgttgctgttaaaaagaatgaagttttatatgatgcagaattgtctccaagatatgtaatttatatcaaataaattatatcaaaaatatatatcctacatgtataattaaaacaggcagcaatcatgtttttttaaaagagagggttggttgtgtgaatatatactcttttgggcataaactctctggacggacttacgaagctgacaacattgatgaatcctatgcggggaggggagactgcctttctttggtatgcccatttatactgtttgaatttttcccatggtcggatattacttttacttacttatgaaagacaaaattacaaacaaaaatacaagagaagtgcaaaaaaagcccttagttttcttaaattcgttcaattttttactcctttactatgcaactagggaacatttggccagttatatgttgaaaaatcaagtctttgtcagactgttatgttgcagtacaaagagataagctaaatgaaaacatcttccttttaagaaccttatgcctgttcgctaatgagaaaagaaacatttgttgagtacttgctttggactcatgaaaaaagtaatgatgagtactttacaagttttcatatttattccttacaaccttatgaggtagttaatagtatctttatttactgatgaaggctcagagaggttaagaaacatacccaaagtgacaaggctacgagtggcacatctggcatttgaatttttataagcagtggggtcatgatctttctactacattatgtggcctaatcttagatggcacaaagtctgtcttactgatgctgatgtcattattctatacataggtaccgatgggcctttattccagaagcctcagatgattcaggtttggaagtcagaaggcagggtatacatcaacgagaatttaaaccttacgtggtacgactagcaaaacttcttcggaaaagagcaaaggtatcgcattcttttgtgattgttttgttttacatcactacatgttgcattagtgaggtatttattaaatacttcctgggaaactgagaacgttatcaagttgagctattttgaaaacaagtccccagttttgagagttaatgtccataagcctcatatttccagacattagaaaacatatcgtatgtattttaaaggaatatgcggttattcatttttttaaagaagaaaaaggaaggcttttgtacattaataacatctaccttaaaatgttttcccctcaaaaaagaaaataaaaaccttggaaccatacatgtgagtatttaagactgtagtcctgaacactcttcgtgtcaaaaacttgagaatgtaatataatgttcatcttaatgccatgatgacaaacaaaagtatgagttgattgaaaaaaatacagtacaaaagggatttttagaacctgtcagagttgtttcaacagaactaatcaatgggtaagaagattatacattttaaatttgtaaaatatgagtcagatttcattgaaattgaatgagctagacctcgatcagaataaaggaaataatcattagcattcattctgtttatctatatgaaataaaatatatatgctaaaattcattttctaagtatttttcactttctgattataacctacattcagaaatgtgttccttatcctgatccagtacagctatataaccgaatctaaagtttcacaaaacagttcttgcccttaacatgagatattttcctttttgtagttcacagtgatgatgctgagtacagattgcaagacccccacaacctgcagtttttaaaacagtgctcagagttaaactggctttatgactctttaatataaagcatcttcttagagaaattatttaaggggaaaagtgggaatttacttaaaacatataccattaaaaagtgtaggaaaataaaatttgtaaaatattgtcttatatactttttatctttcagtatgcatcatgctaatttattacagatctttgcccaagaacctaccagcaatgaaactggtatgctcaccattgggcctttgttattaaccttttgtcaaattttcttttacattcaacaaatttcaaaatcaaattgtacaatttgggagtgatctaggttgtctggtgagatctagtatgcagtgtgtgctttgagtgctcagaaattttccagtcttctggagtcctcctaatcaggcagcagctcttaaactgaattccataactataaaaatggaatgaagaaagtgattaaagagattttgctggaaggaatttacatgagaaaacttgacttaaattcctagttgcttctgtaggggcttaataaaaggacagagatgaggatgtatgctgggtcctgagttcagggtaggactttggtactttcaatttgatatctcagagtttgggcaagtaatcatgacaaatccagaagcaaatatgaccccaggcacatgtccttttctgttatgcctgcctttcattagtaatgagaatttttataagacccccctcctttatctaaataataaatatgacagtcttttgcccaaaatttgtcccacagaataagaaaactattttgattgaaaggcatcttcccatccaaatcaccttaaacaaggtcttcatggccaagcatacttttcactggaacaaaggctgtgagttctcctctttccttccacaggacaaggaggaggactttaagacagtgattttggagggattggagatggccaagcatcaggtgagggtggctgtttcatgcttatgatatggcagcaaaagttgccaaatattgagacacaaacccaggtctgaatgtcaacaagtacaagggaggtaaacaggaaggaagtcttttttcaagtgtggactggtgaagtcaaaggagaaatcatttgtatggaaacatttgactttatttaatattgagacaatacatatagttctgattaagagcatcagaaactctgaatcaagtgtattcttcttggtcaagagcttaataaaagtccctctcttaaaggctcatcttgataggaatagaaacaaaaggttaccccatagttctcttacatttggaagttagctatatagagggtacaaggatattcattttccttcaggacaaagtcatctctgtacgccctttattgttgaattgcagtttgatttaggggattagaggtggtatggtaccagtaattgagtaatggtggaaatgtgaaagtcagtcacaggactctcattggtgccagtgtcatagttaagaaagaaagaaagaaagttttatatatcctgtaatctagactggaagctaaataattgctaggaagcaaacttaagtgatagctgttaagttttttggtttgtttttgaccagagatgatgaagtaggtgatcttttcttggtttgctcctagactcttccattttaacttatatttttagtttggtgcaaaagtaattgctgtttgggaccatgaattttaagtcattataactaggttcacacaaatctttattaattaaaataggaaccattacaatcaacacatttttgccaatgagaaataagtttgtttactcctgtagcataaaaatccatgcttccaaatttgacgaactcttggaaagcattttctgtgtcctgctagttgtggaagcaatttccctgcaaaacgttgctgagatgcctaaagaagtggtagtttgttggcaagaggtcaggtgaatatggcagatgaggcaaaacttcatagcccaattagttcaattttcgaagcgttggttgtgcaacgtgcggcccagtgttgtcgtgaaaagaattgggccctttctggtggccaatgccggctgcaggcattgcagtttttggtgcatctcattgatttgctgagcatacttatcagatgtaatggtttcacctggattcagaaagctgtagtggatcagactggcagcaaaccaccaaacaatgaccatgaccattttttggagcaagtttggctttgggaagtgctttggagcttctttcagtccagccactgagctggtcatcgccagttgtcgtataaaatccaccttttggcacacatcacaatccgatagagaaatgattcattattgttgcatagaatagagaaaatgacacttcaaaacaacgaatttttttatttttcactcagctcatgaggcacccatttattgagctttttcaccttttcaatttgcttcaaatgccgaacgaccataaaatggtcaacattgagttcttgggcagctctcttatagttgtaagaggatcagcttcgatgatgttctcaattggtcattatcaatttccgatgactggccactgcactcctcatcttcaaggctctagtctcctttgcaaaacttcttgagccatcacggcactgtatgttcattagcagttcctgggccaaatgcattgttgatgttgtgtgttgtctctgctgctttataacctattttgaactcagaaaatcgctaaatttgatttttgtctaacatcatttccatagtctaaaataaatataaacagcaataagtcattagcaaaaaaaaagtgagaaatatgcttaaaatgatgtataacataaccacatttatttaagaatgtactccaatataaaacggcaaatttcaacaatgcaaaaaccgcaattacgtttgcaccaacctaatattttcctttttcaggattttactttaaaataagcaataagcttgagagcacatagaagaaaataagctggattttgcatctgcttgacccactaggaaactagtgatattaaattattaggtaaacaatgaaagtttctgagcaacatctgatcttagaaggcaaactccatttgttaatatgacagattgtaattctgcttcctaagtcttcatgatttcttccttctgtctagttcattgcttattttcattctttagtgtggaattgtatctgtgattctgcccaagttcaaccaacctgttctctcttatctttctctagacagaatgatgtctgtagctgtgtttgtgtaattcaggtggcttctcaaactagcctcttaatacccaaattattagtctttatatttagttgacagagttttcacataccttctcatttgacttctctactaaaaggtagttttagactgtcccattttataagtgaggaacctttgtatatcctgcccaagggtgccgtaagtatggcagagccagcacactaactcaattcctttgactccaggtccagctttcctccctatgttgtttagcacaacccagaaggagacagcagtgtctcctgagggatcccttcctttctctgtgatgcagtactgacagtaattattcactttggacactgctaccatcatggcaaatttaggccatttagataaaagggaattaactaattataataaaaggggatatattatgaaatgtataaagcactttgttccttttttctgtagtaattttgtgacctagtccttggttacagtagtgagggttcagaaacctgggagctttttgagtaaatacaaagcacaacataaaacttttatgtttgactctattcctgttcaaagctatttctgttaactaagcttatctgcgcattctagttgggaactattactacaatgttagactgctccatgtaaaactaataaatggcagtaaaaggtctcagaagcaccaagggttttgatcaggtcaggagttagaaacttaatgtcatttgtattcatttcttgaccaattgccaaagtttatatatttttaatttttctaacataccacattgtctgttgtattaataccagttcactttttgttttctgcagaaaaatccagaggaagacaactcagggagaacattgggttgggagccagggcacttgctgctcaccatctgcaccgtgcgcagtatggagcagctcctgccgttcttcaatgtgctcagtcaagtcttcaacagcaaagtcacaagccgatgtggaggacactcagggagtcctatcctctactcaaatgccttccctaataaggacatgaaactggagaaccacaaaccatgttccagcaaagccaggcaaaaaatagaagagatggtagaaaaagattttctggaagggatgataaaaacttgagcaccattgctggttccatttagcttacatgtaaatgtaattatttaaaacacacacactgctctgcgttgtatagtttttccttttttgtatgtaacagaacacatttcagattgtatttaatttaaatatttgtatataagagcaaatgtctgaatgtggcctgaatcaagtttaaatattgttggctcatactgattatggtgcctaagagagctatatatatacacatgtaaagtccattgtttttattgtcctgagttgtcttaaacctgcaaaatatacactacccattttttttttccattggtttcagacttggttcaattaagattggttggggatttttctcttttccttattaaccatgttctggtatcagaatggtgttccttctccatcagaggctgggaaacgtattataattagtttttctcccacataccttcaccaagagcagtgaagaataactgaaggctggaccatgcatccttaaaagtattgcatgagcatctccacctcagtatggaagagggatggacaaccccctattcatacctctgagttcctgatggcattagtcatataggtaagtcatctaataatctttcttaagactctgcaatggaaaaactggttgtataaagtcttctctgccctctccatttgtatcagcaatggggaatgctgcaaaacatcatcttgctcatgtgatggtgatggcaaagatatcacaaggagttggtaataagatttaattttccagtagcctgcatgaattgttccccacataaaactgtacagttagtgactgaattgtatacttaagtcccagtattttacattagtgagactgaaattagaggtaaatttctttaacaagtgtaaggcttacctatttataaagaattattctgttagtgtttaagaaaaacagatctagagacaatccagtaggctgcattgtaaacattatgattataaatctcttagtactgccattattattgacagttttgtaaagacttgtaaaaagtccagtttctcaggaatatgaaaattatcttcagaaacctggttggggcctttctccaattcctccagccagctgaaatactgccaagctcacttcatgtgcaaggtgatctgcactttcctgcaaattacattaaaagagattagatgagaaagacatagcatgtgtctaacatgggcaagaccatgttacttggaactctggggaagagaggggtgattcttgattttgtttcactaacaaattctaatgaaaaccttttttcatctttcagtaacaaattccaaagcccttaaataaacggaaaacagaccaaattcttctaaataaggtaagtttttaatcaattcagattataaaaatagctatcattccacaactgaaaaaattcaataaaactttaatccacaattggcctaacagtaagtaagtactaatgcctctgttgccatctcctcatccatcatggatattcattagactctgagatggcttaagcttctgcaggaaagctgccaaatgtctcctcctgattccctattcagcgcactcactgtactttgccctggctttgcacacactttaaggagtatgtgaagaggccaaataataaaaatccagaccacaagtcttgacccctgtcagggaaacaggcacagagtaaggctgtcatttaaaggaaatattttgaaaaacaaatcaagagtccagaatgctatcagttgacttagaaatgaactacaaagctggttgttttcatgtcacaagagtatatttttaaaagaagagaaaaggatcatctaccttatagtgcataaactaagtatttattagttattcctgccatggttaaaaatatgacactttcaggaagtctagaataagtcaaaaatatttggggaaataaactaagtgggtctaattttgttaaattgtataattactgctggtgaaaataattttgtagtcttaatgtgaacctaaaaggctcaacaaaataaagccttaatcatcatagtgagattctaaaaaccattaaaatagtttgcctgcccatcacctaatattaggctctttttcaatagaactatcccagcttacttgtgagtctgcttctgcatatactcggacgacatcttctgtaccagagggccggacaaaagctcgagaaagcttgtacttcttcaccaggtcattgattgcctcctgtaatcctgggggtgtaactgcttgtctttcagcatcggtagtgctaataactctcctgtctgcaacctaagtgcaagcatttcatatttgttactctattacacttcctttcagaagcttaacctgttaaacatacattctacgaaaagtgccagactaaatataaaattacattaaaacttctttctccaaggtcagggtaattaatttcaacatttgtgcaacttttctctttttcttcagtctataaagaattacctttggcaaaaaatatttccacaaatgcttagagttaccactaagataatggccagtaaatacgatatgactaagtcccatatcacacacaaaaacaggataagtggtagcccattatataagaagaccgataagaatttcttaaatatgccaaaaataatctgaacaatcagccatttctgtgaactgtggctttagtacctccaattgtctttcacaaattctgttggtgaatgtgtaaactggcataaacatgtacagaaatcaattagcaatttatctgaattctctccctcaggaagtactctgtgaactaaacataatgcagagtaagtactttcacttgaaatgacagggcatctgagttttgcttcaaaataatgttggggccaggtgcagtagctcacacctgtaatcctagcactttgggaggccaagggagaaggatcacctgagctcaggagttcaagaccagcctaggcaacatagtgagatctcgtctctaaataaaatatacaaaagagtattgggagggggtatgaagaatgtatagggcaataattgaaatctgttgaagctgggtacacaaaagttcattatgttgtttctctacatttatatctatttttaatttttttatatctatttttaattttccataataaaatctctttaaaaaagtgatgcgtcattcatattatttattatatcataaagttggaaaccaaatacttcacagacaatagaatgttaagtaaatgaacttagttattctataatttttttttcagctgtaagagaatacaattaggtatcataaggccttctttttttgttttgagacggagtctcgctctgtcgccaggccagagtgcaatggcataatctcggctcactgcaacctctgcctcccaggttcaagtgattctcctgcctcagcctcccaagtagctgggactacaggtgtgtgccaccacgcccagctaatttttgtatttttagtagacagggttttaccatgttggccaggctggtctcaatcccttgacctcatgatccgcccgctttggcctcccaaagtgctgggattaaaggcatgagccacgagctactgcgcttggcccataaggccttattttctatgtatcatatgtgtatgtacagaatgaaataggaaacatatgtcagtgagatataatgagaattgggataataggttttacttagctaatattcaaaaaagttactttaaagtttctctcacacctgaactttaagttgtctgtttggaagatctgtatagagagcatcccactgttgtacagtcaagcccttcagagccaagattgcttcaatcaccagcatgtcagaaatagcatcaccagctgcctgcaaatggggaaacaaatggaagaaaccacttaacacaagcaaatcttggaaatggatgttttttcttagaaaaccaatcacagtacaggttgaacaacctgaatctgaaacatgctgagtgccaaaataatcacaagtgaaaaattccacacctggcctcctgtgacaggtcaaaatgtgggtatacaactgccaggtgtggtggcatacacctacagtcccagctactcaggagaggctgagatgggatgattacttgaagctaggagtttgaggctgcagtgtgctgtgataatgcctgtgaacagccaatgcactccagcctgggcaacatagcaagaccttgtctcttaataaaaaacaaatgcactcctgacctcactgtcaggaatttgaaaccagcctggccaacatggtaaaacgccatctatactaaaaatacaaaaattagctaggtgtggtagtgggcgcctgtaatcccatctactcgggaggctgaggcaggagaattgcttgagcccgggaggcagaggttgcagtgagccaagattgcgccactgcactccagcgtgggcaacagagcgagactccatctcaaaacaaaacaacaacaacaacaaaaaaaacccactaaaggcaggcccgcagttcattcagcatccccaagggaaaaagaccctctcagcctccttcagctatgatacatcgtttccatgcatgccagatatgtatcatattttttactattaaaatacttgtgtgtgaataagtgtaaaaaaatgattgattgcttattgattgatagcatataaattcagagttttaggaatgatggtgatgccagacaaccacagattgtccaacgggtggctgacagagtgacacctttgctttctgatggttcagtagacacaaactttgtttcatgcactaaatttacagtattctataaaaccacctttaatcttatgtaacatacatgaaacaaaagaatttagtgtttccgacttgagtgccatacccaagatgtcacattatatatatgcaaatatcccaaaatccagtgaatctggaacccaaaacacttctagtcccatgcattttggataagggatactcagcctatatcatgtgctttctcacatgcagcatgattaaatgaagtgtttttgtggatggataaaatacgaacaatgaggtgaagatctctgtggaagacaatgaaaggtataacaaagaatactgaaactagctcttgagaaacttgcctttagtactccttatttataaaatgaaattagactggataactctaaggctcagcctaacattccatcactcatttttctttttataaatagatcccttttgagatattaccccacaatgattgatagaaagcatcaaggtaaaatggagaaatatgagctttggtataagatataactgaagataaatctctgtttcttcacttataaaatggaaattacagtaacacctctccctgtgttactgtaaggattacacagcaaggtatataaagtgtccagtgtgtgcaagacactcaaataattgaatcgctttcctctaccctgagtactgcttttccatagccaaacgacactccaaccccaactaacccacatgtatgtcctttgtcaatgagacaaccagttatttgtgtttgtttttgagacagagtctcgctctgtcacccaggctggagtgcagtggcgtgatcttggctcactgcaagctctgcctcccgggttcacaccatgctcctgcctcagcctcccgagtagctgggactacaggtgcccgccaccatgcccggctaattttttgtatttttagtagagacgaggtttcaccctgttagccaggagggtctcgatctcctgacctcgtgatccgccctccttggcctcccaaagggctgggattacaggcatgagccaccgtgcctggcctgacaaccagttatttttacttaatttcatcgaggtttggttaaaaaaaaattaataatatatatgtatacactgagtagctgaatctgtgatcctaggtagaagctacccaatatacttgaaaatttccatcataagaggtaggggaagggaagcatattaaaaaatgttctgtcattccatttcattataaatctcaactgaatataccactattagaaggaagccaccaggccaggacgtctccactttaattttgtatgcacccacactctgttctgtccatcttctgaataatgtaaaggtaaccaagagtccactgccccatcagttctgacctggttaaacaagtcaataatgttttcaagcatcttagcagcttttcttttcttatcttccagttgttctgctgattgttttatcttcatttcaacagctgtactaaacagtgcctgcagcaaaagaatataaaatcagtctcaaaacactatccaaaacctagtcataagtactattattctagctaacccacttttccctcctagtcaatctggagaaactgaggggaaaaatagtggcagccttaaaatgtatgaaattaatgtaagatcacattaaaacccagaggatagtactaggggaaaaattttatttgcggattatataactggttataaaaatttaaacatctgattacaaagaaaacaccaccttgacaagaggcaagcacacacagtaagttcatgttttccctttaaccagctaaatcatttctgtgcaaccaggttacttagagcctgtctgtatcctttttactttgaaggatataattcattgcagctagtatagttttattctaaaacttaaggggatgagctaggcaaaattaagagttcatagtattcatcaaaatatggcaaataatgtcatggatagtcattacaatatataattcatcatgctcctcaagagtcttatctcatttggaaatactcatcttttttactgccttctagaggcctaatactgagcaagattagcatactatgctcaactacttgatgaaatacatttttcttgataaaataaggcacaggctagtcacctgtttttgtaaagttttactggaacacaaccacacagattcatttaagctagatcagcagagttaaacaactgtaagagaccttatggcctgaaaatccaaaaatatttactctctaccctttagaaaataatttaccaacttctccattcgatcactaaagttatatcttaattgcattttgtaggaacttatttttcccctttttatatttatgccctccaaaagccaattttaaattaatgaggaaaattatttggctttgattcaaatgttctgatagccacctcaagtgtattcattaaatgaggtgagtataaaaacattttaaaaatattctgaacattatgaatctacaaaaaactaaattatacactttaaaatgtaattttatgtaaaatgtaaattgaaacattttatgcctatcactagttaccttaaattcattttcatttcttattaattatcaactttccaacactttgcaattcaccatagcgactgaatttttcttttcctctcctatggccagccggaaaatgcatagacaacatacttataaaaaaattaagaactgtaaattttaaaaaactattcaaaacaccttagtatatctcttcacattcaaagaagaatcattaccatgtaaaagagaatcacagtttcataatacatcaatatataagataaccaaaggatctttttgtcacatccaattatttcaacaaagtacaatattacctattattacctcccagatatagaagtctcatcataaagaaaagtgccagctaaggccaactataattaagagaacttacagtgccatgcccatttgcttcaaaataaactccaatgtcaaactcttgagccttgtggtgcaaatgttttacaccagtcttagtgcaatagacaggtacctataacacatgcatttaaagaaatacagcaattactcagatgtcaaatgtttcttgcatacctagtatcccagagatacaaaggggaacaaaatactggggccgagtccagtgaggaagacgattaagcattaaaatacaaaatggtacgtatacaatggaagcatgaacacactctggaagcacgcagccaagggtaaagcacggtgagagagatgagggtctccttataagacacgaaagattacaagtgggggcgtgacatgacctaactgttttagaaagctgtttagctacagtgtggagaatagcttagagcagaattgcaagctttttctgtaacaggccagacagtaaatattttaggctttgcaggccatatggtctctgtcacaattactctgccattacagtgcaaaagcagccacagaccatacataaacaaatcaacatagctctattccaataaaactttgtttgcaaatagcagcaagttcaattagaaggttaagaaatggaatgaggaggcttctaggactaatcccagtaagaaatagtggctggatcagcaatagtgaatagggaaagtcatggatggatggatctgagagagctttaagaatggttaaggaaagattgatagtagaaaaactgcaaaagaaagatcagcattagattggatgtaggagacctcaggaatggcaagggctaaaaatatttcatctggaagacagtgagttgagaagtaacagtttcttaaactaggttattttatctgtaataaatttttaagacagaaaatgaaaatcctaaaacaataacccaagtactgtgaaataacccaatccctgtgaaaggcaggcaaatgggccccagatggaatcccttgaatgagcttattataaccatatattaaaatcaggtcataaactagcagcctcaagatatatttcgttttgcccagccactgtttctttttaaacaaataggaacatcacatgaaaattcagatttcctgcttctcttgaagagtgtgactacagttgacatcagctggcacatactgacctgtttttagccccctgctgccctcattcactttacctgtccaaatcctgcaggaatctgactttgtaattcctgctttctagagaatggaaaggtaactaaaactagtataaatgccagaacgaggtacaaaatgaggtacaaaaaagttggaaaacttctcgataatgagaaagtataggcaaacagacttccagttttgtccatgaaccctggtaactctccgagcaagtagtgtggtgccaagggtggtcacctggtggacaccggggaaataattagaaacagaatctcccaccaccccagaaaacctctccaaaaaaaaaagaagggtaagaaacagttttattactgaataagtattaagccaaactgatgttcaatcacaggctaatttgctaagagatagcaaagataaacgctcaccctttaatatagccaagcggacacattccaatacaatttgctaagataaaagatggctaatgacaaaaattctctccttgaccaaactttagttaggtttaggtgggcctgactaggccttgtccttaggcatgtcttccaatagcccgattttaataagagtcatgctaagtgagcttagcgagaatccctcatcctgatacatgaccactcttgacatctgatctgagttctcattctctaccatcccccaggtaatatgtgaccgccctggcctaccttcagcaaaagtcctgttagatcagtttagccaaaataccacccacttaccctcatgtttcctctcagtaatttttcatccactgaccaccccccacacaccctgctccttggctataaagccctacttttccttactatatttggagttgagcccaatctttctcctaccactgcaaaactccatcacattagtccctgtacctatcacaacagtcctgaatcaagtctgccttaccattttaacaagtgtcatgaattattttttctttaacactagtcctcaaataggaaaacttgaaaccaccatttgtcacacacatagtttatcctaaacttacttggtaatagggatggccacctgtgttaactgcccttctctaaaggagtaataaaacttttcatacctctgtgacaggtagatagttacaaattggacgcaaacacctaagttaaactctcctgagactgggagataggtgagctatcttccttgatgtttatatttgaaattggtgactctaggcccttaaagaaaagtattcctgagctataaaactggcttattaggcctttagaaagacttacattcattacaaaggcacagagaaagaattccaagttttctaaaggaaaactccaagaaaaggaaggaaagaagttttcctttattcatcaaggacaactaaattttttcttatttatttctctttacctttacatgaacagcagctcagcttcatgcactacaacataatcacttttatgagggcagtatctttctcacagaaacatgatcttaattaagaaactaccagaaaacaaaaatggttcaataccttcataacttcttcaagataccgtgttgaacttccatttgcatatgcagtttgtacaacaccaatattcaaactttctccaatctagacaaaaacaatgatacttaacttgccatcaaaagtatggtctacaaaaacaaatataatgagagttctaaaggctaccaaaattatcagccagttcagttgtgccttagtttatgccaaaaatgtctgactgaaaatttacatgtatgccaggaaaaaagcctaaaatacatttgaacactatttaaaacaattctatgagaattcctcttttaagaagcctgtatctcctgatcttcacctctttaattttttaaataaaagtatctggccaggcacggtggctcacgcctgtaatcccagcactctgggaggccaaggtgggtggatcacctgaggtcaaaagttcgagaccagcctggccaacatggtgaaaccccatctctactaaaagtacaaaaattagccaggtgtggtggcatgcatctgtaatcccagctacttgggaggctgaggcagaagaattgcttgagcccagggaggcagaggttgcaatgagccgagatcacgcccctgcactccagcctgggcaacagagcaacactgtctcaaaaaaaaaaaaaaaaaaaatctattaaattcttaaagtatgctgtttccagattataataatttccaattacattgtgtacttaaagctagcctgagatttatttctaaaatagcaaaatgaaacaaatctcacattactaagcttatcataatcagttaatatatcagatgatgagatttcctattagaatttagggcttttatggagtgaccacagaactgtcatcaaagtttcaattatgatggaagcaaaacttcctaaagcttcaaatcacaaaactcagccagtataaggaggaaaagagtaccttcaggttccaaagccaatgcctcaaatgttcaaatgactgggtattaccactgctctttttttaattttctgcccactaatgtaaagaatttgtcataaattgtgcccttctgacaaatgattgtaaaatatggaactatttcactactaagtcttgttttagagggtagccaatccccccaccatacctccaccaggagctctttaaggaaactgctaattaacgttgctatcttgtctccatctatgagatgaaagtggccatctgcatcatggtagtaataaacaattctgtctgcatctccatcaaaagaacagcatctttcattggacttaatttccattcctagcacacaggataatttaacatgcatttcagtctaagaatttattataaagagttttagaattttctcttaaaattatccacctaaaaatcaatgtcttaatcttaaatagtgtataatctttaaatagtacatagtttattagtggtttttacaggtcaaattctttcactgcaaagtgaaaaaaggagcattcaaaatctatgctgatatttgctataatactaccataaaattccactttataagcaggttggtttggctagacaggtgtcccataaaggttttttgaaagctacatgtatttctgaatgtaatttacctaggaccgtgatctcctttacatagaaaaaataatcagcactagatgatgtatgtgctttaattctaacagaaatgatttttatttgttcataccaccaataaaaagaaacactgataattaagagcaaagaattataactttgagagataactggcctgtgaaatttacataaagttgctgaaatctcagcaattgtcacatcaaatttattagaaaatttggctattccttagccatgacagcagcagagtgacaaattcaacatgagacaactaagaagtaaaaggcttttgtcaggaatgggatcataagattgatgaaaggacatgatgcaagcttcaggaaagcaaggactatggttttgttcatactgtagtcccaaagcctagagcatagagagtaagagctcagtatttaagaaatggataaataagtggcagaactgaactgtcaagtaaatgtcaaaacaagcaattcaatgaaaaggagctcaaattggttgactacactgacattttaaatgcttactaagtaaagcataataacatgaatgaatgaggcaactggatgaagtctgtagagttccagaatgcatgtcctattttaggggagcagcatctatctgactgtagtggactaatgccatgtgtgaacattttctgattttggtaaagagatgctagagattccaatatataagagaagtcacggaatttttaaacagtggcacacagacaaacacacaaatgcagccagccaaacaaaacatatctgcaagtcaggtttggcctaagcaaataatttagggtctataatgcagataaatccagaacacctcttactacaactaaaatctgaagaaaagtcttcctcctattctgcactgagtggaaaacactgattgctaacaactgtataagcagagttacatttgctttccatagtgtatttaattcagataaggtatctaataatacttactatgctcccctgtagatctgtgattctcaaaaagggatccccagacaagcactgggaacaaagcctgcaaacttgatagaaatgcaaatttctatcatatgcaaatcctatgccagacctccagaaactcagaagtggagcccaggaatctgtgtgctaacaagccctcaaagtgattctgacacatgccagtttgagaaccactgctctagaatgccatttcctgactttgctttccccacctgatttcctgtagactatgaggaatggtgtgatttacaggcagagagagcagaccatgtttcaatggctctgagagtgggaagacttctcaatgtctaaatgtggcagagccaggaatagctgcaagattcttaactcactttaccaccttagtttataagtgagattggcttcaaagagcattaaaaacaaatttttgcagtgctagtacgacataccctgtggaggtttctgatgacttttcacaaagtcagctccacataaatgattgagtttgcccttggacccatcattaaacagctgaactgacaggccctgtgagaagtagtgttccatttcccttagcttcagggcccctatgccatttgcacagtcaaccttaagtgatctgtattcatctccactgcaagaagcct

SEQ ID NO: 11923 - DNA, 2459 bp, Homo sapiens
attatccattactgtttgttggatccaactacacagtatcaccaagtaagactgcacaaatatttgacttcttttgaaagactgtgaggtctaataaatttccatttgtaaatctcagtaagtaatatgtttcttttcccccaactgttaatagcttttggtcagtgtagaccagaaacacttgtttgaagcacgcagtggaatcctctcaatccttcatatgatcatgtcctctgtgacactgctttggagcatactgcatcaagctgattcttcaaaaaagatgactattgccgcatccgcatctcttaccactattaatcttggagctacaaaggttagacaattcatatttaatctgtagagctcaagagtctgaggaccttcccaaagattatattcagaatatgtgaataatttgtgtagtatttacaggactctgctaattatcaaataatttttaacagttttcctgggctatggctgacgtatcatagaatttgcccatttttaagtatacaattcagtaatttttttagtaaatttacagagttgtgaactatcaccccagtccaatttttgaatatgttctttaccacagattcctcatggccatttgcactcactccctgttcccatccctaatcccaatcaaccacgaatctattctctccatatattgatttgctttttctgaaaaagttcatataaatggaatgataacaatatttggtcttttgtgtctagcttctttcacgtgacatatttttaaggttcattcatacatgttataactttattccttttttttttagggcattttaaattgacattttaatatgcaaagccctcctagaaaacaatttagcaatatgtatagagagctttaaaggtttcatagtctttgacctagtaatctactttaggaatgaattctaaggtaattgaaattatacaaagatgtatatacaaagtgttcattatagtattatttaatggcagaaaaaacagagatcctaaacaattaattagggaatgtttaaattatcctttcaatgtttcattacatagccactaatattcatggttttgaagaattcttattggatggagaagggctcaaaagctcagtgaaacagggatgttacataattgaacaaataccatattttcaattatgtaaaaaatgttatctgcagaaaaaggaataaagaaagtttgcattttatcagtaattatctcaggatggtgggataacttattgatttttaaattttttttcttccttgcactctgatattttccaaatgctgtgccatgtcaagctgtcaaattgatatccttcaataacctaattttgctcctagaccagaccacctggatcagggatccaagggaacacatagggaagtgggaaaagggtaagggtgggaaccattagaacatttgatctaagttttgatgcttggattaaactatactttttatgtttcgttttacttaaataaaacagaaggtgttttataattatagaatccctcacctttttttaaaggactctatatcagacttactaagttgaattttatatgtgttgtgtttttctagtatcttttcacagtgaatagacttttatttggctgattggtagccgtcattttataggatttgtttttcttttagaattatagtcatattgtagctcttaacgttattaaagtttcctctagtgttatttagatagtaaaacctataagtactatattatttcaaagaaaccaaaaacgcagtctagttgtaaatgttttttcattttttaaaagtttcactttcatttgcttcaaattgttttagaacttgagacaacagattcttgaattgttgggccccatttcaatgaatcatggtgttcactttatggctgccattgcatttgtgtggaatgaaagaagacagaataaaacaaccaccaggaccaaggtatgtatttagacatttggcactttttgtttttgcatttggtgagtacatgctaatttccacttctccatatattgcagtggggccggggtagattcgagtgtaaagcaaaagtctgtcgacagctttagataaattgttgccttaatttctttaagtattgattaaaatttgaggtcaaggctaggcacggtggctcacacctgtaatcccagcactttgggaggccgaggagggcggatcatgaggtcaggagatccagaccagcctggccaacatagtgaaaccccgtctctactaaaaatacaaaaattagccaggcatggtggcacacgcctgtagtcccaggtactcgggaggctgaggcaagagaatcgcttgaacctgggaggcggaggttgtggtgagccaagatcatgccactgtactccagcctgggcaacagagcaagactcttcctcaaaaaataaataaataaa

SEQ ID NO: 11924 - DNA, 507 bp, Homo sapiens
ttttttttttttgagacggagtttcaccgtatcgctcaggctggagtgcaatggcgcaatctcagctcactacaacctccacctcccagcctcaagtgattctcctgccaagtagctgagattacaggcacccaccaccacgcccggctaatttttgtatttttagtagagacagggtttcatcatgttggccagactggtctcaaactcctgacctcaaatgatccacccacctcatactcccaaaatgctgggattacaggcatgagccaccacacccggcctgtcatgaatcaatttaaagtgaacccagccagtgccccaggtacccagcagaagccagactaaactttaccaaaggactatactttcattgtaaacctcaaaaacgtcccataattttcaaaaacaaaaagaaagaaaaccagcttacagttaaacatagctaacatataagaaaagcaccatgagcaaaaaacaaagaaaaatggatcgcaaagatggacc

SEQ ID NO: 11925 - DNA, 456 bp, Homo sapiens
gtaatagaaagctcagcgaagggtttccctagttttatttctgatatgttatctaagtgcaaagttcagaaagtgattcttcattgtttgctgtcatctatctttagtgctcagaaatggcatagtgaaaaaatggcaggtaagaacctggttgctgtggaagaaggtttctcagaggacagccttattaatttctcagaggatgaatttgacaatggcagcacgttgcagtcacaacttcttaaggtgcttcagaggctgattgttctagaacacagagtaatgactattcctgaagagaatgaaacaggttttgattttgttgtatctgacttagaacacatcagtccccatcaacccatgacttctcttcagtatttgcatgctcagccaatcacatgtcaaggcatgttcctctgtgcagtgatacgagctttgcatcagcactgtgcatgt

SEQ ID NO: 11926 - DNA, 456 bp, Homo sapiens; identical to SEQ ID NO: 11925

SEQ ID NO: 11927 - DNA, 1804 bp, Homo sapiens
cagaaatcctgcttttattatgttatatttatttgttcagtaagctttagtgtttagaattgtgttgcacagttcaaagttttatctctatattaactccaagaactacgggattgtgtaaaaagactgaaatgatgactgactatggggactttttcgttgatgctgttgttgctgccttctgttgtttgtttttcttttaaagtcaggcccctcttctgtagggctgctgtggtttgctcggggtccacttcagaccctattcacttgggcccctcccatacctggaggtgtcatcagtggaggctgcagaacagcaaagatggctgcctgctccttcctccgggatctccgtcgcagagggaaaccgacctgatgctagcaggaatgctcctgtaaaaggtatctggtgacccctgttggagagtctcacccagtcaggaggcataagatgcaggacctcttaacaaagcactctggctgccccttggtagaggaagtgcactgtgctgggggcactcccatacatctggactgcctagattcctcagagccaccaggaaggactaagtctgttgatccatggagaccacagccgtccctcccccaaagggcttaaccccagagagaccagagctctgtccctacactcctgcctgaagttgctgaaattcctgcagggaggccccatccagtgaggaaggatcagtcagggtccagcctaaagaggcagtctagacaggatctgccacagatcaagtggacctgatagatatcaatagaactctccacccacaaataacaggatatacattcttagcagagcatggcacttacattaaaattcatcacataattagaagtaacacactctttagcaaatgcagaatagctgaaatcataacaaacaatatctcatacaacagtgaactcatattcaaactcaagattaagaaattcactcaaaaccatacaactaaatggaaattgaacaacctgctcctgaatgacttttggataaatcatgaaatcaaggcagaaatcaagaagttctttaaaactaatgagaacaaagagaaaacataccagattctctgggacatagctgaagcagtgtcaagagggaaatttatagcactaaaggcccacatcaaaaagctagaaagatgtcaaattgacatcctaacatcacaactaagagaaatagaaaactaagagcaaacaaaccccaaagctaacataaaacaagaaataaccaagatcagagaggaactggagggagagacatgaaaaacacttcaaaaataaatccaggatttattattatttatttaaaaatgtagaccacctgctgaaataataaagaaaagagaagaatcaaatagacacaagaaaaatgataaaaaagatactgtcactgaccccacagaaatacaaacaaccatcagagaatactataaacacctctatgcaaataaactagaaaatctagaagaaatggataaattcctggacacataccccctcgcaagactgaaccaggaagaagttgaattcttgaacagaccaataacaagttctgaaattgaggcagtcataaatagcctctcaaggaaaaaaaccccagggccagacagatttatagctgaattctaccagaggtacaaagaggagctgataccatttcttctgaaactattccaaacaattgaaaaggagggacttcaccctaactcattttatgaggccagcatcactgtgataccaaaacttgccagagatttaaaaaaaaaaaaaagaaaag

SEQ ID NO: 11928 - DNA, 1804 bp, Homo sapiens
cagaaatcctgcttttattatgttatatttatttgttcagtaagctttagtgtttagaattgtgttgcacagttcaaagttttatctctatattaactccaagaactacgggattgtgtaaaaagactgaaatgatgactgactatggggactttttcgttgatgctgttgttgctgccttctgttgtttgtttttcttttaaagtcaggcccctcttctgtagggctgctgtggtttgctcggggtccacttcagaccctattcacttgggcccctcccatacctggaggtgtcatcagtggaggctgcagaacagcaaagatggctgcctgctccttcctccgggatctccgtcgcagagggaaaccgacctgatgctagcaggaatgctcctgtaaaaggtatctggtgacccctgttggagagtctcacccagtcaggaggcataagatgcaggacctcttaacaaagcactctggctgccccttggtagaggaagtgcactgtgctgggggcactcccatacatctggactgcctagattcctcagagccaccaggaaggactaagtctgttgatccatggagaccacagccgtccctcccccaaagggcttaaccccagagagaccagagctctgtccctacactcctgcctgaagttgctgaaattcctgcagggaggccccatccagtgaggaaggatcagtcagggtccagcctaaagaggcagtctagacaggatctgccacagatcaagtggacctgatagatatcaatagaactctccacccacaaataacaggatatacattcttagcagagcatggcacttacattaaaattcatcacataattagaagtaacacactctttagcaaatgcagaatagctgaaatcataacaaacaatatctcatacaacagtgaactcatattcaaactcaagattaagaaattcactcaaaaccatacaactaaatggaaattgaacaacctgctcctgaatgacttttggataaatcatgaaatcaaggcagaaatcaagaagttctttaaaactaatgagaacaaagagaaaacataccagattctctgggacatagctgaagcagtgtcaagagggaaatttatagcactaaaggcccacatcaaaaagctagaaagatgtcaaattgacatcctaacatcacaactaagagaaatagaaaactaagagcaaacaaaccccaaagctaacataaaacaagaaataaccaagatcagagaggaactggagggagagacatgaaaaacacttcaaaaataaatccaggatttattattatttatttaaaaatgtagaccacctgctgaaataataaagaaaagagaagaatcaaatagacacaagaaaaatgataaaaaagatactgtcactgaccccacagaaatacaaacaaccatcagagaatactataaacacctctatgcaaataaactagaaaatctagaagaaatggataaattcctggacacataccccctcgcaagactgaaccaggaagaagttgaattcttgaacagaccaataacaagttctgaaattgaggcagtcataaatagcctctcaaggaaaaaaaccccagggccagacggatttatagctgaattctaccagaggtacaaagaggagctgatagcatttcttctgaaactattccaaacaattgaaaaggagggacttcaccctaactcattttatgaggccagcatcactgtgataccaaaacttgccagagatttaaaaaaaaaaaaaagaaaag

SEQ ID NO: 11929 - DNA, 1804 bp, Homo sapiens; identical to SEQ ID NO: 11928

SEQ ID NO: 11930 - DNA, 1931 bp, Homo sapiens
agatgacatcttccatgtgttatggtaatttattgctgaaagaattaagcacatcctgggtgactccatggggagaagactcttagaaatttgtttggtttcctccaaactttgcccatgcgcaactttcagctttgcttattttgctttgtgttttttcgctgcaataaattttagttatgaagcagactgcatgctgagtcccatgagtcctcctagcaaatcactgaacctaggggtggtcttgggggacactgacacagggagttgattgtttggcaacacaagttgtttcagagcaaatgaattctttttccacaagctagcatattagtaaactatcagggagcataaaatcagttgactgagttctgtcgggaaacaaagggaaaatttttcttcaaaaagacatgatatcctccctgttaagcaaagcagtactttccctgtggataagtgtattcagttggaatgtgcttggctgcaagaaactgaaaactattatattacaatgctttaaagaggctagtgacttgtttctgagggaaagatatctaggagtggtacagtcactcagtgatgattttttctttttgctccaccatccttagtgtatagtttttgtcttcatggtcacaaggcagctgctacagtgccatgtattgtttgatgtccaagtgatcaggaataggagaatgtgaagggcaaaacccaactctgccctctctagggacttcaatttctatataattgactagcactgtcccacaggagctgaaaattcaactacttcacttttcaatactggaaatgagtggtaagaaacttggactagatgatcgatggtccacataaattatctgtcacaattcttctgacactaatagaacagcaatacaagattgtcgttgattccctatgtgaagatcctgtatgtggataccttgattgtaaggctgagagattaaagaccatagtaacttttgttaagtggtctccttgtcactcacatacctttgctcctgagttcttccataggtgccactgaacagcttccttgaggtaaactcttctgaacttgtaacctacattaactgggatattaataatctcttttaatcttaatgctcttatgaaatgacataaaaagaagaaatgcattgcactgttgtatgagcagataagacaaaatactaattctctccttttccccccatcctatcttgttttctttctcagaagctgtagatgaaaccaaacctaaggaaagtgcccggcaggacgagggtaaagaagaggaacctgaggctgaccaagaacatgcctgaactctaagaaatggctttccacatccccaccctcccctctcctgagcctgtctctccctaccctcttctcagctccactctgaagtcccttcctgtcctgctcacgtctgtgagtctgtcctttcccacccactagccctctttctctctgtgtggcaaacatttaaaaaaaaaaaaaaaaagcaggaaagatcccaagtcaaacagtgtggcttaaacattttttgtttcttggtgttgttatggcaagtttttggtaatgatgattcaatcattttgggaaattcttgcactgtatccaagttatttgatctggtgcgtgtggccctgtgggagtccactttcctctctctctctctctctgttccaagtgtgtgtgcaatgttccgttcatctgaggagtccaaaatatcgagtgaattcaaaatcatttttgttttcctccttttcaatgtgatggaatgaacaaaaaggaaaaaattcaaaaaacccagtttgttttaaaaataaataaataaagcaaatgtgccaattagcgtaaacttgcggctctaaggctcctttttcaacccgaatattaataaatcatgagagtaatcaagg

SEQ ID NO: 11931 - DNA, 1752 bp, Homo sapiens
agatgacatcttccatgtgttatggtaatttattgctgaaagaattaagcacatcctgggtgactccatggggagaagactcttagaaatttgtttggtttcctccaaactttgcccatgcgcaactttcagctttgcttattttgctttgtgttttttcgctgcaataaattttagttatgaagcagactgcatgctgagtcccatgagtcctcctagcaaatcactgaacctaggggtggtcttgggggacactgacacagggagttgattgtttggcaacacaagttgtttcagagcaaatgaattctttttccacaagctagcatattagtaaactatcagggagcataaaatcagttgactgagttctgtcgggaaacaaagggaaaatttttcttcaaaaagacatgatatcctccctgttaagcaaagcagtactttccctatggataagtgtattcagttggaatgtgcttggctgcaagaaactgaaaactattatattacaatgctttaaagaggctagtgacttgtttctgagggaaagatatctaggagtggtacagtcactcagtgatgattttttctttttgctccaccatccttagtgtatagtttttgtcttcatggtcacaaggcagctgctacagtgccatgtattgtttgatgtccaagtgatcaggaataggagaatgtgaagggcaaaacccaactctgccctctctagggacttcaatttctatataattgactagcactgtcccacaggagctgaaaattcaactacttcacttttcaatactggaaatgagtggtaagaaacttggactagatgatcgatggtccacataaattatctgtcacaattcttctgacactaatagaacagcaatacaagattgtcgttgattccctatgtgaagatcctgtatgtggataccttgattgtaaggctgagagattaaagaccatagtaacttttgttaagtggtctccttgtcactcacatacctttgctcctgagttcttccataggtgccactgaacagcttccttgaggtaaactcttctgaacttgtaacctacattaactgggatattaataatctcttttaatcttaatgctcttatgaaatgacataaaaagaagaaatgcattgcactgttgtatgagcagataagacaaaatactaattctctccttttccccccatcctatcttgttttctttctcagaagctgtagatgaaaccaaacctaaggaaagtgcccggcaggacgagggtaaagaagaggaacctgaggctgaccaagaacatgcctgaactctaagaaatggctttccacatccccaccctcccctctcctgagcctgtctctccctaccctcttctcagctccactctgaagtcccttcctgtcctgctcacgtctgtgagtctgtcctttcccacccactagccctctttctctctgtgtggcaaacatttaaaaaaaaaaaaaaaaaagcaggaaagatcccaagtcaaacagtgtggcttaaacattttttgtttcttggtgttgttatggcaagtttttggtaatgatgattcaatcattttgggaaattcttgcactgtatccaagttatttgatctggtgcgtgtggccctgtgggagtccactttcctctctctctctctctctgttccaagtgtgtgtgcaatgttccgttcatctgaggagtccaaaatattgagtgaattc

SEQ ID NO: 11932 - DNA, 640 bp, Homo sapiens
aaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggc

SEQ ID NO: 11933 - DNA, 606 bp, Homo sapiens
gttatatttttgttaratcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaarccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaagkaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggc

SEQ ID NO: 11934 - DNA, 628 bp, Homo sapiens
aagcgtaatatttgtaaaattcgcgttaaattttgtaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggc

SEQ ID NO: 11935 - DNA, 640 bp, Homo sapiens; identical to SEQ ID NO: 11932

SEQ ID NO: 11936 - DNA, 513 bp, Homo sapiens
gagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggc

SEQ ID NO: 11937 - DNA, 612 bp, Homo sapiens
ttcgcgttaaatttttgttacaatcagctcattgtttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggc

SEQ ID NO: 11938 - DNA, 462 bp, Homo sapiens
caacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgmtattacgccagctggcgaaagggggatgtgctgcaaggcgattaagttgggtaacgccagggttttcccagtcacgacgttgtaaaacgacggccagtgaattgtaatacgactcactatagggc

SEQ ID NO: 11939 - DNA, 640 bp, Homo sapiens; identical to SEQ ID NO: 11932

SEQ ID NO: 11940 - DNA, 640 bp, Homo sapiens; identical to SEQ ID NO: 11932

SEQ ID NO: 11941 - DNA, 654 bp, Homo sapiens
aataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggc

SEQ ID NO: 11942 - DNA, 414 bp, Homo sapiens
tgaaccatcaccctaatcaagttttttggggtggaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgggtaaccaccaccaccgccgcgcttaatgcgccgctacagggcgcgtccattcgccattcaggctgcgcaactgttgggaagggcgatcggtgcgggcctyttcgctattacgccagctggcgaaagggggatgtgctgcaaggcgattaagttgggtaacgccagggttttcccagtcacgacgttgtaaaacgacggccagtgaattgtaatacgactcactatagggc

SEQ ID NO: 11943 - DNA, 647 bp, Homo sapiens
  misc_feature (29)..(29): n equals a,t,g, or c
cgcatcaggaaatgtaagcgttaatattntgtaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggc

SEQ ID NO: 11944 - DNA, 640 bp, Homo sapiens
aaattgtaagcgttaatattttgttaaaattcgcgttaaatttttgttaaatcagctcattttttaaccaataggccgaaatcggcaaaatccsttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaagsaagggaagaaagcgaaaggagcgggcgctagggcgctggcaagtgtagcggtcacgctgcgcgtaaccaccacacccgccgcgcttaatgcgccgytacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggc

SEQ ID NO: 11945 - DNA, 640 bp, Homo sapiens
aaattgtaagcgttaatattttgttaagattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggc

SEQ ID NO: 11946 - DNA, 571 bp, Homo sapiens
aataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggc

SEQ ID NO: 11947 - DNA, 640 bp, Homo sapiens; identical to SEQ ID NO: 11932

SEQ ID NO: 11948 - DNA, 639 bp, Homo sapiens
  misc_feature (88)..(88): n equals a,t,g, or c
aattgtaagcgttaatattttgttaaaattcgcgttaaatttttgttaaatcagctcattttttaaccaataggccgaaatcggcaanatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggc

SEQ ID NO: 11949 - DNA, 648 bp, Homo sapiens
gcatcaggmaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggc

SEQ ID NO: 11950 - DNA, 434 bp, Homo sapiens
gggcgatggccccactaccgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggc

SEQ ID NO: 11951 - DNA, 624 bp, Homo sapiens
tattttgttaaaattcgcgttaaatttttgttaaaccagctcattttttaaccaataggcggaaatcggcaaaatcccttataaatcaaaagaatagaccgagatagggttkagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggc

SEQ ID NO: 11952 - DNA, 509 bp, Homo sapiens
gttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggc

SEQ ID NO: 11953 - DNA, 654 bp, Homo sapiens
aaatacgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggc

SEQ ID NO: 11954 - DNA, 546 bp, Homo sapiens
  misc_feature (20)..(20): n equals a,t,g, or c
ttataaatcaaaagaatagnccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggc

SEQ ID NO: 11955 - DNA, 2602 bp, Homo sapiens
ccttggttggtccctttgataggtttccagcgctctctgctgggtggctttccatctgtgtctcacagacaaaggagagtctgatgtatccacccatctagtgtaagacagagatagcaaaggcggaacaaatggagtccatgccccgaggctgtgccctcaagctggcctagggtcagagaagggaggagatggtagcagcagaaccacagcacaccactgagcactggaaagagcaagagctgaaatcttaggttattggatatgcctagagtcagaaaagccttgggaaatttttggtgatcgatttttcctgtgaagggggaagctgctgatggagacttgtatctgcagtacttcaggttcccagctggctccccatccccaccctataacatgaccggcgtacagaaattaattggccgactgttaccaccactagtctgtccctggctagactagacagatgggtgtgcccctgggctcagtggtagcctacccggggtgatggtggggttgccagctgtagtccagctgttctggggcctgtgtttgtgcacctgtggtgctgtatcctgccccacagagctggctgtccagtggagaatacaaagtgacatctggtgctccctcagaaagaatgtggccccagaggcatgccagtggctttagactctctgggaggacatgtttgagagcaacagccccttccccatcttttcctttcttctcagcagttataaatctctctgcctgcagtaagtagagtgagtggctggtgaggaggtttgttgatgacactgacaatatctggtgactccctccagatgtgcactcagcagtgagctgggcagaggcgtgggaaggacgttggctgggagcagacggcctctgcaaatgaatctctagtttcctgcaacctgggagtgtccccatgagttttactttcctactttatgaagtgaacctgctttctttgggatttcatgtactcctaatgctttttctctccaggtatttctttcctgctacatattaggactcccaaggcaagagtgcacctttatttagacctgggagtaaagggaaagagttgcctgtctttcgtgtgttttcagctttggctctgtgggatcagttatgcctcattcctgaaaagggcctttttatccccccagaatgcttttgctttgccaataccaccttcctcagcctgccttttggaaaggttgagaagctaaaaagtcaggtaagagaaggcagagatggacttcagaacctgatttttaaattttaaggcaaggctggctgccactggtgagagtgatgcagcagcctagcgtgttcccagcagaggtctagtctttgccctaagaagtcaccgcgcttatgaggttgctatcacagtgcatgtggtaggttagatttgagaaatggttaggattgttctgttggataagtgcagacacctgcccagggaagcagctctttttttgtaagagttttcttggttactgaaatcaaatgggggaccagtttgttataggagacatctgtggccagcaaatctgaacagcttcctagagggaaagtacctcttttaaactaagttattatagacagtgaatgaatcctacccttaaaagagatgacggcagggtaagtgcaaagtaaaacctccttgctctagtctcttgggagagtattgtaatgaaagcagcgtttacttcgttgttgttgcattggggtgaaaaatctgagatgctggaatgatggcaatgtttgccttctctccttcccttcctgacagccagtgtgggccaggctccactctccatcttcacaccctgcccttgctccagtatttccattctgtttttctcctctgtctctttctgtctttctctcaaactccatcctgcttccacccctgcccgcttttcttctcctttcctggaagtaatcattaaacaaaagaaaaagttgaatgttctttggtgagtttccttcttctctgccttttccttctttagccagttcccctcaacccctgtgcactccataggaaggacaaacttacctgtctgcttccttcccatgtgcttctccccaaattttcatatagatatatacgtacactccttttggaataaacgaagaggtacattatatttgacacaaacttgggagtgttaagaggtcataagtgtttacctatcagataaccatctgtggctctgtgttggattttttttataccattaggaaaatgggaatttttttataggcctgccatacttctactttgccaaatagcactttattatcaagatacacccatggctcatttcagactcactgaactttttttatatgaatgcacagtcgtcatattttgggcagtctgtgagttcttggtaactcatccccttactacaaaagcactaagtgaacaatacaaaagtataaaagcacaaatttgaacttacatagtttagtttaagtatgtttcactagaaaatcaaatatttagatttctcacattgaaaatgcttaggattgaggtttagctgcttcctttaaaaaaaaaaaaaaaaaaaaa

SEQ ID NO: 11956 - DNA, 654 bp, Homo sapiens; identical to SEQ ID NO: 11941

SEQ ID NO: 11957 - DNA, 523 bp, Homo sapiens
cagttccaccggtaacttcactctcataaggtggattccagaagcatcttgtttccattatccccccagtcctcttcctctcatctagccagtggctgtaatactgaggtggagagaacagtcattgtttaagctggctatcttttggcctgagggtttggggtatgttgatatttgtcggttactatgacttcttttttttcccccctcaattgcatcaaacccttaaaacatggtggtaagtgagcgatatgcatgcttttggagtttgtttaatctccgcttcagtctatacgatgcacagttcataatgttaacacttttcttcaagtttacttcattcactttcacaactaatttggatttcagtttgctgtttaatcctcatttactttggtttctgtatcttttttctgtaattctgttctttccctctcccctgacttccctgttaggggtcaagtcgtttttttgtctgacctgtaggggagagtggtgctgcagatagtgattcagtccagga

SEQ ID NO: 11958 - DNA, 4338 bp, Homo sapiens
agaaactgacatggcgatcaagacaacaggatcgagaaaactgtgctatgaaaggcaagcataaagtgagtgaaacagaaaaatgtctgctagatttagtctttctgtgggcttgataccacagtgccagcatgttcaaatgtctaatattaatgtaactactactttctttaggatgaatgccacaactttatcaaagtatttgttccaagaaacgatgagatggtttttgtttgtggtaccaatgcattcaatcccatgtgtagatactacagggtaagtatattttatgtgatatgcttcttttgatcaacttttctcccttcactgatatgctgttagagttgaaatctttctgctttccagtaatttgttttatctctagtgcaatgaaagaataaagacagaattcttcaaatggaattttaatacaaataaaatagtattgccttcaaacgggcacgttgaatagatatgacactggctatttacttttcttttgtagttgagtaccttagaatatgatggggaagaaattagtggcctggcaagatgcccatttgatgccagacaaaccaatgttgccctctttgctggtaagatcctttagcgtaatgaatataaatgattaatgacattgaaggtgaaaaaggaatttaatggaagagtaaaagttaataacttggatacccaccttgatctaagtgttcgaaaggctagaatctatgcacaaatttccaaaaaaagaagaaattaagggcaaggatatttcagtgcacactataagtattatgacaccgtgttgttaactaggccagtggcccccgataagttgcttaagtttttgatgcctagatccctgtaaaattagataatatcatggctgacctgtcacatgttgatggtgagaatcaggtgtagccctatttgtatagataatggtaataccagtgagagcgctccaaagggcataacacgctgccaaagctaacacactgcaggataattatggttatcttaccaaaattatacctttggtttcagatgggaagctgtattctgccacagtggctgacttcttggccagcgatgccgttatttatcgaagcatgggtgatggatctgcccttcgcacaataaaatatgattccaaatggataaaaggtacctttgaagagcagtgtcgtggggtcaccaggatagtggatggcccaagtggggacagcagccacggccatcaagaggttcagcgcatgactttatattgtttatttagaacaagtacacactgcttttattgtgaaacaggaactttgacagggaatgaggaggctggtaaccatgttaaaagagtaagttcattccggtgtttatcctaggtgacctcaaaaaaaaaaaggggagatttcatctctgtgtgtgccaatttgtctaacttctaaaatgcacataatactacttgccatctacccatcttggaaagtacccagagagaatcgattagtccgtatgagagccattttgttcttcagagtctagaaatcaagattttttattttcagtgtaagaggttttcttccctagttaaataggttaatgaataaatctgttgaaacaaagacctttgctgtagttcagttccctgtaggtctttttacagtccattagctgactttagagatgactggttccctgaagcttgaacacacccatattgggactcctcaaagtcattggcagattggagttcttgttggcttgaatgtaattgtgcaacatctgtcagtcatgctttgcagtcggggtcttatgctaattgaattatcctttaggaaccagtttgtttttaatttttctttcagagccacactttcttcatgccatagaatatggaaactatgtctatttcttctttcgagaaatcgctgtcgaacataataatttaggcaaggcaagtatatgcatttggcttgaattgtggacttgtactgcatgaaattgagaccactgtgatagagttaaggatgctcacttggcatgttttccagctctcaattcagtatacatagggccaactgcagagaggtgggttgcttatcatgagaataattgctggaaaacatctgaacaataacctgagtgggaacagcagccttgagttttgagaaggtatcgttttttttcctgcagccacagagagtgttctacaggtacccttgagctacggatgctttttttactctttagaaaaccactgatagtctattctttctcagcgtcaaaagacaggatagaaagtagcgaccccattcaatttttagtgtttcagtgaaagcccatgtgattttaaagtattgcaaccccttctatgccaagttgaaagatgacatgtttcattaacaatacaggaagcaaagttggagaccaagtgcagggatggttttcattcagcaaggcagatagacagctcacttcttgggaaggatgcttagcaaaataggaaagtggctcttttttccccacaggtgaatctagtttaccttcttactgaacagatccctagagagaagactgctagatttttttgaaccagatgtatctttagtattttttgtccctcccttaaacagtatcattttgtttccattcctttccatgctcataaccccattgctttgcttctatccgttgggcaggctgtgtattcccgcgtggcccgcatatgtaaaaacgacatgggtggttcccagcgggtcctggagaaacactggacttcatttctaaaggctcggctgaactgttctgtccctggagattcgtttttctactttgatgttctgcagtctattacagacataatacaaatcaatggcatccccactgtggtcggggtgtttaccacgcagctcaataggtgagagcagaaccccggcactgcaaagatattctctgcatgcctgtcagaaccaagacaggcttcatgtcgccagcctcttcctgatgattttcttccttttcagcatccctggttctgctgtctgtgcatttagcatggatgacattgaaaaagtattcaaaggacggtttaaggaacagaaaactccagattctgtttggacagcagttcccgaagacaaagtgccaaagccaaggtaaataaaaaagtagaaaagggttttgtcttgaacaaaaccttccggtcattggaagcatccctcctcagggagcagcttggccaacctcccacaccaggaaggggtccctctctcagacagagccagcagacatagccttgtgacctgcaagcccatgagtgtgaatggagaacccattgaattcaggggcatagcattgctcctttagtttcactcactctccttcctcacttgacctcttctctgagaatatacacttattccttagatacagtacatggtgtggcaggggcagccgagagcataaaataacgctgttttcctttcaggcctggctgttgtgcaaaacacggccttgccgaagcttataaaacctccatcgatttcccggatgaaactctgtcattcatcaaatctcatcccctgatggactctgccgttccacccattgccgatgagccctggttcacaaagactcgggtcaggtgagattgtgtgtgaaacactccttcctattcaacgttttctctgcccgtgggcctccccttctgatctgtgccgcctcctcttgtaggtacagactgacggccatctcagtggaccattcagccggaccctaccagaactacacagtcatctttgttgggctctgaagctggcatggtacttaaagttctggcaaagaccagtcctttctctttgaacgacagcgtattactggaagagattgaagcctacaaccatgcaaagtaggtatatgttacgagaacgcccttcagcactgctcaaaaattttcggcatgtatttcatctagtcatgtccttttggtcctctaaattagcagtggtttggcataatagtgttttgtgttttttttctcattgaaataaatcttgggtttgtttttttcccgagcctgctagggcgaggggggtgaatggttgatgagtttaaaaataatgcagcccttgtttttcacctgtagaatatgagaacattttaacagcacctctcttatcttgcagatatattccaagatgctacatgcagcagacagctgtgagcttgcatacacacacacacaaatatacatgcacatacatacacagaatgcagtactagttaagtatttccttcctatctttaataagtaagagaatatttagaccattaaaaaaaaaa

SEQ ID NO: 11959 - DNA, 6773 bp, Homo sapiens
ttgcatctcgtgacccgtattgtggctggttaagccagggatcctgtggtagagtgaccccagggatgctgtaagtatactttgtcacatgagctaggatgaactatcctctccagggtctctaaagctagaaattgcagaaaacttccaattatactacttttctttttttttgttgttatgggagaaacaggaaaacgaaaaccaggagacgtgacaaggaagggaataataatacttaagggaaatggtagacctaataatacttaagggaaatggatggagagaaaaaaccaattctcttctgttctcttaagcattctagttcaccagtttttaacagaaatagtcattttagcaagttatgttaaaatgttgttttttttttttctctctctgcccattcttactaatcagtctgtgttcttggttctgctctggttgtcacttgtgttcctatgaaggctgttaaccgaagacttctttgctttccataaccacagtgctgaaggatatgaacaagacacagaattcggcaacacagctcatctaggggactgccatggtaagacagaatcttccattcccacctggagcttctttttgaccacatttgcacgtcgacattattttacaatcagtctttttaatgactcaggacacataccacctagcatttaacttaaacttcgcaaaagctgagctgttcggtcatggggatacattagaaaagaggcttactttttttttccttcaccatttacaattttgtaggaaatctagagagaggtagtctaaccagtaggttaatatttttaatttatagtcttttttttttttacttttttagttaattggaattcataaatttttgctttcttttggttacttttcactgattacttgttcctttaattcttttagaaattttgcctacttcaactacaccagattacaaaatatttggcggtccaacatctggttagttttttttaatttttttgaattaacaaccttttctttccttcagttcagcattttcagccccttctcccctccttttgcgcagtttggcagcccttcatttttccgctttgactcatattcccactgatggtaccaaaagacttttcttactgagcacttcacccttgtttatagcatgttaacacttcatcattgaccaagccacatcctttaagaaaattcaaatgggctaacatagactgcattccagctgcacgcacgcccacccaagcttttttctttctcacctctttgcattgtgaatgtttcttctggtcatctgtatttaatggatggcggaatttcattattttccccatctctcctcacctttcctatgacctagtaaacaaatacacatttcccataaatgtgtatttataagttttagagatctttgaatggtttgcgctaatcctgggaatctttgaatgttgtggtctcagtggtgtgaaaaaagctttaatggagtgaagcttgatttttgatgtattaagatgttcaatgggcttttccaagcctttttgtacctgtttggagctccttctgttaacttgttgcaccagtcagaattgtggtctctgaggttttagcttaaaagcgtaggcttacattttgaggaaaatctaatttgaaggaaatcagtactagacatgttaaaaggttaagttactccccggtcctattgctgcttctaaaactcaccagcaattcctttcctcagggggagaaaaagatggtagatcttatgtatcagaatatcctcattcagtttgtaaatgccattgcctttgcattaggttctgcttggaagaaactccccagcagttttggagagagtacaagcaaagtctgtcccctccttcgttgttttactgtgggtggcagagccttagtatagtgaataatctacaaatggacaggagcccctggtaacaacctcttaggcagagctggtttgtcacgtccaaaatcaagtattttcatagacttaaccagatattttccaacaaagttccatcatagcttcttccccagtaaagcctatagattttctaaccatctgtgaaagtgcttttaaaaatgcataaaaaagaaatgaaatgatgtctcacaagagaaggaagaaacagcaactaatctgccctgggaattatattacctttttcatgagtgtcattagtaaccacaggggctttcctaagagcctttcgagtatctttaattttgaaatctgctgaatatgtctttactgttaatttttagttttcattcttcccttgaaaggaaggaatttgatgtagcttcctcaggcgtgtttttacaaaatcctagagcaaactttctcataaaatttactcaaactttatttaaaaatgcaacagaccaatcaaaaaaaatcttgacactatccatattaataaaaatctgtttgccaccacagacatggaggtatcttcatcttctgttaccacaatggcaagtatcccagaaatcacacctaaagtgattgatacctggagacctaaactgacaagctctcggaaatttgtagttcaagatgatccaaacacttctgattttactgatcctttatcgggtatcccaaagggtaaggcctcagcagggacctcatctctaactgcgtggaaacctgatccttaatgtcactgaggagtatgtggttctccaaaggtgggcctcacaggagcttttgcggttgtacctccaccgccccttgccacagtctttctggctttctgtggttatatctgagtgcattccttaaaagataaaagaggtggaaagctgttggagaaaaggctggtgaagcagccactcagacaatctaatctgtgttgatttctgtctgaagaagcagagagcctgctggatttcagggaatttcgagggtcaccgcagcaacatcaaaaaacaaaactcattaattgcaaatatcctgatatcagatgttttgtctaggagcctttcccagactcttgtttagcttcaattcaaaatgcaatctgaaaaggatatgtgagatgctaagttgcttgaatgccacaagcaataaaacataacagagtgctcgtccataactatcattttcagcccgtaataggagcagttataaaatagctgcctgttgagttagcttattaaatatattactctaggaaaaaaaaatctattctttagtacttactaaactatggtatcaggtttccaatcagtttttatggcagcacattgtcatttatgatttatatcggttgattttcattttatatgttttcgttgtaaccaattttataatcattcttctttctgctttgctttctttagtaacaccatttttttctacttttctttctcggtctttcacagtgccactgaattccataacattaattaaacattaattaaaaacaactaatgttcaaaggccttagtactaacttaaagcaacagaatcttcaaaatcactctgacttaccttactctgggatagctgtgtttatagcatgtaacagacttgaatacctcttaaactaacttttttttattaattgttagatgtctgtggttgcattaaaaggttaagtttaatttcagtaattataaactaatttgctcttctttttctaggtctaatttaaatattttcaaatatcttcagataatttgacagtttacttaactaatacatagtatgtttccttagactgtctgggtttcttacatagtcggtcattcaagagtgcttcaccccaagatggaatgaaaaaaaaaatccaagcaaacatgaaagtctctatttatagctaacagtgatcaagcagatatttttggtttgtgaacaaattatatgttcatattaaagttagtataattgtatcagagtaattattttagcatatgtttatgctaattattacattttcctatatcctagtagctaccttttaatcctgaattaagagaaaattatgagacaaaacatatgagtttaaagttagctatttagaaaatatacacttctaactattttttagatagaaactcttacatttttaacatgtaacaactatttatgagggattggaggaaaagaacagaagaatacagatcagtgggagattagagttatcctggcatttgcagcaatcctgtatgtctctggggatcctagtttgattaaagacaaaatatacaaggaattttggagtctacttgaccctccgagctaagcatatgaaccatatgaaggtcgtgttggctcactgaaagccatttgctatttattattatttttaaaaagcaccttattcacattgtcccatgtgtctatttcaggtgtacgatgggaagtccagtctggagagtccaaccagatggtccacatgaatgtcctcatcacctgtgtctttgctgcttttgttttgggggcattcattgcaggtgtggcagtatactgctatcgagacatgtttgttcggaaaaacagaaagatccataaagatgcagagtccgcccagtcatgcacagactccagtggaagttttgccaaactgaatggtctctttgacagccctgtcaaggaataccaacagaatattgattctcctaaactgtatagtaacctgctaaccagtcggaaagagctaccacccaatggagatactaaatccatggtaatggaccatcgagggcaacctccagagttggctgctcttcctactcctgagtctacacccgtgcttcaccagaagaccctgcaggccatgaagagccactcagaaaaggcccatggccatggagcttcaaggaaagaaacccctcagttttttccgtctagtccgccacctcattccccattaagtcatgggcatatccccagtgccattgttcttccaaatgctacccatgactacaacacgtctttctcaaactccaatgctcacaaagctgaaaagaagcttcaaaacattgatcaccctctcacaaagtcatccagtaagagagatcaccggcgttctgttgattccagaaataccctcaatgatctcctgaagcatctgaatgacccaaatagtaaccccaaagccatcatgggagacatccagatggcacaccagaacttaatgctggatcccatgggatcgatgtctgaggtcccacctaaagtccctaaccgggaggcatcgctatactcccctccttcaactctccccagaaatagcccaaccaagcgagtggatgtccccaccactcctggagtcccaatgacttctctggaaagacaaagaggttatcacaaaaattcctcccagaggcactctatatctgctatgcctaaaaacttaaactcaccaaatggtgttttgttatccagacagcctagtatgaaccgtggaggatatatgcccacccccactggggcgaaggtggactatattcagggaacaccagtgagtgttcatctgcagccttccctctccagacagagcagctacaccagtaatggcactcttcctaggacgggactaaagaggacgccgtccttaaaacctgacgtgccaccaaagccttcctttgttcctcaaaccccatctgtcagaccactgaacaaatacacatactaggcctcaagtgtgctattcccatgtggctttatcctgtccgtgttgttgagaggatgatgttgtaagggtaccttaaaacaagagactcgcttgtattttaagagaaccaagtggccaaagaaactctttctaactttggcaacatcagaacttgccacatgtagctactgcagcaaggcttctgtgtacttgcctgaaaacaaaggaaggtgctggtcattccatttcttttgtttgaagctaaagagatgtgtagctcacaggggctaccttaccagtataaagagctgataacagtactcagaagaatctgtgaacaaatacttgaaaatgggttcaatgtagactgccattatgtgtggtcttcccattaaatgtgaacattttaatatgtatgcattcaccttgcctcttgcacaaatgtcaaaaaaaagatggtaatatctcaaagaaatgaacttgtagattaccaagcagtttgctaaaaattcaatctttgacccaagctgtagcatttttttttcatgtgtggcatctttttcatgccaccaacaaacttgttgtgtgtgtgcgtgtgtgtgtgtgtgtgtgtgtgtgtgtgtgtgttctgtacccactaggatttgtttaggtgcccattgcatctttttgtgctatggagttgtttacattaagcatgaccgaacgagagacaatactatttcccacaggagtccattgggttcagctttgaaagaggaatagaatcgaggctcctttgaccatcaaaatgatgaactttacttatgtggtacccaatgccagaatgtaagagttgcaagtgattttgtgctgctattcattaaaacttgtattccagtcttgccagcttaaggagatcaagatattaagaggtatccttgatttattttccagtattcagtagtaaaattttcctgtccactgtgaatcaaagcctgagtcactctatttaaccttggacacactaataaggttttattttgattgtgttcgtttccccccccccaatagtaaaatttctcctcctttaactcctcctaccccccaaggtaagaaacaaaaaacaaacaaacaaac

SEQ ID NO: 11960 - DNA, 1597 bp, Homo sapiens
atgctgtgcttttggcgcaagtggtggggggatggggtgggggtggaatttttttctcactctaatgacttcctattggaaaggcattgacagccagggacaggagccagggtgggggtagttttgtgggaaagcagaactgaagttagcttaagcataaaaacaaagaaaaatcttcgcttttcatgtatgtggaatccaagaataaccataggctctaccagaccagaagggtaaggatggacactaaaatgaaacaaataccaaggtattccttctgctgcagcctggagaccaccgagagtcgagctggggcacacacacacctggccgggacccggcagggacaaggcgggccgtggcctcctccaccaagtctctctagacaattcagggcctgctttccccagctccatgcatggctggactggtgattccagggtgcagaagggattcatattcccagaacgctttaagtgtacacctgcaggataaagagataccggttacattattaaatgattctagggattcactgggggatatttttgttgcttttactttcatggttagagctacaaagaacagtgattttttttttttctcccttccccattcagaaacattatacattgggccatttttctttctcccaaagaagattcatggatagtcagactgaactgtgtgcaacaggaaaagtcaaaagggaaaaggtagctgatgaggttacatggttacatgttctacatcatgcatagtagcttgaaatctagtctggagaaaactggatcaagattctagcccactggagttgcaaggaatgagaggcaaaaattctaaagatttgggttatattttcaacttgggggacagagagaaatggagagcaggaattacagttccaacaaacatcatgatagtctggtagtcaagacagagattaagtaaaacaggttttactgtttagctgagttcagttaatacaaaatgtacataaaacgttagtcctttgagactgacatgattaatgatcagtgtggtgggaaatgatgtagttattgtacacaagcacttgcaaactctttatccctatttctttaaaacaaaataaggtgaaatacgaagtccttggtctgatataaagcccctattggattcttcggatgcgtaaaagaaattgcctgtttcagccagaagactggtgaaaacacatacatcagactatgttgtgagccaggttgattttttattttattatatgcaggtgagtgttgaaactgttaaaattccaatttgttttcattcagtattagtttagttctaaatatagcaaaccccatccaggtgctatcagatgaccagttactgcttagttaactaggtgtaaagttttacatatacattaatgtcaatagtttattacaagttgtgtaaaatggactctagtttaataatgggggaaaaaagattaggttgctcctgaaactgactgtagagcatgtaaaatgattttactggattctgttcaactgtaatcaatgaaaaagatgtacgttgtagacaaagttgcagaattaaaaaaagaaatctgctt

SEQ ID NO: 11961 - DNA, 2017 bp, Homo sapiens
gcagtttcactatagggaaaactcacattttgaatgttcttccaggacagaataaaaatttcctagtgacatctgttagccctggggtctcacggaggacaacccgggcagctgtcgtgtgggaaaagtcccctgaggaaagcccagaggttctggctttggctgcatctgagaatcacctggtggggagctttgacagttctcagcgctcaaacacaccccaaatcaattgggcccaggcatgagtatttctgggagttcccaggtgctccccggatgcagccacgctgaagaaccaccgcactgagtaagttaccttccattttcctccttcacaaatgctctaggtttcaggcggcccctttgtgtggattctgggggccttctgtacacacagcactgttgagggtctcaggcctcactgctccgaacaggaaagactcgtgattagcacagggccctgtcaaggtgaacatatccttctcagtgcaggcctggctgaacccatcctcctccactaactaactgtctcatctcctttcttgggcctcccacaggagctacaatgatagctgtttcctggattcctccctctatccagaactagctgatgtccagtggtacgggcaggaaaaagccaagcccgggaccctcgtgtgagccagcccggcctaatctgaccgcctcaacgccattctgagatcacctcactgcctctcatttgccttacccagacgcaccgtcaccctgcaccagctttggccctcagcactttttttctcctgtctccgcattccctcccccttgaaaacctgactgaggagacattctggaaggttccggtcccactgtgtgtcccctggcgctcttgcccatagagagccagacaccaatcctcaatggcaccttggtggcttccctctgccatgacagcccctaggccaggaaccatcaggggggccagccggcatccaattcctgcggataagtagcgttgggagagaacgggaaaggggacttgagttacagggtgacccagaaagacgattcagctgtgtccagcctgccacccatacgtaggccaaccaagcacttcatgaagaggaggcctcgtggcatattcagtttacacctgaaatattccttgatgggacagcttgtggggatggctatgggggaaggggaggttgagaaaggaagttctcgacaccagaaatgcatcggaggaccacaatcagttctatgctgccaaagattaaaaataaataaaaacataaaaaattaagaggggccaagaggaagacattctttctgcaaggaaatttcttttaaattctgaactgctactacacacaagtgaaagtcaaccctatgtaaactggtgtcctctctctagccctctcccttactggcccacttctctctccgtagagagcctgaaaaactgccccaatgccacggtaaaggcgaggaagtcttggctggcgttgctgactcacagtcgccatccatctggacacaaagagagacctgtgggagtcgtagagggtactgttagccccggtccatgcagggggttcagccgagcccaagactcaaagctgctttcctttcaggatttgtagtaacgtaaggtgataatggccaaaagtggttctctctcattaaaccaaccagtaaaagcgtatcctatttttttgcacaaggtgtttcattttcgtttttatgggaaaccaagggaaaagcacattgcgatccattcagtgtttaactgtcgtggctcattttctgttcgttagcacttgtgtgacaaaagagctcagatccgacttctcctatgtgtcacttattccaagaacccaactatgcccttaggtagaaagatttgactcgtgtgtctactagccaacaggcagagcagggttgaaaaaaatatcagctcccaaagggcccatgtgtctacatcatcagttactgtcatgcaccacatttgtgtgcagataccaaaagaggagga

SEQ ID NO: 11962 - DNA, 845 bp, Homo sapiens
cccgtcgttttacaacgtcgagactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcgggatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatgggttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgg

SEQ ID NO: 11963 - DNA, 2312 bp, Homo sapiens
gaaaatcccccttcatcccccaggactgtcctttactctttgatagtatccctctattttcttcccaattctctaaatgctttatcattttttcctgagatgcttctgagggatgctgacctcccactatggggaaaagggttgcttggaggacctggggtggcagccccccgaccagaagcaccctattttatagatagcagtctgaatggtagagagtcctgtgtgtgggttgttagaaggttggttcttcctgttattctctctggctttcctttcaacccacttattttcagaggcctctccccttagcatcctttaaaaggttttctgatgaatgtgtgaaagagttgattatttcaacagtattggttaagtcacaacgacgaagtgctgagaaggttatgggtaccaggaagaaacaaacagaagtcttaagattagaatgagaaccaaagagaatttaaccctgccatttttttttttttaacaccaagatcctaagtaattccaaatgccttagatatcaatgaaagctacacaccattgagatgggcaaaattctttctctacaaagggagtaatcaagtaaatacctgttctctttcaatggactgttgcctattgagcattgtggatgatgtgttttcagatttccaggtgaagttctgaccctacctgtttggccaaagacgtaaattgagaggaaaggccttggtcttcctgatcaaccagcatttaacgaacagtggcttaatgcagatcactcaagaggcagcatagcaatgtaaaaggaatataagtaggtgttggatgcctttttcctagaccaggaatggggaatatataacacctgtgccaccgctcttttaaggaggcattatgaatgagtgcagcattcctgtcctctgtgccaggatttggtcttagaatccatgtcagattggtgcttccagacatctattcccagtccatcagagtgaaatgaaggctatttgccatccctgccttagacagaggagtgaaagaattaagtgggtagacaccaaccaaaatgactttgaaagcagtgagctgattgagctccagttctgtggttaccagaaatactgagtgtctgtcatgtgcaagacaatgctaagaacagaatacagacataaataagtcacggcccatgaccttgaagagcttacggccttataaagaggttcactgtaattgtcttcaccagggcgtccttctcaaagatgcccacttttgtctggcacattggggctcggtggtctggtggtcccttcggtcttggccctgtccgtcctttgtttttgtgatttactaacaatcatcacgaaccagttttgtttttcttttaaatttgaacatcacatcttgtgttttagttttttgctctatgatttttttctcactgcttttcagtcttctctgtacttcatttttgtgaaaaagtgaaaatcacatataatctttatttaaaaatgctcaccaagcactgcagactttggagttagggattcagcagcttgttccagtgaaaaggaggagtgaagctggggaagttagtatctaagaggggcaagctgattgcatgtgcatttatacctatgcctttaaaacattcccataaaaagtattaataaagaaatttccattccacactagtactgatgaaaaggtggttgattttgccttgtgataattatcaaaggatagtttttcatccttagattttattcacatgagagattttttttattttctctgttgacttaggaacacatcataaattcacaccaactgacacgttgctgacgtctgtacttgacataaccatttttattcatacaggaagcattaaatataaaagatggtcagttttgaagagcaaagggtgctgaaatgacttgtacggttggctggtgctttctcaaatggattgccatagttcattactagtaaagaaaaggaaaatgtgatttacgttgtcatttttcctattaaaaaaaacccttaagaatggggcacttgagctgtccctgcaatgttttcatatctagtagtcattttagggaaagtgataatctgtagaatgaatagttatgttttgatatgactgatactttctttgttaaaaggttgtattaagtcttcaatttcaagtctagcttaaaagtgtaaacattatgtgattcatttgaatacaagaatgcctatgaaatacccactataacagcattccttttgtgtttagaactatagaagaaaatgtcttcaaataaagtagttttcagtca

SEQ ID NO: 11964 - DNA, 192 bp, Homo sapiens
aattatttaatcctcacatgaatcccatgtggtaaatacaaatatcctccgctttacagttgaggaaactgaggcactgtaggttacaaattgccacttgagaaagaggagaagggaaaactacatacagtggtcactggtttaaagggtatcctttctcttgctagtggaggagtgggtttccgagtgagc

SEQ ID NO: 11965 - DNA, 8891 bp, Homo sapiens
cttacccaatcctctggctgagttctctgcctgtgagtgtaagggaaaaatttatgtcattggaggatacactaccagaggtaagtgaagggaccaggtaggtggtctgcccatgtgtaggcgtcagcagtctgggaagggcaagagggtgtcagaggaagccccgacatatccgagtgtcatgttatgctttaatagtgtacacttacacatctggaaggaagagagttccatatggcagggatgattgggacaggagggatcttttgataactttgtgtgagcatgaaaatcgaatggggaagggagagctgtgaaaaaaaaatgttatctctttttttttgcttctggaaacccagctttttggtcagccgtcttgtgatttggctgggcctggtttgtgggggtcgctctctgaggttgggtagctctttggagaagattatctgggaactcccatccttatcccaaacatacaccaaacctgcccccatccaccattatggaatttagtaccagagcatccttgcagattagttctcattttctctctttgtgagcacacacacatcaggtagaggttccagaaacccagctttaggacactgttcacatatcacaggaggagcaaggacatgaatacaagagagctctttcctgaccagcagtgggaggtggttgtactatctatttatttgtttatttatttatttattttttgagatggagtctccttctgtcacccaggctggagtgcagtggcgtgatctcggctcactgcaatctctgcctcctgggttcaagcagtcctcctgcctcagccccccaagtagctgggattacaggctgcaccaccatgccccgctaatttttgtatttttagtagagatggggtttcaccatgttggccaggctggtctgtaactcctgacctcaggtgatccacctgccttagcctcccaaggtgctgggattacaggtgtgagccaccgtgcccggcctggttccactatttattaaaatgtatatatgtgtttttcacttttttggtaggcattttattgttaataatttggaaattaaaaaaatttctccacaagcttattttttgtggagacaaggtctccctgtgttgcctaggctggtcttgaattcctgggctaagtgattgttctgccttggcctctcaaagtgctgggattacaggcataagtcaccatgccctgcttgccagcaagttttatactgctctttttggtagggaattgtctcaggttacagtgatagagaacaatgtagttgttggtgggatacagtggctcatgactgtaatccagcactttgggaggctgaggcaggaggattgcttgaggctgagagttgaggacaggcctgggcaacatagcaagacaccttctctaaaaatgaaaaaaattagctggatgtggtgtcatgtacctgtagtcccagttgcttgggaggctgaggcaggaggatcacttgagcctgggtgttcaagataggcctggtcaacacagcaagaccccttctctaaaaatgaaaataaaaaaattagctggttgtggtggcatgtacctgtagtcccagttacttgggaggctgagacaggaggattgcttgagccaggggtttgaggctgcagtgagctatgactgctcccctgcaccccaggctgggtgacagagtgagacccagtctctaaaataaaaaaaaaaaaaagaaaagaaaaaataaaactgtggttgtgggaagacagacaatgggggacagtcaagcagaggggtgcctttccttccctctactctccaaagcagatgtctccaagttacctcttagccaaggaaatctatttctgcatttggtctgtgtgactctatggagcccaggacttacagaaaaggtgtaacctggctcttaggactttaagccacattatggtagtagacctgccgttttatttgacatggtgaaataaactaccactcctttgtggtaccatatgggcaggacagagctcttcaaccctggctaacaagcctgaagaagaccctgtgaggccgcagcagccatgggaacttcccaaaggacagaaatccacatgctaacgtagcatccagataggtgacagaaattccttccaccatatccaaatgtgtcctgttttggggatttatgttaggaagaagttaaaatgtaaagtatttgatgaacatctgatttatttctttttagaataagtcgaaacattaattcagtggggaagatggtgggaggtgtgttagtttcctgtggctgccataacaaattagtatacacttggtggcctaaaacaacagaaacatattttcttatagttctggcgaccagaagtcagaagtcaaggtgtcagcggggctgtgctccttctgagggctctaggggaggagtcctccttgctccttctagtctctggtagctcggggctccttggctggtggctccatgatgcccctgcctctgtcttcatatgatgcccctgcctctgtatgtatctgtggcttctccctttctgtctaaggacagttgccactgttggatttaggccccatctaggtaatccagaaagatcttaaggtttttaacttaattacatctgcaaagaccccctttctttttcttttttcccttgagatggagtctcactctattgcccaggaaatagtgtagtggcacagtcatagctcattgcaggctcaacctcctgggttcaggcgatctcccacctctgcctcccaaagtgctgggattacaggcatgagccactgtgcctggcccaaagatcctttttttgaataaaatcaccattcacaggttctggggattaggaatttgacatatcttgttagggaccaccatgcaacccactgaagtgatgtgtatatttatgtatttaaggagaggcaagacaaagagaagtgaccttttttttttcccactccaagttttcattatttgtcgagctattcccaatgtccctctctggtgactctccactgaagatagttttcaactttttctttacatataattgaaaaaaaaaaaaagaaacttagtagtcattgctttgaccttcaacactggttgtcaggttacagtgattataggtttagactaagccatgggcccctcagtccccctgaactcctgtgtttatgtagtaatccccctctctcgtgtgtgtgtgtatatgtgtgtgtcttttcttctaggaaagtcaatactcccagttatttacctatgagcaattctaagaattctgattcctctctaggttgagtaacacagactgcatcttgtgggctgacataacgcacatatgtgctttgacttctcttgtaaccaagagctgttcaacactgacaggcggcactgtaacccaaagagtactttactggtagatttcctagtttttccatgaccctggctgagcaaatgttctttagatttgacctagaaaacccttcttgtgtgttttgtaacctcacaagccactgctaatgtaccttcttcacttgggccacccaccgtgatttctgtcctggattccctgagccaaatacccatgatgggatggttcagtgatgtggatggatggctatttgtgtaagggccgaaaactagttttctaagatgggagagctgggcagttacttatactctgaagcccttctctttctctgctggggctttcccagcagttcctaatagttccttgtatttcagataagtcatcatgattgttaggaaaaaaagaaaaagttagtttttagcctcctgacttcttaagtcaagtgagacttttaaaatttagtaaataatagctcattatttttatggtagctatttgattattttaattctttagcagcactgaagaaattcagagaagttcaatagagagtaatagctataaagggaagaagggtgatttgtcaaacttcagaatcaactttaaatgtaaaaacaaaaagatcattccaccaactcaggccaccttgttgagtgaagagagaaaacatttacagaacacctggaaagaccttcgggcctggagctgagaaatacgtggaagcctcactagaatgagttctttattggttcggtggacagccaggttactaaggagcactttttgttaaataagtgaccaaaatccccttgggccatctcctaaaatgatctttatcataatagctacagtaaaaagaaagaaggagaggtattaatgtgggtggaaatcaggacagtttcctaatgccgtggcttacaattctgagatttctccaggcatcaggacatgtgcgcgcacaggacttggctctcttaggagatacttcagtttgtatcagatgtggctgtggagggtgctctttaagcattgctaactatgagtgggtccctctcagaagaaaggactgtaagaggtatgaaacttctgagaaaacgagctgtcttctcttaccaagcgcctgcagccgtcaaaatgctgtaggctttagtcgtctgccagttcccaagctgagctgtctccttcatggataggatttgtttgtttagaaacaacaacaaagttcattctgtttataactcagagcatttgttttttctgctgaggctaaaatacttgtttattctttcctagaggagaaaagaaaagagaacaattaaaaacaagaaaaacaaaactagatattctaaatttcacaagcgtttttcaaaaagagacgaggccatatttttccttaaagaaaattacttttttttttgagagaacaggatctcactctgtcaccctggctggaatgcagtgacatgatcacagctcactgcagcctcaccctaccatgctaaagtgatcctcccacctcagccttccaagtagcagctggtaccataggtgcacaccaccatgcctggctaattttttattttttttagagacaggaggtctcaccatattgcccaggctggtctcgaacccctaggctcaagtgatcctcctgcttcagcccacccaaagagttgggattacaggcatgagacaccatgcttggccgaaaatcattattaattaaaaatgtcagagcaaccttttatctagacgttgatcttatctacgctacaactgtcatcttgtgagggacatgggaaatgggaaaagggagaggggaggacctttgttagtgtctctctggtgatataatggggaaactaaggctaggcatggtaaagatcctgtctttaaaaaaaaacaaaaaaaaaactggaaactgaattgccaagtggttctgtggcttgttagaaggccgcaggtgagactttgctgcctttctcctgacttgtaacgttgtgtccttttcactagacagcctctggagatcctgtgttgctacttgtcatgtttcttaggatcagctatcaagaataatctacttgctgcccagcctggcttctgtattaagtagtcggtaattttgtagctattgatgagggttctgaggcacttactttttttacactgacctggtggttcaaaggtgtggggataccagggaggaggggctgtgtgaaagtcagagctgcgctttttcctggttttatccagtctgagtctcccacggaagagacgtttgggagtgggaggtgagtgcggatggatctaaatatatctcttcccagccactttgaaaactgtttttctaacttgtgctttttctgaaagagttttttctctttgttaccaaattatgcaggcagaggtagacatttctgtacagacttgcctagtggtgttagtggaggcggtgtcatcacttgtctttctttctttcagaccggaacatgaacattttgcagtactgcccctcttccgacatgtggacgctctttgaaacatgtgacgtccacattcgcaagcagcagatggtgtctgtggaagagaccatctacatcgtgggggggtgtctccacgagctggggcccaaccgcaggagcagccagagcgaggacatgctcaccgtgcagtcctacaacaccgtcacccgccagtggctctacctcaaggagaacacgtccaaatcgggtcttaacttgacttgtgcgctccataacgacggcatctacatcatgagcagagacgtcaccctgtcgaccagcttggaacaccgagtgttcctcaagtacaacatcttttcagatagttgggaagcatttcggcgttttccagcttttggacataacttgctggtttcttctctttatctgcccaataaagcagaaacatgactgaattgaattggtagatgaaaaaaacctggttcaagttttttttaaaatgtggtgtcccattccaagggagaccaattcctaaagggtaaagaagggttaaagtaggtcacatatatacagtagcagctgtaaataagcttacttgaactaattacttgaaaactggtggaaaaaagagaccaactttgttattttttaaattattgatttttaaattatgggagcaaatccatctccaaacatgatactcttgggccaatgacggatcatcaaaatgtagattcattgtgtctgtgtggtaaagggccaaagtcaataattgggacaaatggtaaagatgattttaaaatctgttgtatttaggtcccttgacatatcattagcaccttaagtgagaggttttctttttcttatcagtgtccttgacaagcattcatattaacatattcattctctcttctccatcacccatacccacacatacatctagtatgtttagggttctgtgttcagatattttgtttgcacactactttttaggaaacttataatgatggagccctacagtgaatccttaccagtgttcagtcctccccaaaacttgcataaaaatattcttagctatttttccagccttttttgcagttacaaatgctggataaatagactgataaaacctcttattttatttatgtggcaggttgcatatttatgtggacacataggttgcactgctaggcattctgtattgttttaaagaggatatattatttagaaaaatggacatatgaatattattaaaaattgagtcttaaatttaaatgggaagggaagaaaacaccaaataagaaaaaaatttgcctttaagagttacttttgttgaatgtatttgacttagttcttattttaaggctaaaaaaactttgtcatatttaagtcggcagctttctaatttaatcttagctttgtaattcatgttttgcttttgtggactaaggtaaggacagcatttaaatatttgtgctggagtgaggggaagaagctgttacagaagtggaatggtttctggtggtatttctgaagttaggtaaagtgctttacttgccttggttgttaattgaaatagaattcagctcaagcagttgttttcagtgagtgagttaacaataaaagcttctgccaatcatagatcaacattcctcaaaaatacatacactcatacttatggaaattttattttgattgaaaacactctgaaattatctgatattttgtaatggcatcagttaaactgtgagctggattccatctttctgcagtaacagcgggcagaaccatttcagttagcatgtgcctcactttaagaaagtcctgtaggggaaaaaaaaaactgtcagagcgaattcatgcattcaacaaacacttatgagtgcctggagtatgccgtccactgtgcagatgtaggacaggggctaatcacttagagttcttcagtttattagaggagtgactacaggttttctttacaaccatggcctctagtatacttaaaataagcgtccagttataaaaagcctatttgcacaactttttgggaatacttctattaactaaaatgaggtaagccattattttggacatagaaacagatctttgtatcttgtcaccaaataatcttacctctagtctacttacaactttgtaagggtttctaagctatgcccatttattcccaaatattaagcccttaaaaaaataaaacctctgaaccaaaatcttcccaggaatagtacttaatagattttaatgttaatttatattcattgtagaattgaatttccagtgacctgtaatttcattacatatattttaaaatctatttattttagatggtgttaacttttcgttgctgaagagcttaactttttaaaggctttgtcctatacatttagaagatgagtcagttgaattagtactggacaaacagttggagattagtttgcaaataagcatatcatatcaaatacaatattccagccaaccagttaattctcttcctggttacattcattgggtctatttgcctaatgttgacaattagattcttggaccaagtgagggtgtactctgatccacaaagctcttttataaaccaggtttgaggttgtgtgtgtgtgtgggggtgtgtgtgtgtgtgtgtgtgtatgtttgcatattatagctctctttaagacagacatctaaaaagattttggttattctgggctgccagcagtacgtgggaaaggtggaatgtgcaataggaacagatctgtgcattttgtgacatcgtccttcctgctgtgcacatcagctgtgatgacattttgagggtagttttaatttagctcggttctcttgttggtgccagtattacattgaagactacctatgatagaggcaatgttgctttgaaaatctcccttcaggcggaggttgcagtgagccgagattgtgccattgcactccagcctgggcgacagtgcaagactctgtctccaaaa

SEQ ID NO: 11966 - DNA, 2977 bp, Homo sapiens
cgctgtggtacgtcccgcgctccgcttggcccaagatggcggcctccgtgtgcagcgggttgctggggccacgggtgagtggggcgactcggcaggtccctgcgagtcggaggtggggtccctagtttccgcctcacgcgccctccctccacaggtgctgtcctggagccgagagctgccttgcgcttggcgcgccctgcacacctccccggtctgcgccaaggtgagcaccgccggggcaggggcctgggggcctgggggccggggggccgggggccggggaagccgtgcgggctgaagggggcgtgtcgctggggtccgaggcggggctagggtcggggcttagggatcaggggattggggccggggaacagtgccagctgactggggggacatggcgcgaagtaggggtctggatcggggatctcgtggagtcacggccccttttgctcctagaaccgggcggcccgagtacgcgtaagcaagggggacaagccggtgacctacgaggaggcacacgcgccgcactacatcgcccaccgtaaaggctggctgtcgctgcacacaggtgagcggaccccaggcctccaaaaggagcactcaatccgactgtcatgtaaacaaaatgaacacgtgtcacaggttttctttaactcaggaaataatgctagggtcagaaatctatgaaaccaactcaagggagacataaaaaagcagagatatatatagatcaggatgttgaaacaaatttgaagatggatgcaaaactgactttttccatggcaggcagggactcaattgatcctccactgaacagaaattatttgcatgtctacagacaagaattattttgcattcctgtcagttatctgtaatttacagagctgtaaaatagctcagagtcaaggaaaggagtgaaaccgttgcagaatctgataaccctgaacagtgtgctctaaggaatgcagttttccactaaagcacaaatttttctctgtaaatatatacagacaaccctcgttattcatgaattccatattttcagattcttctactgactaaaatttatttgtaagccccaaatcaacactctgggcactctcaaggtcactctgagatgtgggtggagctgccaccccaggtgcatgtcccgagctgaggtcgacaaggctctgcctagtttcagctctcgtactgtaaaaggtgtcctttttatggtctagaatcttttttttttaatttgcattttcgtgctttttgttagtgattttgctgtttaaaatggccttgcaatgctgaagtgctatctagtgttcctaagcgggagaaggctgtgacgtgccttagggagaacatacatgtattagagaatctttcttcagtcatgagttgctcttggccctgaattcaatgttagtgaatctaccatatatattaaacaaggtgtctttaaacagaaacacaaaggaaactaggttatgtattgatttgttaacaaaaatacggtgcccagaggctgaaaggaatctaaccctgtatttcacctaggagcaatggttcagtattcactaagtcagtgttggcagtgactttatagaatataactattgtgaacaattgataaccaactgtgctttgtttagtacaggggttcttggatgtttgagatgcatctagagaacttacttaaaatacagatgcttgcctggcacggtggctcacgcctgtaatcccagcactttgggaggccgaggagggtggatcctgaggtcaggagttcaataccaacctggccaagatggtgaaaccccatctctactaaaaatacaaaaaaattagctgggcgtagtggcgggcgcctgcaatcccagctattcaggaggctgaggcagagaattgtttgaacccaagaggcggaggttgcagtgagccgagatcacgccactgcactccagcctggacgacagagtgagactccatctcaaaaaaaaaaaaaaaaaaaaaaaaaaagagagagagatgcttgtctcccactctttcaggttctggtctgaggtttggatgtaggtgtgcagactcttagtggacattgtaagggctgcaggggatccacagttcacactgaggaacccactggtggaagccctgggcctagctcatgtccctaatctcaaaaatagctggtagcctcatctttctggcccatgggatgaccagtgtttttataaggcagccaagaaagcaggaaaggggctagatgtggtggcatcatcttgagttttgtaccctgactcaggcctccatcttcctttttgtaaaataaggataatgataatacctactaaactgaattggcttgggaattaatgacataacatactttgaactttaaagtgttatttttcttattccattagcagaagaaaagagaagaggctgggggtgaagggtgggattgtgctcagcgcttttggatgttgactctggagttatggcagggccctggggcaatgaggctgattcttctattatgcccttccctcttcaggtaacctggatggagaggaccatgccgcagagcgaacggtggaggatgttttccttcgcaagttcatgtggggtaccttcccaggctgcctggctgaccagctggttttaaagcgccggggtaaccagttggagatctgtgccgtggtcctgaggcagttgtctccacacaagtactacttcctcgtgggctacagtgaaactttgctgtcctacttttacaaatgtcctgtgcgactccacctccaaactgtgccctcaaaggttgtgtataagtacctctagaacaatccccttttttccatcaagctgtagcctgcagagaatggaaacgtgggaaaggaatggtatgtgggggaaatgcatcccctcagaggactgaggcatagtctctcatctgctattgaataaagaccttctatcttgtctt

SEQ ID NO: 11967 - DNA, 448 bp, Homo sapiens
ttttaaccaaaatatgtttcttctttatttgtggataaaagtctggagggtttttctgttttgtttttctacgaatattatttggaggcataactaggacctggggaaacgcttggctcctcttcgagccccgagggtgcaggttgggcagggcgggctccggtgggccgcacacccatcacccgtactagcgtgaggttgtcgaagagaaaatctcacgtttcgcatcctcaaatttccggatctgaaaccctatgcaagcagcaaccgcgggagagcgaacagcggcgggatgagcattcacaaggctgagcattcacagggctgcggggaaggcgggagtaacagctagcagcataccgcggccccgccccgcagaggccctgccccgcccccgccagagtacagagtacgagctccgacttggtctcgtccgcggtcgtcccca

SEQ ID NO: 11968 - DNA, 727 bp, Homo sapiens
ctcacgcctgtaatcccagcactttgggaggccgagatgggcagatcacgaggttaggagattgagaccatcctggctaacaaggtgaaaccccgtctctattaaaaatacaaaaaattagctgggcatggtggcgggcgtctgtagtcccagctattcgggaggctgaggcaggagaatggtgcgaactcgagaggcggagcttgcagtgagctgagatcgcgccactgcactccagcctgggtgacagagcaagactccatctcaaaaaaaaaaaaacaatatgaacatatatcaaattgaccatgaagctttcttataattccactccagagagaactactgtgaacagcttttatattttattcccagatgtacttttttcaaggaatacttttatgcacactcatcgatactaaactcttatcgagtgcctcctccggcccaagcactcttctaactgcctgggacccattagtgagcaaaacatttcattccaagatcactgtctttgtgacactcacatcctagtgaaagggcagggagcgtgaggcagcattaaatggtccaagcacgtgaaggaggaagacatgcagataaatggaggaagagcatttcagaaagttgcattcacaacagccagcacctggtgctaggaagtagggcagaggttgctgatcctgaccttgactctcatcttgatcatgtctctgatatctttaacctg

SEQ ID NO: 11969 - DNA, 1912 bp, Homo sapiens
ggaagatggccgtgccctgtttttcggtgtaaggcagcgacggcggctgcgacggcgagactgagatcctggtgtcgtgggcacctgagttctagcttcccccagcgagcgcgcgtcccttcgtgcctaggcgagagccggctcttccccgggagatgcgtttgtcccaggctcgggggctcagtgggagttcatgctgcgctggaggctcttggccaccgctctaatcgccttgtgccgccgcagcgccagctccgtcgccagcggtgagcctcccgattcccccccttgcccctggcggcggcgatgaccggggagaagatccgctcactgcggagggaccacaagcccagcaaagaagaaggggacctgctggagcccggggatgaggaagcggcggctgccctcggcggtacctttaccagaagcaggattggcaagggcggcaaagcttgtcataagatcttcagtaaccatcaccaccggctacagctgaaggcagctccggcctcctccaatccccccggcgccccggctctgccgctgcacaattcctccgtgactgccaactcccagtccccggcccttctggccggcaccaaccccgttgctgtcgtcgcggatggaggcagttgccccgcacactacccggtgcacgagtgcgtcttcaagggggatgtgaggagactctcctctctcatccgcacgcacaatatcgggcagaaagataatcacggtgaggagtgctagcccctctccacctctctccttccccgagcctagggtgtgcctccccaggcttctggaatcctaggccccctccagcagactcttctttttgcccatcatccgggccgttcggtaaatcatgatcgactcagtaatagcgtgccagtggtcaaggggttggttcttgtgggtgcaaaggaatgtatcctccttgcccacttcaaagtttgtcgtgagaagctgttttgtttgagacaggccttcgatttgctgattctggactgtcagaaattttaggttgcctcccacccaacatggttttctccctttgtttatggagctatatatctttatttctctctcttccccctaccttggcattttaaattttgaacgcataaattgccctcctcccttcattgctcacatacagatcccatcttgactgcaactggttgtgattttgcctgccaccaggttgtttcttttttgtctgctttcagtaaacttagaatgttagatttctgaaagccacacagtagaaatttgttggtatttgatacgtagaacagttaaagtgacttctcaacagccgatttttgtttgagtagagatttgattttttgcttgttttaagtagataattgctaatagtaatgtctcatcttgatgactgtgactaaaaatagtattatgatttttatggtaattttatcttagtcaatattgaccatttctttttgccttgtcagctgaattttttgtttaattctaaaaaataatgtgactgagttgacttttaagcaacagtaaatttattattgaagactaatgtgaacactgacattttaacatttaatagccgttttaaactgggtagttggcaaatattgttgatcgctctgctattaatatgaaaattgtatacattcagttagaacacactgaaccaactttgtgctcaaaatgatatacgtatcaatgaaatatttgcctgtgaaataagctcacttaattccattggatcgtaggctttttaggacaaaaattcagataaaaaaaacgagtaagatttctcttggctgtataattatctaacaactgcatttgttttcagaatttacaatgttgtaattgtaataaaatcaccacctatcatttatcataaatccccaaaaaagta

SEQ ID NO: 11970 - DNA, 307 bp, Homo sapiens
cttttttttttttttttttttttttgagacggagtcttgctctgtcgcccaggctggagtgcagtggtgcaatctccgctcactgcaagctccgcctcccgggttcacgccattctcctgcctcagcctcctgagtagctggtagtacaggcgcccaccaccgcgccaggctaatttttttgtaattttagtagagacggggtttcactgtgtgagccgggatggtctccatctcctgacctcgtgatctgcccgcctcggcctcccagagtgctgggattacaggcctgagccaccgcgcctggcc

SEQ ID NO: 11971 - DNA, 283 bp, Homo sapiens
acggcacgaagtagatgctcagtaaatgttggttgactgagtatcctctgcatctcggtgacatcacatcctgcgtgccgtggcgtcattctgcattcctctgcgggaggctcagatccggagggtttaagtggttgtttataacatgcaccgaacatatccaacggaggctgtggtttccgaccgcccacaaaaagcgcggttggcgggagtgcgggttcggggtcggctggcagctgggagactccagctctgggcggaaacacactgcctcggaggcgcc

SEQ ID NO: 11972 - DNA, 2532 bp, Homo sapiens
atccctaaacaagtctttgtgtggacatatgcttttacttctcttgagtaaatacctaggagtggaattgctgggtatttttaactttttaagaaacaagctgtttctcaaagtggttgtatcacttgaaatcctaccagcactgtatgaactccagtttcttcatatccttgccagccttgatatggtcagtctgtttaattttaggctggtggcaggtgtctagtggtaaagtagctcattgtggttttatcttctgtttccctaataactagtgatgttgagcctgttctcacgtgcttatttgccacctgtatttttatttatttatttgcttattttgagacggagtctcactctgtcgcccaggctggagtgccgtggcgcaatcttggcttactgcaacccctgccttctgggttcaagcgattctcccacctcagcctcccgagtagctgtgtctacaggcatgcgtgaccatgtctggctaatttttgtatttttagtagagatggggtttcgccatgttggccaggctggtctcaaactcctggcctcaagggattcgtctgccttggtctcccaaagtgctgggactgcagatatgagccactgggcctggtggccccctgtatattttttaaatgtcttcatattgtttactcatttttcaatttggttgtttggcattactgaattgtcctttatcctagattcatgtatatattttgagagtgtcttttgaagagcacacttaacttttgctttttgtgtgatagttaaaaaaatcattaccaaacccaagaacactaagattttctcatagctttacctttagaaggtttataattttagctcttatattaagtacttggatccatttcgaggtaatatttgaatacatatttctaagggtgaggtaagttcatttttttttttaaacgtactgctatctaattgtcctggcaccatttattgaaaaaaattacccttattgaagtgcctttgtatctttgaaaatcaatgggctgtatatgtgtgagtctcttcattttgtttcattgatctttctttacaccagtactattacttaaataatgtagctttataagtcttgaaaattaggagaagtgtaagaccttcaattctttttagagttattttggatattctacatcctttgcatctcctttaaaatgttataattagcttgtcaatttcgacataaaagggatgctgctggcatttctattaggatgcattgcagatatagatacatttgggaaaaactgaaaatccaaaacattggactcagtattccaatccgtgaacataggtatctctgcatttatttaggttttccttcagcagtgttttgtagttttcagtctcatttgttagatttatcactatttcatattttcgatactgtgtaaatgttactattaaaatgccaatttctggttgtttccaggtagtttatatacagattatttttgtatatcttgtttcctgtaacttggctaaacttaataggttctaggaacttttttttgtagattctgtagaattttctccatagacaattttgtctttgaattgagacaatttttactttccttccaatgtggacaccttttatttctttcgcttgcctgttgtgctagctaaaacttccaatacagtgttgaatggaagttttgagagtggacgttcttgtattagtaagtgtaatgttagctgtagtaaacatttaaataggtttagggaattcctttctgtattaatttgctgagggttttttttccttagtctgggtcttgctctgtggcccaggctggtgtgcagtggtgcagtcacaggtcactgtggcctcaaactcctgggctcaacctgtcctcctgcctcagcctcttgagtggctgggactaatgcaccactatgcctggctaattgtttggggggccaggggggtggagatgggatctcactgtattgactacactggtctggaactggcctcaagccatcatgccatctggcttcggcctctcaacgtgctggcattacaggtgggagccatcgtgcccagcccactgagcgtatttattaaggaacagaagttggattttgtcaaatatctttttctcctgcatttagtaagacagtcatacagttttccatataatgctggattacattggttgatttttgattgtaggaatcctagaccaacttggcattcccagattaaatcttactttgtcatgatgtattttcatgatgaataatccatgttggattattttgttaagaaaatttgcatctgtcgtcatgaatgacattggtctgtacttattttttaccttctaggctatttgtctggttttggattcacggtaatgtgggtctcatagaatgagttggaaaatgtactgccctcttcacttttctggaagagtgtgtgaagaattgaaattttttttttccttttttttttttttgagacggagtctcactccatctccaggc

SEQ ID NO: 11973 - DNA, 2532 bp, Homo sapiens; identical to SEQ ID NO: 11972

SEQ ID NO: 11974 - DNA, 126 bp, Homo sapiens
agtgattctcctgcctcagcctcccaagtagctggagctacaggcacccgccaccacgcctggctaattttttgtatttttagtagagacggggttttaccatgttagccaggatggtcttgatct

SEQ ID NO: 11975 - DNA, 126 bp, Homo sapiens; identical to SEQ ID NO: 11974

SEQ ID NO: 11976 - DNA, 3022 bp, Homo sapiens
gcatgcctaagattttcaggacagaagtcaagtgtaaatgatgatatattttgctcttctattagcatcccttttttttctgcttaaagttaaaagtcactttggatgtaaaaatgtaactaccacatcagccaggatttttttaaagccattgtgtactccaaagtctattttccctctgagtagatatggaagaatgagctcctaagagactagcctaatcaaatttaaaagcaaatgtaaatttaaatcaaccatgcagccctgctgtgtggcaattaacatttcaaggtaaaatgaaatgtgatgatagtaaataccagttctacgcagaatcggaaacattctgttccatggtatatttgggcagagaatggaaagttgaaaggaaaaccattattaacacaccaactttgacatttcaagatataattcaaacttgattagaacttccactaaaaataaagtcttctattaaaaaaatcacagtttcccccacctcataggctacatcacagcctctcaaccttggcactctggacattttggactatctaattcttaggggctttcttgtgcattgtgggacgtttaactgcatccctggccctacatactagatgccagtagtaactcaccttcttccatcattgacagctatgaaaatcaaaaatgtctccatataatactgattgaagaatttagggaactgggttactactcactaggcttaccagtccctaactgtgtgttttgtttgtttgtttgttttgggttttttgtggtttcttattcctcccgtatcatatttcaacttaaatatatgaggatttatagtagttttattaagctctaaaatgatctggttgaatcttcctattacttttttaaagggaaaaaacactatttcagagacagaaagtcctcgagggatggtctttgggggataagcagaaggaagtatgatatgaaaaaagggtttaaaattgtttgcagcaaaagcaaaactaccagagccatgcatattttttataagtgtcatccaagagtcggaatttttacagttgttattggttaccatggatattagtttgaaggacttggaaaagtggaagaggagggttgtgggtagtgggatgatggccataatacatttcctaggagtgttcaagaagtaaaatttacgttctatgtaatttgtataatttttctgaaaagaaaaacttttcaggtaaaacaggtattattatttataccttactgatcaggagctgtatagttctgagttaagtgactcacctaaaattatgatctagcaattacgttggctcaagcttcttttcttctacttagaaagtggaggaaagcatttgccttctgaaggcggaaggctcattgctaattttcagtgttcacaaaatctgctgctgtggtatttctggggcttctgacaaggacaggaagccacacattggtgaagcatccatgcattggcagcactattgctggataatggagattctaatttaatcagcctgagttagggaaagcacaatacaaatgaacactttgtaaagatgcttgatttgtcatgatcagaacagaatatccaggtagacctggtgcttcttcctttattgtgtttgttcatcctggtccttttctaagacatcagttgctcattgcccctttccccagatcatctgatgtgattgtgacatgtacacttggtgtgattgtgattaacaatagctggccagtgggcactgctgctgtttgcggcaaactcatcctttcttcctgatgagaaatcacttttattggacgttatccttaatcaccagtcaaatgagcctctcttgaaatctggcttctctgtaacctgctgctaccacatttactctattggcatcaaacagggtcgtatatcaatgcaagttaatttcttgaaatctgttaaagaggatgatcttttgctctgtagcatgcagattatgttggtaaacttagtaatacatagtaatacattggagttagcacaggaatagggcaattctgttctttttcttgttgcaaagctaggggacaggtaatttattatacacgtattcaccctgaataggtcagaaccatgaaatttaagaatccttcattggaggctatcaagtcattggggagattaaatctacattgtactttaatctgccggatggccattgccatcagtaaaatgtcggatctgtcggcattgttaatgtaaggggcaccgtctgggtaatcatcaactgaatgcagtgacaagtaattttattgaagtaccaagtaagaacttaaccctcttgatttttttcccttgaacccattttcttacttttgatggaatgaggacatttttagaaaatacagtgagttctatgtcagttttaaacaaaatgtttctcacccttacacctaaatttagttcatctgagaggatatgccaagaagaaaagaagaattaacagattaccaaaaaaaaaagtaattttacaaaatttaaagcactctctttttctatctttgctaagtcactatttttatagtaatcctttggagtatttacattttgcttctgaacagagagacaaattcttctcccaccacgtatgtactggagtcgtattaatccttgatattgctggaactaacttttcataatagaatatgttctctttcccttttagactgagaatttagtaggtaaaagaagaaatacagattaaactttgagcttcttaaataattcaagatgataggattttacaaaagcttagaagtcagatattaaaaatggaatctgtattctgcagttgttgtataccagtataagcttgatcacaaatttttctgtttataaaatataaaatcacaatttgatacatacgtgtataggcactctattcatgcttaggaaaatataactgtgaagtgaattgtaagtaattttgtaagtacttactatactgatatcagaaaaaaaaaa

SEQ ID NO: 11977 - DNA, 3022 bp, Homo sapiens; identical to SEQ ID NO: 11976

SEQ ID NO: 11978 - DNA, 2337 bp, Homo sapiens
  misc_feature (2199)..(2199): n equals a,t,g, or c
ggcacttctgaacctgtggggcaagggggtcttccctgggccccaagagtgcagagatgcctgggtccgcagcctggcagggcagctgcagctttccccagggagcttccgccctgccaactctgagagggtggggctcctacttgttgctggctcccactggttctgtggagcatgcagcaccagctgcacctcctcatatgctggggcaagggctctaagtccaacacatcatgcctgggcccagtgctaagctgctccaacatgtggagtctggctctgctggtagtggctggctctatgggggtagcatacagctctgtggtgatgtacgttttgctctgggtgccgctcccacttccttcccacttccttccttcaggggcccctgaagcacagcccacaacttgggcccagtccccacactccgtgtgcaagtgtggcaccaccttgggcccagctaaacctcagggcccctctttgcctactcctccatgcctgatcatgttgctgtcctgccgcaggcagctaggtctggccccatcatggtggctgccgggggtgggttcccatggtggcgaactccggggatgctcccaggggtgggctccagggattgcccacctcagtatctgcacctgatgacccttggtctgtccctgttccccactgcagctgacatcatggtagtgatcacttcaaacaggctgccgctgtcctcacatacaatttataatttaaattagaaagaaacataaataaacgacataagattttgaatataatctatgtaagtaatttcaaaatatgttttattatcttctccatgctagagaacattttattagtttatattttaactaattttaaaaacgtaaacataaaattacatgtgttgtcaagctaactcaatcgatgtttgagataaaaattaacctaagaccaaagtatattattttgatttccttagaggaaaagttatgcagtaattacttgaagagtaattctctctacaattagcattgcagatgcatccattataccactaaagtacacttaataaattaatacttaagaaattaccagacaccataggaaaaataaaaataaaaagccattttgaaaaaagtttagaaagtaaatcattcctagaatgcttggaaaagtatgtgcctgtgtgccagtatttctgatcctaagagttatgaatatcttatgaatagttatgaatatcactgatagtgaacctgagtgtaaatgcttgggcttgggttgcagatggactacagatacaaatctaaagtagtgtacctagtagcactgtaactcagttaagtacttacttttcatgccctcagtattttatctgcaaaataggaatgaaatagctaatcatgttatcataagggttaagttatgagatataatacctatgaagtacttaatgggtaacggaaaaaataagcttagcagttgttgttgttgttgttgttgacgaccttatttcaccatatacacttgttagtaactcaaaggggtttctccaaagtgaaatatttaaaaaacgaatgagataaattattattttgtaattagaaaatatatttagcaatttgtctcactggatcataaaactaattgtggtatgagaccatttataaaacacaaaccatgtatagttagtaagcactcataaatacttagataaatttagtctgtaatctacagccattaatagaactatcttaactaattgcaaaaagtaatgcgagagaacataatatagtctaacgataatttaaaaaggaaataatgttaagagaaaagagaagaaataagaaagggtagatcacgtaggagaaaatgctaagaataactccttttcaataatacacgtttcaatgtttatcacagacgtgctcttatgatataaaatgttattttttagtagcaaagataattttggactctgtaatcaaagtgtattggaatttaaattttaaaatgtcaccagactgatgacactggaattcattaaattacttaagattgtatttggtaacagaactactagtgaataatgctagttatattgcttcattaaatatatgtgatctagcttatctatatgaaagatactcaatttaactgcaaaatatattttttataatatttttcagctctatgtagagatatagnctgaattaattaatattattctcttttttttattactctcttacattttaataggttgcagtcaataaaatagccttggccttgaaatgcagtaatcatcacatcatcaaaataaaaacaataatgaaaaaaaaagaa

SEQ ID NO: 11979 - DNA, 1505 bp, Homo sapiens
ttttttttttttatttttataaaaatgtgttttattgttttaaaacaagtctataaaagtagaaatcacatacaaaagtacagattactctgatatgttggcaaaatagcttatggctggacttgagtttggaagttctgtatgtttgagggtttccggatgtcagagtccaaccggatcctaaccccagctcttgtcactaatctgtaaacaataatttcaagtagtatttagcactttttaactactaagaaattgaagcataatcatttcctttgcaacccaactttaaaatcttccttaggtctaagcagataaaggcacttcatactatgtttctaacattaacaatttttgatttaaaaaaaaacagttaatacaaatgacggttgtaggctttctttgtcattacattttgaacatacgaacaattcatcaatttaaactagtttttgtgattttcaagaagtagaatttggctgggcacggtggctcactcctgtaatcccagcactttgggaacccgagacgggcggatcacgaggtcgggagatccagaccatcctggctaacacggtgaaaccccgtctctactaaaaatacaaaaaaaattagccgggcgtggtggcgggtgcctgtagtcccagctactcgagatgctgaggcaggagaatggcgtgagcccgggaggcggagcttgcagtgagtcgagattgcgccactgcactccaccgtgggcgacagagcgagactccgtctcaaaaaaaaaaaaaaaaaaatagaagtagaatttaatcttttcacttctctgtaccagtttaaaaatatatatatcactgatggtatcaaaaagtcccacatctggattttaactcttatgtaggtataagtagtgcttactattgaaaaatgcatgggacatatacccgcttctattgtgtatttctgattgaagagatcatgcagttcctcttagggaactgtaggtctgataaccttataaatggatagtttcaaacaattattggtgagagagcattaaaataaaaaagacaatttaaaatacttgattccagagtaatataaaactaaccttaagaacctcagcgctaaaggaaaacagcaggcaacttcagaattcttccatccaaattttcaagaatagagagtggattaataccacctttctaaaccaaagctagtcattttaaaagctaaaggacccatgttaacataatttgattatcaagttagaaaaccacaattacatttctcatctaatttagattctggaaacacagtaacttaatgaacattacaatacttcaaattaacctgtcatagcaaactgtctgctgggccttcaaatcctatacccattctatacctctgggttttgcaatgtttggtcttttgtaagttttaaggtgaattacatggggttacttatttctataaacctaatttcaaatttaaaggcaaaatgatgatggagtttttttttt

SEQ ID NO: 11980 - DNA, 11724 bp, Homo sapiens
ctccaggacacagtggccctggaccatgggggctgctgccctgccctcagcaggctggttcccagaggctttgggactgagatgtggactctctttgccctttctggacccctggtaaggaggaggagctggggggcaggtagggagtggaggaagctgagaggctgagggtgtctgccttgcaggcaggatccagaaatgtgctcacattttccccagaaactgcccatgttgactgccaggtccagagtctggggacagcaggatggctcctgaaagctgtctctggacaatccccagtggcagtggggcctgactttgctcagcagcaggcagcccccacacagaaggggtgggtgtgcctcagctggaaacccacaaaagcctgagttggaagatggctccaggacaaatgggacccagagatgcatgaagcctgcagcaccttcgcagggggaagaaggggccggctacccatttcatttccaaaggggaaattgttttaaatacatttattttttctgatcatgaagaggaataggctgggcgtgctgcctcacgcctgttatctcagcactttgggaggccgagcagggaggatcacctgaggtcaggagttggagaccagcccggccaacatggagaaccccccgactctactaaaaatacaaaaattaaccaggcatggtggcgggcgcctgtaattccagctacttgggagagagaggcagagaatcgcttgaacccgggacgggtaggttgcagtgagccgagatcgcgccactgcactccagcctgggcaacaagggcgaaactccgtctcaaaaaaaaaaaaaaaaacaaaaaaaacaaaaccaaaaaggagtaatggaattgcacttcctgtaaaacttttagaaaaaaatgaaagatataaagaagaaagaaatttaactcaaatcctagtacttggaaatagccattactaagattttggtgtatttaattcccctccttttttgggggtgtgcggcctgaccaaattattgttataataggaactgcaatagcagtatcagacacttgggtcaagctcagggcgccaggcactgcgctgcgccaggcactgacccttctgggtagggacgtggaggccaggcgtgactgcagctgcagaacgcagaatgggagctgggctaggtcatccgacctccagccctggcttccccaggcgtaggtgacctctcggggcactggtgcggggccctcaaagctggagaggcctgtcttgcagggctcggctgtgtgggcacctgtggccccgagtctgacctggccgctgtcctccagttcctgttccaggtgctgacttttatgatctacatcgtgagcactgtgttctgcgggcacctgggcaaggtggagctggcatcggtgaccctcgcggtggccgtgagtacccagcttggcccagagcagggacgttctctccccaggcttctccaccgggttcccgggtgggcccgtcttgggtggctggtcagggatgggaagacacagcccacgtggctggacagctgccttcacaggtggaacctgagggccggagatggaggcggtctggccctggggcacacagcacatgaggctgctgagcagagcctctgccaccgctgcctgctgggcagcatttcctgaccctggctcagcccagatgcaggggcctctcttcaggcctcacctgacaagctcttgtttcctcctgtgtgtggcgccagtttgtcaatgtctgcggagtttctgtaggagttggtttgtcttcggcatgtgacaccttgatgtctcaggtgggtggcctcctggagctgggcaggaagccaggcaagggcagagccaattccacaggtgccatggagatggcaggtgggaggggcgcagccaggtgatctgggagcaatgggccctggggtcagctgcccctgccctacctccaaggaccacaggctgtcagggaaacagaccctcccctttgaaagagtctgggccaggagaaaggggtggagatggtggagacagttctctgatctcttgcccccagaggaggtcaccaagtagagaaagacaaccggttccccagcctcaatcctaagttcggctgcctacatgcaggcatgtgtcgaaggccaaggggacacagaaggaacctccctgcttgcaggggcctgcagtccagcaggggctgcccaggtggccatggggtcacaaagcggcaaggcctcacctctccctgggggttttagcttcacggtggacctgggctttgtcctggctccacttaacctgccgctgacatgtgatgaagccccatgtgccttcgtcctccttggagctttggaagaacagtggagacagtggtaggcccaggctcaggaaggccgctgtgccattacaggctgcgggcgccaggctgtggtcaccagaggccgccgggtccgccacacaccgctggcgccgctgacagcccgctccccgcgcgggatttaggaatgtcccgggcagtggaaacggctgacgcggggcgggctgttttgcagagcttcggcagccccaacaagaagcacgtgggcgtgatcctgcagcggggcgcgctggtcctgctcctctgctgcctcccttgctgggcgctcttcctcaacacccagcacatcctgctgctcttccggcaggacccggacgtgtccaggtgcgctgggctccggctggggaggtggggcttgctgggaaacccgggccgccgagggaaaccctgaagatgcccagccctcacaccccatgcttctctaggccacgagtgctcacagtgcacggtgcctgtgggtaccttccaggctttggtttggggattctccccatggctgcggctccagcagtgaccagcagggacagaggcggacaaacgcccagttttaatttagaaggcaaggcaagaaacaatttgggatttgcattttatttgcatttgtgtgcccggacacagttggagctttacagatgctttcgaagaaatgaagtgtgtgcattttcccatattccgaaaaggagaaagatgacaaccactttttgatgaattatagatgatgatgatgatgatgattattattattattattattattacttgagacagagtctcgctctgtcgcccaggctggagtgcagtggtgcaatcttggctcactgcaacctctgcctcccaggttcaagtgattctcctgcttcagcctcctgagtagctgggactacaggcacgtgccaccacaccaggctaatttttgtatttttagtagaaacggggtttcaccatgttagccaggatggtcttgatctcctgacctcgtgatccacctgcctcagcctcccaaagtgctgggattacaggcatgagccatcgcacccggcctatagtttattattaaatttattttataataaatccctctcatagggatgccttgttcatttatattatgtacatttcatttggttattcctttttaagatataacctttttttcttacgaaccacgttactctgaatttaagttccctcatcctgaggcctgggtgtttgggtgtttcggctgcccctcctggcacctgcttaccatctggaagcagcagcccctgatgctgaggtttcacagtcctggctgagaccctgggacagcggccgagcacccagtcctggaggacacaggggagagggccctgcctccccgggccacagcctggtcagctccggagcttctccctctcttgcaggttgacccaggactatgtaatgattttcattccaggacttccggtaggtgcccctgtttgctgagcgtggaatcacattcccctaaattctggctttttgctttcccactctatctgctgcggaagatccctatcctgctgtgacttcctgctgggccatgagggtgactgacaaaagttcccgttgcagttggtgcaaattgaatttaaaaaaaatagtataacatgtttttctgatttgaaaatgtttattggagaaaatacgaaaagcatgaggcagagaaaattcaaatcacctataattctaccacccagagagaacatatgttactatctctctccaggatttgattttttttgagatggagtcttgctctgtcacccaggctggagtgcagtggcacaatcttggctcactgcaacctccgcctcctgggttcaagccattctcctgcctcagcctctggagtagctgggattacaggcatgcaccaccacgcctggctaatttttgtattttttagtagagatggagtttcaccatgttggccaggctagtcttgaactcctgacctcaagtgatctgccacctcggcctcccaaagtgctgagattacagatgtgagccaccgtgcccggccctccaggattatttctattcacgggtgtgtgtattcaaacacacacataaacacaaattggaatgggatcagtatgtgtatattgggttataatacgctttttccctttaaaatatgtcattagtctctttataggactaaataaccttccacaatattaattccaaaggttatctggtacccatagttaggccataacttattaaccaatctctatttataatacgaactattataaataagatttgtggtaaatattcttaaaaaaaaatctttgtgaatcatcttacagatggttttcaaggaaactatcaattacagaaatgcattactggaagtggacggctcagtgaatggctcttgagacatattgccaaactaccaatttctactcccaccagcaaaaacttccactagcatagactattattattaaaagatttcttccaattagaaatagtattaacatgcatttcttttttcttttcttttttttttttttttttttttttttttgagacggagttttgctctgtcatccaggctggagtgcagtggtacgatctccgctcactgcaacctctgcctcccagattcaagcaattctgcctcagcctcccgagtagctgggattacaggcacccaccatcatgcccagctaatttttgtatttttagtagtgacagggtttcaccatattggtcaggctggtctcgaactcctgacctcaggtgatccactcgcttccacctcccaaagtgctgggattacaggcgtgagccaccacgcctggcctgcatttcttttactgataatgaagttgaacattttctcatgtacttattatgtgaatagctcttcgcttattttagtgggttaatctttttctaagtattgtacttcttattaaataatatcttaatcctttgtctcaaatattttccaatttgtcgtttgccttttattctgcttatgtttctgacttaaagaattttgagctgggcgcagtggctcacgcctgtaatcccagcactttgggaggctgaggcaggcagatcacctgaggttgggagtttgagaccagcctgactaatatggagaaaccctttctctactaaaaatacaaaattagccgggtgtggtggcgcatgcctgaaatcccagttactcggaggctgaggcaggaggattgcttgaacccaggacgctgaggttgcagtgagctgagatcccaccattgcactccagcctcacaagagtgaaactccatctcaaaaaaaaaaaaaaagatttgtgaatgtgtatgtaagtcctattccttatgtctttaacgagcttaaaagacttaacccagccgggcacggtggctcacacctgtaatcctagcactttgggaggctgaggcgggcagatcacctgaggtcaggagttcgagaccagcccggccaacatggtgaaaccccgtctctactaaaaatacaaaaattagctgggcatgatggcgggtgcctgcaatctcagctactcgggaggctgagtcaggagaattgcttgaacccgggaggtggaggttgcagtgagccgagattgtgtcactgcacttcagcctgggcaacacgagcgaaactctgtctaaaaaaaaaagacttaacccactgcaagattatatacacatttgcttatacttttttggacccttccagggtttctatttttacatttaagatattaatccaactaaaatttttttgaacaccatttattacatattctctcctttctgcattaatttgttaattaatcaacagtacatctatctaggtcagtgattgtatgtccagtgacccggggatctgtatgtctcttctgcagcccagtgcttcactgtttgacttgcagcttagtgatgcctgttacgactggcagttctgtgtgctagacagccctaccaggctcagctcactttctgacagtgtagcctccatggcaccagggggaatgtttggggcaagggagctgggcagggaagaggtcagggtgaaggtggggtgtcccaacagtgtgcagtcccagcagacccagccacacccacctctctgccaggccagtgccatgacctttttggggcctagctggttacagatttttttctggtttacggaaacccccttatagggctgctcttctcctctgagtcttccacataatccatactttggcttttcagaccgaggtgatggcatcttgtcaaccaggatttttggggctgggtcggggggaaatgccctgtaaagatgtcactgtggtgtcttctttgtcaagccaaagtccttccataaaatgcagctgcaaaagttaattgccaataatagtgactaataacactaacatagttatgttagtggctaacacttggaatgcttaaatgtcccatatatcatttggtaagcactttgcaatattaactttgcaatatttatgtatgtaaaatattaagtgtatattaagtacacacacacacactattattatccccattacagatgaggagacaaactcagggagattaagtaacttgcccaagatcacacatctcagaagaggcagagccaggaattaaacccggtctattccagctctgtactcttaatcagtacactatgctgaaaataagtgaagagctacaggaaggaatgggacaagggccctgggctaggtttcagttgatgcctattctattccccttaagagaggagagaaagggtaggtacagtgccccccaacacacacactgccacgtacactcccctatggtcctccccagccagggaagggcccgccacccccgtagggtcttgaacctgcttagcataggctgcccacggccagcatgtctcagtacctgccattccctcgtccgaagtcacaccttcaaatcctgtctctaaggccagaaccaaagtgggcccttctgtgaacaggtccttgggtcacttctcaccttcctaagctgatggaagcctggcttagcagccggaaggcctaccaggcactgtgcactatgagcatgtgtgcaaagagtactctctctgagccaaagcatgcctgctcatctcccctgtggcagaagggagccctgagggggcctcttccataggctgggcccgagcatgagtccaggtggctgggtaggctttggccgcacctgagaggtcccagacatactttgatgaagtaatttccccaatctggggtactatgtcctggaaaggaatgtctgttaatgctcatttggtgagttttggtcattattgttgatttgtttgggtttgcttttcatacaggtgatttttctttacaatctgctggcaaaatatttgcaaaatcaggtacaggtctttggtgtgtggggaggcccttctcccagcacactgccctattccagtgggaggggggcctggggctttccccttctctccaccatctgtgaaccagctcttgaaaggggtcacttccaacccacctgccatatcctgacctcccgcacagaggcaggtgagaggctgtgcgtcccagcctcttccaactcctcaacagggatggctgaaggggcaggaggaggagtccccattccaaaccccgggtttgtccatcctccatccatctcactcacaccttagcagggccagttttcatttatttcagaagatcacctggccccaagtcctcagtggtgtggtgggcaactgtgtcaacggtgtggccaactatgccctggtttctgtgctgaacctgggggtcaggtgagcccgggggctggtggggcctggtcaggggacactgcccactgagctctccacccctggtggagacagatcagtcaccatcctggccctgcctgtgccgtcctgaagtggagggttatggggagttggaggggcctgatggtcccttggggacctcagtttgacgcttgattgggtgagaggacagccactccccgctcctgcccaagcccaccaggagaggtgaagtgggcactggcaaggtggcccccaggacactgtagtcacggctgccttggtagagccaccatggccagaggtgcctgtgggccctggttgagtctgatcccaggatgggggaagagcagagccatgcctgccccacacgggctggccgccagagccacctctctctcaggcagggcggtggcagagagttggcatcagtcgcagccctgttctccctccttacccaggggctccgcctatgccaacatcatctcccagtttgcacagaccgtcttcctccttctctacattgtgctgaagaagctgcacctggagacgtgggcaggtgggaggcctggcctgctctgggaggctgagcaggccagcggtggtgctgccctagccttggggcagggtggtcagcaggcagagggtgcagtagagcctgttggaggaggtgcaggaccctgcacggccccctccttcccctttgcttccccagccccaagggcccagagtccctccacccaaggtgtcacgatgcagagccctgctgggtccatcacagaagcctggcccagggagctttcttgcccagcctctgctctcaggatggcggtgagagcagtgacacccgtggaataccaggcgtcagcagtgcgtggggtgcctgacattcctgaattcatttaaacctcaccccacctcattagccccattttacaaagaggagattatgacagacggaggttaagtaatttgctgaaacagcaggcgtgtaggggcctgcctgtccttttctgcctcttgagagccaatcccatacaaggaccttctcctgccaggcatttcaggaacagctctgcaggcccctggggcctcatgtggggcagggccctggctgagccccttccaagcttgcccagtgcacctgtggtgtgtttcccttcagcatccttgatctcatgccgcctctgaaaactccccagggaggcagggcagctataaggcctggggttttcagatggaaatggagcctgcagagtggtgggtggtggagtggggaccaacacccatgccctgagccctggggccacaccgtggactggccaggtgagcctggtgccctgttcctgcatcctcctcctccgtaggccccaacaccagctctagaccagctgcattccctctgcaaaatgcccagtgcctgagcctgctaagccccagagcaggaagagccaaaggggtttaggggcctcctggcagtggggagcaggaatgaggtgggcaagcagggcaggctgtcagctcatggggcctctgtttccaggttggtccagccagtgcctgcaggactggggccccttcttctccctggctgtccccagcatgctcatgatctgtgttgagtggtgggcctatgagatcgggagcttcctcatgggtacgtggaagaggatggggggcgcaatggcgtgtgggcggctcacccagcccagaagccccctccccaggatggcggctcacccatcccagaagccccctccccaggatggcagctcaccagcccccttccagcttcactggccaggccctcaggcttggacccagagaacaccactgcccagcggggctgatccgtctgttgctggtctgcctccccagtaggctgtgagcatccaggaggcagacttgggccttttgtgcctgaatcccagcatgggccaggcagagcaggtgcccgtgggaggtggctgaggcacggaggagtgagagattcagttggtttgcgggtgtgagcagaggtccaggcttgccagtgtgaggctcccacctgctgccttgtgtgtgctcattagagcactcggtgaagtgaggactccaggcagcctgaatgtgagaacccctgccctgccccgcatttgcagatgagaaaacggggccccaagaacacaggaactccacaaatagaaaatcagtgggagggccaagaaccgaactcgagttgccggaccctggtcctgttctctgtcccctccctcacactgccaccctgagttcatctggaaagacagaccacacagggaagcctgcaggggcctccggggcactgggcagaattttcctaacaggctgaaggccaggcaggaatgtctttttgttgtcattgttaccaatctgcccttcaaaatcagccgggctcagtggctcatgcctgtaatccctgcactttgaaaggccgaggtgggtggatcacttgaggccaggagttcgagaccagcctggccaacatggcgaaactctgtttctacaaaaaaatacaaaaattagctgggtgtggtggcaccacctgtagtcccagctacttgggggcctgaggtgggaggatcacctaagccaggaggtggaggctgcagtgagctataattgcgccactgcactccagctcaagcgacagagtgagaccctgtctcaaggaagaaaaaaaaaaaaagcccctgagtccccaaagcaaagcagcgtcctgtcggcgcagggtctgggtgtctggggctgcgggccggactcacggcgggcctcttctctagggctgctcagtgtggtggatctctctgcccaggctgtcatctacgaggtggccactgtgacctacatggtaaggctcctgcaggggtgccttccccacatcccccacctgatggctggaggtgtcataggaggggggcaggctgtcacctgaagctatctctgtctcccgaaggaccctccccgggcctctcgtgcccaccaggtccagaccctgctcagcttacgccaggactcacacacaggtgcccacaacctgacgaccaagggtgatatttcactcacagatgttggaattttaaaaattaattagtatcattttaaaattgggagatttcacatcacaatcttatttttggattttctttaaaaatgcacattccaggctgggcgcagtggctcacgtgtgtaatcccagtactttgggaggctgagggcggatcacaaagccaggagttcaagaccaacctgggcaatatggtgaaaccccatctctactaaaaatataaaaagttagccaggtatggtggcacaagcctgtagtcccagccacttgggaggctgaggcagaagaatcacttgaacccgggaggcggaggttgcagtgagccgagatcgtgccactgcactcaagcctaggcaacagagtaagactctgtctcaaaaaaaaaaaaaaaaaaaaa

SEQ ID NO: 11981 - DNA, 506 bp, Homo sapiens
ttttttttgtatttgtcctgcctcctctccttcagggtctgctccttcctcctcgcggctctgggggctgcatctcggaatcctgccggccactcctccgctgcaggggtggacatgggaaccaagtggggcctttgggatgtcttcagccctcccacagccactggccagcctgcctgctgtcttcctgcccccctcgctcactcctccttctcctgggctgaaccacacccaaaagcttgatccaggactgggctaggtgaccggtgcaatccttagatgcctctcttggttcccactgccctgctggtcttgaggcaggttgaggggggagtcacaggccatccctgcaaggaaaagcagagagggcaatttgggaaggtgacagaggaccctgtgggacgtcgagtcacagccttgctgggcacagtgactggcgtgcatagtgagctgctttcccaagcactgccacccctggctctcagatatgctgctgaaaggggtga

SEQ ID NO: 11982 - DNA, 364 bp, Homo sapiens
gcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggtt

SEQ ID NO: 11983 - DNA, 247 bp, Homo sapiens
tgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcgctgtgtcgtcgaatttctgccattc

SEQ ID NO: 11984 - DNA, 776 bp, Homo sapiens
  misc_feature (39)..(39): n equals a,t,g, or c
  misc_feature (68)..(68): n equals a,t,g, or c
gaaaaacgttcttcgggggcgaaacctctcgaggatctnaccgctgttgagatccagttcgatgtacnccactcgtgcacccaactgatcttcagcatcttttactttcaccagcgtttctgggtgagcaaaaacagacaggctcaatgccgcaataaagggaataagggcgacacggaaatgttgaatactcatactcttcctttggcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagtcaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgta

SEQ ID NO: 11985 - DNA, 686 bp, Homo sapiens
  misc_feature (592)..(592): n equals a,t,g, or c
ggtaccgagctcgaattcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaagaaccgtaaaaaggccgcgttgctggcgtttttccataggctccgcccccctgacgagcatcacaaaaatcgacgctcaagtcagaggtggcgaaacccgacaggactataaagataccaggcgttttccccttggaagctcctcgtgcgctcttctggttcgaccctgccggctaccggataactgtcccgnctttcttccctcgggaagcgtggcgctttctcataactcacgctgtagtatcttaatttcggggtagccgttcgcttccaaactggccttggtg

SEQ ID NO: 11986 - DNA, 878 bp, Homo sapiens
  misc_feature (138)..(138): n equals a,t,g, or c
tggttagtactcaaccaagtcattctagaatagtgtatccggcgaccgagtgcttctgcccgggcgtaaatagggattaataccgcgccacatagcagaactttaaaagtgctcatcattgaaaaacgttctcggggncgaaaactctcaaggtttttaccgctgttgagatccagttcgatgtaacccactcgtgcacccaactgatcttcagcatctttacttttcacagcgttttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttc

SEQ ID NO: 11987 - DNA, 845 bp, Homo sapiens
ccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaacccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaatcccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtctcgacgttgtaaaacgacggg

SEQ ID NO: 11988 - DNA, 364 bp, Homo sapiens; identical to SEQ ID NO: 11982

SEQ ID NO: 11989 - DNA, 288 bp, Homo sapiens
aagagtccactattaaagaacgtggactccaacgtcaaagggcgaaaaaccgtctatcagggcgatggcccactacgtgaaccatcacccaaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaat

SEQ ID NO: 11990 - DNA, 288 bp, Homo sapiens; identical to SEQ ID NO: 11989

SEQ ID NO: 11991 - DNA, 1308 bp, Homo sapiens
ctcaaggatccatttgccagttgccctgtggtcttatgggatccaggcacactcatggcagagcaggcccctgctgcaggtttgctcatctaaagctacaagatgagcaggcccaccttcgcttcatttataaagtatatttggtcactacattgtatgagaagctgcacagagggggcaagttggatcagatttcattataaacatgccttacaatattggttattttacattttattttattttattttattttattttattttatttagagacaaggtcttgctctgttacccaggctagagggtagtggcatgatcatagctcactgcagccttgaactcctggactctagcgatcctcccacttcaacctcctgagtagctaggactataggcatgtgccaccacacctagctaattttttttgttttgtggatatggggtctcattatgttgcccatgctagtctcgaactcctggcctcaagcggttctcccacctcagcctcccaaagcactgggattacttgcaggagccaccttgcctagcttcaatattggttattaataaggaacagttaagccccattgctttacaataatgctgtagaaatgcttcatatttaaaatgtattatttaaggaatgtaccacttacctgtaattcctttggataaagatactgtttttactagtcaggccttagagaaactgttgtttaagtgaaggaaaaccctgggtcactctgagggcaagattagagctacagctgcagttaaattagtcacacaatgttcctggagcacttacttcagtcagcttaatcttggtttaagtccgccttccaagcctggggccaaggaacaggcaggccaaagcccacccagaaattggagacactgagtgtgtctcctctgccctctttgtcactgggctcatggccccctggcatcatggccccagttccattcccacctgtgtgtgcagagcaacagagtccagatcgtgaggaacgtggtggagaaggcagaactctgggcatgtctctgcccagcttacaacaatccctgtctccccctggcgcccttcacaagtccccttttccacccttgcttgtcctgccattcttgccgtcccctcctgccccagggagtcctgctgcccccggcctgttcttacactcaaacagtcccgccttctcccactctgcccactgccagcagcagcctggggctccatgctcacttccaactcttgcggatcctcggtctgagccagaggtcacctctggcagggcatctgcactct

SEQ ID NO: 11992 - DNA, 3958 bp, Homo sapiens
gccgggcgcggtggctcacgcctgtaatcccagcactttgggaggccgaggtgggcggatcacgaggtcaggagatcgaaaccatcctggctaatacggtgaaaccccgtctctactaaaaatacaaaatattagctgggcgtggtggcgggcacctgtagtcccagctacttgggaggctgaggcaggagaatggcgtgaacccgggaggcggagcttgcagtgagccgagatcacgccactgcactccagcctgggtgacagagcgagactgtgactaaaaaaaaaaaaaaaagagtggtgcttcaaaattgtgtctttttcaacgtttgttgtctctacatggtaaaatctgaatttaggcctaattcaaaatccatgagattgggaatgggattgggaatctcattatttgcattaatgtatgagactctctgagtaagtgttggtttaagtaaatttttttcttaaaaaactcagtagaaatggaactcagattttaaaatggactttaaaatggtctaaaaagtgtttctaggtacaaaatgaattggagtttacctattttttccaaagggcaggtagcaggtctgaagtgagagagggaaacgttcgatgctgcgttgttctgggagatgtgagccgccggctcattcagaatgtgcagggatgtccattcccacaggagcatgtgtcgttcagccaggtgcatgttttaccttgatctactgtgcttggagccttttctttcccagatctaggtctgatacctgcccctcctccttaccctggactgtaattaaagggaatatgtggaaatccaggccacaactattttactttctgtgaataaggccatcaagttgatggcttgttactgtgggtcgatgggtcaaacatgaggcaatttggggaaacagcctaaggtggctataccacagaggccagcagagcaggtaaccaggcacaagatgcgatcgctgacgagagagctgctgtgacagagtaaggagtgcatggggaggagggaccactgaggtttgtctgcgtgtgggtaccccatgcgcagatcctcaacagccgttccaaggaagtagtcatttgggagatgaagggggtgcaggtagaggagtgggggattgagacagggaggggaagccacctagctagtgaggtttgtgtagcaagaaggtaaccactcggagcacctggagtttaatccttaaggagactgctgagaaacagagtggtgcacacttagggttattttactgagaggcaggagatgtagacagcgctgggggatgtagacaccacttgttaaaatctggcagaagagaatttagagaagaaaggtattgctgtgtggtaagagcaatgacttggtcaggatgagggtgggcatggagctctgaggaagggacgtacagaaaccaggacagaactctagccattatctcctttcttctagcgatctgacaaggtcctgctagatccttcactagactctagggcaggcttctacttagtacaactgataccaccgccatgcagccatcatggcccctcccagggcccatttgttagtaataataataataatgcttaagaagcattgagtcctaactgtgtgtcctataaactatcataacccgtatagtcttcataaagatgccttcaaggagacactcttattatccccattttacagggagaaaaaaatgagcctacgttcagcaattttaagcaaattttctattgtctcatgactagtaaatagtggaataggccagttttgttttttcaccttgactgactgcaaatgtctcagtcatgattcctgaccatcttctaaccctctaaggacccagacactcctaagtagttaaagagtctgacgttatcaatcaatggaaatattttcaaaaggtaaagagaaaagaaattaaagttatgatgatcttttaaggcaaatcctgctttcttgaagcttggtcagccctggcacaggcaaaagtgcatgtcatttcaaggcatggggcaggtgaaatggaacacggctgtcctggcgtccacaactcacaggagagtggagaatgtggaagttacatgctccatttagacatcagtgttctctactacaaaatcgtttctgcagttcattaatcagactctccaaatttgtttaactcattatttataacagcattaaatccagtgacaccaaacggtgtcaccatgagtatcaggaagtctgattttaatcctcagaaaatgtgttcaatgtctttccctccctcctccacacttaacagggacagtgaatggaagccagtgttaaatttgcacgatgtgcagtggtctaaactttcactgaatcctaatcaacttaatatcctgttgcctttttgaaatccagtgatgaaatgtaaccctgagacagcttaaacagaactcaagcctggatgctctctgcaaaatggtctaatttggtggttatagcgctagtattgtatgtacaatgatcaaatcctgtgttttcaattgtcctttttatggtcaatcaaggcggtcttaggatatagatttaatatcgcaagagtctaatgtaacaggctaatgcatgccctccagttacagggagaatgtctttttgtgacagtggttctctgggtacgtcttacaggcttctatttttgaacttgactccaagggccaaagcagcacattttggaaatggttttgtaaactgtaacgaaggtatctttcttcagcagcttcctgcccaaagacgccagagtgctttacaaacttatcaaagtgatatacagggatcgttttagcctctgctgaaatacaggggcccaggggggaaattacagtcattgttgaaaaatcttagattgtcaggtcgacaggaggagggagagtgtacagcacctaaaatatcctcccaaactggatggcatgtcccaagggctgtggtcttatctactgcctgctgcaggtgacgtttgtgaaaggggtcctgtgagttttgatgattgtctctcttagacatgctggtaatacagctccttgtaaagctgattcttcccttggatttgctcatctcatatcagagactttaaggtaccctctgacatacaccctctacaaaataggcatgttgcattttttggcatactagaccatcagaaggggaactgctatatcacagcctctggaatcctggctaactacagggaagagatgtctgaattatagcagaacatgaaagaaggcagcttgtgctttaaaggaggtgttcaaagcatgtctgagcagagacttttgggctctgttttaattaatactttaaaataattcatatttaaaatatcagatgtttccataaagaggaggatgtttaaatgcctccagactacattcctttttattcttgattttacctgggagtccaaagttcaattccataaagcaagcgtttatttgtcactttcaatatacatcgattgccatgcttaagatgcaatatgggctgcggaaataggttaacccacaggctcccagggcccagtgtagaaggtgagagattcgtgtaaaatgattcaaataaaaggaagaccctggccgggtgccgtagctcacgcctgtaatcccagcactttgggaggccgaagcgagtggatgacgaggttaggagttggagaccagcctggccaacatcgtgaaaccccgtctctactaaaaatacaaaaattagccgggcatggtggcaggcacctgtaatcctagctagttgggaggctgaggcaggagaatcgtttgaatctgggagttggaggttgcagtgagctgagatcgcgccacagcactccagcctgggtgacagggtgagactctgtctcaaaaaaaaaataaataaataaagtaaaaataaaaaggaagaccttga

SEQ ID NO: 11993 - DNA, 9456 bp, Homo sapiens
gaacgtgctccgcgggctcagtccgcccgccgctgcgtcccggagtgcaagtgagcttctcggctgccccgcgggccggggtgcggagccgacatgcgcccgcttctcggcctccttctggtcttcgccggctgcaccttcgccttgtacttgctgtcgacgcgactgccccgcgggcggagactgggctccaccgaggaggctggaggcaggtgcgtggcgggaatccgggttcgggtcagaggaagggagccgggtccgaggaccggggctgggaatcggagattcggagattcgggttccggtatcggaggcgttgggaattgaggttcacttatcggactggaatccgggtctggtatccgggcccgcgtccgcacggtctcggacagaagggtggatgggagcccggctccgggcctgactgggacctgtgtggtgctggctgcagggtgtgcagggcgtcacgccgcggtgcctttggttgggtggatttgccgagggagacgcggcgctgagcctgcccgcgccgttgctttcccagtcccagccctgggccccatttccagcccaccttcgcccccgtgcgggcccccagcctcttcaagtccactttcaactgtctctcctcctccccaccccacttacgtcaggtctgcccttgagactttagacattagatcttcaggagaaatattgcatagacaactttaaattattcacgaattaattatcgactctgcccgtcttcctggttgtctctacttttaccttttttttttttttttctgagacggagtcttgctctgtcacccaggctggagtgcagtggcgcgatctcggctcactttaacctcctcctcccgggttcaagcgattcacctgcctcagtttcccaagtaattgggactacaggcgcgcgccaccacggccggctaatttttgtatttttagtagggacgcggggggggggtctcattatgttggccaggctggtctcgaactcctgacctcaggtaatccgcctgcctcagcctcccaaagtgttgggattacaggcgtgagccatcgcgcctggcctccttttccccttctaatgaacgactggtcgaggcaggaggcagagcaatacttacctggccggtttttgtgagtgctgcatactctttataaagtgcatggaagtgtgcctagtacagcattgcgtggttaagggaattactgatatttgactattaaggcagctgttttcagttactgtattcttttgctgtagctaagaaggctctgctgtgggtgtcggacataccgagagaaactctcgtgagaagtaggagggtttgctcatgattaatcagtgatggattcaaggactgttcagatggcagaggcaagatagccttgctactataacccttgggcaggattcaaagtgcattgaggaccagattaagagcagagttaaatagtaggctctttgaaagggttcgattcaagcctgacatattatcaaaaaagttacatttatcctatgggatagatatactttcctgaagaatctctaattggctttatagtgaatgctaaaaagtcgttttacttggcacctcaggaacagtttgaagtctgaattgttcttggtttgtgggggaggcagtgtccttgaaaggaaggcaatttgagacatttagaacttgcctggaaatgaatccatttgcctcttaagaacagattctaaaatcccagagctaaaggggaacttaatgactgtttagcaccaacctctcactttttagataaggaaagagactcagggactagtccaaggacgtaaaacagaaagtagcagggttgggatgctaacccaggtctcttgcttccaaactagggctctcctgtctgtctccgcaacgtcgtatcaggtcatctgtcattgggagtgtatgtgttcccagcagatcagatgatgggcatatttataaacctactctgaaaagaagacacagcgagtgactttcatgggcactggactgatctgaactcatgtttccatctgcttttccaaatccccaggtcgctgtggttcccctccgacctggcagagctgcgggagctctctgaggtccttcgagagtaccggaaggagcaccaggcctacgtgttcctgctcttctgcggcgcctacctctacaaacagggctttgccatccccggctccagcttcctggtcagtgtcctgccctccctccaaccctgtttccttatctgtaaaatttggatactcccctgtaacctcatgggattgttgtgtggggatgattaaaagtgacagtgggtgtatcggggctggcacacagtggccctcagcacttacggagggattgagcaccgaagtgggagacactgacagcttccttttgtactgcttccctctcccaccccagcctgtttctctcctctaggctgaggctggacctgctcaaacagtttccttgtcggaaactagaagaaaagcaaacatgtccaagagaggcaggggaggtgtgtggggctcggggtcaggggctgactccttgaggctgccctgtgtctgtcttctgtcttgaactgatccctcttcagggcagagagccagctgctgcttggtgggggctccacatccagacctgagggtgaaccctgactctgcctgctgtgctcttggggaggatacttaatctctcacctgtagaatggggcaaggatggcatgactcagggatgtagtgaggattacacaggacatgtagtcaagcacttaacacagtgcttagcggctccccagcttcccacttccaaggcttccttttactttctctcttggatcccatgttttgtcaggatgatgtctaccaaccaaaatgcatttaggaagtattggttcacttttccctttttcttaaaccaagacatcttcaaatgtctgctagagctctggtcaacatggaaccccggtattaacatactgcatagatgtaattccagcaaaaagcaaagaaacaagacatcttacatagcttgtgtggtcttaccaagggaaaattcatggtttgtgttcatcttttgaaatagtaaaaataactcgtgagtttcatttctactttcttggagccccagtcattgcagaatctaccacagccacagatcccatttcattctctcctgccccctgaggcttttatccttatcctcattttcaaggtgaagagactgacggcaggtgtagttcccagccttttcataatttttcattcacctctttaaatggcaattgggacctggggcagtggctcacgcctgtaatcctagcactttgggaggctgaggtgggaggatcacttgagtccgggagtttgaaaccagcctgggcaacacagtgagaccccatctccacaaaaaattttaaaaagtgggtgaatgtggtggtgtgtgcctacagtcctagctgcttgggaggctgaggcaggaggatcgcttgagtccaggagttcgaggatgcagtgagctatgatcatgtcactgtactccagcctgggtgacagagcgagatcctgtttcttaaaaataaataaataacgcaattgggttttagctggaaaaaagcagtgaaggaggagggaacctatgactctcaggctccaagatgacgtgcctggtagctgccagatgttcacatgcctgagggtttgttttatttgcagaatgttttagctggtgccttgtttgggccatggctggggcttctgctgtgctgtgtgttgacctcggtgggtgccacatgctgctacctgctctccagtatttttggcaaacagttggtggtgtcctactttcctgataaagtggccctgctgcagagaaaggtaaggggaggggtcacatctgagagctgggaccccagacagtcgctacgtgcatggccttgagagaagcgagtggcagggatttcccacagtactcttccacgctgtttcaggaggtcctaggggttcttttgatgtcttcaggagacatagacctgggatcaaatcccagctccatcattaccagctctgtgactttgggcaagttcttgacttctctgatcctcagcatgtctattttaaaatgaggaaaacagtctttccctggagggttgttggaagaattgggaacagattatgtaaagtgtctagaacagtgcctggcaccagcaggttttcaacacctggagaccctttctgcttcttaacagctttcttctctttggctacaggtggaggagaacagaaacagcttgttttttttcttattgtttttgagacttttccccatgacaccaaactggttcttgaacctctcggccccaattctgaacattcccatcgtgcagttcttcttctcagttcttatcggtaagatgctagtggggtaggtttgagtcttcagagctgtcacgctgggggtctgccctgggttattggccacgtgagcatgtgcctgcttctgagaacacaggctcacaaagtgtgacttcaagccttatgatctaaagaaatgattcctgatttcagatctgctcaggcttcaacatgaaaacccataaaaatacttttggactaaataaagattgtccattgcatggctgtatgcactaggcactgggattagaagagatggtctgtgtaaagtatacaaattggcccatagtaagtactcagtaaatgctagcaggaagagcagggttggaatgagggtgtgtgtccatgagttttgagtggggacagaagaaaggagcagagcaagggacttcctgtctggtttttggcccctgttttgattaagttctgccttaggaattgctggcatcagtgtggttccttcctgccttttgacaattgcacaacctgcagcaagctacttaccctcaatggaccacctggctaggaatagagcagtgtttctcaaagtgtgggctttgggccaccttcatcagattgttagggtcagggggcttgttgagaatctagatttggggcctactccagacctactgaatcagaatcttgggagtggaatctgggaatatgcattttaatccagttcctagtcagtcattttcaaactgcaaacccagtcattctcaaactgcaaacctattaagaatcgcctgcaaacctattaaaaatcacttggaggccgggctgagtggctcacacctgtaatcccagcactttgggaggttgaggcgggtggatcacttgaggttgggagttcaagaccagcctggccaacatggtgaaaccccatctctactaaaaatacaaaaattagcctgacatggtggtgtgcgtctgtaattcaactacttgggaggctgaggcaggagaatggcttgaacctgggaggcggaggttgcagtaagctgagaggatgacacttcactccagcctgggtgacagagtgaggctccatctcaagaaaaaaagcaaaaaaacaaaaacaaacaaaacaacaaaacatcacctgtggagattttaatccctaagctaaggctacaccacacatcaactaaatcatctctggggtaggactcagggatcaggatcttttaacattttccaggtgatgcaagtagttagtccctaaaagggattccgctggatcctgagttttgcagtctactgaattagacgatatctaaagtttctccttgcctttgacaattatatgacctgcagcgagctacttagtctgaacgggctactcgtccagataaggggctgggactagagcagtgtttcttgaagtatgggccttggaccacctttatcagagtggtaaagtgctaacatcctataaaatcagtgtttgctactttctccatactggaagaaaaccaccctccttaagcctaaggcaaggatctcttctcttaaacctcccttagatcctagagggaaagacgattcagggcttctaggtcaaacagagcaaatctgtggttgagcagctgctattcataggagatacctgagagaaatggagatcttaaatagaagcaagatctaccacggccaattttggtcatattggctttcagacaaagtgcctcaggccctcagctagtgggggtttgctgcttctaattacctaggtggcatgaggcttggcaagattctggagaccaggcttcctgtcctctgtctcacaagctgtgtgaccctgaggggtctgggatcttcatctcctgtatacttcctctcctatagaagagaaatggactatcagagtgttccaaaccaatcggaatctcagggtgggagtggagaaggggcttttaaaatacaggttcctgggcactaccccagaaccaagtacccagaatttctggggtggagcccaaggatgtggttttttaacaatgtcaccagctgattgttctgcagccagcctgttcagccagccagacttttggaatccagtggatttgatgacatctttgagacagtacagaatgtgaatagtacttcttttaaaaaactgtttgtcaacaatggcacttctctctttactttggctgttgggtactcagaaccaaatttggggcccacttttggcaaacaggtgaaccttatgcatttttttactaactgtactccctgatgtcttgtattcttctgcacgcattttgcttttcctatttaaaattttatttatttatttatttatttttgagacagagtctagctctatcgcctgggctgaagtgcagtggtaagatcttggctcactgccacctctgcctcccaggttccagtgattctcctgcctcagcctcctgagtagctaggattacaggcacatgccaccacacccggctaatttttgtgtttttagtagagacggggtttcaccatgttggccaggctgatctcgaactcctgacctcaggtgatccacctcggcctcccaaagtgctgggattacaagcataagccaccattcctggccctattttaaaattgtcttatagtagcatgtattatttgtgtaaatatctcaagttcttttgttgaacaagacaggcatatatgggaagtgaggaaaggagggaaaataatagaaaagaaggaaagaagggaaagagttaatatgtataagggtcaagagtcaagcaaaaaaaaaccgtagtcactgttcctggtgacattctgaattattattttcttaattttgctgctgcttgtaacaggtgctttgtccttttcttcttccaggtttgatcccatataatttcatctgtgtgcagacagggtccatcctgtcaaccctaacctctctggatgctcttttctcctgggacactgtctttaagctgttggccattgccatggtggcattaattcctggaaccctcattaaaaaatttagtcagaaacatctgcaattgaatgaaacaagtactgctaatcatatacacagtagaaaagacacatgatctggattttctgtttgccacatccctggactcagttgcttatttgtgtaatggatgtggtcctctaaagcccctcattgtttttgattgccttctataggtgatgtggacactgtgcatcaatgtgcagtgtcttttcagaaaggacactctgctcttgaaggtgtattacatcaggttttcaaaccagccctggtgtagcagacactgcaacagatgcctcctagaaaatgctgtttgtggccgggcgcggtggctcacgcctgtaatcccagcactttgggaggccgaggccggtgattcacaaggtcaggagttcaagaccagcctggccaagatggtgaaatcctgtctctaataaaaatacaaaaattagccaggcgtggtggcaggcacctgtaatcccagctactcgggaggctgaggcaggagaattgcttgaaccaaggtggcagaggttgcagtaagccaagatcacaccactgcactccagcctgggtgatagagtgagacactgtcttgacaaaaaaaaaaaaaaaaagagaaaaaaagaaaatgctgtttgtattttgtggtctaataaggagttcgggatagcctgttgtatttgcctcatgccagcccctgagctgccttgggagaagatgctgattgtccttgtccagagtactgcttttgcagagtgacaggctgctgggacagatgtcctcctgttgcatctttgtggatgtttagtaccaatgatgacacgggaactcacatcactgacaccgctcttcatcttctgttagtctcttgaagagcatttttttgtacttctttgctgatgacctacctcttcataagccaagtgaaacaagttgacgaactgcctaggacttccacgtgttgctcacatacatgatgatttctgtcacgctcttgtgttcagacacactgacattaccatgtatgtcagacctccttatgatcgcatgtcctgacagttaagctgattgcaaacagactattaaatatgaatggagcaaacgctgtatgtcatggatatgttctggagaaattcttacccatctggatggggcagggcccttgactcacctgaatcatgaccaggcaaacattttatctgtcctttctgcaggaatccgttctgtgtcatgctaggagaatgggttcagtatatggggccatcaggcagtataccctctgaatgtttttcattgttgtatttgcttagagtaactaaacaattgtatcttttaatttatcttttaattcaaagaggaaaccttggcttctgataactttgttgtgttgtatcttaatggcctatagctgtcattacttcctgtagctgcagtacagaattgttacagacctggattaatgcttccaaagacagaaggaccttggcacctaaactgaccagccctgtgatcctgcaccccacaggagtaactcatcaggacttaccagactgctgcttttgggcatcatctgctgggttgatgatttggtttggccaagagtcttgccaagactttaatctatgcctcttgttctacatgaattcttgggaattactcacgttccataggaagagtgcatccccaggtgatggtttttggttatggtatgatcctttcacaccgaggatttcattgtttaaaacgtgtttctttaaaagaagccttgataacgagagtgggggaaggaggcagcagactttgaagactgtggcctttggtgttctggagtagggggagggaaggagaaacatgttttccacatcatcgcaagtgtgtgccctttgccccttttcaggatccttagagttgcctccctccctccaccccgacagttttgcaataatgtgccttatcagttgtgagtttacaggtgaagcaatttcccaaataaatggatgtaagtgttctg

SEQ ID NO: 11994 - DNA, 9455 bp, Homo sapiens
gaacgtgctccgcgggctcagtccgcccgccgctgcgtcccggagtgcaagtgagcttctcggctgccccgcgggccggggtgcggagccgacatgcgcccgcttctcggcctccttctggtcttcgccggctgcaccttcgccttgtacttgctgtcgacgcgactgccccgcgggcggagactgggctccaccgaggaggctggaggcaggtgcgtggcgggaatccgggttcgggtcagaggaagggagccgggtccgaggaccggggctgggaatcggagattcggagattcgggttccggtatcggaggcgttgggaattgaggttcacttatcggactggaatccgggtctggtatccgggcccgcgtccgcacggtctcggacagaagggtggatgggagcccggctccgggcctgactgggacctgtgtggtgctggctgcagggtgtgcagggcgtcacgccgcggtgcctttggttgggtggatttgccgagggagacgcggcgctgagcctgcccgcgccgttgctttcccagtcccagccctgggccccatttccagcccaccttcgcccccgtgcgggcccccagcctcttcaagtccactttcaactgtctctcctcctccccaccccacttacgtcaggtctgcccttgagactttagacattagatcttcaggagaaatattgcatagacaactttaaattattcacgaattaattatcgactctgcccgtcttcctggttgtctctacttttaccttttttttttttttttctgagacggagtcttgctctgtcacccaggctggagtgcagtggcgcgatctcggctcactttaacctcctcctcccgggttcaagcgattcacctgcctcagtttcccaagtaattgggactacaggcgcgcgccaccacggccggctaatttttgtatttttagtagggacgcggggggggggtctcattatgttggccaggctggtctcgaactcctgacctcaggtaatccgcctgcctcagcctcccaaagtgttgggattacaggcgtgagccatcgcgcctggcctccttttccccttctaatgaacgactggtcgaggcaggaggcagagcaatacttacctggccggtttttgtgagtgctgcatactctttataaagtgcatggaagtgtgcctagtacagcattgcgtggttaagggaattactgatatttgactattaaggcagctgttttcagttactgtattcttttgctgtagctaagaaggctctgctgtgggtgtcggacataccgagagaaactctcgtgagaagtaggagggtttgctcatgattaatcagtgatggattcaaggactgttcagatggcagaggcaagatagccttgctactataacccttgggcaggattcaaagtgcattgaggaccagattaagagcagagttaaatagtaggctctttgaaagggttcgattcaagcctgacatattatcaaaaaagttacatttatcctatgggatagatatactttcctgaagaatctctaattggctttatagtgaatgctaaaaagtcgttttacttggcacctcaggaacagtttgaagtctgaattgttcttggtttgtgggggaggcagtgtccttgaaaggaaggcaatttgagacatttagaacttgcctggaaatgaatccatttgcctcttaagaacagattctaaaatcccagagctaaaggggaacttaatgactgtttagcaccaacctctcactttttagataaggaaagagactcagggactagtccaaggacgtaaaacagaaagtagcagggttgggatgctaacccaggtctcttgcttccaaactagggctctcctgtctgtctccgcaacgtcgtatcaggtcatctgtcattgggagtgtatgtgttcccagcagatcagatgatgggcatatttataaacctactctgaaaagaagacacagcgagtgactttcatgggcactggactgatctgaactcatgtttccatctgcttttccaaatccccaggtcgctgtggttcccctccgacctggcagagctgcgggagctctctgaggtccttcgagagtaccggaaggagcaccaggcctacgtgttcctgctcttctgcggcgcctacctctacaaacagggctttgccatccccggctccagcttcctggtcagtgtcctgccctccctccaaccctgtttccttatctgtaaaatttggatactcccctgtaacctcatgggattgttgtgtggggatgattaaaagtgacagtgggtgtatcggggctggcacacagtggccctcagcacttacggagggattgagcaccgaagtgggagacactgacagcttccttttgtactgcttccctctcccaccccagcctgtttctctcctctaggctgaggctggacctgctcaaacagtttccttgtcggaaactagaagaaaagcaaacatgtccaagagaggcaggggaggtgtgtggggctcggggtcaggggctgactccttgaggctgccctgtgtctgtcttctgtcttgaactgatccctcttcagggcagagagccagctgctgcttggtgggggctccacatccagacctgagggtgaaccctgactctgcctgctgtgctcttggggaggatacttaatctctcacctgtagaatggggcaaggatggcatgactcagggatgtagtgaggattacacaggacatgtagtcaagcacttaacacagtgcttagcggctccccagcttcccacttccaaggcttccttttactttctctcttggatcccatgttttgtcaggatgatgtctaccaaccaaaatgcatttaggaagtattggttcacttttccctttttcttaaaccaagacatcttcaaatgtctgctagagctctggtcaacatggaaccccggtattaacatactgcatagatgtaattccagcaaaaagcaaagaaacaagacatcttacatagcttgtgtggtcttaccaagggaaaattcatggtttgtgttcatcttttgaaatagtaaaaataactcgtgagtttcatttctactttcttggagccccagtcattgcagaatctaccacagccacagatcccatttcattctctcctgccccctgaggcttttatccttatcctcattttcaaggtgaagagactgacggcaggtgtagttcccagccttttcataatttttcattcacctctttaaatggcaattgggacctggggcagtggctcacgcctgtaatcctagcactttgggaggctgaggtgggaggatcacttgagtccgggagtttgaaaccagcctgggcaacacagtgagaccccatctccacaaaaaattttaaaaagtgggtgaatgtggtggtgtgtgcctacagtcctagctgcttgggaggctgaggcaggaggatcgcttgagtccaggagttcgaggatgcagtgagctatgatcatgtcactgtactccagcctgggtgacagagcgagatcctgtttcttaaaaataaataaataacgcaattgggttttagctggaaaaaagcagtgaaggaggagggaacctatgactctcaggctccaagatgacgtgcctggtagctgccagatgttcacatgcctgagggtttgttttatttgcagaatgttttagctggtgccttgtttgggccatggctggggcttctgctgtgctgtgtgttgacctcggtgggtgccacatgctgctacctgctctccagtatttttggcaaacagttggtggtgtcctactttcctgataaagtggccctgctgcagagaaaggtaaggggaggggtcacatctgagagctgggaccccagacagtcgctacgtgcatggccttgagagaagcgagtggcagggatttcccacagtactcttccacgctgtttcaggaggtcctaggggttcttttgatgtcttcaggagacatagacctgggatcaaatcccagctccatcattaccagctctgtgactttgggcaagttcttgacttctctgatcctcagcatgtctattttaaaatgaggaaaacagtctttccctggagggttgttggaagaattgggaacagattatgtaaagtgtctagaacagtgcctggcaccagcaggttttcaacacctggagaccctttctgcttcttaacagctttcttctctttggctacaggtggaggagaacagaaacagcttgttttttttcttattgtttttgagacttttccccatgacaccaaactggttcttgaacctctcggccccaattctgaacattcccatcgtgcagttcttcttctcagttcttatcggtaagatgctagtggggtaggtttgagtcttcagagctgtcacgctgggggtctgccctgggttattggccacgtgagcatgtgcctgcttctgagaacacaggctcacaaagtgtgacttcaagccttatgatctaaagaaatgattcctgatttcagatctgctcaggcttcaacatgaaaacccataaaaatacttttggactaaataaagattgtccattgcatggctgtatgcactaggcactgggattagaagagatggtctgtgtaaagtatacaaattggcccatagtaagtactcagtaaatgctagcaggaagagcagggttggaatgagggtgtgtgtccatgagttttgagtggggacagaagaaaggagcagagcaagggacttcctgtctggtttttggcccctgttttgattaagttctgccttaggaattgctggcatcagtgtggttccttcctgccttttgacaattgcacaacctgcagcaagctacttaccctcaatggaccacctggctaggaatagagcagtgtttctcaaagtgtgggctttgggccaccttcatcagattgttagggtcagggggcttgttgagaatctagatttggggcctactccagacctactgaatcagaatcttgggagtggaatctgggaatatgcattttaatccagttcctagtcagtcattttcaaactgcaaacccagtcattctcaaactgcaaacctattaagaatcgcctgcaaacctattaaaaatcacttggaggccgggctgagtggctcacacctgtaatcccagcactttgggaggttgaggcgggtggatcacttgaggttgggagttcaagaccagcctggccaacatggtgaaaccccatctctactaaaaatacaaaaattagcctgacatggtggtgtgcgtctgtaattcaactacttgggaggctgaggcaggagaatggcttgaacctgggaggcggaggttgcagtaagctgagaggatgacacttcactccagcctgggtgacagagtgaggctccatctcaagaaaaaaagcaaaaaaacaaaaacaaacaaaacaacaaaacatcacctgtggagattttaatccctaagctaaggctacaccacacatcaactaaatcatctctggggtaggactcagggatcaggatcttttaacattttccaggtgatgcaagtagttagtccctaaaagggattccgctggatcctgagttttgcagtctactgaattagacgatatctaagtttctccttgcctttgacaattatatgacctgcagcgagctacttagtctgaacgggctactcgtccagataaggggctgggactagagcagtgtttcttgaagtatgggccttggaccacctttatcagagtggtaaagtgctaacatcctataaaatcagtgtttgctactttctccatactggaagaaaaccaccctccttaagcctaaggcaaggatctcttctcttaaacctcccttagatcctagagggaaagacgattcagggcttctaggtcaaacagagcaaatctgtggttgagcagctgctattcataggagatacctgagagaaatggagatcttaaatagaagcaagatctaccacggccaattttggtcatattggctttcagacaaagtgcctcaggccctcagctagtgggggtttgctgcttctaattacctaggtggcatgaggcttggcaagattctggagaccaggcttcctgtcctctgtctcacaagctgtgtgaccctgaggggtctgggatcttcatctcctgtatacttcctctcctatagaagagaaatggactatcagagtgttccaaaccaatcggaatctcagggtgggagtggagaaggggcttttaaaatacaggttcctgggcactaccccagaaccaagtacccagaatttctggggtggagcccaaggatgtggttttttaacaatgtcaccagctgattgttctgcagccagcctgttcagccagccagacttttggaatccagtggatttgatgacatctttgagacagtacagaatgtgaatagtacttcttttaaaaaactgtttgtcaacaatggcacttctctctttactttggctgttgggtactcagaaccaaatttggggcccacttttggcaaacaggtgaaccttatgcatttttttactaactgtactccctgatgtcttgtattcttctgcacgcattttgcttttcctatttaaaattttatttatttatttatttatttttgagacagagtctagctctatcgcctgggctgaagtgcagtggtaagatcttggctcactgccacctctgcctcccaggttccagtgattctcctgcctcagcctcctgagtagctaggattacaggcacatgccaccacacccggctaatttttgtgtttttagtagagacggggtttcaccatgttggccaggctgatctcgaactcctgacctcaggtgatccacctcggcctcccaaagtgctgggattacaagcataagccaccattcctggccctattttaaaattgtcttatagtagcatgtattatttgtgtaaatatctcaagttcttttgttgaacaagacaggcatatatgggaagtgaggaaaggagggaaaataatagaaaagaaggaaagaagggaaagagttaatatgtataagggtcaagagtcaagcaaaaaaaaaccgtagtcactgttcctggtgacattctgaattattattttcttaattttgctgctgcttgtaacaggtgctttgtccttttcttcttccaggtttgatcccatataatttcatctgtgtgcagacagggtccatcctgtcaaccctaacctctctggatgctcttttctcctgggacactgtctttaagctgttggccattgccatggtggcattaattcctggaaccctcattaaaaaatttagtcagaaacatctgcaattgaatgaaacaagtactgctaatcatatacacagtagaaaagacacatgatctggattttctgtttgccacatccctggactcagttgcttatttgtgtaatggatgtggtcctctaaagcccctcattgtttttgattgccttctataggtgatgtggacactgtgcatcaatgtgcagtgtcttttcagaaaggacactctgctcttgaaggtgtattacatcaggttttcaaaccagccctggtgtagcagacactgcaacagatgcctcctagaaaatgctgtttgtggccgggcgcggtggctcacgcctgtaatcccagcactttgggaggccgaggccggtgattcacaaggtcaggagttcaagaccagcctggccaagatggtgaaatcctgtctctaataaaaatacaaaaattagccaggcgtggtggcaggcacctgtaatcccagctactcgggaggctgaggcaggagaattgcttgaaccaaggtggcagaggttgcagtaagccaagatcacaccactgcactccagcctgggtgatagagtgagacactgtcttgacaaaaaaaaaaaaaaaaagagaaaaaaagaaaatgctgtttgtattttgtggtctaataaggagttcgggatagcctgttgtatttgcctcatgccagcccctgagctgccttgggagaagatgctgattgtccttgtccagagtactgcttttgcagagtgacaggctgctgggacagatgtcctcctgttgcatctttgtggatgtttagtaccaatgatgacacgggaactcacatcactgacaccgctcttcatcttctgttagtctcttgaagagcatttttttgtacttctttgctgatgacctacctcttcataagccaagtgaaacaagttgacgaactgcctaggacttccacgtgttgctcacatacatgatgatttctgtcacgctcttgtgttcagacacactgacattaccatgtatgtcagacctccttatgatcgcatgtcctgacagttaagctgattgcaaacagactattaaatatgaatggagcaaacgctgtatgtcatggatatgttctggagaaattcttacccatctggatggggcagggcccttgactcacctgaatcatgaccaggcaaacattttatctgtcctttctgcaggaatccgttctgtgtcatgctaggagaatgggttcagtatatggggccatcaggcagtataccctctgaatgtttttcattgttgtatttgcttagagtaactaaacaattgtatcttttaatttatcttttaattcaaagaggaaaccttggcttctgataactttgttgtgttgtatcttaatggcctatagctgtcattacttcctgtagctgcagtacagaattgttacagacctggattaatgcttccaaagacagaaggaccttggcacctaaactgaccagccctgtgatcctgcaccccacaggagtaactcatcaggacttaccagactgctgcttttgggcatcatctgctgggttgatgatttggtttggccaagagtcttgccaagactttaatctatgcctcttgttctacatgaattcttgggaattactcacgttccataggaagagtgcatccccaggtgatggtttttggttatggtatgatcctttcacaccgaggatttcattgtttaaaacgtgtttctttaaaagaagccttgataacgagagtgggggaaggaggcagcagactttgaagactgtggcctttggtgttctggagtagggggagggaagcggaaacacgttttccacatcatcgcaagtgtgtgccctttgccccttttcaggatccttagagttgcctccctccctccaccccgacagttttgcaataatgtgccttatcagttgtgagtttacaggcgaagcaatttcccaaataaatggatgtaagtgctctg

SEQ ID NO: 11995 - DNA, 9181 bp, Homo sapiens
gtgaagtacactttttgtttaattccatgcatttgtttgctttgatagtcattcttgttcccattgccgttcaatacagagagggagccggcatcagaaaacaacactgggagctggggactgacagtacaggagaccagaggggagccaggtaaggaggttcatttggagacctaaccacaaaagagaaattcattcgctccaagtcgataggagctcaaattactgtaataaagcgtcaaagagggtcttcccacttccagagtctgggaagtggtcactctgaaggtgaagagccactggggtgatatgggcaagatgggacatcttcctaatagcttgcacatgctggctggggttcccttggcctgcagtcactggaggaccctgtccacctggtcactggacagcagcctagggccgggagccagcgatccctgagtgctgtgaagtggctctggagagcagacctgggatgctgccgggagcttccttacagtggccttgccatctgcttagggctctgctctgtgaagtcctgccatcgtaccctggccacatgacagttaacaaaagccttaacccacctcctgtttctcagagcagtgattttagagctcccctctttagccacctgtccctgagaaatgctccaggttccacaagggtcctctgcttagcctagttcagtccgacttgaataggcttttgcagtatcagttgtaacatgcaaacaagcagattaatatgattctaatgtgccagtctgtgagggtgggacactggtggtgtgagtatgctaggatatttgtcctatgaaatcagcaaagaagaaacattttgctgcctggaaaggcactaaattcatactgaccgtacaagtcaaagtctcgaaaagaatgtcacattgttttggtacatgagtctcacagagtctaagaagcaagtaactgggacttatattaattttctgtttataaaaggtgagggaggaacatattcattcaacagaattaaatgatgtgaatgaagagacattttggaatgggatccatcagtgattggtgttccttcaattggaattgttgtccaaaagggcagtgggtagaggcaagtggcctttcccctttctgtggtaccgcccctgacagccacaggtggacactagtgcgagcctgtcgttctgccattggggctaactcaagctcaaatggcaattccaatcaagcggcaattgttgctccaagtgctatgttgagaggttctgaggctgtgtctaggctcagtaggaaagatacgatgctcaatacataatgttggtcttggtcttggaggtggtagatggtggtaagtggtagtataatatttcggcttctggctcagtgggaaaacaaaacatagcacactctactgcagagcagggcaggaattctatggattataaatattatgttctggagaattcagttccaggaagttcaagtgggactgttttaagaaaaggaaaaaaaaattgagacatgaggacattgaagaaaaaaagagtaaatcatttgatcaaaaaggatgcatttattcttaaaggatgccaatgttccacagtgggagagggcatttaaaatagtctggaggctgggcatggcagctcacgtttgtaatcccagtactttgggaggccaaagcaggaggatcgctagagcccagagttcgataccagcctgggcaacacagggagacgcccatctctacaaaaaaaaaaaaaaaattgttgtgcatggtggcacacacctgtggtcccagctactcaggaggctgaggtgggaggatcacttgagcccaggaggttgaggctgcagtgagccataatcatgccactgtactccaacctggtgacagagtgagatcctgcgccctcacccccccccaaaaaaagtctgggttggtgccaggtaaatcccaaacccaagcacatctattatttagaaaaggagaggggaataatttagcatgatgaagctctacaggagatgtccagtacttactaaatcctactcaaaatgtctttacttctagaaggatagatttgtttgatgccaacattttaaaatatagtatctcaacttcaagtagctagatgaagacgccagtttacaatagagctagcatcttcatctttctcagtaggagctccccaccatcttgcaaacaggtctaaacttaagtggtggtaaggtccattataatttcaaagtagatgcaggcttctcagcccctctgcaaagcaattttaaaaggaactgttatccagaggatatgatcttgaaatagatgaaaatcagaaccaaatgctcatctgcaacccaaattaaaactcatcatcttgcagtcagttaaaaacagacgctaacggaacatggacattcatcccaagatggtgaaactttccatcaatgaagcagcttgaaatcacagtcttgtgaggttcctggaagcactgttgtaacacacttgtcaggactgaagaattagctcataacttccctgagctcttgattcaacactcttcagatgactgtggagtcgttctcaaagaaacatacatcaattcaagattttcccggttatcacaaggcaggcagcgaaggaccaggctgggctagagaaggtatttccctttttaacctccactaaggaccttattctcctctgaaacctctagtcaattctacttaaaaaaatgtgttcaatatggactttattcaactctcgactatacaatgaatgactgagattcagccactacgtactaccctaacatactcataacagttaatccacataaggtgtatgatgacaatagcataacagataatcaagatgagaattcaaaaaaaactgatcaaaattacgaggtatcaggggtaggttttctaggaagaccatcactgaaagatgtaagataaaagctgaccctcatgtttctctgttgccactaaaggtgggcaagaattggacaaaactgccagtgttttatgttggatagaaagaagacatagagttgtagcatctctgttccaaggaataatgaaccagagagatttacagtacagtgagatctgaagtcaagaggatggaaaatatagcctttcaagaatttttttccagtcgttggtcctctaagtgaccaggcctccttcttaaagttctttagtcttgttctaggatgacatcacagttaggcattttatgtcatgccctacatgtatatacggtagtcctcccttatttctgggggatacattccaagacccccagtggatgcctaaaaactctgatagtaccaaaccctatatatactatgtttttttttctatacttacatatctatgataaaatttaatttgtaaattaggcacagcactcttgccctttggggctattattaattaaataggggtacttgaacacaagcactgcgatacagtcatctgataaccgagacagtcgatctgatcaccgagactgctactaagtgactaatggatgagcagcatgaatatgctggacagagggaggatcacctccagggcagcaaggggcaagatctcatcatgctcctcagaatgctgtgcaattaaaatttatgaattgtttatttctggaatgttccatcaaatatttttggactgctgttgagcgtaactgaaaccatgaaaatgaagccatgggtaagaggggactactgtataccatttctttttttagtctccctgctactctccactaggagaataaaggtgggagaacaaaggggtctggcaggaaggagattgcaaactatgttgtcaattcttgaaacgaatccatgagccctgtgcggaaaccctctaggtctgttcctctcaggacattaaatcattctctttttatttctaatatagtcccatgaatttatttcctaagaaactttagaaagtttacagctttttaactatatgtccatccactatttgacatcctgggggtcatcggcccacccaggagctttcatgatcaagtcaaaatcacaatgtatccattgggcttcagggcagaacatgcgtcctcagatgattgttgtacacagaaaattagggaacacagctaagatcaataccagggagctcccaaatgggaattccattttcattccttcattaaaatcataaaatccataataattcctggttagcaataaacacaaccattgtgccacatcataaatcacaccttctgatcgacagaaaatgagaatgataatattataaaataaaataacaatgataataatgccataacttaagatctttcatgtagtccagctacagaatttttacaaaatggaataaattaatgcaaacaatactgctctttgtataaattaaacattttccttcatcctaagagctataaatcacagacactacattttaaatcaatgtatcaacataaagtgtaaacaaatggatcaaacaagcaaaaggaactctaaattccctcctgcctttcctttttggctgatgcaatcagtaaaacccagaggagcggcaacattttcatgtgcattggaaatggtttaacagctgtctgtgcaagtatttcctaacgtccaacatgatgcagtgtcaaagagtccagtgaatctagagaggttgtttgacggtaatctgtcttggagacagggacaggtactaggtcaacacctatttgtacataaaattctaaaaaaatttttccttaaggccaaggcaccatgaagtaccttggaatgcttttcagagcccatgaccctggagacaggcaggacctcatgcttttggcaatgtaaaaatccttcctatccctgctcagcatcccttgttctttccacaaatgttcaaatccagttatttaaaactgcattgatttggagtgaagtaaaagatattttacaagtagcattgaacaaaaatgctattgtgctgggagaggagttgccttttgcaagctgcttgtttttgcttttattctgacagtggtagccagtcattaagacttctaagataggccgggcacagtggctgatgcctgtaatcccagcactttgggaggccgaggcaggcggatcacctgaggtcaggagtttgagacaagcctggccaacatggtgaaaccccgtgtctactaaaaatacaaaattagccaggcgtggttgcgggcgcctgtaatcccagctactcgggaggctgaggcaggagaatcgcttgaacctgggagatggaggttgcagtgaactgagattgtgccattgcactctagcctgggcaaaaagagcaaaactctgtcaaaaaaaaaaaaaaaaaaaagaacttctaagatagaatgagttattgaataaaaacaaagggatggtttgggctcagacattgtatagacacacatacatcctagctgccttcaaagtctgttctcctgcttgaatcaatatgactcaagtagacaagcaacctggctccagagaggggtggttccatcttctcctcgtagctgaactgagtgatcctgagaatggagttttataaattccacgttcgttttcctaacaccactgtagatgttcttcctctctcacccttttctcctcctcagtactgccccccaacctttgttcctacaggaagtggtcagcaggcagaaaggaaatgagctacaaggaaatggcacttgagtatgaaagatcaacacgttgggtcaaggtagcacatttgccaaggtaatgacagtgacagcactaaaaagggacgtatttgccaaaaacaagatttgacactatctgtaaacctcactaccaactgctgcttaaacatttaaaaatgaaaccagcttccacatacacaggtttgtttgtttgtttgtttgtctgtttttccctcctagaggaagcacatgcccttgaagacattgggtgcaagtatctggtcaccagacttttctaggtcatttccgtaagccacctggacaagctggttgaagtgaatatggtctgttcacaagttgcctggaattgcttttcttttgctgttctttgtgttctaaaatgttcaatgtcttgctctggctcttctttagtcacttatggccaaaagacctggtcccctgttcaagcagcaataatacctcccggccccacaaattcccaaggatgttgctcttaaattccacttatttctttttttctgttctttcttttatctctttttttttttgcaagaaattattgtctctctatctcatatatagttcactctttgcagtacaaagtgttaaaatgtcaaacaaaaataaatatcaatgttacagtagctagaatattcaataaaatagatccctgccattcttgattgaaatgttcagtgagacttaatttcatttggatattattttccagagatttgcgaagtctcatgttcctgttattgcagctcatttctagggggtggtaaagatggggtagtctctcttcccagacaaaatgctgggagagagtgggatgagtctgggggtggggtggatctgaaatgccagtatagtcacgagatcttcaggatgtgtattccttcattaccaggtagcagagctgtagtgtttattggtcctaactgtggcatcagaacactccccatctgaagagtcacagtccgattcttcaaactgcatggggttctgcaaaggcaagacaaaaccttaattcatttcgataatcactcagtaaatatatgtcaaacacctcccacacaacaggcactgtgcttggtaagggggctacaaaggtaaacgagaccaggtcctgtccttgtgggacttatggagaaagaaaacacatgatgattatgattgctacgacaataaaaacagtgcccaccacacaaccacttatatagcgtttactatgctccaggcactgttgtaagtactttacttatttatttatttagagatggagtctcactctgtcgcccaggctggagtgcagtggcacgatcttggctcgctgcaacctccgcctcccggattcaagcgattctcctgcctcagcctcctgagcggctgggactacaggcgcgtgccaccatgcccggataattttttgtatttttagtagagacagggtttcactgtgttagccaggatggttttgatctcctgaccttgtgatccatctgcctcggcctcccaaagtgctgggattacaggcatgagccactgcgcccggtggtaagtactttattaatacatctgttaatccatttagtcctcatgataacactatgagacagatgctattatcatccccattttacagagaggttaagtggcttgccaggtcccacagtaagtggaatgctacaatttgcattcaggcagtcagattccaggctttacacttagaaccactatgctagcctgcctctccaaaggcagtcctgaatatgaaataaagtgctatatgtcctatgatggcatcatccagggaagagtcagggtatggagtggggaggctcagacctttaaaataatttttttttttcagagacagggtctcactgttgctcaggctggagtgcagtggtgtgatcatagctcactgcagcctcaaactcctgggcttaagagaaccttccacctcaagcctcccgagtagctgggactgcaggcatgtaccatcaaactcagctaattaaattttgttgttgttgttgttgtagaggcaaggtcttgctatgttgctcagactgatcttgaactcctgaccctaaagtgatcctcctgcctcagcctcccaaagtgctgggattgcaggtatgagctaccacacctgacctgggctcagacctttaaccgtgttgggagataggagtgggaggaagtgatgtttgagttaaatcttgacatgaagggttcctgagcagttcaatgtgtgtgtgtcatttgggagaaactgccctcatttctgggagctctgttgatctctgtacgtctacttacttcttggaggcctgatatggtttggctctctgtccccacccaaatctcatgttgaattgcaattcccaatgttgggggaggcacctggtgggaagtgactagatcatgggagtggatttcccccttgctattctcatgatagtgagtgagttctcatgagatctgatggtttcaaagtgggtggcactttcccctttgctttctctctcctaccaccatgtgaagacatgcttgcttcctcatcaccttctgccatgattgtgtttcctgaggtctcccagccgtgcttcctgtacagcttgtggaagtgtgagtcaattaaacctcttttcttcataaattacccagtctcaggtagttctttatagcagtgtgaaaacagactaatacaaggccactgttgtatcttattattaaatgaaaattgtaaaggccctagagacttgaaccccaaagagcaaaaaagggaacagtgatgggaggagaagggagaagcccccacctcatagccacgttcctccacacacagcttgcccagagacatctgagtcttcacacggcgcacggcacactccttgtcagagagcccatccgagtgtgaggatatgtcaatgggaatctctggcgtctgggacagcaggtcgtctagcttctctgccaagcggtcttcaagtttatcagctaactcatcaggactgtttgagtggtcactggtatttccctcttctccatcagacacagagaaattctcagagctaaaggttgaatatgactggcagctgctgatacagcgatggggcctagaaccaagaagaaccaggagaacttagtcagaggaacaactgcttttctttccttatctgtcactcatagtagtggtagagataatctagttttttccctgccatcaaggaggcctaagaaatcaagataggtagaaactatttaacttttaacattaaggcaatggactgaattttatcccccatgaaattccatgttgaggccctaataccagtgcgactgtattcggagatagggcttttaggaagtaaataaagttaaatggatcataagggtgaggtcctgatcaaataggattggcagccttataaaa

SEQ ID NO: 11996 - DNA, 10099 bp, Homo sapiens
ctcaggggccccagccctcctggtgctgctttccctctctgtcaagagctcggtatacggaccctgcacaatccccgtcttcgacagctgggagaatggcacaggcttccagaacatgtccatgtgagtgccctcagggctgcagtgggctccctggctctggcagaagggccacatgggcctggggctccaaatggaatatcctgtaggcaaagcactggctgtggggcagagagggagctggggcttagacaggggagtttgcagggggctccaccacatcccttccatggatccaggtctcctgcagaggcagccttgtgttctatgctggtgaagtctacgaagccagcgtctgctcgccaacctgccagggcagccgggcctcccgcctcctctgtcctgccctgccctccagtgcccaggccctgagggtctggctcagcctgcacttgactctgttcccctgcagaccaccttgctgcacctacccaggctccaactcctcccgacctgccctgggcactgccaggcctctcaagtcctcctagtcggacaagagtgctgtgggggctgggcttgggggagacaaagagaggcagcgaggtgggcctttaggggccgggggacacgctgctgctttttttttaatagcccctccctgcaggcgaggacgttaagctttttattattatgcaacatttctaatagccagacatagactagcctaaggaacccccgcgcgcccatcactcacttgcagttggctgtggaacctttttccttcttggctgatgcaggctcaggatgggggctgattctgtggcaggccttgggtatcagctggcttcgttttcacaagggcaagggccgggtcctgttgccagccctattttacagttagggcacctgagaaacaggcagcttaagaactctacctgaggagccctagccagtcagtggcagagctggggcttggtctccggcaggctggtccagagcctggcccccagcccctgaagcagggccgggggactgcgtgctacataggtggggctgatccctctcacattgaggctcgggtgtatcagaggacatgtgacttcaatttacatgaattgttctctgcaatctccatgacaacccataaggcaagtacataatcatccccaacctacagatgaggaaatagaggctctggcctcagtttacatactctctgaagatgtattttcttttttttcttttttttttttttttgagatggagtttcgctcttgttgcccaggctggagtgcaatggtgtgatctcggctcactgcaacctctgcctcctgggttcaagcgattctcctgtgagtagctgggattacaggcgcgtgccaccacgctcagttaatttttgtatttttagtagagacagagtttcagcatgttggccagactggtctcaacttctgacctcaggtgatccgtctgccttgacctcccaaagtgctgggattacaggcgtgaacactatgcccagcctattttcttatataataatatgatgaggacaaaggagctttagtgacacgtccacaggacccactaatgcacagatgttagagaacacccacctacgagccagcttctccctgggtcttcctcactctgccctctcctctcaggaaacaattaccttggggtttgtgactttttttttttttaatttaaaacatctcttactatgtatatacacattcctaaacccaaacatcagttaaaaaccaaaaacaggccaggcgtggtggctcacgcctgtaatcccagcactttgagaggctgaggtaggcagatcatgaggtcaggagatcaagaccatcctggctaacacagtgaaaccccgtctctattaaaaatacaaaaaattagctgggcgtggtggcaggcacctgtagtcccagttactcgggaggctgaggcaggagaatggcgtgaacctgggaggtggagcttgcagtgagctgagatcgccactgcactccagcctgggcgacagcgagactctgactcaaacaaacaaacaaataaaaaacacatcctggccaacatggagaaatcccatctttactaaaaatacaaaaattagccagacatggtagcgggtgcctgtaatcccagctactcaggaggctgagtcaggagaatcgcttgaacccgggaggtggagattgcagtgagccgagattgcggcactgcactccagcctggagacagagcgagactccgtctcaaaaaacaaaacaaaacaaatacaacccttgaaaatcattcagatgtccactgacgggatgctggatgaatggactgcagtagagctgcccccgtggggatattccctagcggtgaaagtgagtggtcgcctaccacactcatcaacttggaggaatcccaaaataatgtcctgggacccttgtgactgtaggggcaggagccacaaagtgaacctcagcaggggattgtgacagttaggggctcaggctctgggcctggggcttcaggatccagctttgcctctaactggactgtgttcctgagctagagcctgagtttcctcatctgcaggatgaggacgattatgtacttgccttatgggttgtcatggggattgcaggggacaagtcacataaagcacatcgttactggtggagggtgtccaggttcttggcgtcttgaaccaagaattggacaagcctgggcatggtggctcgtgcctgtaatcccaggactttggaaggccgaggcaggtggatcaactgaggtcaggagttcgagatcaacctggacaacacggtgaaaccctgtctttactaaaaatacacaaaaattagctgggcgtggtgtcaggattctgtagttccagctactcaggaggctgagagaggagaattgcttgaacctgggaggcggaggttgcagtgagccaagatcacatcactgcactccagcctggtgacagagactccctctcaaaaaaaaaaaaaaaaaaaggaaagagtgaggcatgaattaagcaagaaaagcagagattgattgaaaatgaaagtacacgctacagtgtgggagtgggccagagcatagggcctcaagagccctattacagaatttgtggagatttaaatatgctctagaggtttccattggttacttgatgtacaccctctgtaaatgaggaggatgaagtaaagttacaaagtcatttggcatatgccctatgtaaatggagaggatattttctgtcatagctgaagtgtttccatttgatttatttttatttattttgagatggaatctcgctctgtcacccaggctagagtgcagtggtgcgatctcggctcactgcaacctctgcctctcgggttcaagtgattctcctgcctcagcctcccgagcagctgggattacaggcacctgccaccacgcccagctaatttttgtatttttagtacagacggggtttcaccatgttggccaggatggtctccaactcctgacctcaagtgattcgcccacctcggcctcccaaagtgctgagattacaggcatgagccaccgcgcctggcctccatttgatttagttctaggaagtccttacatttccctgtctctaaacccttttctcctgcctcagcatgacattgtgtccgactaaaaggtggcatctgtcttgaaggtgtcttggggaggcaaagggcagaggcctccgggagggcgtgggaccggggctggcttcggttagttctccatggctctctgctcagccctcagtgggctctcctgcggctctgtgtgctctcaggttgacacttggagggtccctgtccaccaagccacaggttggcagcccgcccactctccagcgcaggccttggtggccccgtctaggtggggagtggctcctggggaggggcgtcccactgcagagatggtgatgaggtggtgacaaccatgtagtggggtggaaggggaagtttccaggaaagagggctccgggccaaggatccaatagaagatggggcatgccggccttgggctggccatggaagcagagaggagtgagatgtggaaaggagagaggaagaattttcaggggggtgaagacatggggacgtgagagaaaccactgtggctggaaaggtgggcatgagggagcttcagattgttgaccaaggaggcagatgtgtcctctgatggtggcctggctggaaagccgggtgaggggtttcactgtgtgttcagtcaggcaagaaacaatagggcctgagccaggagaccgagtggggcttcagggagtgatgctggcctccccgcgggcctgggagccactgtgagcctgacacgtcaccctcccctgcagatgctgggtgcggagccccgtggtgcacagtgtcctggtcatgggctacggcggcctcacgtccctcttcaacctggtggtgctggcctgggcgctgtggaccctgcgcaggctgcgggagcgggcggatgcaccaagtgtcagggcctgccatgacactgtcactgtgctgggcctcaccgtgctgctgggaaccacctgggccttggccttcttttcttttggcgtcttcctgctgccccagctgttcctcttcaccatcttaaactcgctctacggtagggctggagggcggcctggaggaagctacctggcagggggtgtatggctggtgggatgttcactgctaaaggggttcaggtgaagggggcgagtgggggactaacatccagcccacagctccactagctaagctggtgggggctacatctgcatgaaggtaccctatggactggccacagcagctcttccagctctgaggctctgcccctctggcctcctacagtaagagattctgggagttgcccatgggccccagggaggccagctcgctgcagccaaggagaccctggcctttggggaagcccatgctgccccgtggaactcccgcctttctcttgcaggtttcttccttttcctgtggttctgctcccagcggtgccgctcagaagcagaggccaaggcacagatagaggccttcagctcctcccaaacaacacagtagtccgggcctcctggcctggaatcctcagcctctctggccgccagtagcctgaggctacggctcctgctagagagggtggcaggcctgctgctggaccccagaggccactgtgaccgccaaggggccttttccacttccacggcctctccaggcactgaggggaaggcattgctctacctctccctgacattttgctccggggcagatccaaccttacctggggcagcaaactttgtcctggtacctgggcccagctcgccagggatgtgggcagagcaccagcctgggcatcaggaagccaagtttcaaggactgtctttgagtctgtctgtatgaccttgggcctgccacttctcacagaccctaggtatccacagctgtgacatgggggcaagcggctttgtttcagcctaacccaggagcttagtaaaaattgcataagaccagggggaagagtgtcagcgtggggtgggaattcccgcggcctccacctgcttgctaggggcaggatctcattcaggctgccctggaagcacctgcttggccctgccaccttcctccaggggagggccagatggcatcctggcttggggcgggtgggacctacccaggctctgagactttactggcctatgcctgaggcctcttttcctttaactccctaaattatgatgactccaagtccaagcccacccttcccaaagattgggaggttccgccgttcccagaggctcctcctgcggtgctcccaagacttccatagaccatctggaccagtagcccatcccgcagttttcttgggggcagaggaaaacgcttctttctcctccagctgaatcagctggatcccagtgtcctggctgtttggtgattgggcaagattgaatttgcccaggtaggcgtgagagtgtgggttttaaattcgaagctcaggccatagtttcagagaatcacccttaccccagaccttcatgagacagtgctcatgaagccagtgcgtttcccagaacgaacactaggcggcaccgttggtccacactcagaggcccttggcgccaagactgcatctagaatcgctcaaacacctgtttgcagaccccatgcaccagctggaggggccgtaactgcaggactgcgcctactgagtgacccatttcctccaggaggaaaggcaagacacgcttacacggccatttgtctcttttcccaatgcggcggtgcactttcgctcttgggggctgcaccccagacatagctggcaccagagcagggtgctcaggtggtgggtgctcagggccctgccccaggccactgggccgttttgatgacctcgaaggtcacaggcagaaaataggagcaggatttcccctggggaaaagttctcctgggacatcttctgctcttctgtacatttctagatgcaaataactccttcaccaggcagtgagtggcgtaggctctggagccaggctgcctgggctccaatgccagctctgccacttgctagctgtgagactgtggacaaaccactcagcctctgtgtgcctcagttttcctatttgtaaaatagaggccatagtggtacctattttgaagactaagtaaaagaattcaaataaagagacttggcacagagtaagtgctcagtaaatggttactggtattatcattagtatttttgctattattgttaacagtgttaactgagtttcagaggccagcctgtctaagccccaggcccagctctgctcaaccttgtaggcacaaccccttcttaggcacatctcaccatgcctcagtttctttccccagacgggtctctactcccacctcgctgactttctgctgttctaggaatagtccccacacagtgcagcctccaggccatgccacatgtcccccgacctcccagttccccaatcttccggtctatagaaattcctggtggtcatttatcacatctacaaaattgccccagcggtgcctagagaaggcctctttcccacgctaactccaggcagattctccccacccctgccaccatctgggtgatgtgagcacccatccaagctcccatggttaagcccaggctctccaggccttggggcagggggtccccttgctaatgagggtcccgaggaattatgggaacctttagcccttctcttgggcagccccagggagtggggacacaggctcctgctgtggctgggtctgcatagagccccccagcccaggacccagcctctcagaccccaccaagcccagggcttgcccgagggaggatgtggccacagcgacacgggaggagactggcagttccaggaagcagccccaagcttgtggccctgagccccactggggtccaggccctgggcagggaccacttcctggaaatgtctcactgggtgtgggggagggactgagggagatagtgtggagccaggcagggcccctcttcccccttcctctctctcccagcagagcccagatggggccctggggccagctcttgggagcttccagacttagcaggaggatggaatggggtggagtctgggggctgttgttcagggccagggactcagagcaggcacttggtgaacggatgccatgtaaatgtcaacaggaccacagattaggagatttctgtgtgtggttttgttagtgttatttcagaaaagggtgtgtgcatgtgtgtgtatgggggggctattgaaaatagggttgccagataaaatatcagatgcccaatttgggagacgtactaaaacattattcattgtttacctggattcacatgtagcagggtatcctattattgatgtattttgattttgctaaacctggaagctctaatgagaagagcattggctcaggagtccggggtgtggactcttcactctctaaatccacccaggctgtgctgagggggaagcccctctgcccactggatgagtccccctcattcacagcccactcagcttgaggtgttcctattgccagccaaagccaccaccagaaatcccaaggggtctgccttgggtgtccccacccctgctgtcagccctggcgcagacctagcccccatcccctgtagaggcgccatggacctccctgcctccccactcccaattccaaattcacccagaagccagagggtgttttccatcctgcagcctgcccgtgtccacccctgcggaagcccttccacagcaccccctcttcattgccacactccccagtggaacttgaaaggcccacggtccggcttgtgtccccctctccagccgtgtcttaccactccttccccctcctcctcggtgctgccacactgaacagctttcggttccctgaacaggttctttctcatctctgggctgttctctgtctggaaggctctccctgtgtgtctcatttgtggagtgatggcgacacatccttcaaatctcagccttgcacatcctcattcccctcaatgcagacttcaaatctagggtggggcctcctttcagccccaccactcccgcccttcccccatgacagacgttatttctttgtattatgactgtccccatctgtctcagctgccagaccgagggcattttggagacaggtgctgtgtctcattggctcattcattcacccatcatgtaattgttaaacacttgttatattccaggcactgtactagttgctgaggatatataaatgaacaagtcatcacattcttgtgggggaggaatgtctcacactaaacagtttaacaaatagacataagatatgacaggtggcgacaagtgctgagaagaaaaattgaggagggtgagggagtagagtggccaagagcctgggtttcagcagagggagctggagaatgaacccaggggcgctggagctgggggcgtgggagagtgtcagagagctggcatgaactggcaggttgcctggaggggagggctggttccaaagccagtcttatagcaatttttccatttcttgatagtgaactttggaagagctaggggtggggaagatgggaagttgaaccacctctgagataaaactctctgagggggctgaggtggtcctgggttggggtgccccctgctactggcaagagagaagcaaactcaatatggaggtaagcttcccttggttaggccaggaggatgcccagagtgagacgaagcaatgggcttcaatataaaacttacccaaatcacaaagtaagccaccgagtgagagtcggcagaaaagaaggaagcaacagattttagaccccagggacggaatacagaatagccatatatgacacgtttaaagaaacacaagatgcaatcgcaaagatgagcatataaacgaatagaaatgaagagagacagagagatttgggggaaaacaaatggaacttcaagaaataaaaagtattatctcaagttggatgtggtggctcatgcctttaatcctagtgactcaagaggctgaggcgggaggatcacttgaggccaggagtttgagaccaccctgggcaacatagcaagacccctgtctctataaaaatcaaaaaaattagccaggcatggtggggcacacctgtagttccagctacttgggaggctgaggcgggaggattgcttgagcccaggcgtttgcggctgcagtgagccgtagtcactccactgcactcaagcctgagtggcagagcaagaccttgtctctactaaaaaaaaaaacataaaaaactctcaaaatctaaaattcaacaaacaaacagttgaatagagaattaattagcccagcgtggtggcatgtgcctgtagtcccagctactcaggaagctaaggtgggaggatggtttgagcctgggaggcagagtttgcagtgagccgagattgcaccactgcaccccagcctgggtgatagggccaggccttgtcttaacaacaacaacagaaaaaaaaaaaaaagag

SEQ ID NO: 11997 - DNA, 152 bp, Homo sapiens
cacgcctgtaatcccagctacttgggaggctgaggcaggagaatcgcttgaacctgggaggcagaggttgcagtgagccaagattgcgccactgcactccagcctgggcgacaagagcaaaactccgtctgaaaaaaaaaaaaaaaaaaaaa

SEQ ID NO: 11998 - DNA, 6012 bp, Homo sapiens
ttttttttctttttttattatactttaagttttagggtacatgtgcacattgtgcaggttagttacatatgtatacatgtgccatgctggtgcgctgcacccactaactcgtcatctagcattaggtatatctcccgatgctatccctcccccctccccccaccccacaacagtccccagagtgtgatattccccttcctgtgtccatgtgatctcattgttcaattcctacctatgagtgagaatatgcggtgtttcgttttttgttttgcgatagtttactgagaatgatgatttccaatttcatccatgtccctacaaaggacatgaactcatcattttttatggctgcatagtattccatggtgtatatgtgccacattttcttaatccagactatcattgttggacatttgggttggttccaagtctttgctattgtgaataatgccgcaataaacatacgtgtgcatgtgtctttatagcagcatgatttatagtcctttgggtatatacccagtaatgggatggctgagtcaaatggtatttccagttctagatccctgaggaatcgccacactgacttccacaatggttgaactagtttacagtcccaccaacagtgtgaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgtgaaaattttctcccattttgtaggttgcctgttcactctgatggtagtttcttttgctgtgcagaagctctttagtttaattagatcccatttgtcaattttggcttttgttgccattgcttttggtgttctagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtatatatgcggcattatttctgagggctctgttctgttccattgatctatatctctgttttggtaccagcaccatgctgttttggttactgtagccttgtaatgtagtttgaagtcaggtagcgtgatgcttccagctttgttcctttggcttccgattgacttggcaatgtgggctcttttttggttccatatgaactttaaagtagttttttccaattctgtgaagaaagtcattggtagcttgatggggatggcattgaatctgtaaattaccttgggcagtgtggccattttcacgatattgattcttcctacccatgagcatggaatgttcttccatttgtttgtatcctcttttatttccttgagcagtggtttgtagttctccttgaagaggtccttcacatcccttgtaagttggatccctaggtattttattctctttgaagcaattgtgaatgggagttcactcatgatttggctgtttgtctgttgttggtgtataagaatgcttgtgatttttgtacattgattttgtatcctgagactttgctgaagttgcttatcagcctaaggagattttgggctgagacagtggggttttctagatatacaatcatgtcgtctgccaacggggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatatcagctgtgggtttgtcatagatagctcttattattttgaaatacgtcccatcaatacctaatttattgagagtttttagcatgaagggttgttgaattttgtgaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttacatcaattttcatcaaggatattggtctacaattctctttttttgttgtgtctctgcccggctttggtatcagaatgatgctggcctcataaaatgagttagggaggattccctctttttctgttgattggaatagtttcagaaggaatggtaccagttcctccttgtacctctggtagaattcgggtgtgaatccatctggtcctggactctttttggttggtaagctattgattattgccacaatttcagctcctgttattggtctattcagagattcaacttcttcctggtttagtcttgggagagtgtatgtgtccaggaatttatccatttcttctagattttctagtttatttgcatagaggagtttgtagtattctctgatggtagtttgtatttctgtgggatcagtggtgacatcccctttatcattttttattgcgtctatttgattcttctctctctttttctttattagtcttgctagcagtctatcaattttgttgatcctttcaaaaaaccagctcctggattcattaattttttgaagggtttttcgtgtctctatttccttcagttctgctctgattttagttatttcttgccttctgctagattttgaatgtgtttgctgttgcttttctagttcttttaattgtgatgttagggcgtcaattttggatctttcctgctttctcttgtgggcatttagtgctataaatttccctctacacactgctttgaatgcgtcccagagattctgttatgttgtgtctttgttctcgttggtttcaaagaacatctttatttcagccttcatttcgttatgtacccagtagtcattcaggagcaggttgttcagtttccatgtagttgagccgttttgagtgagattcttaatcctgagttctagtttgattgcactgtggtctgagagatagtttgttataatttctgtacttttacatttgctgaggagagctttacttcccagtatgtggtcaattttggaataggtgtggtgtgtgctgaaaaaaatgtatattctgttgatttggggtggagagttctgtagatgtctattaggtccgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatcttggtgctcctgtattgggtgcatgtgtatttaggatagttagctcttcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattctgagcctatgtgtgtctctgcacatgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttgctcgttagttgatgcagtttcttcctagtctcgatggtctttacattttggcatgattttgcagcggttggtaccagttgttcctttccatgtttagcgcttccttcaggagctcttgtaaggcaggcctggtggtgacaaaatctctcagcatttgcttgtctgtaaagtattttatttctccttcacttatgaagcttagtttggctggatatgaaattctgggttgaaaattattttctttaagaatgttgaatattggcccccactctcttctggcttgtagggtttctgccgagagatccactgttagtctgatgggcttccctttgtgggtaacccgacctttctctctggctgcccttaacattttttccttcatttcaactttggtgaatctgacaattatgtgtcttgaagttgctcttcttgaggagtatctttgtggcgttctctgtatttcctcaatctgaatgttggcctgccttgctagattggggaagttctgctggataatatcctgcagagtgttttccaacttggttccattctccccatcactttcaggtacaccaagcagaggtagatttggtcttttcacatagtcccatatttcttggaggctttgctcatttctttttattcttttttctctaaacttcccttctcacttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcctgtagctcagagtaatttgatcgtctgaagccttcttctctcagctcgtcaaagtcattctccatccagctttgttctgttgctggtgaggaactgtgttcctttggaggaggagaggtgctctgctttttagactttccagtttttctgttctgttttttccccatctttgtggttttatctacttttggtctttgacgatggtgatgtacagatgggtttttggtgtggatgtcctttctgtttgttagttttccttctaacagagaggaccctcagctgcaggtctgttggagtaccctgccatgtgaggtgtcagtgtgcccctgctggggggtgcctcccagttaggctgctcgggggtcgggggtcaggggtcagggacccacttgaggaggcagtctgcccgttctcagatctccagctgcatactgggagaacaactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcctggctgctttgtttacctaagcaagcctgggcaatggcgggggcccctcccccagcctcgctgccgccttgcagtttgatctcagactgctgtgctagcaatcagcgagactccatggggtaggaccctccgagccaggtgcaggatataatctcgtggtgtgctgttttttaagcccatcggaaaagcgcagtattcgggtgggagtgacccgattttccaggtgccatccgtcaccctttctttgactcagaaagggaactccctgaccccttgcacttcccaagtgaggcaatgcctcgccctgcttcggctcgcacaaggtgcgcgcacccactgacctgtgcccactgcctgggactccctagtgagatgaacgcggtacctcagatgtaaatgcagaaatcaccagtcttctacgtcgctcacactgggagctgtagactggagctgttcctat

SEQ ID NO: 11999 - DNA, 4499 bp, Homo sapiens
gtttcagctttctacatatggctagccagttttcccagcaccacttattaaatagggaatcctttccccattgcttgtttttgtcaggtttgtcaaagatcagatagttgtagatatgtggtgttatttctgagggctctgttctgttccgttgatctatatctctgttttgataccagtaccatgctgttttggttactgtagccttgtagtatagtttgaagtcaggtagtgtgatgcctccagctttgttcttttggcttaggattgacttggcgatgtgggctcttttttgtttccatatgaactttaaagtagttttttccaattctgtgaagaaagtcattggtagcttgatggggatggcattgaatctataaattaccttgggcagtattgccattttcacaatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattatgcatgggagttcactcatgatttggctctctgtttgtctgttgttggtgtataagaatgcttgtgatttttgtatattgattttgtatcctgagactttgctgaagttgcttatcagcttaaggagattttgggctgagacaatggggttttctagatatacaatcatgtcctctgcaaacagggacaatttgacttcctcttttcctaatagaataacctttatttccttcttctgcctaattgccctggccagaacatccaacactatgttgaataggagtggtgaaagagggcatccctgtcttgtgccagttttcaaagggaatgcttccagtttttgcccattcagtatgatattggctgtgggtttgtcatagatagctcttattattttgaaatacgtcccatcaatacttaatttattgagagtttttagcatgaagggttgttgaatttcgtcaaaggctttttctgcatctattgagataatcatgtggtttttgtctttggctccgtttatatgctggattccatttattgatttgcgtatattgaaccagccttgcatcccagggatgaagcccacttgatcatggtggataagctttttgatgtgctgctggattctgtttgccagtattttattgaggattttttgcatcaatgttcatcaaggatattggtctaaaattctctttttttgttgtgtctctgcctggctttggtatcagaatgatgctggcctcataaaatgagttagggaggattccctctttttctattgattggaatagtttcagaaggaatggtaccagttcctccttgtacctctggtagaattcggctgtgaatccatctggtcctgggctctttttggttggtaagctattgattattgccacaatttcagctcctgttattggtctattcaaagattcaacttcttcctggttttgtcttgggagagtgtatgtgtccaggaatttatccatttcttctagattttctagtttatttgcatagaggtgtttgtagtattctctgatggtagtttgtatttctgtgggatcagtggtgatatcccctttatcaatttttattgtatctatttgattcttctctctttttttctttattagtcttgctagtggtccatcaattttgttgatcctttccaaaaaccagctcctggattcattaattttttgaagggttttttgtgtctctatttccttcagttctgttctgattttagttatttcttgccttctgctagcttttgaatgtgtttgttcttgcttttctagttcttttaattgtgatgttagggtgtcaattttggatctttcctgctttctcttgtgggcatttagtgctataaatttccctctacacagtgctttgaatgcatcccagagattctggtatgttgtgtctttgttctcgttggtttcaaagaacatctttatttctgccttcatttccttatgtacccagtagtcattcaggagcagcttgttcagtttccatgtagttgagcggttttgagtgagattcttaatcctgagttctagtttgattgcactgtggtctgagagatagtttgttataatttctgttcttttacatttgctgaggagagctttacttcccagtatgtggtcaattttggaataggtgtagtgtggtgctgaaaaaaatgtatattctgttaatttggggtggagagttctgtagatgtctattaggtccgcttggtgcagagctgagttcaattcctgggtatccttgttgactttctgtcttgttgatctgtctaatgttgacagtggggtgttaaagtctcccattattaatatgtgggagtctaagtctctttgtaggtcactcaggacttgctttatgaatctgggtcctcccgtattgggtgcatatatatttaggatagctagctcttcttgttgaattgatccctttaccattatgtaatggccttctttgtctcttttaatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacaccacactgatgggtcttgactctttatccaatttgccagtctgtgtcttttaattggagcatttagtccatttacatttaaagttaatattgttatgtgtgaatttgatcctgtcattatgatgttagctggttattttgctcgttagttgatgcagtttcttcctagtctcgatggtctttacattttggcatgattttgcagcggctggtactagttgttcctttccatgtttagtgcttccttcaggagctcttttagggcaggcctggtggtgacaaaatctctcagcatttgcttgtctgtaaaggattttatttctccttcacttatgaagcttagtttgtctggatatgaaattctgggttgaaaattcttttctttaagaatgttgaatattggcccccactctcttctggcttgtagggtttctgccgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgatagattggggaagttctcctggataatatcctgcagagtgttttcccacttggttccattctccccatcactttcaggtacaccaatcagacgtagatttggtcttttcacatagtcccatatttcttggaggctttgctcatttctttttattcttttttctctaaccttcccttctcgcttcatttcattcatttcatcttccattgctgataccctttcttccagttgatcgcattggctcctgtggcttctgcattcttcacatagttctcgagccttggttttcagctccatcccagctcctttaagcacttcgctgtattggttattctagttatacattcttccaaatttttttcaaagttttcaacttctttgcctttggtttgaatgtcctcccatagctcagagtaatttgatcatctgaagccttcttctctcagcttgtcaaagtcattctccatccagctttgttccgttgctggtgaggagctgcattcctttggaggaggagaggtgctctgctttttagagtttccagtttttctgttctgttttctccccatctttgtggttttatctacttttggtctttgatgatggtgatgtacagatgggtttttggtgtggatgtcctttctgtttgttagttttccttctaacagagaggacctcagctgcaggtctgttggaatgccctgccgtgtgaggtgtcagtgtgcccctgctggggggtgcctcccagttaggctgctcgggggtcaggggtcagggacccacttgaggaggcagtctgcccgttctcagatctccagctgcgtgctgggagaactactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttggagcttcctggctgctttgtttacctaagcaagcctgggcaatggcgggcgcccctcccccagcctcgctgccgccttacagtttgatctcagactgctgtgctagcaatcagtgagactccctaggcgtaggaccctccgagccaggtgcgagatat

SEQ ID NO: 12000 - DNA, 288 bp, Homo sapiens
tttgtttgttttccatttgcttggtagatcttcctccatccctttattttgagcctatctgtgtctctgcacatgagatgtgtctcctgaacacagcacactgatgggtcttgactctttatccaatttgccagtctgtgtcttttaattggagcatttagcccgtttacatttaaggttaatattgttatgtgtgaatttgatcctgtcattatgatgttagctggttattttgctcattagttgatgcagtttcttcctagcatccatggtctttacaatttggca

SEQ ID NO: 12001 - DNA, 36925 bp, Homo sapiens
aagtatttttttaattattatactttaagttttagggtacatatgcacaacgtgcaggtatgttacatatgcatacatgtgccatgctggtgtgctgcacccattaactcgtcatttagcattaggtatatctcctaaagctatccctccccactccccccaccccacaacggtccccggtgtgtgatgttccccttcctgtgtccatgtgttctcattgttcaattcccacctatgagtgagaacatgcggtgtttggttttttgtccttgcgatagtttgctgagaatgatggtttccagcttcatccatctccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtcattatagcagcatgatttataatcctttgggtatatacccagtaatgggatggctgggtcaaatggtatttctagttctagatccctgaggaatcgccacaccgacttccacaatggttgaactagtttacagtcccaccaacagtgtaaaagtgttcctatttctccacatcctctccagcacctgttgtttcctgactttttaatgatcaccattctaactggcatgagatggtatctcattgtggttttgatttgcatttctctgatggccagtgatgatgagcattttttcatgtgttttttggctgcataaatgtcttcttttgagaagtgtctgttcatattcttcgtccacttgttgatggggttgttttttttttcttgtaaatttgtttgagttcattgtagattctggatattagccctttgtcagatgagtaggttgcaaaaattttctcccattctgtaggttgcctgttcactctgatggtggtttcttttgctgtgcagaaggtctttagtttaattagatcccatttgtcaattttggcttctgttgccattgcttttggtgttttagacatgaagtccttgcccatgcctatgtcctgaatggtaatgcctaggttttcttctggggtttttatggttttaggtctaacatttaagtctttaatccatcttcaattaatttttgtataacgtgtaaggaagggatccagtttcagctttctacatatggctagccagttttcccagcaccatttattaaatagggaatcctttccccatcgcttgtttttgtcagatttgtcaaagatcagatggttgtagatatgtggtgttatttctgaggcctcggttctgttccattgttctatatctctgttttggtaccagtaccatgctattttggttactgtagccttgtagtatagtttgaagtcaggtagcgtgacgcctccagctttgttcttttggcttaggattgacttggtgatgcggggtcttttttggttccatatgaactttaaagtagttttttccaattctgtgaagaaagtcattggtagcttgatggggatggcattgaatctataaattaccttgggcagtatggccattttcatgatattgattcttcctacccatgagcatggaatgttcttccatttgtttgtatcctcttttatttcattgagcagtggtttgtagttctccttgaagaggtccttcacatcccttgtaagctgtattcctaggtagtatattcctaagtatttttatttggagctattgtcaaaggggttgagttctttatttgattctcagcttggtcatcattggtgtacagcagtgctactgatttgcatatattgattttgtgtcctgaaactttactgaattcacttaccagatctaggagctttttggatgagtctttacggttttctaggtatacaattttatcattgtcaaacagcgagtttgacttcctctttatctatttggatgccctttatttctttctcttgtctgatcactctggccaggacttccatactagtagaagtggctacagtggtcatctttgccttgttccagttctcagggggaatgctttaaacttttccctgttcagtatggtattggaagtatgtttgtcatagatggcttttactaccttgaggtatggcccttctatgccaattttgctgagggtttttatcataaagtgatgttgaattttgtcaaatgcttttgctgcatctattgacatgatcttatgatttttttttttttttgagatggagtcttactctgttgcctgtgctggagtgcagtggcacgacctcagctcactgcaacatttgcctcatgggttcaggtgattctcctgcttcagcctcctgagtagctgggattacaggcatgcaccagcactccctgctaattatttttgtcttttttgtgtgtgtgtgtgtgtttgtttgtttgtttttttgagacagagtctcgctctgtggcccaggctggagtgcagtggcctgatctcggctcactgcaagctctgcctcccgggttcacaccattctcctgcctcagcctccctagtagctgggactacaggcacccgtcaccacgcctggctaatttttttcgtattttttttagtagagatggggtttcaccgtgttagccaggatggtctcgaatctcctgaccttgtgatctatctgcctcggcatcccaaagtgctgggattacaggcatgagccaccgcgccaggcctaatttttgtatttttagtagagacagagtttcaccatgttggccatgctggtttcaaactcttgacttcaggtgatccatccgccttggcgtcctaaagtgctgggattacaggtgggagccaccgtgcccagcctaagctttttttttttttttttttttttgagactgagtctcactctgtcgcccaggctggagtgcagtagtgcgatcttggctcactgcaacctctggctcctgggttcaagcgattctcttgcctcagcctccaaagtagctaggattacaggcgcatgcctccacgcctagctaaatttttttgtgtgtgtattttttttttttttttgtatttgtaatagagacggggtttcactgtgttagccaggctggtctcaatctcctgacctcgtgatctgcccgcctgggcctcccaaagtgccaggattataggcgtgagccactgtgcccagccgatgtattatctttttgatatgctgttggattcaattagctagtattttgttgtggattttcgcatctattttcatcagggatattcttctgtagttttctttttttgttatgtcctttcctggttttggtattgggtgatactggcttcatagaatgagttagggaagattccctctttctctatcttttgaaatagtttcagtaggactggtagcaattctttgaatgtctgatagaattcagctgtgactccatctggtcctggactttttttgttggcatttttttttttttttttttttttgagatggagtcttgctctgtcacccaggctggagtgcagtggcatgatctctgctcagctccgcctcccccaggttcacgccattctcctgcctcagcctactgagtagctgggactacaggtgcccgccaccacgcccagctaattttttgtatttttagtagagacggggtttcaccgtgttagccaggatggtctcgatctcctgacctcgtgatccgcccatcttggcctcccaaagtgctgggattacaggtgtgagccacctcgcctggcctttgttggcaatttttaaattactgtttcaatctcactacttgttattggtctgctcagagtttctacttcttcatgatttaatctaggaaggttatatatttctaggaatttatccatctcctctagattttctagtttgtgaacaaagaaatacaaaagatcattcttgtttgctatttctttcttctgctttctcaaatatgctttagaaaccctctaaggatttttttattattgtatttttcagctcaagaatttctgtgtggttgttttttacatccatctctctattgatattctgtatttggtgagacattgtttacttgtattttatttagtttattggacatggttttctttagctctctaaacatagtttaaatatatgatgtaatgtctatttctagtaagtccagtgtgtgggcttcctgaggtatagtttctgttcatcttttcccctgtgaaggggccaaactttcttgtttctttacatgtctcataaattttttgttcaaaactggaaaatttgaatattataatgcggcaactctggaaattagattctcctcattcctcagggttctttgttgctgctcattgtgggttgtagtttttgcttagtgatgtttctaaactatttttgggaagactatattctttgtcatggacactgaagtctctgtcccacgagcttagtggtgagctagcaatttaccagaaatttccttaaacatctggagacaaaaaaaaaaacacctacaaacattttgtagattagccctgtgttggtgcacaccttcaacgcttatccagtcagtttacaaacttttagacttcacttactgcttgcactgagcataaagatcagctggagctgaaagcttagagaccactcaagtcttttctgagcatgtgtcatcttgctgggtatatgaagcttgttcctcaaggctccccaaagtaactctcttctcaccttttcctcccagacttttttttttttgagacggagtttccctcttgtcccccaggctagagtgcaatggcgcgatctaggctcactgcaacctctgcctcccaggttcaagcgattctcctgcctcagcctcctaagtaactgggattacagccacgcaccaccacgcccggctaatttttgtatttttagtagagacgggggtttcaccatgttgtctaggctggtcttgaactcctcacctcaagtgatctgcccttgaacttccaaagtgctgggattacaggggtgagccaccacgtctggccttcctcccagacttttgacatgtctatttattgacccaaatgcaatgttttgccccaagcagcagcagcttgtttatttgcctttcaatgttttcaaggaatacactgtgcatagctgcttttatgccctgagagttctgagttagtcaaaactaaggcaatcctcttgtgtcattccttcactcttatcccctctgcagacgaatcaaacagataaacacaattttctgagaacaaggtctgctctgccctctctgggaccaggtactcacactgagaacacagactgccatctttcagactcctgccacactaaagttggtgggggtgaggctaagggaaaataccacaaagctttcctactgcacttaagtcatcattttcttgattcagcatttgtttgaatctttgactattttctagagactgacaaagttgattctgaccatctttgctcattttttcatatttctatgcaagaacaggcccttggagctccttactcttcaattttctttttcttttttctttttgagacaggctcttgctctgttgtccagaatggactgcagtagtacaatcatagctcactgcagtctcgaactcctgggctcaagtgatcctcccaccttcagactctcaagtagctgagactataggcacatgccaccatgcccagctaattttcttatttttattttttgtagagactgtcttcctatgttgcccaggctggtctcaaactcatggcctcaagtgatccttctgccttggcctcccaaagcactgggattatagttgtgagccactatgcctggctcaaagaatattttttgatttagaggttattttatttatttattatttatttagagattattcatcatttagagattgccatttaacttcagtaagagttccatttgcatctgatgttttttagttttggagaaaggaaatagtgaagaaatggattcatctccaatcctttggactaaaattcagataatttaagctctagtctcaacttcatttaatttggaactgcatgatgtggtgtcagatttgggttcaaatccagttgtcttgctgtgtaaccttgggaaatttacccagcacttgagttgtttcttcatttgtgcagtggagacaataataccaagatgaagatttcatgagatgtctagcatagacaactctttctcagactggatgcatttaacagttggatgctgaatttataagagtatggatttcataaaaagagcataaatttcatgatatgatgtatattccggaagatataggccgggcgcggtggctcacgcctgtaatcccagcactttgggaagctgaggtggatcacttgaggtcaggcatttgagaccagcctggccaacatggtgaaaccccgtctctacaaaaatacaaaaattagccaggcgtggtggtgtgtgcctgtaatcccagctgcttgggaggccgaggcacgagaatcgcttgaacccaggaggtggaagttgtggtgagcggatattgtgccactgcactccagcctgggtgacagagtgagactccatctcaaaaaaaaaaaaaaaaaaagaaaaagaaaaaaaaataaattttcaagtaccatgtaactctttgagtatgactcaggatataaatgactcagacttaagatttttaagtattgaaatgatactatatcaataaaaaaatgtatcttggcagtttagcacttaaaaaaatctaacttgtgaactaatcatcctttaaaaattcattctacggtcactgaagccttctcccttcccctcctacctcaagaaagtgatcacaaccttctctgtatccatattataacacatatttttccactagtgcagaatattgcatttgtttacatttgtctctaccaccagacagaaagaaactgagagtaaatatctattttttcgtcttcattcaatcagtgaaaatttactgaacatgggctgggcacggtggctcatgcctgtaatcccagcaacttgagaggccgaggtgggcgggccacggggtcaggagtttgagaccagcctggccaacatggtgaaaccccatctctactaaaaatacaaaaaattagccgggcgtggtggtgggcacctgtaatcccagctactcgggaggctgaggcaggagaatcacttgaatctgggaaatggaggttgcagtgagtcgagactgtgccactgcactccagcctgggaaatagagcaagactctatctcaaaaaaaaaaaaaaaaaaagaaaagaaaagaaaagaaaagaaaatttactgaacatgtactatgcaggcatgttagaaagtgagcatctaaagatgagtaagacagtgcccctcttctcaagtgggagacgggaccattacaagatggagtaacaaagatgaacatgtactgaagaacagagggaggatatagaacccaaactgggaagtcaggaaagctgcccagaagttatgtttaaggtatgtttgaagggggagaaagcatttcattaattttgtttgaaaaacattaaaaaaaaaaaaacccttcagaccctaaattctgtagctgcatctgttacaggaaaggggtcccaatccagaccccaagagagtgttcttggattttgctcaagaaagaattctgggtgagtccgcagtgcaaagtaaaagcaagtttattaagaaagtaaagtggtgaaagtacaactactacatagacagagtagggtgctcctgaaagtaagaggaggaacgtgtccatgctaggtacaatgcttgtatatatggggagatgtgttctgctacaagggtttgtgataaaggattaattttctttatatatatgtgtgtatatatatgtgtgtgtgtatatatgtgtatatatatgtgtgtgtatatatgtatgtatatgtgtgtgtgtgtatatatatatatagagagagagagagagtgagagtgagttggagtcttgctctgttgtctaggctggagtgtagtggcgcaatcttagttcactgcaacttccgcctcccaggtccaagtgattctattgtctcagcctcctgagtagctgggattacaggcacccaccaccacatccagctaatttttgtatttttagtagagacaggatttcgccttgttggccaggctggtctcaaactcctgacctcaggtgatccgcccacctaggcctcacaaagtgctgggattacaggcgtgagccactgcgcccggacttaattactgtattttgcaagaatcaatattattatctttaaagcaaaattaggaatgcctttgttctccagatatcgggatatctggaaactcccaagtctgggagtgcttagtaaacattactaatttgttcccttaaccttaaacatctagaggctaggaatgcctgagtttctgggaatgcaacccagcaagccccagcctcattttcctagccctcattcaaaatggagtcgctctggttcaaacacctctgacatatctcccccctccctttacaagaggacccttaatcctaagggttgcagaaggaccaagatccatattctgtaacttcaggctgaataggggcaatgatattcctgcttaaatgttagggtctcttgcatttagggtagagcgaagctcagtcagagagcattggtatggtgaaggtcattcataactccaagttctgacaaaaggtgatatctggaagattaatacgtgtccaatttaagaaagcattgaatgagcttatcttgcattcctacataaagaatacaaccgcaatatattccacaacagcaaagcaaaataagtaaaatcattccaagtaaactaaacaggaaggctgtccaagaactgagcagttgttggaaccaagccgatatagggtcgactgacattacatcaatggcagatatgagtgtctaaagctttcacagcctgggtaatattatgtgaatagtctggaacatacacacatttggttttgatcaaagcataaagtcccccttgggctgctgttaaaatgtccacatacccaatagtttgattatatagagaagacaaagtctgtgcccactcagtaaataagttactcgctccatgattccaacttaaacccaaaagtagaatgccaatccatatctttatgttacccatccctttcatatcttctgaacagtagtcggaggtcactgattggctcacaggaataaacagaatcagtctcttgtgttctgtcggcctatgggacttcataagagacaggtttaattcaagataggtgaactcagctgcttattcccagaagtttaactgcagttggggcactaaggagaatttgatagggtcccttccattttggggaaagttgatctgctggggatccttccttccaagtttataataggacccaatctcccggctgagttttaacaagattctcttccttagtgggggaagggagtcttcgatttccatattcaaggtgtgccttttgcacttgccctaagttgatcacacaattctgtagcttgaaagtatctatatctattaggaagtcagtagttacgaaaagccttccatacattatttcaaaatggctgagctgcagatttcccttaggggccattctagcctgtaataaagctgtaggtaataaagacagccaggtttctgatgtttcttggcatagtttagaaagagtcctttttagggtttgattaacactttctactttccctaagactatggtctccatgccgagtgaaggcggtactgaattcctagggctgaagatatgttttgggtaactgtcgctgtgaaagatgggccattatcgctctgtaagctcttacgcagcccaaatctaggaattattccctttagtaggagttcagaaacgcctctgacacatctactggtcacaaagccaggagcaggcacgataagctggaaggtttagaccaaatggatcatttctgagcctggatgtcggatggagccaacacatcttaatgagattttcccagctggaagtcattatttaggaagcactcattggaatatattaatacaaatcatcactgatgctgtaggcaaggtttagccgaatgtgcttaaactatcacccaaaagtggctgaagaccatctctcaacttttccaccatgagtcatactctattcagctgtattcatattttcaggacccacatgaaagaacaaatacaaggtggtgtcagtggagatgtaccaatacaggtttggggcccaggcactggtattaacaaataataattgtagtaaaatacacataaaatttaccattctttttatttatttatatattttttaagagatgaggatctcactacactgcccagactggagtgcagcagctatacacatacaggatcatagcacactgcagccttgaacttctgggctcaaacgatcctcctgcctcagcctcctgagtggctgggactaagatgcaaaccactgtgctcagcttaatcattttaaaatatatattcattattgttaagtgcattcacattgttgtgcaaccaatttctagaactcttttcatcttgcaaaactgaaactctatacccattaaacaacaccccaatcccccttctccccagcccctggcaaccacctttcttctttctgttcctatgaatttgactactctaggtacctaatataagtggaatcatacagtatttgtttttgtgactggcttatttcacttagcatcatgtcctcaaggttcttccatgttgcagaatgaactttcttcctctttaaggctgaataatgtcccattgtaggtatataccacattttgtttatctgttcatccgtggatggacacttgggttgcttctactttttggctattgtgaataatgctactatgaacatgagtgtacaagtatcttttcaagtccctgctttcaattcctttgaacatataccctaaagtggaattggtggactctatggtaatttgatttttaattttttgaggcaattctagactgttttctatggtggctacaccaatttacatttccaccaacggtacacaagggttacaatttctttatatccttgccaacattttttttgtttgtttgttttagagacaggtattgctctgttgctcaggctggagtgcagtggcgtgatcatagctcactgtaacctcaaactcctgggccaagcgatcctcctgcctcagcctcctgagtagctaggactacaggtgactggttttttgatagtagccatcctaatggtatgaggtggtatctcattctggttttgatttgcatttcccttattattagtgacaggcagtcataattaactcctttattatgcacaggccaagttgagaacacagagtttaagggatgtacaaacacaaacttctgaacagtaatctctaggcgattgttcctgcctctcttctaaataaaagtctgtctctgtgatgattttttttattattatactttaagttctggggtacatgtgcagaacgcgcaggtttgttacataggtatacatgtgccatggtggtttgctgcacccatcaacccgtcatctacattaggtatttctcccaatgctatccctcccccaacccctcaccccccagcaggccccggtgtgtgatgttcccctccctgtgtccatgtgttctcattgttcaactcccacttagcagtgagaacatgcagtgtttggttttctgttcctgtgttagtttgctgagaatgatggtttccagcttcatccatgtccctgcaaaggacatgaactgatccttttttatggctgcatagtattccatggtgtatatgtgccacattttccttatctagtctatcattgatgggcatttgggttagttccaagtctttgccatttctttaagaatgttgaatattggcccccactctcttctggcttgtagggtttctgctgagagatccactgttagtctgatgggcttccctttgtgggtaacccgacctttctctctggctgcccttaacatttttttcatttcaaccttggtgaatctgacaattatgtttcttggggttgctcttctcgaggaatatctttgtggtgttctctatatttcctgaatttgaatgttggtctgccttgctaggttggggaagttctcctggataatatcttgaagagtgttttccaacttggttccattctccccgtcgctttcaggtacaccaatcaaatgtagatttggtcttttcacatagtcccatatttcttggaggctttgttcatttcttttcactctttttttctctaatcttgtcttcctgctttatttcattgagttgatcttcaatctctgatatcctttcttccacttgatcgattcggctattgatacttgtgtatgcttcatgaagttcctgtgctgtgtttttcagcgccatcaggtcatttatgttcttctctaaacataaatacaacatgaagctcctttagctcggaggagtttgtctttacctgccttctgaagcctacttctgtcaattcatcaaactcattctccgtccagttttgttcccttgctggtgaggagttgtgaccctttggaagagaagaggtgttctggtttttggagttttcagcctttttgcgctggtttctctccatcttcgtggatttatctaccttcggtctttgatgttggtgatgttgatactattcctgtttgttagttttccttctaacagtcaggcccctctgctgcaggtctgctggagtctgctggaggtccactccacaccctgcttgcctgggtatcactagaggaggctcagttggaaatgcaggaatcacctgccttctgcgttgatctcgctgggagctgcagaccagagctgttcctatttggccatcttgccagctacctccctctgtgatgactgagtgtcaacttgattggattgaaggatgcaaagtattgttcctgagtgtgtctgtgagggtgttgccaaaggagatttaacatttgagtcagtggactgggagaggtagacccaccctcaatctgggtgggcaccatttaatctgctctcagcatggctaggataaatgcaggcggaacgtggaaagacttcacttgctgagtcttctggccttcatctttctcccgtgctggatgcttcctgccctggaacattggactccaagttcttcagcttttagactcttggacttacaccagtggtttgccaggagctgttgggccttcggccacaccgaaggctgcactgttggcttccccacttttgaggttttgggacatgggctgacttccttgctcctcctcagcttgcagatggtctattgtgggacttcgccttttgattgtgtgagtcaatattccttaataaactcccccactcttttttttttttttttttttgagacagagtcttgctctgctgcccaggctggagtgcaatggctcaatcttggctcactgcaatctccgccccccgggttcaagcgatttctcctgcctcagcctctcctgtaatcctgggattacaggtgcatgccaccatgcccggctaatttttgtatttttagtagagatagggtttcatgttggccaggctggtgttgaactcctggcctcaaagtgatccacccacttgggcctcccaaagtgctgggattataggtgtgagccactgtgcccagcctaaactccccttcatatacacatctatcctattagttctgttcctctacagaaccctaatatacagtctccccacctaaattctacattcacagattaaaggtagattaaactccttcctctttaggaagtctgctcagctcctctagggaaatctctctctcattaggactcttctccaggcaatctagatgtcaggaagcaaacctagtgagcacaaactacagcaggggtgtccaatcttctggcttccctgggccacattggaagaattgtcttgggctacccattaagtaccctaacactaatgatagctgatgggctaaaaaataatcagaaaaaaactcataatgttttaattaagtttatgaatttgtgttgggctgcattcaaagccatcctgggttgcatgcggcccatgggctgagggttggataagcttgaactacagtatggtttccaagcgtcaagggagtaatttgcatctacacttgaaatgtaatccatagggaatttgcagctaaagaggaaacctgtaggtacttccctggaataaacttcagtaaattgcttcacttttctatggcaggtttcttcagcagtcaaaatgaaggggctgatttaaatggtatctaagatccttttggctttgactttctgttgtaacagcatactattacagttgctgatctcattcttgctcagaattgggcagaacccatgtaaatcaagacctcgaggttgggcgcggtggctcactcctgtaatcccagcattttgggagggcgagacaggtggatcacccgaggtcaggagtttgagaccaggcttgtcaacatggtgaaaccgtctctactaaaaatacaagaattagccaggcgtggggtggtgtttgcctgtagtccaagctactcgggaggctgagacatgagaatcgcttgaactcgggaggtggaggctgcagggagccgagattgccccactgcacttcagcctgcgtgacaatgcgagactgcgtctcaaaaaaaaaaaaatcttattaacatatgggttccgatatggtttggatctttgtccccacccaaatctcacgttcaattgtaattcccaatgatggaggtggggcctggtgggaaatgactggatgggggcaggtttctcatgaatggtttagtaccatccctttggtactgtccttgtgatagtgagttatcgcgagatctggtcattgaaaagtgtctgccaactcccctcacctttttgctcctgctctggccatgtgatgtgcttgctccccctttgccttccaccatgattgtaagtttcctgaagcttccccaaaagctgagcagatgccagcatcatgtttcctgtacaccctgcagaactgtgagccaattaaacctcttttctttataaagtacccaatctcaggtatttctttagagcaatgcaataacggtctaatagagttccaagtgcatcctttccaaaaaatatttcaatgcatattaagcaatttgtagttataatggcctccaccagcatttcctagcttcttcagaaatctgactgcagaatatcctccatttcaattgattttaattcagcaccaaatctggatataaaaatattatctattcaaatttaagtgcatctttaatattttgcataatagaacaatagagcaggaaggactactaaggtaatttagcctaatacactttacttagtataaagaaatatgttcagagaggttcaggtgacacctatggtcatatagttagacagaaacagagcaagggctaaaagccagatctctttacttcctgtgcagtgtttctactccatgtttgcaaaagagctgctgtctagtttcatataacttataatctgccagggtaactttcaaatcaagtttttattatcaaaaggaaattacctagtcaaggaatgttcactgtctgggacgaaaggtagatcaattgttgcaaacagtcatttatctactcatcttggttgttttgactcacctaatgggtaacaacattaagaatgagggaccatgtatagattcctagaataatatatcccaatccagaaatacttaaagaaactgtcccatcaaactgtccttaggacaatatgaaatttaaattaatttaattataacttcaaaatgtaaaatcctaattttacaattctagtttagtgtttaaaactcactcctctttagatggtaatcaaaaactcagaatttagattgtaaaagtttattgatatggtcaaaaagcaaacagccagacatttggttatctttgccactacaatgtgtcattctgaactgtatcttaaaaatgcataacaaatgatatttaaaccattaccagaaaagtaaatgaagagtctacttaaggcacttcatatgaaagctaattcaaaattttcacaaaagtcacactattttataagtgtagtaaattaccttctacacattttagccagaatgctgcctttctccttacagaagaatgtgctcttaaagggagaaaaagcaaatacaaaaaattgtcattctgtcaatgttcatgacaaattatctggaactatacagattacatggcagtagtattcccgtggtcaatctgtacaaatcagggcatcttcatacaagtctcataagaaccacagcatagatttggcctgagacaagtacaagaatagcaggtaaggaattcagaatctcacaatttacaagtgagtaattaacaaaaactggctgctccattaaaaagtaaaaggtcaaccatatcccctcatccatgaaatctagtaacgaaaaacaaaaaacccacataaaatatttcttctgaggctactatatccatctctttctgcaaaccacatggcagggttattagaaggtaaatggcaggtggcagtcatagtatctttttaatgtaatacttgtaagatttccttaaaattattttttcacaattacaattatcctatttccacaatagtggcatttcaggttactcttcataactatgggggaggttatagttagatataatgataaccatgaaaacattcttcacagaaatttggttagcacatatggttatttctactgacagaaaccaaaagacaaaataaaaaaaatcccttcaaattggtactttgtttctccacctaaaggaagagaataaagactaaaataacagcaaaacatagaacagctttcgagaaacgcttaatttctatatacaggcatcagctcaatattttatgatttttctttcccattctaagggagtccttttctttcttacttttttttttttttttgagatggagtctcgctctgttgccaggctggagtgcagtggtgtgatcttggctcactgaaacctccatctcctgagttcaagtgattctcgtgcctcagcctcctgtgtagctgggattacaggctcctgccaccacacccagctaatttttatatttttagtagagacggggtttcaccatgttggccaggatggtctcgaactcctgacctcgtgatctgcctgccttggcctcccaaagtgctgagattacaggcgtaagtcactgcgcctggccagggagtccttttctaactgagcctatttttctcttaggtacaaatggaataagtgacaaactctaatttgtagaaacattttaggccatgtataagttacactgattttagcactaagctatatttttatcacagatgggtcaccttaaaagaaaactaaggagatggaatgaatctgaaatctttctaaatacaaggtagttaacaccatactcaagcagaaattataatcctgtatttagagatacttttttttgagacagagtctcactctatcactcaggctggagcgcagtagcgtgatctcggctcactgcaatctccgcctcccaggtattaagcaagtctcgtgcctcagcctcccaagtagctaggattataggcatgagccaccaagcccagctaattttcatatttttagtagagacggggttttgccttgttggccaggctggtctctaactcctggcctcaagcaatccacctgcctcggactcccaatagatgtcttttcatgttcacagctatcgagaagcatagacattgctggtgtggtagctcacacatgtcatcctcgcactttgggagactgaggcgggcggatcacttgagcccaggagttcaagaccagcctggacaacttggcgaaaccctgtctctactaaaaacacaaaaattagcctggcatggcggtgcacacctgtaaatcccagctacttgggaagctgtgacaggagaatcgcttaaacctgggaggcagagtttgcagtcagccgagctcacgccactgcactccagcctgtgtgacacagcgagaccgtctcaaaaaaacaacaaaacaaaaacaatcatagacagcactgtatttcagtaggaaatatgcaaggaggaggagaaacaactgtcttgctgagggctagacgtgtgctctgaagaatggtgttccattttcagaagaccacatgacacacataatttctctactcaaaaggaaagatgcgtaaagtatacacatccacacaaagatgaagaagctaagaatgaattcctaatgtagttatctgtaacaggcatatgtgggaacacctggtcaggacttactttccccatctttggataaggcaatataaaatcagatgaccaagttaactaaagtagttttgagctttgttctaactaaaacaaagtagtagttttacaatttttataatatacttaattgtactaaattaaatgttccataaagttcactgggaagagaaggttaagaggataattattttcaaatacctcagattttgacagaggattgcttgttaaggcactacacatcttctttggttaaatgattaactatttaaatcacttgaaaaaaagaggtaatacaaaatatacaagttgcattcttcttttcaaacacacacgattttcgtttttcaatttccagtactccagtgtctatatatctctgggacctttttaactcatcagaaagctgaaacaaaaatatattccaatctattagtctctgaaagaaaagtaggatttacttttaatcaataagcagtatgttggttttaacagataaaagagcattttggtacgtacatgataatctttgggtatcaataacaaaaagtgagaaacactgagagacccgttagtcttatgacaaaaggaaatagaataacctcaagttaaaatatctcctgaatagagacactaattaataattttattttttcatttttttagagatggggtctcactgtgttgcccagtctggtctgggactcccacgctcaagtgatcattctgtcttagccttctgagtagctgggactacaggcacatgacactgctattgaatcaactctgctgatcaaataattaacagaagtcccagcaaaattaccttcacatctcaattagtattctgtagaggataaattattataattattatttttgagatggggtctcactctattactcagactggagtgcagtggcactctatttcttaaaaaaaagtagaggcgagaagaagtttttaacattaaaaaaaatcatttcttcttcaaaaggaagtataatatgcagacaaggagctatgtgaatagataatggcataaaatgttctaatcattatgtatttctagaatacatatgagatttctagaataaattaggtatggcaaaataaatctaaaagatgttcctgagaaatcacatactaatattgtccattatactataattaatttttatatgggaacatatctgaattacagctgtttgggcatggtggctggctaatgcctataatcccagccctctgggaggctgagcaggagactcgcttgatgccagaagttcaagaccagcctgggtaacatagcaagaccctgtctttacaaaaaataaaaatattagctgggtgtggtcatgtgcagctgtagtcctagcctcttgggaagctgaggtgaaatgatggcttgagctcaggagttcaaggttacaatgagctatgaacacgccattacacttcagcctgagtgacagagtgagaccctgtctctgaaaataaatgaataggccgggctcagtggctcatgcctataatcccagcactttgggaggatgaggcgggtggatcacttgaggtcaggagtccaagacctgatcaacatggtgaaaccccgtttctactaaaaatacaaaattagccgggcatgctggcacacgcctgtaatcgcaactacttgggaggctgaggcaggagaatcgcttgaacccgggaggcagaggttgcagtgagccgagattgcgccattgcactccagtctgggcaacaagagcaaaactccatctcaaaaataaataaataaataaataaataataaataaatagatgaataaataaaaataaagcctatatctttcctttataagctaaaatagtttggaagcaaagcaaaaagaaggatattataaagcaatatcaactctaatcattccaggtattggtaatcactgtataaacaaaaaataagaatcatacctgtatgggtagccatgatatttagatctaaaaatagagagcatccaactgaagaataatacaacaagtccaataccagccacacacattactgcagaaaaataaaaggagagtaaaatgagcaggttgagtataataaataaccatggcagtctatactttctttttttattttattttattttattttattttattttattttattttattttattttattttatttttgagacggagtctcgctctttcgcccaggccggagtgcagcggcgcgatctcggctcactgcaagctccgcctcctgggttcatgccattctcctacctcagcctccagggtagctgggactacaggcgcccgccactgcgcccagctaattttttgtatttttagtagagacggggtttcaccttgttggccaggatggtctcgatctcctgacctcatgatccgcctgcctcagcctcccaaagtgctgggattacaggcttgagccaccatgcccggcctggcagtctatactttcagagagtgaaaaggaaggggtatacattattgataaatctcaacttttcaacaattttcatccctatttcttaatcttcaggaatctgccttcccctttaatttgctccattacaatgtaatagagtaactcctttacataattatgcaattcaaatgtatgaaataatgaattcctttaaagtcatcacactgaaaggtttactgttagaaacactgttacaatcgacaagaaaatcacccatttggttttttggttttcttttttttttttttttgagtcagggtcttgctctgttgcccaggctgaagtgcagtggcacaatcacagctcactgcagtctcaacctcctgggctcaagcaatcctcccactacagcctcttgagtagctgggactacagatgtgtgccaccatgcctggctaattttttaatttttttgagaagacggtgtctcactacattgcccaggctggtgttgatctcctgggctcaagtgatcttccgcttcagcctcccaaagagctgggattacaggcatgagccacggtgcccggcttacttatttattgaactttaaaacccctaaaagtggccttgtagtattgataaacattaacttagacatctgatgacttcattgtgatagcctcacttgaaagtactttattcatgcacagataactacacagccttatatatgtaactcaataaacatggatttcttatttgaatgagaaaaaaaatctgatccctagccctagattcatagctctctccactaatcccacatgtcatgtcctacattagcacagcagttattaaagtgaactacaaatactaatccccaaatgcgcaagtatggattgtcatgatgtgaagctctttcaatccccggactaaaaatggctaagaactatagagatagggatgtagggaagcatgtgtccaacagcaaaggaagctctagggcaggggtgtccaatcttttggcttcccagggccgtactggaagaagagctgtcctgggccacaaataaaatacactaacactaatgatagctgataagctgaaaaaaaaaaaaattgcagaaaaaaaccctcatgatgttttaaggaagttgacaagtttgtgttgggccgcatgtggcccacagactggacaagtttgttctagggtaacatacttagtgactgataagaaaatcaattttcggccgggcgctgtggctcatgcctgtaaccccagcactctgggaggccaaggcgggtggatcacgaggtcaggagttcaagaccagcctggccaagatgatgaagccccatctctactaaaaactacaaaaaaaattagccaggcgtggcggcaggcacctgtaatcccagctactcgggaggctgaggcaggataatcgcttggcaaagcttgcagtgaaccaagatcgcgccactgcactccagcctaggcgaaaaagcaagcctctgtctcaaaaaaaaaaaaaaaaaaaaaaaaaaagaaaagaaaagaaaatcaactttcagttttgttttacttatggaacaattcttttgccttttctaattgttacacaatatgactagggcttaatgtgtaaatgttaaacaatatttctctttaattcttttctaatttacaaaaaagaagtgcagcttgctgccaatgctcatttaattttatataatcacgctgtttgaggctgaagtaaatctgactgattttcaatgtgaaaataaaacaaaaactgttgttggagttattactaaacagaactaacatcagaatcgtctgaatcatcacaatagtctatttcagaaaaattgaattcatcaaatgaatctttggccaacaactgttcgagaatggtgtaaacattacacgtggaatgctacattttctaggatttgacattttcagtgatcaagaattactatattttgtaaatggaaataccactataatggaaataaaaatggactgatgtctagtatattagtatattattctatttacagcactctgttttcagtagtggtaatggatcacttgaacccagtgatatctaacatatcaattttgtttccaaagttgatatactagagtggatgtgaaaacaataattaaagcacgatattttgtggcagagttatctcagcgtaaacactgcagccacaagcactgccagtgagtattctcagggcaaatgggaaaagggttaacttaaccaaagaagtgaaagaactctatgatgaaaactataaaacactgctgaaagaaactgaagaggacatcgaaaaatggaaagatgttccacgttcatggattggaagaatggatgttgttaaaatgtccatactatctaaagcaatctatagattcaatgcaatccttattaaaataccaatgacaacttcacagaaatagaaaaaacaaaatttatatgaaatcacaaaagaccaatgatagtcaaagctatcctaagcaaaaagaacaaaactggaggaatcatattacttgacttcaaattatactatagagttatagtaaccaaaacagcatagtactggtgtaaaaacagacatacagaccagtgggacagaagacagaactcagaaacaaacccatacacctacagtgaactcattttcaacaaaggtgccaagaacatccactggagaaaacacagtctcttcaataaaaggtgccaggagaactggatatccataggcagaacaaaactagacccctatctcttgccatataggaaaatcaagtcaaagtggattaaagacttaaatctaagactgtacaccatatatatatatatgcatatatgtatatatatgcatatatatacatgtgtgtatatatatgcatatatgtatatatatgcatatatatacatgtgtgtatatatgcatatatgtatatatatgcatatatatatatacatgtgtgtatatatatgcatatatatatacacacacacacataaataaaagacaagagtcttgctctgttgctcaggctggagtgcagtggcatgatcttggctcactgcaacctccacttcctgggccaagcaatcctcctgcctcagcctcccaagtagctgggactacaggcacacaccaccacacctggctaatttttgtatttttagtagagacagggtttcaccatgttggccaggctggtctcgaactcctggcctcaagtgatctgcccttcttggcctcccaaagcattgggattacaggtgtgagtcactgtgcctggcctaagactgcaaactattaatatgaaacaactataagaaaacaatggggaaactctccaggacattagtctgggcaaaaatttcttgagtaataccccagaagcacaggcaaccaaagcaaaaatagacaaatgagatcacatcaagtttaaaagcttctgcagagcaaaggatacaatcaacaaagtgaggagtcaatccacagaatgggagaaaatatttgcacagtacccatgtgacaaggggttaataaccagaatataaaaggagctcaaacaactctacaggaaaaaaactaatgatctgatcgaaaaaacataaaatcttttttttttttttttgagacggagtcttgctctgtcgcccaggctggagtgcagtggtgtgatctcagctcactgcaagctccacctcccgggttcacgccattctcctgcctcagcctcccaagtagctgggactacaggtgcctgccaccatgcccagctaatttttttgtattttttttcagtagagatggggtttcactgtgttagccaggatggtctcgatctcctgacctcatgatccacctgcctcggcctcccaaagtgctgggattacaggcgtgagccaccgcaaaaaaagaaaatatttcaatagacgtttctcaaaagaagacatacaaatggcaagtaggcataaaaaaactactcaacatcaatgatcatcagagaaatgcaaataaaaattgcaatgagatatctatcatctcaccccagctaaaatggcttatatccaaaagacaagcaataataaatgctggcgaggatgtggaaaaaagggaacccttgtacactgttgtacactgttggggggaatgtaagttagtataaccactaagaagaacagtttggaggttcctcaaaaaactaaaaattgaaccaccatatgatccagcaatcccactgcttgggtatacacccacagaaaaataaatcagtataccgaagagatatctgtactcccatgtttgttgtagcactgttcccaatagccaacatttggaagcaacctaaatgtccatcaacagatgaatggataaagaaaacgtggtacatatatacaatggagtactattcagtcattaaaaaaataagatcctgtcacttgcaacaacatggaactggaaatcattattattattgttgagatggagtctcgctctgtcacccaggctggagtgcagtggcgccagcttggctcacttcaacctctgccttccaggttcaaacaattctcctgcctcagcctcctgagtagctgggattacaggtgtgcaccactacgcccagctaatttttgtattttagtagatacggggttttaccacgttggccagggtagtctagaactttctgacctcaaataatctgccccacttggtctcccaaagtgctgggattacaggagtgagccaccatgcccagccttggaagtcattaagtgaaacaattcaggtacagaaaaaaaaatcatatgttctcacttatttgtgggatcaaaaaatgaaaacaattgaactcatggacacagagagtagaaggatggttaccagaggctgggaacggtagttggggaatgccgggggaagtacggatggctaatgggtaccaaaaaaaatagaataaataagacctactatttgatagcacaacaggataactatagtcaataataatttaattgtacattttaaaataactaaaaaagtataattggattgtttatgacacaaagggtaaatacttgaaggatggatactgcagtctccgtgatgtgactattacacattgcatgcctatatatcaaaacatctcatgtatcccataaatatatacacctactatgtacccacaaaaattaaaaataaaatacttttcctgagtattaacacatgctgagtgtagacaagttagccttttattctctaagaaaatgtactcatagactgcgtgtgatggctcacgcctgtaaatcacagcatttggggaggccaaggcagaaggattgcttgagcccaggagttcaagaccagcctggacaatgtagcgaggccccatctctacaaaaaattacccaggtgtggcagtgcatgcctgtagtcccacctactaggaaggctgaggtgggaggatcacctgagccagggaggtcaaggctgcagtgagttatgatctctccacagcactccagcctgggcgacagagtgagaccctgtctcagatttaaaaaaaagaaaaagaaaatgtgcacatacgtatatacagcatcactctgtatatatttgtatcctcctcttttcatacatctaaaagtgcttagagcagttcccagaacatgctaaagaaacgtctattaatttgtgatcattttgttaggtaagaaacttaggagatcaaattgtgactatttcagtatatgttgccaaaatgtttaacaatttaagttcatgtcagtaatgtactttgatggccttttcccaagaataaacactgaaataggcaatttttaaacagtcaggcaaagtctacagccatagcaccctgaacgcgcctgatctcgtaaaaagtcaggcagtgaaaggacatatactgactggattaaaaactataaaatgcttactttggcagcatatatactaaaactggaatcatacagagaagattagcatggcccctgtgcaaggatgacatgcaaattcgtgaagtgttccatatttttttaaaaaaattttaaaaactgatacattaattatttttctaacacgtaaaaattcatttttttagagattgagtctcgctctgctgcccagactgaagtgcagtggtgtgatcatagctcactgcagcctctaactcctggcctcaagccatcctcctgtcccagcctcacaagtagctgggactacaagtgcgttgtaccacatccagctaaaaaaaatctattttaattgagcaaaacaagtatttctcaaattttaagttcagtatcttcatcttttttctagaagttaaagtaaatattagactttatttaggtagggtaatttttatgacatttaacttttttatttatttatttattttgagatgaagtctcactccgtcgcccaggctggagtgcagtagcgcgatctcggctcactgcaacttccgcctcctgggttcaagtgattctcatgcctcaaactcccaagtagctgggattacaggcacgtgacaccatgcctggctaatttttgcttttttagagacggggtttcgccatgttggccaggctagtctcgaactcctgacctcaggtgatccacctgccttggcttcccaagtgttgggatttacaggtgtgagtcaccacgcctggttgacatttaactttttaatcataaaaggaaaatcttgacttatttcatgaaagtaaaaccaaattacattgttagattctctctgcaacagataacaatgtgtgaatattctaatatataaaaagttcatgcaggctgggcatggtggctcacgcctgtaatcttagcactttgggaggccacagtgggaaaggttgcttgagcacaggagatacagaccaacctcggcaataaagtgagaccccatctctacaaaaaataaaattaaattaactgggagtggtggcatgagcctgtggtcatagctacctgggaagctgaggcagtaggactgctggagcccaggagttcgaggctacagtgagtcattattgtggcactgcactccagcctgggcaacagagtaaggcctggccttaaaaaaaaaaaaaaaatgtccagctgagcacggtggctcacgcctataatcccagaactttaggaggctgaggcaggcacatcatgaggtcaggagttcgagaccagcctggccaacatggtgaaatcccgtctctactaaaaatacaaaaattagctgggcgtggtgacgtgcacctgtaatcccagctacatgggaggctgaggcaggagaattgcttaaacccaggaggcggaggttgcagtaagccaagatcacaccactgcactccagtctgggagacagagcaagactccgtctcgaaaaaaaaaaaaaaaaattccttgcaaaccaaataaaagggctaagactctaacagataaatggcaaaagacaaaaggacaatttatagaaggaaaaacataaacacaaatgactagtaaacatttaggaaaatatttgaccttataaaaataaaaggagtacaaaataatacatttccaccttatctgattggcaaatatatatgtatctataaaacagatacatattaatgagattaatgctgataaaattacaatgaaatggctgggcacagtggttcatgtctgtaaccccagcactttgggaggccgaggcgggcggatcacgacgtcaggagatcaagaccatcctggctaacacagtgaaacctcatctctactaaaaatacaaaaaaattagccaggcatggtggcgggtgcctgtagtcctagctactcgggagactgaggcaggagaatggggtgaacctgggaggcagagcttgcagtgagctgagatcgcgccaccgcactccagcctgggcgacagagcaagactctgtcttaacaacaacaacaacaacaaaaccaatgaaacaaacattctttttttttttttctttaagatgaagtttcactcttgttgcccaggctggaatgcaatggcacgatctcggctcactgcaacctctgcctcccaggttcaagcgattctcctgcctcagcctctcaactagctgggataacaggcatgcgccacaacgcctggctaatttttttttttttttgagatggagtctcgctttgtcacccaggctggagtgcagtggcgtgatctcggctcgctgcaacctctacctcctgggttcaagcaattctcctgcctcagctgcctaagtagctgagattacacacgcacgccaccatgcccagctaatttttgtatttttagtagagacgggggtttcaccacgttggccaggctggtctcaaactcctgaccttgtgatccacctgccttggcctcccaaagtgctgggattacaggcgtgagccaccgcgtctggccaaatttttgtacttttagtagagacagggtttcatcatgttcatcaggcttgatggcctcgaactcctgacctcaagtgatccacccgcctcggtctcccaaagtgccaggattactggcataagccactgcgcccggccaaaacaaacattcttaaataccagtagtagaaatctaaattattttaacttgccaaaataatctgtaatgattaaaacatcaagagaattgaaaatactcagacagaggaccacacagttattcttcttctaggaatctaccttaaggaaacaatattaaataagaatgatggctgggcgtggtggctcatgcctgtaatcctagcacttcaggaggctgaggcaagtggatcacctgaggtcaggagttcaagaccagcctggccaacatggtgaaaccccgtctctactaaaaatacaaaaaaaaaaaagaaaaaaaaaaccccaaaaaacaaaaaaactagccgggcgtggtggtgggcgcctgtaatcccagctactcaggaggctgaggcaggagaatcacttgaacctgggaggcagaggatgcagtgagccgagattgcaccactgcactccagcctgggtagtaagagcaaaactctgtctcaaaaaaaaaaaatgatgcttaatgtatcatgatagttactgaagaataattatagttaaaattaggaaaaaactaaacattgaaaaaaatcggaatagttaaattataatatagagtataagtcagccaggcacggcagctcacgcctgtaatcccaacactttgggaggctgaggtgggaagatcacttgagtccaggggtttgaggccagcctgggcaaagtgacaaaaccccatctctacaaaaagtacaaaatataagctgggcatggtggcacatgcctgtagtcccagctactagggaagttgaggtgtgaggacagcttgagcctaggggcggaggttgcagtgagctatgattatgctactgcactccagcctgagtgacagagtgagaccctatcttaaagaaaacaaacaataacagagtataagtttaaaattatgtatatagaaaaagttattagttatttaactccagtttaaaaagggggtgtgaagtgtcaaaattttatatatacagtttttaaggtttttataagtggaaagaaatatattacaatttaaaaataattagtttttcagtggtggaatgtttcatgctcctgtttttttacattttctataatgagcatatattaattttaaaatagtaaaggagtttaataacagatatgacatttaaagaaaaaaatagtaaaggggtaaaataacctacttatcctataagtaagaggaaaagtgattaagagatcactctttttccatagtacaggcagcactgttacattttgagtaaggtgacttactctttcgctttccaatatccatgtcagaggtagcagcttcacataaaagcaccattcctaaggtaactccaccatctaagaaaaattgtttaaggagaaattcgcacagacaaaaaagacataccattttactatttccagtttctcatgaagaaaattaaaatgaatatataaaccttcaactcttcattataaaaaaccaaaataaggaatcttgtatctatacggcatgacaattatttactatgaagatacaaaaaattaaaattggaagattacttcatttgtgcaaagaaaaattgatattttaaacaaatgtcccaccataacttacagatgaaatatgagttttcccgaaattgtactttgaaataacctgtctggacattcagttattgccctgacctcaaacacatttaaaaatattaaatggcttttttttttttttgagacagggtctggctctgtcacccaggctggagtgcagtgacgcaatctcagctcactacaacctccacctcccaggctcaagccaccctcccacctcagcctcctgagtagctgcaactacaggtgctcaccaccacgcccagttaaattctgtaatttttttttttttttttttgtagagatggggttttgccacgttgcacacgctggtcttgaactcttgacctcaagcaatccacctgcctcggcctcccaaagtgctgggattataggtgtgaatgaccacgcccagccctaaatagccattttgaatatttcaccccacctccctaaagaacacatttgaaatatatatcatttagggagaacagtaactactttttatttgaaaattaatttctgaaaaatctctcctggcctagtttagcggttcacacctgtaatcctaacagtttgggaggccgaggcgggccgattgcttaagtctgggagttcaaaaccagcctgggcaacatggtgagaccctgtttctaccaaaaaatacaaaaaattggccaggctggtggcacatacctgtagtcctagctacttgggaggctgaagtaggaggatcacttgagcctggaaggttgaggctgcagttagccgtgatcataccactgcactctagcctgcatgatagaactagactgtgtcaaaaaaaaaattctccatattttcaataatactttattttttaaatttttcccatgccaagatgccaaaagtacatcaataattagcctttaaagcacaaattactactaacctatctaattttatcctattctaataaaaaagaaaaatcctggccgtgcgtggtggctcacgcctgtactcccagcactttgagaggcagaggtaggcggatcaccttaagtcaggagttcaagaccagcctggccaacatggcaaaaacccgtttctactaaaaatacaaaaattagccgggcgtggtggcaggcgcctgtaatcgcagctacttgggaggctgaggcaggataatcacttgaacccgggaggcagaggttgcagtgagccgagatggcactactgcactccagcctgggtgacagaacaagactccatctcaaaaaaaaaagaaaaagaaaaagaaaaatcccacatgtgccatgaccacacttttattcagcttaataggagctgcataaatacaaaatacaacaacccatacaaataggtaacagatggcatggttgaatattaaaataagcaagttcaaattttaaagcaaatagaatgtgttctagtagaaaagagagacagattcaccctgcagtttagtgaatactaacagcagtaaaacactcccaaatcaattatacatatgtacatacatgttgtatgctaccgcatgtgggtatcattaagcggaaagggaaaaatatgtgccctttagatgaggcctgaatttataattggctctaaaatttgacttgtcatcccttcattaccatcttgcattcttttttaaattttttaatttaatttatttatttgagacagggtctcactctgtcacccagggtggagtgcaatggcataatcacaactcactgcaacctccacctcccaggctcaagagatcctcctgcctcagcctcctgagtatctaggactacaggtgcataccacgccacgttcgttttgttgatttttttgtagaaacggggtctcactatgttgcccaggctggtctcaaactcctggactcaagcaattctccagcctgggcctcccaaagtgctggaattacaggcgtgaaccaatgtgcctgtgccccatcttgcattctttcttcaatagcctcttgttagggatgatgcccattcatcatgttttcagttgttcagccaagtctcttctccagcaattttttctgagttctttatctgcaggtttgtgcaaagattgatcatttcgttttttaaaatttttatttattatactttaagttttagggtacatgtgcacatcatgcaggtttgttacacatgtatacatgtcccatgttgctgtgctgcacccattaactcgtcatttaacattaggtatatctcctaatgctatccctcccccagtatttttttgccagtattttattgaggatttttgcatcaatgttcatcaggaatatttggtctaaaattctctttttttgttgtgtgtctgccaggctttggtatcaggatgatgctggcctcataaaatgagtcaaggaggattccctctttttctattgattggaatagtttcagaaggaatggtaccagctcctccttgtacctctggtagaatttggctgtgaatccatctggtcctggacttttttttggttggtaagctattaattattgcctcaatttcagagcctgttattggtctattcagagattcaacttcttcctggtttagacatgagagggtgtatgtgtccaggaatttatcaatttcttctagattttctagtttatttgtgtagaggtgtttatagtgttctctgatggtagtttgtatttctgtgggatcggtgatgatatcccctttatcattttttattgcatctatttgattcttctctcttttcttctttattagtcttgctagcggtctatcaattttgttgatcttttcaaaaaccagctccaggattcactgatttttttgaagggttttttgtgtctatttccttcagttctgatctgatcttagttatttcttgccttctgctagcttttgaatgtgtttgctcttgcttctctatttcttttaattgtgatgttagggtgtcaattttagatctttcctgctttctcttgtgggcatttagtgctataaatttccctctacacactggtttaaatgtgtcccagagattctggtatgttgtgtctttgttctcggtttcaaagaacatctttatttctgccttcattttgttatgtacccagtagtcattcaggagcaggctgttcagtttccatgtagttgagtggttctgagtgagtttcttaatcctgagttctagtttgattgcaccgtggtctgagagacagtttgttataatttctgttcttttacttttgctgaggagtgctttacttccaactatgtggtcaattttggaataggtgttgtgtggtgctgcaaagaatgtatattctgttgatttggggtggagagttctgtagatgtctattaggtccgcttggtgcagagctgagttcaattcctggatatccttgttaaccttctgtctcgtggatctgtctaatgttgacagtggggtgttaaagtctcccattattattgtgtgggagtctaagtctctttgtatgtctctaaggactcgctttatgaatctgggtgctcctgtattgggtgcatatatatttaggatagttagctcttcttgttgaattgatccctttaccattatataatggccttctttgtctcttttgatcttttttggtttaaagtctgttttatcagagactaggattgcaacccctgcctttgttttccatttgcttggtagatcttcctccatccctttattttgagcctatgtgtgtctctgcacgtgagatgggtctcctgaatacagcacactgatgggtcttgattctttatccaatttgccagtctgtgtcttttaattggagcatttagcccacttacatttaaggttaatattgttatgtgtgaatttgatcctgtcattatgttagctggttattttgctcgttagttgatgcagtttcttcctagcatcaatggtctttacaatttggcatgtttttgcagtggctggtgccggttgttcctttccatgtttagcgcttccttcaggagctcttgtcgggcaggcctggtggtgacaaaatctctcagcatttgcttgtctgtaaaggattttatttctccttaacttatgaagcttagtttggctggatatgaaattctgggttgaaaattcttttctttaagaatgttgaatttggcccccactctcttctggcttgtagagtttctgctgagagatcagctgttagtctgatgggcttccctttgtgggtaacccggcctttctctctggctgcccttaacattttttccttcatttcaactttggtgaatctgacaattatgtcttggagttgctcttctcgaggaatatctttgtggcgttctctgtatctcctgaatttgaatgttcgcctgccttgctagattggggaagttctcctggataatatcctgcagtgttttccaacttggttccattctctttgtcactttcaggtacaccaatcagacgtagatttggtcttttcacatagtcccatatttcttggaggctttgttcgtttctttttattcttttttctctaaacttctcttcttgcttcatttcattcatttgatcttccatcactgataccctttcttccagctgatcgaatcggctactgaggcttctgcattcatcacgtagctctcgtgccgtggttttcagctccatcaggtcctttaaggacttctttgcattggttattctagttagccattcgtctaaccttttttcaaggtttttaacttctttgccatgggttcgaacttcctcctttagctcggagaagtttgatcatctgaagccttcttctctcaattcatcaaagtcattctctgtccaggtttgtttctttgctggtgaggagctgcattcctttggaggaggagaggcactctgatttttagaattttcagtttttctcttctgttttttccccatctttgtggttttatctacctttggtctttgatgatggtgacatacagatgaggttttggtatggatgtcctttctgtttgttagttttccttctaacagtcagcaccctcagctgcaggtctgttggagtttgctggaggttccctccagaccctgttggcctgggtatcaacagtggaggttgcagaacagcagatattggtgaacagcaaatgttgctgcctgattgttcctctggaagttttgtttcagaggagtacccggctgtgtgaggtgtcagtctgtccctactgggggatgcctcccagttaggctacttgggggtcagggacccacttaaggaggcagtctgtccgttctcagatctcaagctgcatgctgggagaaccactactctcttcaaagctgtcagacagggacatttaagtctgcagaggtttctgctgccttttgtttggctatgccctgctcccagacctggagtctacagaggcaagcaggcctccttgagctgcggtgggctccacccagttcgagcttcccgg

SEQ ID NO: 12002 - DNA, 4109 bp, Homo sapiens
gtctaacctttaaatctttaatccatcttgaattgatttttgtataaggtgtaaggaagggatccagtttcagctttctacatatggctagccagttttcccagcaccatttattaaatagggaatcctttccccattgcttgtttttctcaggtttatcaaagatcagatagttgtagatatgcggcgttatttctgagggctctgttctgttccattgagctatatctctgttttggtaccagtaccatgctgttttggttactgtagccttgtagtatagtttgaagtcaggtagtgtgatgcctccagctttgttcttttggcttaggattgacttggtgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttcgttgagcagtggtttgtagttctccttgaagaggtccttcacatcccttgtaagttggattcctaggtattttattctctttgaagcaattgtgaatgggagttcactcatgatttggctctctgtttttctgttgttggtgtataagaatgcttgtgatttttgtacattgattttgtaccctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattgttttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagccctcttgatcatggtggataagctgtttgatgtgctgctggattcgttttgccagtattttattgaggatttttgcatcaatgttcatcaaggatattggtctaaaattctcttttttggttgtgtctctgcccagctttggtatcagaatgatgctggcctcataaaatgagttagagaggattccctctttttctattgattggaatagtttcagaaggaatggtaccagttcctccttgtacctctggtagaattcggctgtgaatccatctggtcctggactctttttggttggtaaactattgattattgtcacaatttcagctcctgttattggtctattcagagattcaacttcttcctggtttggtcttgggagagtgtatgtgtcaaggaatttatccatttcttctagattttctagtttatttgcgtagaagtgtttgtagtattctctgatggtagtttgtatttctgtgggattggtggtgatatcctctttatcaatttttattgtgtctatttgattcttctctctttttttctttattagtctggctagcggtctatcagttttgttgatcctttcaaaaaaccagctcctggattcattgattttttgaagggttttttgtgcctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaattgccctctacacagtgctttgaatgtgtcccagagattctggtatgttgtgtctttgttctcgttggtttcaaagaacatgtttatttctgccttcaattcgttatgtacccagtggtcattcaggagcaggttgttcagtttccatgtatttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaagtgtatattctgttgatttggggtggagagttctgtagatgtctattaggtccacttggtgcagagttgagttcaattcctgggtatccttgttgactttctgtctcattgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccattatgtaatggacttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggtgattttgctcgttagttgatgcagtttcttcctagtctcgatggtctttacattttggcatgattttgcagcggctggtaccggttgttcctttccatgtttagtgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggtgttctctgtatttcctgaatctgaacattggcctgccttgctagattggggaagttctcctggataatatcctgcagagtgttttccaacttggttccattctccccatcactttcaggtacaccaatgagacgtagatttggtcttttcacatagtcccatatttcttggaggctttgctcatttctttttattcttttttctctaaacttcccttctcgcttcatttcattcatttcatcttccattgctgataccctttcttccagttgatggcatcggctcctgaggcttctgcattcttcacgtagttctcgagcgttggttttcagctccatcagctcctttaagcacttctctgtattggttattctagttatacattcttctaaatttttttaaaagtttttaacttctttgcctttggtttgaatgtcctcccatagctcagagtaatttgatcgtctgaagccttcttctctcagctcgtcaaagtcattctccatccagctttgttctgtttttggtgaggaactgtgttcctttggaggaggagaggcgctctgcgttttagagtttccagtttttcgattctgttttttccccatctttgtggttttatgtacttttggtctttgatgatggtgatgtacagatgggtttttggtgtggatgtcctttctgtttgttagttttccttctaacagacaggaccctcagctgtaggtct

SEQ ID NO: 12003 - DNA, 4810 bp, Homo sapiens
tttacttattttttaaattatactttaagttctagggtacatgtgcacaacgtgcaggtttgttacatatgtatacatgtgccatgttggtgtgctgcacccattaactcgtcatttacgttaggtatatctcctaatgctatccttcgccccttcccccaccccacgacaggcccccagtgtgtgatgttccccatcctgtgtccaagtgttctcattgttcaattcccacctatgagtgagaacaagcagtgtttggttttctgtccttgcgatagtttgctcagaatgatggtttccagcttcatccatgtccctgtaaaggacatgaactcatccttttttatggctgcatagtattccatggtgtatatgtgccacattttcttaatccagtctatcattgttggacatttgggttggttccaagtctttgctattgtgaatagtgccacaataaacatatgtgtgcatctgtctttatagcagcatgatttataatcctttgggtatatacccagtaatgggatggttgggtcaaatggtatttctagttctagatccttgaggaatcaccacactgtcttccacaatggttgaactagtttacagtcccaccaacagtgtaaaagtgttcctatttctccacatcctctccagcacctgttgtctcctgactttttaatgattgccattctaactgatgtgagaagttacctcattgtggttttgatttgcatttctctgatggccagtgatgatgagcattttttcatgtgtctgttggctgcataaatgtcttcttttgagaagtgtctgctcatatccttcacccactttttgatggggatgtttgattttttcttgtcaatttatttaagttctttgtagattctggatattagccctttgtcagatgggtagattgtaaaagttttctcccattctgtaggttgcctcttcactctgatgatagtttcttttgctgtgcagaagctctttagtttaattagatcccatttgtcaattttggcttttgttgccattgcttttggtgttttagacatgaagtccttgcccatgcctatgtcctgaatggtatggcctaggttttcttctagggtttttatggttttaggtctaacatttaagtctttaatccatcttgaattaatttttgtataaggtgtaaggaagggatccagtttcagctttctacatatggctagccagttttcccagcaccatttattaaatagagaatcctttccccatttcttgttcttgtttttgtcagatttgtcaaagatcagatggttgtagatgtgtggtattatttctgagggctctgttctgttccattggtctatatctgttttggtaccagtaccatgctgttttgattacagtagccttgtagtgtagtttgaagtcaggcagcgtgatgcctccagctttgttcttttggcttaggattgtcttggcaatgcgggctccttttggttccatatgaattttaaagtagttttttccaattctgtgaagaaagtctttggtagcttgatggggatggcattgaatctataaattaccttgggcagtatggccattttcacgatattgattcttcctctccattagcatggaatgtttttccatttgtttgtgtcctcttttattttgttgagcagtggtttgtagttctccttgaagaggtccttcacatcccttgtaaattggattcctaggtattttattctctttgaagcaattgtgaatgggagttcactcatgatttggctctctgtttgtctgttattggtgtataggaatgcttgtggtttttgcacattgattttgtatcctgagactttgctgaagttgcttatcagcttaaggagtttttgggctgagacaatgaggttttctaaacatacaatcatgtcgtctgcaaacagggccaatttgacttcctcttttcctatttgaataccctttatttctttcccctgcctgattgccctggccagaaattccaacactatgttgaataggagtggtgagagagggcatccctgtcttgtgccagttttcaaagggaatgcttccagtttttgcccattcagtatgataatggctgtgggtttgtcctaaataggtcttatcattttgagatatgttccatcaatacgtagtttattcagtttttagcatgaagggctgctgaattttgtcaaaggccttttctacatctattgagataatcatgtggttgtctttggttctgtttatatgatggattgcctttattgatttgcatatgttaaaccaccgttgcatcccaaggatgaagccaacctgatcatggtcgataagcttttgatgtgctgctggatttggtttgccagtattttattgaggatttttgcatcgatgttcatcagggatattggtctaaaattctctttttttgttgtgtctctgccaggctttggtatcaggatgacgctggcctcataaaatgagttagggaggattccctctttttctattgattggaatagtttcagaaggaatggtatcagctcctctttgtacctctggtagaattcggctgtgaatccatctggtcctggacattttttggttggtaggctattcattattgcctcaatttcagagcctgttattggtctgttcagggattcaacttcttcctggtttagtcttgggagggtatatgtatccaggaatttatccatttcttctagattttctaatctatttgcatagagatgtttatagtattctctgacggtagtgtgtatttctgtgggattggtggtgatatcccctttatcattttttattgcatctatttgattcttctctcttttgttctttattagtcttgctagtggtctgtcaattttgttgatcttttcaaaaaaccagctcctggattcattgattttttgaagggttttttgtgtctgtatctccttcagttctgctctgatcatagttatttcctgccttctgctaccttttgaatgtgtttgctcttgcttttctagttcttttaattgtgatgttagggtgtcaatattagatctttcctgctttctcttgtgggcatttagtgctataaattttcctctacacactgctttaaatgtgccccagagagtctggtatgttgtgtctttgttctcattagtttcaaagaacatctttatgtctaccttcatttcgttatgtacccagtagtcattcaggagcaggtggctcagttttcatgtagttgagcagttttgagtgaatttattaatcctgagttctagtttgattgcactgtggtctgagagacagtttgttataatttctgttcttttacatttgctgaggagtgttttccttccgtcaattttggaataagtgtgatgtggtgctgagaagaatgtatattctgttgatttggggtggagagttctgtagatgtctgttaggtctgcttggtgcagagccaagttcaattcctggatatccttgttaactttctgtctctttgatctgtctaatgttgacagtggggtgttaaagtctcccattattattgtgtgggagtctaagtctctttgtaggtctctaaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagaataggactgcaacccctgcttttttttgttttccatttgcttggtggatcttcctccatccctttattttgagcctatgtgtgtctctgcatgtgagatgggtctcctgaatacagcacactgatgggtcttgactctttatccaatttgccagtctgtgtcttttaattggagcatttacccatttacatttaaggttaatattgttatgtgtgaatctgatcctgtcattatgatgttagctggttattttgctcgttagttgatgcagtttcttcctagcctcaatgatctttacaatttggcatgtttttgcagtggctggtaccagttgttcctttccatgtttagtgcttccttcaggagctcttgtaaggcaggcctggtggtgacaaaatctctcagcatttgcttgtttgtaaaggattttatttctccttcacttatgaagcttagtttggctggatatgaaattctgggttgaaaattcttttctttaagaacgttgaatactggcccccactctcttctggcttgtagagtttctaccgagagatctgctgttagtctgatgcgcttccctttgtgagtaacccgacctttctctctggctgcccttaacattttttccctcatttcaactttggtgaacctgacaattatgtgtcttggagttgctcttcttgaggagtatctttgtgacgttctctgtatttcctgaatttgaatgttggcctgcgttgctaggttggggaagttctcctggatagttctcctgtagagtgttttccaacttggttccattctccccatcactttcaggtacaccaatcagatgtagatttggccttttcacatagttccatatttcttggaggctttgttcatttctttttactcttttttctttaaacttctcttgtcacttcatttcattcatttgatcttcaatcactgataccctttcttccactttatcgaattggctactgaagcttgtgtatg

SEQ ID NO: 12004 - DNA, 3889 bp, Homo sapiens
gtctaacatttaagtctttaatccatcttgaattatttttttgtataaggtgtaaggaaaggatccagtttcagctttctacatatggctagccagttttcccagcaccatttattaaatagggaatcctttccccatggcttgtttttctcaggtttctcaaaaatcagatagttgtagataagcggcattatttctgagggctctgttctgttccattggtctatatatctgttttggtaccagtaccgtgctgttttggttactgtagcctggtagtatagtttgaagtcaggtagcgtgattcctccagctttgttcttttggcttagaattgacttggcaatatgggctcttttttggttccatatgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttattggtgtaaaagaatgcttgtgatttttgcacattgattttgtatcctgagactttgctgaagttgcttatcagtttaaggagattttgggctgagactttggggttttctagacatacaatcatgtcatctgcaaacagggacaatttgacttcctcttttcctaattgaatgccctttattcccttcttctgcctgattgccctggccagaacttccaacactatgttgaataggagtggtgagagagggcatccctgtcttatgcccgttttgaaaaggaatgcttccagtttttgtccattcagtatgatattggctgtgggtttgtcacagatagctcttattattttgagatatgtcccatcaatacctaattggttgagagtttttagcatgaagggttgttgaattttgtcaaaggccttttctgcatctattgagataatcatgtggtttttgtctttggttctgtttatatgctggattatgtttattgatttttgtacgttgaaccagccttgcatcccagggatgaagcccacttgatcatggtggataagctttttgatgtgttgctggattcggtttgtcagtattttattgaggatttttgcatcaatgttcatcaaggatattggtctaaaattccctttttttgttatgtctctgccaggctttggtgtcaggatgatgctggcctcataaaatgagttagggaggattccctctttttctgttgattggaataatttcagaaggaatggtaccagctcctcattgtacctctggtagaattcggctgtgaatccatctggttctggactttttctggttggtaagctattaattattgcctcaatttcagagcctgttattggtctattcagagattcaacttcttcctggtttagacttgggagagtgtacgtgtcgaggaatttatccatttcttctagattttctagtttatttgtgtagaggtgtttatagcattctctgatggtagtttgtatttctgtgggatcggtggtgatatcccctttgtcatttcttattgcatctatttgattcttctctcttttcttctttattaggcttgctagtggtctatcaattttgttgatcttttcaaaaaaccagtcctggattcattgattttttgaagggttttttgtgtctctatttccttcagttccgctctgatcttagttatttcttgccttctgctagcttttgaatgtgttttctcttgtttctttagttcttttaattctgatgttaggatgtcaattttagacctttcctgctttctcttgtgggcatttagtgctatactggtagtatagtttgaagtcaggtagtgtgatgcctccagctttgttcttttggcttaggattgacttggcaatatgggctcttttttggttccttatgaactttaaagtagttttttccgattctgtgaagaaagtcattgatagcttgatggggatggcattgaatctgtaaattaccttgggcagtatggccattcctctacacactgctttgaatgtgtcccacagattctggtatgttgtgtctttgttctcgtttgtttcaaagaacgtctttatttctgccttcatttcgttatgtacccagtagtcattcaggagcaggttgttcagtttccatgtagttgagcgcctttgagtgagtttcttaatcctgagttctagtttgattgcactgtggtctgagagacagtttgttataatttctgttcttttacatttgctgaggagtgctttacatccaactatgtggtcaattttggaataggtgtggtgtggtgctgaaaaaaatgtctattctgttgattttgggtggagagttctgtagatgtctattaggtccacttggtgcagagctgagttcaattcctggatatccttgttaactttctgtctcgttgatctgtctaatgttgacagtggggtgttaaagtctcccattattattgtgtgggagtctaagtctctttgtaggtcactaaggacttgctttatgaatctgggtgctcctgtattgggtgcatatatatttaggatagttagtagttctccttgttgaattgatccctttaccattatgtaatggccttcttttctcttttgaactgtgttggtttaaagtctgttttatccaagactaggattgcaacccctgccttttttgttttccatttgcctggtagatcttcctccatccctttattttgagcctatgtgtgtctctgcacgtgagatgggtttcctgaatacagcacactgatgggtcttgactctatatccaatttgccagtctgtgccttttaattggagcatttagcccatttacatttaaggttagtattgttatgtgtgaatttgatcctgtcattatgatgttagctggttattttgcttgttagttgatgcagtttcttcctagccttgatggtctttacaatttggcatgtttttgcagtggctggtaccagttgttcctttccatgtttagtgcttccttcaggagctcttttagggcaggcctggtggtgacaaaatctctcagcatttgcttgtctgtaaagtattttatttctccttcacttatgaagcttagtttggctggatatgaaattctgtattgaaaattcttttctttaagaatgttgaatattggcccccactctcttctggcttgtagagtttctgccaagagatcagctgttagtctgatgggcttccctttgtgggtaaccccacctttctctctggctgcccttaacattttttccttcatttcaactttggtgaatctgacaattatgtgtcttggagttgctcttctcgaggagtatctttgtggtgttctctgtatttcctgaatttgaatgttggcctgccttcctagattggagaacttctcctggataatatcctgcagaatgttttccaacttggttccagcctccccgtcactttcaggtacaccaatgagacgtagatttggtcttttcacatagtcccacatttcttggaggctttgtttgtttctttttattcttttttctctaaacttctcttcacgcttcatttcattcatttcgtcttccatcgctgataccctttcttccagttgattgcatcggttactgaggcttgtgcattcatcatgtagt

SEQ ID NO: 12005 - DNA, 4908 bp, Homo sapiens
tttttttctttctctttatgtatttattgagttacttacttgtttttgatatctttttttattatactttaagttctaggttacatgtgcacaacgtgcaggtttgttacgtatgtatacatttgccatgttggtgtgctgcacccattaactcgtcatttacattaggtatttctcctaatgcttatccctcccacctctccccaccccacaacaggacccagtgtgtgatgttccccttcctgtgtccaagtgttctcattgttcagttcccatctatgagtgagaacatgtggtgtttggttttctgtccttgcaatagtttgctcagaataatggtttccagcttcatccatgtccctacaaaggacatgaactcatccttttttatggctgcatagtattccatggtgtatatgtgccacaatttcttaatccagtctatcattgatggacatttgggttggttccaagtctttgctattgtgaatagtgccacagtaaacatacgtgtccatgtgtctttatagcagcatgatttataatcctttgggtatatacccagtagtgggatggctgagtcaaatggtatttctactctagatccttgaggaattgccacactgtcttccacaatggctgaactagtttacagtcccaccaacggtgtaaaagtgttcctatttctccacatcctctccagcacctgttgtttcctgactttttaatggtcaccattctaactggtgtgagatggtatctcattgtggttttgatttacatttttctgatggccagtgatgatgagcattttttcatgtgtcttttggctgcataaacatcttcttttgagaagtgtctgttcatatcctttgcccactttttgatggggttgtttgattttttcttgtaaatttgtttaagttctttgtagattctggatattagccctttgtcagatgcgtagattgcaaaaattttctcccattctgtaggttgcgtgttcactctgatgatagtttcttttgctgtgcagaagctcgttagtttaattagatcccatttgtcaattttggcttttgttgccattgcttttggtgttttagtcctgaagtccttgcccatgcctatgtcctgaatggtattgcctaggttttcttctagggtttttatggttttaggtctaacatttaagtctttaatccatcttgaattaatttttgtataaggtataaggaagggatccagtttcagctttctacataaggctagccagttttcccagcaccatttattaaatggggaatcctttccccatttcttgtttttgtcaggtttgtcaaagatcagatggttgtagatgtatggtattatttctgagggctctgttctgttccattggtctatatctctgttttggtaccagtaccgtgctgttttggttactgtagccttgtagtatagtttgaagtcaggtagcgtgatgcctccagctttgttcttttggcttaggattgtcttggcaatgtgggctcttttttggttccatatgaactttaaagtaattttttccaattctgtgaagaaagtcattggtagcttgatggggatggcattgaatctataaattaccttgggcagtatgaccattttcacgatattgattcttcctatccatgagcatggaatgttcttccatttatttgtgtcttcttttattccaatgagcagtggtttgtagttctccttgaagaggtccttcacatcccttgtaagttggattcctaggtattttattctctttgaagcaattgtgaatgggagttcactcatgatttggctctctgtttgtctgttattagtgtataggaatgcttgtgatttttgcacattaattttgtatcctgagactttgctgaagttgcttatcagcttaaggagattttgggctgagacaatggggttttctaaatatacaatgatgtcatctgcaaacggacaatttgacttcctcttttcctaattgaataccctttatttctttctcctgtctgattgccctggccagaacttccaacactatgttgaataggagtggtgagtgagggcatccttgtcttgtgccagttttcaaagagaatgcttccagtttttgtctattcaggatgatattggctgtgggtttgtcataaatagctcttattattttgagatacgtcccatcagtacctagtttattgagagtttttagcatgaagggctgttgaattttgtcaaagcccttttctgcatctattgagataattatgtggtttttgtcattggttctgtttatatgatggattatgtctattgatatgtgtatgttgaaccagccttgcaacccagggatgaggccaacttgatcgtggtggataagctttttgatgggctgctggattcggtttgccagtattttattgaggatttttgcatcgatgttcatcagggatattggtctaaaactctctttttttgttgtttttatgccaggctttggtatcagaatgatgctggcctcataaaatgagttagggaggattccctctttttctatcgattggaatagtttcagaaggaatggtaccagctcctctttgtacctctggtagaattcggctgtgaatccatctggtcctggactttttttgtttggtaggctattcattattgcctcaatttcagagcctgttattggtctattcagggattcaacttcttcctggtttagtcttgggagggtgtatgtgtccagtaatttatccatttcttctagattttgtagtttattttcatagaggtgtttatagtattctctgatggtagtttgtatttctgtaaaattggtggtgatatccccattatcattttttatcgtgtctatttgattcttctctcttttcttctttattagtcttgctagtggtctatcagttttgctgatcttttcaaaaaaccagctcctggattcattgattttttttttgaagggtttgttgtgtctctgtctccttcagttctgctccgatcttagttatttcttgccttctgccaacttttgaatgtgtttgctcttgcttctctagttcttttaattgtgatgttagggtgtcaattttagatctttcctgctttctcttgtgggcatttagtgctataaatttccctctacacactgctttaaatgtgtcccagagattctggtatgttgtgtctttcttctcattggtttcaaagaacatctttatttctgccttcatttcgttacgtacccagtagtccattgttcagtttccatgtagttgagtggttttgagtgagtttcttaatcctgagtctagtttgattccactgtggtcagagagacagtttgttgtaatttctgttcttttacatttgctgaggagtgttttacttgcaactatgtggtcaattttggaataagtgcaatgtggtgctgagaagaatgtgtattctgttgatttgggatggagagttctatagatgtctattaggtccacttggtgcagagctgagttcaattcgtggatatccttgttaactttctgtctcgttaatttgtctaacattgacagtggggtgttaaagcctcccaatattattgtatgggagtctaagtctctttgtaggtctctaaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgccttttttttgttttccatttgcttggtagatcttcctccatccctttattttgagcctatgtgtgtctctgcccgtgagatgagtctcctgaatacagcacacttactggtcttgactctctatccaatttgccagtctgtgtctttcatttggagcatttagcccatttacatttaaggtgaatattgttatgtgtgaatttgatcctgtcattatgatgttagctggttattttgcttgttagttgatgcagtttcttcctggcatcaatggtctttacaatttggcatgtttttgcaatggctggtaccggttgttcctttccatgtttagtgcttccttcaggagctcttgttcagcaggcctggtagtgacaaaatctgtcagcatttgtttgtctgtaaaggattttatttctccctcacctatgaagcttagtttggctggatatgaaattctgggttgaaaattcttttctttaagaatgttgactattggcccccactctcttctggcttatagagtttctgctgagagatccactgttagtctgatgggcttccctttgtgggtaacccgacctttctctctggctgcccttaacattttttccttcatttcaactttggtgaatctgacgattatgtatcttggagttgctcttctcgaggagtatctttgtggcgttctctgtatttcctgaatttgaatgttggcctgcgttgctaggttggggaagttctcctggattatcctgaagagggttttccaacttggttccattctctccatcactttcaggtacactaatgagatgtagatttggtcttttcacatagtcccatatttcttggagtctttgtttctttttactcttttttctctaaacttctcttcttgcttcatttcattcatttgatcttcaatcactgataccctttcttccacttgatcaaatcagctactgaagcttgtgcatgtgtcacgtagttcttgtgccatggttttcagctccatcaggtcatttaaggtcttctc

SEQ ID NO: 12006 - DNA, 45964 bp, Homo sapiens
gtctaacatttaagtctttaatccatcttgaattaatttttgtatgaggtgtaaggaagggatccagtttcagctttctacatatggccagccagtttttccagcatcatttattaaatagggaatcctttccccatttcttgtttttgtcaggtttgtcaaagatcggatggttgtagatgtgtggtattatttctgagggctctgttctgttccattgatctatatctctgttttggtaccagtaccatgctgttttggttactgtagccttgtagtatagtttgaagtcaggtagcgtgatgcctctagctttgttcttttggcttaggattgtgttggcaatgtgggctcttttttggttccatatgaactttaaagtagttttttccaattctgtgaagaaagtcattggtagcttgatggggatggcattgaatctataaattaccttgggcaatatggccattttcaggatattgattcttcctatccgtgagcatggaatgttcttccatttgtttgtgtcctcttttatttccttgagcagtggtttgtagttctccttcaagaggtccttcacataccttgcaagttggattcctaggtattttattctctttgaagcaattgtgaatgggagttcactcacgatttggctctctgtttgtctgttattggtgtataagaatgcttgtgatttttgcacattgattttgtatcctgagactttgctgaagttgcttatcagtttaaggagattttgggctgagatgatggggttttctaaatatacaatcatgtcatctgcaaacagggacaatttgacttcctcttttcctaattgaataccctttatttctttctcctgcctgattgccctggccagaacttccaatactatattgagtaggagtggtgagagagggcatccctgtcttgtgccagttttcaaagggaatgcttccagtttttgcccaatcagtatgatattggctgtgggtttgtcatagatagctcttactattttgagatacgtcccatcaatacctaatttcttgagagtttttagcaagaagggttgttgaattttgtcaaaggccttttctgcatctattgagataatcatgtgttttttgtcattggttctgtttatatgctggattacatttattgatttgcgtatgttgaaccagccttgcatcccagggatgaagcccacttgatcatggtggataagctttttgatgtgctgctggatttggtttgccagtattgtattgaggatttttgcatcgatgttcatcagggatattggtctaaaattctctttttttgttgtgtttctgccaggctttggtatcaggatgatgctggcctcataaaatgagttagggaggattccctctttttctattgattggaatagtttcagaaggaatggtaccagctcctccttgtacctctggtagaattcagctgtgaatccgtctggtcctggacttttcttggttggtaggctattaattattgcctcaatttcagagcctgttattggtctattcagggattcaccttcttcctggtttagtcttgggagggtgtatgtgtccaggaatttatccatttcttctagattttctagtttatttgcatagaggtgtttatagtattctctgatggtagtttgtatttctgtgggattggtggtgataacccctttatcattttttattgcatctattgattcttctctcttttcttctttattagtcttgctagcagtctatcagttttgttgatcttttcaaaacccagctcctggattcatttactttttgaagggctttttgtgtctctatttccttcagttctgctctgattttagttatttcttgtcttctgctagcttttgaatgtgtttgctatggcttctctagttcttttaattgtgatgttagggtgtcaattttagatctttcctgctttctcttgtgggcatttagtgctataaatttgcctctacacactgctttgaatgtgtcccagagattctgatatgttgtgtctttgttttcattggtttcaaagaacatctttatttctgccttcatttcgttatgtacccagtagtcattcaggagcaggtttttcagtttccatgtagttttgtggttttgagtgagtttttaaatcctgagttctagtttgattgcactgtgatctgagacacagtttattataatttctgctcttttacatttgctgaggagtgttttacttccaacaatgtggtcagttttggaataggtgtggtgtagtgctgagaagaatgcatattctggtgatttgtggtggagagctcggtagatgtctattaggtccgctaggtgcagagctgagttcaattcctggatatccttgttaactttctgtctcgttgatctgtctaatattgacagtggggtgttaaaatctcccactattattgtgtcagagtctaaatctctttgtaggtctctaagaacttgctttatgaatctaggtgctcctgtattgggtgcatatatatttaggatagttagctcttcttgttgaattgatccctttaccattatgtaatggccttctttgtctcttttgatctttgttggtttaaagtctgttttatcagagactaggattgaaacccctgctttttatttgttttccatttgcttggtagatcttcctctatccctttattttgagcctatctgtgtctctgcatgtgagatgggtttcctgaatacagcatactgatgggtcttgactgtttatccaatttgccagtctgtgtcttttaattggagcatttagcccatttacatttaaggttaatattgttatgtgtgaatttgatcctgtcattatgatgttagctggttattttgctcgttagttgatgcagtttcttcctagcctcgatggtctttacaatttggcatgtttttgcagtggctggtaccagttgttcctttccatgttagtgcttccttcaggagctcttgtaaggcaggcctggtggtgacaaaatctctcagcatttgcttgtctgtaaaggcttttatttctccttcacttatgaagcttagtttggctggatatgaaattctgtgctgaaaattcttttcttttaagaatgttgaatattggcccccactctcttctggcttgtagagtttctgccgagagatcagctgttagtctgatgggcctccctttgtgggtaacccgacctttctctctggctgtccttaacatttttttccttcatttcaactttggtgaatctgacaattatgtgtcttggagttgctcttctcaaggagtatctttgtggtgttctctgtatttcctgaatttgaatgttggcctgccttgctagattggggaagttctcctgggtaatatcttgcagagtgttttccaacttggttccactctccctgtcactctcaggtacaccaattagacatagatttggtcttttcacatagtcccatatttcttggaggcttcgtttgtttctttttactcttctttctctaaacttctcttctcgcttcatttcattcatttgatcttccatcactgataacctttcttccagttgatcgaattggctactgaagcttgtgcatgcgtcacgtagttctcatgccacggtttccgctccatcagttcatttaagaacttttctacactggttattctagttagccattcatctaatcttttttcaaggtttttagcttctttgtgatgggttggaacattttcctttagcttggagaagtttgattgtctgaagccttcttctctccactcatcaaagtcgtcctccgtccagctttgttctgttgctggcgaggagctgcgtccctttggaggagaagaggcgctctgatttttagaattttcagcttttctgctctggtttctccccacgtttttggttttatctacctttggtctttgatgatggtgatgtacagatggggttttggtgtggatgtcctttctgtttgttagttttccttctaacagtcaggacccttagctgcaagtctgttggagtttgctggaggtccactccacaccctgtttgcctgggtatcaccagtggaggctgcagaacagcaaatattgcagaacagcaaatgttgctgcctgatcattcctctggaagctttgtctcagaggggcacctggccgtgtgaggtgtccgtctgtccctcctgggaggtgcctccctttttggctactcgggggtcagggatccacttgaggaggcagtctgtccgttctcagatctcaaactctgtgctgggagaatcactactctcttcaaagctgccagacagggacatttaagtctgcagaagtttctgctgccttttgttcagctatgccctgccccgagaggtggagtctacagaggcaggcaggcctccttgagctgcagtaggctcctcccagttcgagcttcccggctgctggctgctttgtttacctattcaagcctcagcaatggcgggcacccctcccccagcctcgctgccactttgcagtttgatctcagactgctgtgctagcaatgagtgaggctccatgggtgtgggaccctctgagccaggcacgggatatagtctcctggtgtgccgtttgctaagaccattggaaaagcgcagttattagtgtgggagtgacctgattttccaggtgcagtctgtcacagcttcccttggctagcaaagggaattccctgaccccttgcaattctcaggtgaggcgatgcctcgccctgcttcaactctcgcttggtgggctgcacccactgtcctgcactcactgtccaacactccccagtgagatgaaccctgtacctcagatggaaatgcagaaatcacccgtcttctgcatcgctcatgctgggagctgtagactggagctgttcctattcggccatcttagagcttgttctttagccatatagaattcttttttattccctggaaacctcaggctgtttcttgtttctgtgcctttgcttgtgccattccgtctgcttgaaatacacccttcatacccacatcccctcaccctcaccccaccttcatccaattggttagtacctatgcattccttaaagatcacctcctatttcctcagcttccttgatgcccagggtagacttccatcgttacactctactgtgttcatctgttgatgaatctgtctccacttagcagattttaatcaccttgagggcaagcactgtatcctgcacttgtcagtgtacttgcgacatagcaggagtgtaatatatgtatgccaaatgaaagaattaatcaaatgcttccagatattttgctagctgtggctgccttgcctttttaccctgctaactgatgttttcactgaagttataatcacttgtccagttttctcactgtgttacaaggctttcaaaaagtagagcggattttcattgagactttgcaagaccaccttaacatataggaaaatactgtgttttgttatcaaaaccaggactggaaagcacctgcttagatggacattagccaaaactattgcctcccgctctgcctgctgggaagaatgcttcagatctcacatttgttgtgaaaatacagtctcataggtaagaagtgctaagtaaagtagcggagtggaaggtaagaatgtttcctagcaattgaacatttgtatcgtctacagtatttgtgtttctggatggcaggggtcagagagatatttaatgtgctgaagaaatatgatgacagccatttgtatccagagataagaaaatgaaaggtggctcatgatgtacaggaggtgctgagagtgattgaaagtctgtgaacttgtatgttttcatgtctgtcagtgggtattttttctccttccttcaaagtgccagcctttttataaacagtctttattcttcaccccctttgaaagaacaaacaaagaaaaaaatcaacctagcatttaatagccttcgctgagaaagaagcaagcgcattccaatgtgtcacatacccacttagcctagcctggcagaggctctcacttagaaaaggctgccatgatgtacctgcagagctttggctgtgaagggatttcaaaggctttagtggtcccagcttattgtttttcaccaatgccatcatctccaacaaaagaagcagtggccccattgagcctttcctgccttgttctttacttcggcaagcttcatcttcttttgttcctgctcaatcttcacctctttcaaaagcattcatatctaactctctccgggttggatgttagcactgcctttttcctccaatagtaggagtgtatccaagggagaagttcagtcctttgaaaggagctggatgttggcgggaaggtggagcttggggataaagttataaaagcaaatgctgtattttcttttcaataaatgcccttcaaatctcacagaaatctttgtcataggttaaaattgctaaagtctcagactctaatgcagatctttatggggttttgttcttaaaaatttgaggacttgatttcagtgggcaatattagcttgtattggatctttcatttactaagtggatttttgcaaaatgcaaggtctttgcaaatccataaatacacaaagggtagctccttctttctcagccctggtcctctaattagcttcataaggtatgaacctccaaacacctaccatttaccttaagggttctgaaagtactgccttgggaagctatttccccccacccccaccccagtgttttcttttttgtttttacccaggttggagtgcagtagcatgatcataggtcactgcagcctcaaactcctgggctcaagctatcttcccatttcagcctatggagtagctgggactaaggtatgtgccaccatgctctgcacattttttttttagaggtggggtctcgctatgttgcccaagctgatctcgaactcctggcttaatgggatcgtcctgcctcagcctcccaaagtgttgggattagaggcgtgagtcactgcacctggctgccctggaaggtattagcaaatcaattcaacatagtttatcagcacaagttggggagatcaataggatgttgaagggcatacaggagtataaaggggtgcctcatagagttgggggagggtgttttttacttcctctaaaagattggtggatgaagagaattgggaaagggcagatatttgacagaaggtcatgagctcctgaggggaaggaaaagaattttcgtgagattcctccaaaacactgtttttggtttcttatgcataactctagactctttttttgcttatacaaacaaatatgaattaatgattatccacatctctttttacacagacagtagtatggtatacatagtattctgcattttgcttttttcacttaacaagattcctgaataatatttcagtgtcagctgggcatggtggctcatgcctgtaatcccagcactttgggaggctgaggcaggaggatcacttgagcccaggagttcaaaaccagcctgggcagaatagcaagatcccatgtctataactataactataactataactatatatatatttcagtgtcaatatatatagagagacttatcattcctttttacggcagtatattattctatttactgcgtgtgcctatttttctaactaaatcccgattgatgaaattgctttttttctcagtcctttgcctccatgtgtttgcaagtatatctgtaggataaattcctaaaaaagaatagctggatcaaagggtaagtgcatttgtaataactgtgttctatatgttgccaaattgccctccatagaagcatgtggattattaatatgatcccaccagcaatgtattagaatgcctttatagcttcattatgtaatgagttgtcaaagttgatttttgccagtctgatagatgaaaaagttgtttgattttgcatttatatttaagttgtttgagtttgcatttatatcattatcagcgagattgcatgtattttcttatgtataagaaccacttggattttctttttggttaagtgccgtttgaccatcttttcctgttgggttcttgccctttggacatagtgtaatgatctttaggatatgaacttactgagacaccttcctccagtggtgtaaaaaattgggatgcagaactccattaccttgaatgtaaaacactgggcatcgcactgtcaggagtagagctgggttgagatgagaggagcacagggagaggttggtctctgtgaacataatctctaaaaggggtgccttttcaacaaatattgtaaaggttttctgctgactatgatgaaaagacatcagaggaagcagtgtgaaaactagacacatgaggaagatagccaaggatgacatgtgtccactccccctactggctaacagcccaggccaacatagcttcattctgtctagctcggtccctgccccaattggaaactggttatgcttctttccactgactgctggcaaacagttctgtgtgactgggatttgtgagtagtggcagcttcaggtcaatgcaggcagagctcactctgtgaagacttcattttccttccttttttcatttttgatagtatattttatttaacctaatatatccaaaatattaaaatttcaacatgtaatcaatataaaaatagtgagatattttacattcttaattttcatattaagtctataaaatccagtgtgaattttgcacttacagcatatttcacattacaccagccacatgtcaaatgcttgatatccacatgatctagtgggtacaatatcgaatagcaggatagcacacttataggcaatggtgaactgttttttttttttttttgagacagagtcttgctctttccctcaggcctgactgcagtggtgctatctaggctcactgcaagctccgcctcccgagttcacaccattctcctgcctcagtctcccgagtagctgggactacaggcacccgccaccgcacccggctaattttttgtatttttagtagagacagggtttcatcgtgttagccgggatggtctcgatctcctgacctcatgatccgcctgcttcggcctcccaaagtgctgggattacaggcatgagccaccgcacccggcctgcaatggagaactgttgaagcatttttttttcaataactatactttttacatgtcttacatttaaataatatttgctttatgtagagttcccatgtgctctttatccagttttcccaaggtgaatgttttcattttttctattttataacttttttcgttctacctcttagaagatttccgtcatgtttctctttaaaattatgaagatttaagaaaattcaaaatctacattttatttcatatttttattttcttagagctttttcctgttttctggatgttcctttttataacctactgtttttgtttcatggatgtaatatctccttttatctttctggagatattaattatagcctttatctactacgccccacattgtttctattgccttagtggttttttttttttttttaaactgtttcctgtcagtggttttcctgaaatgtttggtgattcctggttgtctttttatatttaagcatgcaccattattacatattaaaggacataaatggacatgcacattgacttgtcaactagtaaaaaaatcacattgggtgattgtgtggggacacaacttattaatttgggtggcgtattaatatctatagatattttctcatggaccactctgtatccccatagaggtacctttcaatttcctgcctgggcagtataatcatgtctgcaggtattgtcaaagatacatgagggaagggagctgagggtttcaccattcactatgtggccattcatttaatgcctttcatttccatccttcacttgtatcttcaactgttcttagtgtctccaggtacagattatgtctggtttaaccttactagaaattgatcctggagtagtagtaagtagttgtctgttatcagccccattttgcatcccttcttttagttatatcttgcacctctaattcttgtgccttcccaggacttttgaggtccagataagcttgtgcactgatgagtactcttaatgaaggtttatatttcaactttctttaatctgctgtcagttactgcctagtttttggctttccagttttctaagatgtttacttcttttgttttctgttgcctcttctcccgttctctttgtacatatgggtttacgcatttattattcacttactgtcattgcagtggggattcaggagaaaatggagataaatgtgtgtgtttaattacatgtatttagccagaagtgtcaatatttgattataagaattaccctgatataaaaatggttactgcctgatgtgctctgtaaccgccagaggctgaaaaatgtctcctgtatgaactttgtcatgttttggtgccctgaatgcttaaaatttcaaagctgtcatggacaacgctaacccaactgcctcaaagtgaataactgaatagttttcctctctcagaaccctgggatttttctctgaaggcacaaagggacagaattatagcatgttggaggtggaagagtacttccagatcattgatcacagtgtttcccaagttgtgatctatggaacatttgttcctcaaggttctctgagagaaaaggtttctgtggtcaaataaattcagaaactctctatagtagtgccccactttgagatttcacagaacatacttttttagtctctgagaagtttgcagaaactttcattaccaacatatggcagactttgctgagctggcacaaaaggaaggattctacagaggccaaaagtagttgaaaacaggaggaatcctgagaagtaaaccagcctccaaactggcattttccctgaggactttttctcaactctggagaacttgagctcctcctccccgttagtaactgcttaggggtcaggaacagaaggtgcagcctagagcctagacagacagttttacaggaaatccctgcataaagctgggatcccaaaagccacaccttaatgtgatggtgaatgataactagtcctgtaagtattaaagaaataaaatcagtagttcaaatcatcctgtgatgagaacagcaggctcagattgttcaaaggagagttcagcctaacactttaagaagacataatttcaattttatacaaattattttagagaaagtaagatggggaatacaccgcaactttttctgtggagtcaataaaaccttgataacaaaatcagataaagataatttaaggaaaggaaaattacaggactaagtcacttatgaacacgtttaaaaatctcaaacaaaatattataaaataaaacccaacaaagtataaaaaagataattcttcagaaccaagcagaggttaccctagaaatgtaaggtcgatttaatattagaaaatcggccgggcgcggtggctcacgcctgtgatcccagcactttgagaggccgaggcgggtggaatgcttgaggtcaggagtttgagatcagcctggccaacatggtgaaaccccatctctgctaaaaatgcaaaaagtagccgggtgtggtggagggtgcctgtaatcccagctacttgggagactgaggcaggagaatcacttaaatttgggaagcagaggttgcagtgagctgagattgtgcctgggcaacagggtaagactctgtctcaaaaaaaaaaaaaaaaaaaaaaaagaaaagaaaagaaaaagaaaatcaattaatgtaattcactatattaacagaaaataatgtatgatgatgtcaattgatgtaaaaaagcatcaggcaaaattcaaagtccatttatttttttgaaaaaagcttttcaaaccagaaataaaagggaacttctgtgtaacttgatgcaggaaatctgtaaaaatcctacactgaacgtcttttttctttttctttttttcttttgagacaaggcattgctcttcatcccaggttggagtgcagtggcatgatcatagctcactgttatcttgagctctcgggcttatgtaattctcctacttgagcctctcaggcagctagaagtaaaggcacctgccattatgctgagctaattaaaacaaattatttttctgtagagacaagattgtatcatgtttcccaggctggtcttgaactcctggcctcaagcggtcctccccattcttggccaaagtgctgggattataggcttgagccaccccgtctgccctccacataatttctgatgggagaatattgaaaatattcctttcaagttaagagacaaagatgctgactctcattacttacgtttatttaatattatgcttgaggttctagtcactttatgaagacaagaaaaataaacaaaagatacaataattggaaaggaggaaataaactaccattattagtagattatatgattttctgcttggaagatttaaatatctaagggtaattattataactaattagaatttagcaagactgacagatttaaaaaatcaatgtacataaatcaattgcatttctattcaccaggaacaattattcaaaatgttaaaaagtacaataaaaaagaaaacatttgatagcaatcacaaatataaggcagccaagaattaaagttctttatggggagcattgtaaaaacagagagatataccgtggataggaagtctcactactagaaataccagaattactaaattcatctacagatttaacacaattccattcaaattctcaatagagttttccatagaatttgatatgctgcttctaaaatttatatggaagagccaagggctaataatacactcccaaagataaaaccagcacacacccaaagaaaaagaaccaggctgggtatggggatggagtaggtgggggcttgtccttccaaggcttactataaaaatacaataattaagaatgtattgataatgagatgattttttttctcttttttcttttttttcccttgaggcagggtctcgtactctattgcccaggctggagtgcagtggcacaatcacggcctactgcagccttgacctcctgggctcagatgatcctcccacctcagcctccccattagctgggactacagacgtgggccaccaggcccaactaatttttgtactttttatagagacagggtttcgcagtgttgctcagacttgtctcaaacttctgggctcaagtgatccacctgcctcagcctcccacagtgctgggcttacagctgtgagccactggacccagctgagtctaatttcattgaatgaaatatagtttatgtacaataaaatacacctagtttaaaatgtagaggttaatgaatttacataaatatacaaacactacctctctgcagctagtcacttctcccaacccatagtcgcaggcaaccactgacgtcctttttgtcactatggatttgttgggaatcaccactttggaaactcagttaaagttgaacttctgcacaccctgtgatctagctatttgacttctaggaatgtgctctagggaagttcttgcgcatgtgcccaggaagcaagcctgtgagtatccacgagcatcaccgctgcgtgccaaccccagccctgctctgcgggactcctcctgctttagctacaccaccgcttcctttcactttttcctccacttttttcttctcttgttttgtatttttttctaatttcttttctgtctctttccctgtttcttccttgcttctgagcttttgtatctccgatttactttttttcaggtcattactaagcaataaaccttcttttgcattggctataaccttagtacttgagttttcttggctatttttgtcattacccactcttcagcagctgttttctggaagagatgtagaaaagaaaagaaaacaaaacaaaacagtccttcagattttatgactttctggatgttggaggtgtcagaataccgacctccaggtagaggggggtagagagatcacaacaccacatatgtctggcagtctggcttctggaaacctgagtcgccggcataatagtgactgcaagtgagaaggacctcagatcatcagggctgtaatagtcacaacaccacgcaatttacactacaggagaggtgtggacttagttttaagtcagatgttattgatttagggttgtataaaatttatagttacatcttcctctatacgggctattttctttttgtgtatacatacacatttgtttcttgaacaacatgggtttgaactgtgtgggtccacttgtacttttttcagtaaaaattacaccgaatgtgtttgcctctcctgcctccccttcaacctcttccacctctgccacacctgagacagcaagatcaagccctcctcttcctcctccacctcagcctactcaatgtgaagacgatgaagatgaggacctttatgatgatccacttccacttaatgaatagtaaatatatttttcttccttatgattttctttatcatcttttcttttcttttgtgggacacagagtcttgctctgttgcccaggctggagtgcagtggcacgatctcggctaactgcaatctcctcccaggttcaagtgattctcctgcctcagcctcagcctcctgagcagctgggattatagatacgcaccaccatacccggtgcatttttgtatttttagtagagacgtggtttctccaagttggccaggctggttttgaacccctgacctcaggtgatccgcctgcctcggcctcccaaagtgctgggattacaggtgtgagccaccacgcctggccttctttataacttttctccagcttaccttatcctcttttgctctttcttcttacctgctcaaccccctgcagtctgagcactcttgtctggagaatttgtcttttcttggcttccatgagttcgttctctcttgattttcctcatctctctccagccactcactcattttctctgagtctctctcataatgttgatgtttctttgagttcccatatttgaaccagttctctggtcactctgcttactatctgtgggtgagcccatctgcacttatgactcctacttctaatctcttcagttcaggcctctcacctgaactaaatttcaatcatctccacatagccacctgacatgctgaaacctgaacaccagctctgtggtatgaggaagagcagaaagaggatctttcatgcctttccatgtcatatttgacctgatcagtatctacagcgagctttctgttttctggttagatgaaccccaaggttcagttgctttcagaattaaccgtaaatcctgattgtcttaattgagactttagccaaatcttttaacctctctaggcctcaatttcctcgtccataaaatggagatcataatagtaataccttttatattgggttgtggtgaaagttacaaaattaaagaattaagtgcatggacactccttagtactgcttctagcattttgtgagcatctagttagtggtagttgacattatttattattgttattgacatttttgttcttgagttggttgagtttgaatccaagttgtactactaactctctgttttaagtcttaccattatcttctctaagctgggaatgaaaacatcacgcaagtaatatatacatatatgtatatatattgtggtaaacatgaaatgcaataatgcaggagtctacaaactttttctatgaagggctacatggtcgatattttcacctttgcaggccaaatgttctctcaaaactatttgactttgctgctgtagcaaagaagcagcagtagacaatacttaaatgagaaaatgtggttgtttcctaataaaactttatttatggacactgaaatttgaatttaatataattttcatgttttatgaaagactctttttttgatttttttttcatcattcgaaaatgtaaaaactgtttagctctaagaccatacaaaaacacacagggatgaatttggcccaagggccatagtttacagatccctgaaataatgcaagcaaattggagattcttgaagaggagtgtatgtacttgaatttgcttggctggagaatagctattctctattttggaaaattagttaaaggaaaggagactgcttggctttcccacataggagagctagctctggtccttatcattcctgttgtgtgggaagaacagggagagtctgtaatcagtctttggcctcttttaaagttctacctctacaaaacgtggttcccccaaaatgtctgtaaatcttgtcaaccagattagtctttctccttgagaaagagcagagagtggatcttgcataaaacctgacctaattagaaaattaatttctttttatccattcatctcaccacgctctgtcccttccttccacaagtatttattgggtatctactttttcccaggcactgtacttcatactggaaattcccggggaataacacagacaaaattgcaaccctcaaagagcttacattttagcaggggtgacaaacattaataatttgtgtaattatttggaggaaaatgtaattgatgcaaattgatttagacattccacctttctttgtgattgcttgcctacttgacatttccacttggatgtctcactagcttttcagacttagtatgctccaaacagaatcatgattgcctccatgctatctccaaaccttctctttgctcatgtctttgccactttagatagtttttaccaccatctcctcaattacttaagcagaaatggggactcattcttcacacttccctctctcttacctctcacatctggtcaatctctcttttgtctctaaaatacattcagaatttgattacctgtcacaacttctagcattaaccccctcctccaagtcaccatcatctctagcctggacgactgcaacagcctacggtttggtaaccatgctttcatttgaatctttcagctgtctatacagtggaaatgaaataagatcatatcccattgccccccagcaaaaatccttcagtaactccccattgcacttagaatacaatccaagctccttatcatggcatatcagatcaggtcctgcacaatctggccactgcctacctctcttatctcctcttgtgctacttccccaccctgtaacctccattagtaacccagctacagtcacactggcctctttctgttccttaggcacatgaagctccgtcctgtaatgaagcctttgcacttttattccttctgcctggtatgttttctcccaggtttcctcatggctggctgattctcattattcaggtctcaagatgaaaggttacctcttctcttaggtctttcctaaccatcccatctacagtagctacacttgccctcttatacctaatcactatcatatcactatttattttctttggagtggttattactacctaacatgtttttgtttgctcatttattgtttctctcttcctattagaaagtaacctccctgaatgctttctgtctttaagagtcttattttagacatggtaaggtttaggtgcctatgagagacaaacaagtagtgatatcaagtaggcagttgaatatgtttaagttaaaaatgcttaggctagtggctgatacacatagtacataccccataacctgctagctatcatcatcatcctcatcatcatgcaagttattaattgaaaaagtagttaattatatttaatcttatatgatgacatcaatcaatcaaccttattgaactaaatagctcctttcaacttgtattctttctctacttttttttttttttttttttttgagacagagtctctctctgtcacataggctggagtgctgtggtgtgatctcggctcactgcaacctccacctccaaggttcaacaggttcaagcaattctcctgcctcagcctcctgagtagctgggattacagacgtgcattaccacccctggctaacttttgtatttttagtagaggcaaggttttgccctgttgcccaggctggtcttgaactcctggccgcatgtgatctgcccaccatggcctcctaaagttctgggattacaggcatgagccagcatgcccagcctcttttcagcttcttgagcaagatttcatatagccaagaaggaattgaaatatttaaaagccctccaggttccagaaatgtctacctttttgaggggaggatgggccattctatagttggctttgttgttcctcaagaaagctcaatgaagataaaatttggatggcatttagcaacctttttctcacaacaatgtcgctaccagacaagagtgatgtgttctgagtctgtgcttgtgttattctttggcagtggcagcttgtaaaggatgttcctttcacagatcttgttatcgcttataaaattgctgtcagtttcttccctctgctttaaattaaatattatctcttcttagtgttggtgacacctgtatttatacaaagcactaggtaaaatatgaaatgtgtgaatgtatcagcatgtttttaatgctttaaggaagcctaataaatcccagtaaacttgccctttctcatggcatttatgcttaatacagtaataagtgggaagtcgcctctctcctctattacctttctaggaatggttgcttcagaatatccttgaaaacaagaagaaaatagtaatagttcatccactcatattgaagcctaatcacccatgtttaccacctttccagcaaaacagaggcataaatggataggtagaactcagggaccagggtctggataggcaaaaattgtaagtggaaggtggtgacatctaataacttggaaagcacacgaagctctattttattgccggattctagtttttgacacagattttgctctgtgaacttcgagtttctatttaaattttgtcgaccttagtttcatcatccacaatgtgataaacaatccttatttcttgggtttgtaaggagaagtggtatgatgaaatctgggaactgtaggaatatagacagtctatgagaagcttgtcctactgttcttgtccactcatctctatgacttttttcatatattccttgacttctgtacctgcctcacttgtcttccttcgatcttattccatgtcatctgggtggatggccagtacaaacctgaccctcaccaactacatgattcctccctactcctcttcagccaatgacaatcagatgttggacatttctgaactttgggttatttcatctctgtaatctcaaaatcagagctatccctctctccctctaacctgtggtttttttttttttaactttcctactctctcattcacattgaacctgcttttttccccatatcacaactctagcttttcaacccttcctagttcacaatgttcttctggctgtccttaacttcccacctaccaggcatcccatggccaaccgtgtcactaatgtttgctccaatatccctgaaccctacaccctttgactctgccccatgtttaacacagtaatctctgttactggctttctcagcatctctgtgatgataattgtggaagaaaagcatgaacattccttacccactctctaccattaatactcccatcagtgattgttctgttcatctttgatgacatcccatcatgttcaccataatgcatgttccagacattttctgcgtacagactctgattcctacttccttacactttcagcagatgattttgcttggtatctcatgagaagatgtaggctatccttcgtggaataccagatattccctcctttccatctgttgttatactttctccacctacccagactttctctttatctttagttttctgtcatttttctttcctggcccaggcaaagaagtgttccttttctttataaatctaatttctccacctaagtttttaacgttccttttcctttctaaggtggggctacactccatcaatttttgtttttctgatatctctctcttcattactttctactcacaagttttctaaggtgaaacaaaagtctctcaattcagagctactatcttatctctttgcttccttgtattgccaacttctgaaaataccaatctgccctcatttgcttacaacacactcactctttcactcttttttgtttgttttgagacagagtcccgctctgtcactcaggctggagtgcagtggcgtgatcttagttcactgcaatgtccacctcctgtgttcaaacaattctcgtacctcagcctcccgagtagctggaattacaggcacccgccaccatgcctggctaatttttgtatttttagtagagatgatatttcaccatgttggccagtctggtctcaaacttctgacctcaagtgatccatctgcatcggcctcccaaactgctgggattacaggtgtgacccactgcgcctggcctctttcactctttaatctaccttattcacttaatgctttgcaccaacccagagaggccttctttgaacatgctattcagtgggtttcctccattattttctacccctgtgtagtcagggctctccagagaaacagaatcatcaaaacatatataaaataaggaattggctcatgcaatatggaggctgagaagccccatgatctgctgtctgcaagttggagatctaggcaagttggtgctgtacttcagcctgagtgtgagtctgaaggcttgagcaccagggaagctgatgttataaattccagtctgagtacaagagaagactggtgtcccagctcaatatcccagtcaggctgagaagggatagattctccttttctctctgccttttgttccttggtcattgttgtcgtcatctttgttgtcatcatctccattgtggctgcctcctccttctcttcctctgtctctctgtttctgtgtctgagtctgtccctctctcttactctcctcactcccttggagggatcatatgatatcattattttgtgaagtgctgtgaagttcaaaaatatttatctatgaccctgagaatttaccacaaatttcagtttttactttctaaaactttagttcaacattaacatatctaaatctaaacttcattcgtcctgctgaatcacatccttatctggagtaacttgaatctattgatgacactgtatgcatttcctgaggctactgtaacaaattatcacaacttcaatggcttacaacaacacaaatttattcttttacagtctggaggctggacatatttttctgaaatcagtttcactgtgctaaatacaaggtgtcagcagaggccggagagagtacaggctctggcaggggaagcaggtgcaggatttcttttctttcctcttccagcttctagatctgaactccttacgttccttagctcagggccactttcttcatcttccaagccaatagtgtagcatcttcaaatacatttctgtgtgcatcacattgtcttctttgtattcaaatcaaactctgcgaaagcccaggataatttcccaatatcaagataatccgggataatttcccatttcacgatccttaatttaatcgtatcttcagagtcccttttgtcatacaaggtaaaatgtacaggtgccagagattaggacctggatatctttgggggccattaattagtctaccacagccaccatttttcttttagtcatttaggctgaaaaatttgaaataatctcacccctcccactctcttgtgacctaagcaatgggaatcttcttcctttctcaatggctcttatgcttatccccttctggttcaggcccttatttgcatatttcagtgactattagtaattaagagtgcatgactgaagaactacatttaaaattttattcagttttaattcatttaaatttaaataggtttcagggggaaagtcaagagagtgctcccttttggcgtagggcatatgactccagaccaacagatgttcttaattaggtatggtggtgggctcagtaagggagggcctggagagccttagtcaggaaggtacacttgaatgggaagtgagaggaatggtggggccagggactgtgacatagaactgatagccaggagttgacccgaggctagatgcaacatgaaaaatattccgttgagaggcaagttgcatgaacaaaagtttgcaatcaagtgttactttttgtgaggagtcagagggctgtggttacatcagttatggactatttgaagaacaggattaaagtggtatgtacctatttcatttgttctgagcattcagtgagatcatacatgtagagtggttagaacatagtgcctggcacatagtatgtgcgcaataaatggtagatatttctattaataactacttttacataatatattaattaagggcatgggttttggaatcagcaaatctgtgttctagttctactttttttttctttttttttttttgagatgtagtcttactctgtcgccggggctggagtgcagtggcactatcttggctcactgcaacctccacctcccgggttcaagcgattctcctgcctcagcccccgagtagctgggattacaggtgcctgctaccatgcctggctaatttttgtagttttagtagagatgggatttcaccatgttggccaggctggtcttgaactccttacctcgtaatccacccgcctcaggctcccaaagagctgggattacaggcgtgagccactgtgcctggcctagttctactattcttatgaccatgacagtcactttaacttgtaaacctctcagtttcctcagttctaaaacaggaatcataatcatacctgtccagcagggtttctgaggttataagcattttaaccacagaacacagaatctggcacatagtatgtacccagtcaagctattattattgtatttgttatctatttttgttatctaccagctcactgttttagggtagacagaagttcttttgaggcctgggcactctctccttcatccagttaacctctagaaggaagacaaaatttaatgatgctttttttttttccagtggaaagtcaaccatactctttttagttcacaaggtactggagaggttccttggccttaagagccagaagtccagactcacctgtgttttaaactgaaatttttcaaccgccagattaattattttggcatttaagaaggggcccagaaaatggatcgacaatactacgaagggttgggaattacagaggcattcaagtgaacaaccaatctggcttgaagagtttctcagagattcttgtcaaaaaatcttttatagccctcctggttttaagctacatctaggatatcagtaataggcacagattcagtggtggagggaagtaaaatcactttatctcagtggtgatcaaaatagcagcaaagaaggagggaaggagcaagagaagaggagaaggacgacaaagagaggaatggaaagattaggatgactcttgggtttctagatttagactggggaaattgtggtaccactagctgatggaatacaggaggagggacaagctcagagggagtggaaatgataaatttgatgttgacaaatttgttgatgttgaattggcagtaataagtagcaaaaataacgaacatttattgcatggttacatgccaggccctgtgatgagcatgttatgttcatcatctcactgaatccccacagataggtacgattatcattcccatcttacagctgagaaaattgaggcactaagacatacaattgcttattcctggtggtgaatggagagctagaatttaaaccagagtccacactataaaccagtaggctatactactcttcagtgtggaacatcaaaagtgaacatttctagcaagtagttacatgtatgaatctgaagttaataggaaagacctgggcctgagatctagatttggaagtcctacgcatataggtgttagtagatgtcttgggagtcagtgcgatctcccagagagaataaagcaagaagagagtcttggatggaatccggaggaacacccgtatttaaatatgggtagactaaggaagccaggaaagaaaactgaaaaatagcagccagagaagtaggaggaaaaccaggagaatgtggcatcacggagccaaaggaagaagaaacgtaaagatgcagtgagtcgttgagcaccacgggctgctgagaggttaagaactgagaagggccaggcgtggcggcttacacctgtaatccaagcagtttgggaggccaaggcaggcagatcacctggggtcaggagttcgagaccagcctggccaacatgccaaaaccctgcctttactaaaaatacaaaaattagccgggcatggtgatgcacacctgtaatcccagttactcgggaggctgaggcaggaaaatcacttgaacctgggaagcagaggttgcagtgagcagagatcacgccactgcactccagcctgggcgacagagcaagacaacatctaaaagaaaaaaagaactgagaagggtccatatatttttgaaacaaggaagacattggtgacttcggtgagcacaatttcagtagataatcagcagaagtaaaagccaggttatgagttgaagacagaatcagtggtgaggaaggagagatagcaagtgtagtttacttgttgtagaaacttggtcatgtgtggagagaagaaagataacatcaagaagggatagagtttcaaaaaaggtagaaattttgtttgtttcagatgagcaagatttgcagatttttatgtgcagaggggaatgagccaataggacgttagagatatgagtgacgtaaaggctagttattagagcagcattcctagggagatgcaggatgagatttagaggccaggcagaagtttggcctgacttaggtaggcctctcttttcctgtaagaggcaaaaaagtagggattggtacagacagagaaatgtatgtggggaggggctcaggaagttgggggagtttattcccagtggttttgatttttgtgcggggggacaggaaatagttcatctactgagagaaatgtgttgggtgaggatttgtggtgctttgagtttcatgttttcaaacagtttttgatcaatgtttacctagcagccaagcaggggacgtcagtaaatatgttgtacatggttaagtgaggagcccatcgcccgtgttgattaagaaacctatcatttcctggtctgtgaagaagtctatggcttgtaaactttgaaaatagattattggcattacctgtttatcttcttcaactaggagagaatgccttttaccatgttggacttcaggaactacttcttttttttttttttttttgagatggggattttactccatcatccaggctggagtgcagtggcacaataaggactcactgcagccttgaactctgggctaaagcaatcctcacacctcaacttcccgagtacctgggactacaggtgcaccaccatgcttggctaaatttttaaaatatttttggagagttgacatctggctatgttgcccaggctggtcttgaactcctggcatcaagtgatcctcccatcttggttttccaaaatgctgagattttagacttgaaccaccatgccctgccaaaggaaacctttactagaaaatttgtgggagggggcaaagaacacatagaagtaaacagccatcaagaatatgggttcatgatttacactacctctaacatggcacagaaaatcaacttggttgaccctaatgtcaataccctcactgctctcctttttctctccttgatccatttttttttttgagatggaatttcactcttgtcactcaggctggagtgcagtggcgtgatcttagttcactgcaacgtccaccgcctgtgttcaagcaattctcgtacctcagcctcccgagtagctggaattacagttacctgccaccatgcctggctaatttttgtatttttagtagagacagggtttcaccatcttggccaggctggtcttgaactcctgacctcatgatccacccgcctcggcctcccaaagtgctgagattacaggcatgagccactgcacccggcctccttgagccatttttatagaccatccatggctctccctccattgcagttgggtcatatcagatagtctcttctcttgcacagtgagatatataatctccaccatatcccttattgacttcatgttcttgattcctcctctgcagaagacccaacttccttccatctgtagcctacatattgcttatcctgcaagtctgatcaacattcatgttctcacagaagcctttctgactcaggttatcctgtgatatttgcttaaagctattcagcaccttaaagcagtggttctcatcctttactaatcattataaccacccgggtaacttaaaaattctacttccttcatgcctataatcccagcactttgggaggccgagggaggccgatcacgaggtcaggagatcgagaccatcctggctaacacggtgaaaccccgtctctactaaaactacaaaaaattagccgggcgtggtggcgggcgcctgtagtcccagctactcaggagactgaggcaggagaatggcatgaacccgggaggcggagcttgcagtgagccgagatcgcgccactgcactccagcctgggcgacagagcgagactccgtctcaaaaaaaaaaaatactacttcctggactctatcatagagattctgattaagtcattctgtggtggctcttgggctttgggacaagctgattctaatggtcagccaatgttgaagactcctgtcttaaagcctctctggggaatagaaaatcaagcaaattggaaaagagcctaaacagccagaattgtttctttgttccttagtcttgtgtttgacttttgacaatcaccttgacattgatctttgattttttttttttgtttttgccatcttctgctgctttgcctttgccctgtctgccaggctatcccttacctgcttggtttgatctgccttgactctcaggtgcctgtcaccatgtttgtggccctctttgaaccaggctcctttcttggctataggtttgtagccataatctttgcagatttcagacctgccaaatggaatctgattccacttgcaggcttctggccctgccatgtcagaaggatcccattctctgccctacttctttccatcagctcaaatcttgagacctgacaagtccatggttttggattacttcagcatgtacattctctaaatccttgcatcttatcgttgttcagcttgtgcattaaagaaagtctccaatgtttggttacaaatacatctgatcatctcatctttactttaagcaaattaaaggcagagtgcatgcttttgctgtttgaattcccttctattacctagaacaggttgacacctagtagttgctcagaaaaaggactgtgtttaacttacagatttgtaaacttacaaagttggagaaagtttgcgtttcagagatgatgcaggtcctggcttgctgtccctctatcaggacatcttcattgtattcatctaaatccagtccctgtttaattatctgagcaggactgattgctatttgatttaatattgccttgtcaagtattaaccagattgttccatctgacccggggcaggagagaaggttggtgacagaaatagaagggacccatggtcttcttcctggtagcagactgttcaagaatgtagcaaaccaatggaggaaaccctctcctttttctatggcaagtctaaaccctctgctggtcccctgctgcccagaagccctctggcctcctacgttggtggcttcctacagtgggaagctaacttttcctttttcattttccattccctccagcaaacttacagcttctttttgtttgtttgtttgtttttgagatggagtctctctgttgcttaggctggagtgcagaggcgcaatctctgctcactgcaacctctgcctccagggttcaaacgattctcctgcctcagcctcccaagaagctgggattacaggcaagtgccaccatgcccggctaattttttgtattttagtggaaatggggtttcatcatgttgcccagggtggtctcgaactcctgagctcaggtgatcctcctgcctcagcctcccaaagtgctgggatttcaggcatgagctactgcacccggcctaacttacagcttctaggctgatgacatcttaacatgccatccatcccagagtgataagcatttgaaaagaagctgctcagagacagcaaaacagttggaaattctggcaataaagctagctgataggaagaatcttttttttctcctctctcctttccctaggttggagaagtggctttcccagtgctctcaaacctgattatatttagtgctgctttgtaggtcatcaaataacaaacaagaaaagaaacaacaaaacatctttagccaaaggccatctggttagaccatgaactggttttccaatgtaagtcaagcctcttaactttataatgaggaaaccaagtcccagagaagaaacatgatatgccaagtattctccagagggaagtctagaatccaggcctttgttgttccagctaaatgagaattatttgtgtttggctgctctgattctccaccagtgtttctgctaaaagttgacatggtatatttagtatttttcacaagtaggagagatacaagggagtttgattttgcagatgttcccgttgaaatctagaacaaagtgccacaagaacacatgctaatgaataggaaagtgtggagcaaggaactgagttaaatggattgtgcttggcagctagatcaatgaaagagcccacagaaaggaaaatgaaggtacgagaagcctggattgagaaaaagttgcggttagatttatttttcagagttttctatggaatcattgttgggcataacttaacaagggagttttgaagaaagactttctcttcaattgggccagcacatcttgggtaaagctgcacaatcgatatgtgtgtgagatgcccatttccatctcaagcaggtcaaataaccagaatccccatttgatggttttctaaagtctccttatcatattgtgtgttcaaagtggaccaagccttctcattcaatttcaatttcttgctgcagagtgggtcaacaactggggtaccatcacttttgaagagtggaggaaattgggagaactctgatccctcgtctgcccttctggttttcaggagaattacgtagaggtggggagacagtgtaagatcaacctcaggtattttttttttttaatgaagtattcagtgatgaacctgggcaatgtgcatgacacagaccttaaaagactttaaggcctggcgcggatcctgcccaggaaatacttaaggcatttgctctaatactggcttcttccctgcctttacctctcttgcacattgttctttcacagcatccagtcatagatgtaagactgcagacaacctctgactgccaggctgtctgcattgaacacataggagcaattccccatgtcccctgatccccgaatttcctagttgatagggtatgtcagggtattgtttcaaatcattcaaatctatttcaaatcgtcactgattgtcctgaggctgagcttcaaatctttttttctttccagaagcagagaaaacagctcatgggttgcccaggtgcagggtggagtggggaagagaagcaggagggcccttcctcagcattcacaatcctccccatccacacattgtcctgcagtctctagtataggagtccttcgggagcgaacaaaaggctttcttgactggataaagtagcacaccaacccccatggctcacctggcaaacaaaacagagtaaggctgggtgaggatgggaaaagacttggtggagctgtgagtagaatctgtcttgctgaacagagtcttatttgcagtgtcacactgggcgtggaaagctgtgagtgctgccacaagggaagagcagatgggggagtgacatagctctcagcaaccaggactagatatagaaaagtagagaagaggctagaggtggttttttgaagtcagcatgaaacagaatttattcagaagcaaacccgaacttcctgagatttctgagcagatgaagcagaaaaggtgctgagcagttgccctaaactgtcaataacagtgaatcaaacattcatgagtttaaaatcagaatacagtctatagccttgaggctgaatctgaactaaggctaacaaccagttaagagagttgcctgttctagactcttccttaagctagtaacacctgaagctggaagtagacacttcggttaacgtacattttttagtgtttatttctttcttcatggcaacttggctaactgggttgatgtggtgccagctcagcagggaatgagcctgggcttgttgatttacagcagggcccatttactcgtttggtttcaattttaaaaccttagatagaatttaaaatcagtggcgttagagtggacctagtaatctattcaaaatttaaaaaatgtttttgagtagccttccttaaatcagagggaagagagtgcttttctgaaattcagaatgcttggcattttaaaattcataatagcaatcatctcggtccagatttattactaatatgtgaaagaagaaaggagtattcagttaatggatacttggaagggtcctacaactgctttagatgtaagggctccaagaaagacactaagaatgatgtttgggagggaactacaggtatgcccaaggcacaagcagagaaggataaagcaatgggatgagagaaacaggatagggacacagaggagggactccagagaaaaggtagagagaaagtggtgcatatgggtcaaggactacctaaggtgctgataacttagatttcctttccttactttaggctccaggaggcatctggggcttactgctgggctgcgaccttgatgttttcaaaatgttgatagcataaacctgcagtgtgactatttaaactgtctctgacatctgccattttcatcaccactccaacttggtttgttcatttattgaacagatatatgtggagtgcctcacacatgtgcacatcaatgaagaaaacagacaaaaatccctcctttagtgaactttacattctagaaggggaggaggataatacacatataacaggagataatttcagattatggtaaatgttatgaattaaacagaaatgtatgttagaatgacacacagtgcatgtgtatatgctcatactaatttagtctggatagtaacagaaagcatcaccaaggaggtgacatttgagtagagacctgaatgataggaaagagccacccagtcagacttgggggaagaacatgtgatataccgggaagaacaagtgcaaagaccccagggcaggaataagctctatgtgcttgaggagcagcaggaaggccagtgtagctacagatttttgaatgagggagagagtggtaggagataaggttagagaggtagacagtggccagataagctagaactctgtaggctctggaaagaatttagattttattcttagagcaatgggaagccattggtgggttttaagcagggtttttacctgatacggtgtatttttgtttgtttgtttagagatcactcatttactttgtgaagattgaattgtaagagggaaagaccagagacaagactacctatctgtaagctatttgaaaagtctaggctggagataatggtgacttggactaaggtgatggtagttggaggatataggatatgttgtgaatatacatttgacagaacattcagatgaattacatactagatatgagggaaagggaagagttgatggttaacccatgcgacttggataacttgtggtacatttactgagctaggaaaatcatccacctcagtcagtgggagtttgtttttgggtgaatgaggggactacagtttgggacatgttgagatatatatttagaatctctgagacaatggcaggcaactgggaatataaatgtggaactacataggacatcaagcctggggatataaatttttgagttgtcatttaaagcgatatggttggaaaaggtcaccaagggttaataagtgaagatagagaaaaggagacagtcaatgggaccaagccctgggttaaaccttcatttagaggttgagcgaaggagagtagcaaacaaaggaaactggtagaacagtcattaaggtaggaggaaaactaggaaggtatcttggatactaacagaaaagaatatttgaagaaagagggattgtattttccaaagatgaccataataataactcctctcccacatgctttagttacactgtgagcatgtatatcccttccttttgagcttgggtggacttttgtgaattgccctgacccatagtgagcgatacaagtgacattatgtgacttctgagagtaggtcagaaaatataattctgattctgttgggctctctttctctctcttgagacatgagcctttggagccctgagctgctatgtcagaagtctaatgacattgacaccactgtgctgtataaaccacatgaagagaccacatagagataggggagagaagtctaatgagcccagatgttctagtccccatctatttgagccttttcagagcaagcaccagacatatgagtgaacagtccttcagacgattccagccccaggcattatctgactgcagccctgtgagacataggagctacctgaattgtttccaaatacctgaccctcagaaattgggagagatactaaatgattgttaagccactaagattggggtgcttttttaaatgcagaaatagataatcagaacagggatgaagaaaaaaatatctattggatttggcaacatagagatggttgatgactttagcaagagcatgttcaatggagtacagagatggaagcccaaatggagcggattgaggagagaatagtaagggataaaataaatgacagtggttaaatgattctttcaatatttcaattagggggattgaagatatgggaaagtatttagagggatcaagggaagatttttccttattaaaatggcagctacttaagcatgttcatgtgatgatggagaaaactcagaagaaataataaatttataatagaagagaaaatgactcagttcctcattacctcttacttggactattgtaattgcttcctgaagtgttttgtctgtttctgatttcttcctactctgtttatgctacatactactactaaatttttctagattcaagtgcccttttcatcatatcataccctgttcaaataaaacaaaacaatgttggctacttctcctttgccttactcatcagactacagttccagaactggaaggaaacaaagatcctctaataccttctccttttaggtacagaacgcaacagaaaacaacagcacataacaggtacttttaggtacagtacggaagtattaattctaatgttcagtatccacgtagttgccaatatgaaaaatggatatcatgccttatgtaagttacatctaaacctgtgcctatatattaagagtaatagatactgtttgatgttggaaaatattcctagcagccatgtgcaattgttaaatgccatgctaattcatgaatacttctggaaccatgaattataatacgagggaagcatgaaaatggatgattggcatttctgagaaacaatacttccttatgcaagactctattacattcatatgggcaattaatttgccttttcttttgccaatgcttttctccttcccaaatactctccatgtgctaagacattgtcagccttcaaagttggcagaagtacaacctccaaacctgcatggcatgcagaccgcgttgccttttgttttgagaacacagggcagtaaatatagaaatcattgtctgaacagcattaaccatgagagtgggtgttgagggatatggataaaggtgtaacagtgctgaatcctggatccggagtgacagaggcagttaagtgtttttggtaagtgtaatgtgtttgagtgggtgtgttagtgatatgcataattttctaaagcttgggacctaggccagggttccctcttgaccagaactaagggtggagctgatcaggacatttatcatagataatatttccttgcttattttgtatgccccacttgatcatgaggtgctcaaggagttttttcatattttattccatgtctctatttcatcccttccgccacagccttagttgtggccaccatcatccctactttgatcacggccacagtccatcaactggtccccatgtttgctttctccaaaccatattctatatctggcttccacagggacatttctaagatatacagcttctaagaagaaaatattagagcttctatttatgtttgtttttattcattgtttagtttttttatatttgtgtgtgtttcatgtgcatagtgtcttagaatggtagcacttgtgtataacgtatacattaatagatgaatatgtaaatcagaggtgcatgctgtctctttgctttcaagagaatgagatagcaaaagtgcaagagacatgtgtctctaggatcaagttcaagcaccttagtatggcagtggaggccttgcatgatctgtttccacctcctttcacatcaaaggcaggagcaaaccctgaggagcatacagtgcaggtgatggaaataattatgatccagcaagcagaacacagcacaacagggtttggcaggtaataatcctggcatgtcctctctgtcaggggcttcaatgcaaagtaatacagacttctagaatccagttgcagattctagaggttcaggcaggctggcagttgtccagtatcaaagaaggctgtcaggaggtagcaggcctcatggttagactggactggggctcagggccaggactatagttcctgggaaggagaggactggcaagagcaacacagtgctctagtgcttgagggatgggagaactatgaaggtattaatttagaggcaaatctctttggggcaggatgtttccctaccaccgcaccagaacctttcacagggacagctcctagatagtcttgttattttgaatccactcacacatgcccacactattcagttagagagggagagagtactcacagccccacagctgcactgggcttaggcaaaggggaaaaggcagtagcaagaacttaggaaggactgtagggggaactgtgccacaggagcaagaggactgtgtttttcacagaactgggacctgaggtaagggctgacccagcagaaagtgtggcttgagacaaagtcccacagtgttgggaaggtatggctgaaaaccttctgccctatggtcagggtgaatcctagagtgcggggcagatccgagcctgcagctgggagtgcatgaccctcacaaagtaaccccagtcatggggaaggatgcagcagagactgagtatgagacagggcctgactccacattgctctctgagaccggcattcaaagtccttcacaatttgtccccacaataataataacaactgacatctggtgagcacttactatgtgccagccactgctcccagttatgtgtattaactcagtgaatactgaaaacaaccgtatgatgattctattcctgtccccattctgaagatgaggagactgaggcacatagattgatcatttgaccaggaatacatacccaggaagaggaggagctaagattcacacagaagcagcctgtcaccaaagcccatctcttaacctctgcacagtggtgcttctccatgtagcatgccagtctttattctcaatcccaaattttcatgtatgcaatgccactgccaatttggatgtctcgctgttttatgagtaggttttgtgtgcctttctttccgaaggcctttccaacattctttggcctctgataatatgactggaatgcccttcttgctactctcaatttatccaaattatacttgcactccaggtgccagctcaggtcttcttttgcctgacccttaatcactagcctggctgagctaatggctgagctgtggctttgcaggctttgcagctgattggagcttaaagggcagagtcctagtcccaactctggcaccagcagctgtggggctgtggagtactctctccttctctgactgaatggagtgtgcgtgtgtgagtggattcaaaataacaagactacctgggagctgtccctgtgaaaggttctggtgctgtggtagggaaacagcctgcccaaagagatttgcctctaaattaatacagtcaggggagagggggcacttcagtgtgcttcaaaatgattagatttgggtttggcttcccttattctttttagacaacagcgtgtttctactctctcaggagtgttgactctgggatggcatcacttgtgttagttcccaataaccttgacagagtttgtaattacagagtggcagcagagagaatgcagaggcaagtgcatgctagagcaattgctagacaaagagtacacagggcaagtgacaagcagagggcaatgggtaggcttgtgggaagggggcaggaggcagggaaggaagcattcaagaaaggatattggcacaagttgtgcgactccttttggaaaaggattgtgccgtcatcaaagctttaggggttccagaagttttgtatgaaagggagtcaaaagtcacccttttattcttcttattggttcacgtgctcatagtccctaattctctttagggagttcatctggtaatgagagattatttggctccatgggagcacggtcagcagatgacaggctgtgtgatttatgtgatttgagaggctcatgatctcccctatgagcctgtgaactgcttgagggcagtatgatctctttactagtgtatttgcttcacaccttgcccaggccatagtaagtgattattaaatatctactgggctgggcacggtggctcacgcctgtaaccccagcactttgggaggctgaggtgggcggatcaggaggtcagaagatcgagagcatcctggccaacatggtgaaaccccgtgtctactaaaaatacagaaattagctgggcatggcggtgcatgcctgtaattccagctacttgggaggctgaggcagcataattgtttgaacccgggatgcagaggttgcagtgagccgagatcgcaccactgcactccagcctggcgacaaagctagactctgtctcaaaaaaaaaaaaaatctgctgaaaaaatgagagggtattgtatatgtctgatcgtttaagagactggtttataagtgttttttctaagcaaagagggccatggagctgctgcagattttattctgtgggtggtgtagaagctgggaagtcagcataaagtagtggcactaggccaaaagagtcactgagttaagttctatatctatgacagaagtgtattataggggctggcgcaatggcacatccctgtaatcccagcacttttgggaggctgaggcgggtggatcacttcagtccagcagtttgagaccagcctgggcaatatagtgaaacatcatctctacaaaaaataccaaatattttttggtgttttgtgatggtgcatgcctgtagtcccagatacccagggggtgggcggggtgggggtggcagaggtgggaggatagcttgagtccggggggccaacactgcagtgcaccataactgcaccactgtacaccagcctgggagacagtgagaccctgactcaaaaacaaaaaacaaaaatacaaccaaaaaagaaatgtattatatgcgttagtaggtgtttagtgtagtccaatgcagtcagcagaaagcaagtaagtcctggccctggtcgtgctactggtataggtggtgaggtttcctaatggcccatttatacttctgccaaacagctcccattttctgtcacagaattaggcacgtgtagatgttcaagaacatgttgtagattttcaagaaatatatgttgagtaatagtagattgcttacgttgatatttactatgtgccctttcaggtgaaataactaagacacaggaagtgtcttagccataccgctagtgagttgaaagacctggattggaatcccagcagtctggctctggcactgtcttataccacactgcaccctgaactttagttactcctttgaatggaaggcattgaaattgttgtgaataatgcaaatatcttggaagggaacacatttgtcctctgtttttagcatattcatcagtcaatatatttcttgactacagtatgtggcctatacatacctgaatatgaactaacttacacagtttaagtttcaacatatgcgtaccatccacacaatcaagataatgatgaatatattcatcatgcttaaatgtttccttgtgcctctttataaactccccttcttagacctctttaccctcctgccccattgctaggcaactactgatctgctttctgtcactgtagattattttgcatttcataaatttttaaatacatgaaagtataaagtatgtattatcattgttatttttatttagcagtacctgtgactttgtcaccaatgaatatcactttttttttttagattatactttaagttctggggtacatgtggagaatgtgcagacttgttacaggtatacacgtgccatggtggtttgctgcacccatcaacccgtcatctagattaggtatttctcctaatgctatcccttccctagccccccaccccctgacaggccccagtgtgtgatgttcccctccctgtgtccatgtgttctcattgttcaactcccacttatgagtgagaacattttggttttctgttcttgtgttagtttgctgagaatgatggtttccagtgtcatccacgtccctgcaaaggacatgacctcatccttttttacagctgcatagtattccatggtgcatatgtgccacattgacctagcaatcccactgtcacccaggctggagtgcagtggtacgatctaagctcactgcaacctctgcctcccgggttcatgcaattctcctgcctcagcctcccgagtagctgagattacagacatgcgccaccatgcccagctaatttttgtatttttagtagagatggggttttgccatgttggccaggctggtctggaactcctgatttcaggtgatccacctgccttggcctcccaaagcactgggattacaggtgtgagccaccacgcccagcccagtttgattatttttatattcacccatgttgttacatgtataaatagataatttctttttattgttgagtagtatttcatcatacagttatactacaatttgtttattcatccattcatttgttgatggacatttgggttgtttcaggtttaaaccattacaaataaagcttctgtggacatctgtctacaagtttctgtatcaacatatttttgtttatcttgtgtaaataacttttttttttgagacaggatctcactctgttgctcaggctaaattacagtggcatgatcacaggacactgcagcctcaacctccccaggctcagatgatcctcccacctcagcctcccaagtagctgggaccataagcgcacaccaccatgcctggctaattttcgtattttttgtagagacaggattttgccatgttactcaggctgatcttgaactcctgagctcaagtggtctgcctaccttggtctcgcaaagtgctgggattacaggtgtgagccatcgtgcctggcctatcttgtgtaaatattttttagaaactgccaaactgatgtcaaaagtggttgtatcattttacattcccaatagcagtgtatgagcgttccagttgctctatatacttgccaacagtaggtattgttatttttaaaaaaagtttagagattttagtgtgtgaatagtggtatatcattattgttttaatttgttaatatatctacctaatgtttagcatcttctcatgtgtttattggccatgtgtatatctactgtggtgtgaggcggtagttcaaaacttttgttcatttttaaacatagttgttttttatattttttgaattttcatcattcttttattttatttacaagttctttatcagatgtatcaatttgctattgacacatggacttaacagctttaaacaacactcatttatttgtacagagttctgtaggtcaggagtatgggacagcatggctcggttctctgctcagagtctcagaatgctgaagtcaaagttgtggttaggctaagttcttgtctcaaggcattgggcaagaaactggttccaagctcattattgttattggggcagaattgagttcttgtggttgtagaactgaggtccccatttcctggtttgctgtcagctaagggtcactctcaggtcttagaagttgctcacatttcattgctatgcagcccactccattttccagtaccgtttgttaaaaagactatccctttccccttgaattgcttttgaagactgtcaaaattacatatatatgtgggtacagttctaaattttctattctgtttcattgatttatttgtctatacttatgttgataccaatgtgtttgggttacagtagctttatgagtcttgaaattaaatagtgggagccctccaatattatttttttgaagtttctttagactattctaggtggtatgtatgtatgtccatatgaatttcagactcagcttgttatgtctaaaaaaacaggcctgctgagattttgattgggatagtattgaatagatcaaatcagggagaatggacatcttaacattattgagttttctgttccatgaacgtggtatatttccctcatttgtttaggtcttcgtggtttctttcatctgtgttttgtatttttcaccatacagatcctgcacatattttgtcacctatatccatgatcatttaatattttgatgctattataagtggtattgtttttaaatttcattttccaattgttgccagtatatagacatataattgttttttatatattaatcttgtatcctttaactttgctaaattcacttattcattgtagttgtttttatttagattccacaggattttctgtactgacaatcatcattctcaaataaagacaattttacttaccttttctttccaatttggatgtcttttatctttttcttgccttattatactgagtaggacctgcagtacactgttgaatagaatggagattttttgttttttttttacttttaagttcagaggtacaagtgcaggtttgttacataggttaacttgtgtcatgggggtttgttgtacagattatttcatcacccaggtattaagcctagtacccattaattgtttttcctgatcctcgctctcctgccaccctgcgccctccaaaaggcttcagtgtgtgttattcccctctatgtgtccttgtgtctcatcatttagctcccacttataagtgaaaacatgcagtatttggttttctgttcctgtgttagtttgctaagcatagtggcctccaactccattcatatccctgcaaaggacatgatctcattcttttttatggctgcatagtaagaatggaaattcttgccttgattctgactttagggtgaaagcatttagtttttcaccattaattataatgttaaatttagacatttccataggtgttttttaatgaggttaaggaaatttctttgtatttatagtatcattataattttttaaaattaggatagatgttacattttatcaaattccttttctttttttaaattttattattattatactttaagtttgggggtacatgtgcacaacgtgcaggtttgttacatatgtatacatgtgccatgttggtgtgctgcaccccttaactcgtcatttaacattaggtatatctcctaatgctatccctccccccaccccgaccccatgataggccccggtgtgtgatgttccccttcctgtgcccatgtgttctcattgttcaattcccacctatgagtgagaacatgcagtgtttggttttttgtccttgcgatagtttgctgagaatgatggaagggatccagtttcagctttctacatatggctagccagttttcccagcaccatttattaaatagggaatcctttccccatttcttgtttttgtcaggtttgtcaaagatcagatagttgtagatatgcggcattatttctgagggctctgttctgttccattggtctatgtatctgttttggtaccagtaccatgctgttttggttactgtagccttgtagtatagtttgaagtcaggtggcgtgatgcctccagctttgttcttttggcttaggattgacttggcaatgtgggctcttttttggttccatatgaagtttaaagtagttttttccaattctgtgaagaaagtcattggtagcttgatggggatggcattgaatctataaattaccttgggcagtatggccattttcacgatattgattcttcctatccgtgagcgtggaatgttcttccatttgtttgtatcctcttttatttcattgaggagtggtttgtaattctccttggagaggtccttcacatcccttataagttggattcctaggtattttattctctttgaagcaattgtgaatgggagttcactcatgatttggctctctgtttgtttattattggtgtataagaatgcttgtgatttttgcacattgattttgtatcctgagactttgctgaagttgcctatcagcttaaggagatttttggctgagataatggggttttctagatatacaatcatgtcatctgcaaacagggacaatttgacttcttcttttcctaattgaataccctttatttccttcttctgcctgattgccctggccagaacttccaacactatgttgaataggagtggtgagaggggacatccctgtcttgtgcccgttttcaaagggaatgcttccagtttttgcccattcagtatgatattggctgtgggtttgtcatagatagctcttattattttgagatatgtcccatcaataaactctgaataaactctaatttcttgagagtttttagcaagaaggttgttgaattttgtcaaaggccttttctgcatctattgagataatcatgtggttcttgtcgttggttctgtttatatggtggattatgtttattgatttgcatatgttgaaccagccttgcatcccagggatgaagcccacttgatcatggtggataagctttttgatgtgctgctggattcggtttgccagtattgtattgaggatttttgcatcgatgttcgtcagggatattggtgtaaaattctctttttttgttgtgtctctgccaggctgtggtatcaggatgatgctggcttcataaaatgagttagggaggagtccctctttttctgttgattggaatagtttcagaaggaatggtaccagctcctccttgtacctctggtagaattcagctgtgaatccatctggttctggactttttttggttggtaagctattaattattgcctcaatttcagagcctgttattggtctattcagagattcaacttcttcctggtttagtcttgggagggtgtatgtgtcgaggaatttatccatttcttctagattttctagtttatttgcatagaggtgtttatagtattctctgatggtagtttgcatttctgtgggatcggtggcaatatcccctttatcattttttattgtgtctatttgattcttctctcttttcttctttattagtcttgctagcggtctatcaattttgttgatcttttcaaaaaatcagctcctggattcattgattttttgaagggttttttgtgtctctatttccttcagttctgctctgatcttagttatttcttgccttctgctagcttttgaatgtgtttgctcttgcttttctagttcttttaattgtgatgttagggtgtcaattttagatctttcctgctttctcttgtgggcatttagtgctataaatttgcctctacacactgctttgaatgtgtcccagacattctggtatgttgtgtctttgttcttgttggtttcaaagaacatctttacttctgccttcatttcgttatgtacccagtagtcattcaggagcaggttgttcagtttccatgtagttgagcggttttgggtgagtttcttaatcctgagttctagtttgattgcactgtgttatctgagagacagtttgttataatttctgttcatttacatttgctgaggagtggtttacttccaacgatgtggtcagttttggaataggtgtggtgtggtgctgaaaagaatgtatattctgttgaattggggtggtgagttctgtagatgtctattaggtctgcttggtgcagagctgagttcaattcctggatatccttgttaactttctgtctctttgatctgtctaatgttgacagtggggtgttaaaatctcccattattattgtctgggagtctaagtctctttgtaggtctctaaggacttgctttatgaatctgggtgctcctgtgttgggtgcatgtatatttaggatagttagctcttcttgttgaattgatccctttaccattatgtaatggccttctttgtctcttttgatctttgttggtttaaagtctgttttatcagagactaggattgcaacccctgcctttttttgttttccatttgcttgttagatcttcctccatccctttattttgagcctatgtgtgtctctgcacgtgagatgggtttcctgaatgcagcacactgatgggtcttgactctttatccaatttgccagtctgtgtctttcaattggagcatttagcccatttacatttaaggttaatattgttatgtgtgaatttgatcctgtcattatgatgttagctggttattttgctcgttagttgatgcagtttcttcctagcatcaatggtctttacaatttggtatgtttttgcagtggttagtaccggtttttcctttccatgtttagtgcttccttcaggagctcttgtaaggcaggcctggtggtgacaaaatctctcaacattagcttgtctgtaaaggttttatttctccttcacttatgaagcttagtttttctggatatgaaattttgggttgaaaattcttttctttaagaatgttgaatattggcccccactctcttctggcttgtagagtttctgctgagagatccgctgttagtctgatgggcttccctttgtgggtaacccgacctttctttctggctgcccttaacatttttttccttcatttcaactttggtgaatctgacaattatgtgtcttggagttgctcttc

SEQ ID NO: 12007 - DNA, 7582 bp, Homo sapiens
tttttttttatattttaattttaccttaagttctagggtacatgtgcacaacgtgcaggcttgttacctatgtatacgtgtgccatgttggtgtactgcacccattaactcatcatttacattaggtatatctcctaatgctatccctcccccctcccccaaccccacaacaggccccagtgtgtgatgttccccttcctgtgtccatgtgttctcattgttcagttcccacctatgagtgagaacatgcggtgtttggttttttgtccttgggatagtttgctgagaatgatggtttccagcttcatccatgtccctacaaaggacatgaactcatcattttttatggctgcgtagtattccatggtgtatatgtgccacattttcttaatccagtctatcattgttggacatttgggttggttccaagtctttgctattgtgaatagtgccacagtaaacatacatgtgcatgggtctttatagcagcatgatttataatactttgggtatatacccagtaatgggatggctgggtcaaatggtatttctagttctagatccctgaggaatcaccacactgtcttccacaatggttgaaatagtttgcagtcccaccaacagtgtaaaagtgctcctgtttctccacatcctctccagcacctgttgtttcctgactttttaatgattgccattctaactggtatgagatggtatctcattgtggttttgatttgcatttctctgatggccagtgatgatgagcattgtttcatgtgtctgttggctgcataaatgtcttcttttgagaagtgtctgttcatatccttcgcccacttgttgatggggttgcttgtttttttcttgtaaatttgtttgagttctttgtagattctggatattagccctttgtcagacggggagattgaaaaaattttctcccattctgtaggttgcctgttcactgtgatggtagtttcttttgctgtgcagaagctctttagtttaattagatcccatttgtcaattttggcttttgttgccattgcttttggtgtcttagacatgaagtccttgcccatgcctatgtcctgaatggtattgcctaggttttcttctagggtttttatgtttttaggtctaacacttaagtctttaatccatcttgaattaatttttgtataaggtgtaaggaagggatccagtttcagctttctacatatggcaagccagttttcccagcaccatttgttaaatagggaatcctttccccatttcttgtttttgtcaggtttgtcaaagatcagatagtcatagatgtgtggtattatttctgagggctctgttctgttccattggtctgtatctctcttttggtaccagtaccatgctgttttggttactgtagccttgcagtatagtttgaagtcaggtagcgtgatgcctccagctttgttcttttggcttaggattgacttggcaatgcgggctcttttttggttccatatgaactttaaagtagttttttccaattctatgaagaaagtcattggtagcttgatggggatggcattgaatctataaattaccttggggagtatggccattttcacgatattgattcttccgatccatgagcatggaatgttcttccatttgtttgtatcctcttttatttcattgagcagtggtttgtagttctccttgaagaggtccttcacatcccttgtaagttggattcctaggtattttattctctttaaagtaattgtgaatgggagttcactcgtgatttggctctctgtttgtctgttattggtgtataagaatgcttgtgatttttgcacattgattttgtatcctgagactttgctgaagttgtttatcagcttaaggagattttgggctgagacgatgtggttttctagatatacaatcatgtcatctgcaaacacggacaatttgacttcctcttttcctaattgaataacctttatttctttctcttgtctgattgccctggccagaacttccaacactatgttgaacaggagcggtgagagagggcatccctgtcttgtgccagttttcaaagggaatgcttccagtttttgcccattcagtatgatattggctgtgggtttgtcataagtagctcttattattttgagatacgtcccatcaatacctaatttattgagagtttttagcatgaagggctgttgaattttgtcaaaggccttttctgcatctattgagataatcatgtggtttttgtctttggttctgtttatatgctggattacgtttattgatttgcacatgttgaaccagccttgcatcccagggatgaagcccacttgatcatgctgaataagctttttgatgtgctgctggattcagtttgccagtattttattgaggatttttgcatcaatgttcatcagggatattggtctaaaattctctttttttgttgtgtctctgccaggctttggtatcaggatgatgctggcctcataaaatgagttagggaggattccctctttttctattgattggaatagtttcagaaggaatggtaccagctcctccttgtacctctggtagaattcggctgtgaatccatctggtcctggacttttttgggttggtaagctattaattattgcctcaatttcagagcctgttattggtctattcagagattcaacttcttcctggtttagtcttgggatggtgtatgtgttgaggaatttatccatttcttctagttttctagtttatttgcatagaggtgtttatagtattctctgatggtagtttgtatttctgtgggatcggtggtgatatccccttcatcattttttattgcatctatttgattcttctctcttttcctctttattagtcttgctagtggtctatcaattttgttgatcttttcaaaaaaccagctcctggattcattgattttttgaagggttttttgtgtctctatctccttcagttctgctctgatcttagttatttcttgccttctgctagcttttgaatgtgtttgctcttgcttctctagttctttgaattgtgatgttagggtgttaagtttagatctttcctgctttctcttgtgggcatttagtgctataaatttccctctacacactgctttaaatgtgtcccagagattctggtatgttgtgtctttgttctcattggtttcaaataacatctttatgtctgccttcatttcgttatgtacccagtagtcattcaggagcaggttgttcagtttccatgtggttgagcagttttgggtgagtttcctaatcctgagttctagtttgattgcactgtggtctgagagacagtttgttataatttctgttcttttacatttgctgatgagtgctttacttccaactatgtggtcaattttggaataagtgcgatgtggtgctaagaagaatgtatattctgttgatttggggtggagagttctgtagatgtctattgggtctgcttggtccacagctgagttcaattcctggttatccttgttaactttctgtgtcgttgatctgtctaatgttgacagtggggtgttaaagtctcccattattattgtgtgggagtctaagtctctttgtaggtctctaaggacttgctttatgaatctgggtgctcctgtattgggtgcatatatatttaggatagttagctcttcttgttgaattgatccctttaccattatgtaatggccttttttgtctcttttgatctttgttggtttaaagtctgttttatcagagactaggattgcaacccctgcctttttttgttttccatttgcttggtagatcttcctccatccctttattttgagcctatgtgtgtctctgcacatgagatgggtttcctgaatatagcacactgatgggtcttgactatccaatttgccagtctgtgtcttttaactggagcatttagcccacttacatttaaggttaatattgttttgtgtgaatttgatgctgtcattatgatgttagctggttattttgctcattagttgatgcagtttcttcctagcctcaacggtctttacaacttggcatgtttttccagtggctggtacaggttgttcctttccatgtttagtgcttccttcaggagctcttgtagggcaggcctggtggtgacaaaatctcgcagcatttgcttgtctgtaaaggattttatttctccttcacttatgaagcttagtttggctggatatgaaattctgggttgaaaattcttttctttaagaatgttgaatattggcccccactctcttctggcttgtagggtttctggctgtagagagatcagctgttagtctgatgggcttccctttgtgggtaacccgacctttctctctggctgcccttaacattttttccttcatttcaactttagtgaatctgacaattatgtgtctttgagttgctcttctcaaggagtatctttgtggccttctctgaattccctggatttgaatgttggcctgccttgctaggttggggaagctctcctggataatatcctgcagagtgttttccaacttggttccattctccccgtcactttcaggtacaccaatcagatgtagatttggtcttttcacatcgtcccatatttcttggaggatttgttcatttctttttattcctttttctctaaacttctcttctcgcttcatttcattcatttgatcttcagtcactgataccctttcttccatttgatcgaatcagctacggaagcttgtgcattcgtcacgtagttctcgtgccatggttttcggctccatcaggtcatttaaggccttctctacactggttattctagttagccattcgtctaatcttttttcaaggtttttaacttctttgcgatgggttcgaacttcctcctttagctcagagaagtttgatcatctgaagccttcttctctcaactcatcaaagtcattctccgtccagctttgttccattgctggtgaggagctgcgttcctttttttttttttttttttttaaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagattagggattggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaggaatttttcttagtgcagaacaaaatgaaaagtctcccatgtcttctactttctacacagacacggcaaccatccgatttctcaatcttttccccacctttcccgcctttctattccacaaagccgccattgtcatcctggcccgttctcaatgagctgttgggcacacctcccagacggggtggtggccgggcagaggggctcctcacttcccagtaggggcggccgggcagaggcgcccctcacctcccggacggggcggctggccgggcaggggggctgaccccccccacctccctcccggacggggcggctggccgggcggggggctgacacccccacctccctcccggacggggcggctggccgggcagaggggctcctcacttcccagtaggggcggccgggcagaggcgcccctcacctcccggacggggcggctggccgggcgggggggctgacccccctccacctccctcccggacggggcggctggccaggcggggggctgacccccccacctccctcccggacggggcggctggccgggcagaggggctcctcacttcccagtaggggcggccgggcagaggcgcccctcacctcccggacggggcggctggccaggcgggggggctgaccccccccacctccctcccgaacggggttggctgaccgggcggggggccgacacccccacctccctcccggatggggcggctggccgggcggggggccgacatccccacctccctcccggacgggtcggctggccgggcggggggccgacccccccacctccctcccggacagcacggctggccaggcggggggctgacccccccacctccctcccggacggcacggctggccgggcggggggctgaccccatctccctcccggatggggcggctggccgggcggggggctgacccccccacctccctcccggatggggcggctggcctggcgggggctgaccccacccccccacctccctcccggacggggtggctgccgggcagagacgctcctcacttcccagatggggtggctgctgggcggagaggctcctcaattctcagacggggcagctgccgggcggaggggctcctcacttctcagacggggtggttgccaggcagagggtctcccctcacttctcagacggggcggccgggcagagacgctcctcacctcccagacggggtctcggccgggcagaggcgctcctcacatcccagatggggcggcggggcagaggcgctccccacatctcagacgatgggcggccgggcagagacgctcctcacttcctagatgtgatggcggctgggaagaggcgctcctcacttcctagatgggatggcggccgggcggagacgctcctcactttccagactgggcagccaggcagaggggctcctcacatcccagacgatgggtggccaggcagagacactcctcacttcccagacggggtggcggccgggcagagcctgcaatctcggcactttgggaggccaaggcaggcggctgctccttgccctcgggccccgcggggtccgtccgctcctccagccgctgcctcccgggcggcgctcgccggcggggcggcaaagactgagacagctccgctgcccgctgaactccatcctcccggcggtcgggcggcggcagctgcggtcggtcgcggcagcggctccgcttcatatccggtatccatatttctaagaaaggtctgcttaaggaaatctaggctttttctatcaagctcctcaaaattcttccagccttcactcactgtgtaattccaaagtcattcccacatttttagatatttgttatagcatcccacttctgggtagccacatctctcttagttttctagtgctgcataacagataccacaaatgtggtggctttaaacagcacaaggccttctgattttcacacatgacctcaattggtggctaaacgcctccaacctttcattagctttcttgaatgcatcagtggtgttcaccaaaagccttcagattcttcggaatctgaagccttcaccatctgtagaatcagtacaccctccaacctctcaaaaaaaaaggggggagctgcgttcctttggaggaggagaggcgctctgatttt

SEQ ID NO: 12008 - DNA, 3700 bp, Homo sapiens
gtctaacatgtaagtctttaatccatcttgaattaatttttgtataaggtgtaaggaagggatccagtttcagctttctacatatggctagccagttttcccagcaccatttattaaatagggaatcctttccccattgcttgtttttgtcaggtttgtcaaagatcagatatttgtagatacgcggcattatttctgagacctctgtactgttccattggtctatatctctgttttggtaccagtaccatgctgttttggttaccgtagccttgtagtatagtttgaagtcaggtagcatgatgactccagctttgttcttttggcttaggattgacttggcaatgtgggctctttttttggttccatatgaactttaaagtagttttttccaattctgtgaagaaagtcattggtagcttgatggggatggcattgaatctataaattaccttgggcagtatggccattttcacgatattgattcttcctacccatgagcgtggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttgatgtataagaatgcttgtgatttttgcacattgattttgtatcctgagactttgctgaagttgcttatcagcttaaggagattttgggctgagacgatggggttttctagatatacaatcatgtcatctgcaaacaaggacaatttgacttcctcttttcctaattgaatgccctttatttccttctcctgcctgattgccctggccagaacttccaacactatgttgaataggagtggtgagagagggcatccctgtcttgtgccagttttcaaagggaatgcttccagtttttgtccattcagtatgatattggctgtgggtttgtcatagatagctcttattattttgagatatgtcccatcaatacctaaattattgagagtttttagcatgaagggttgttgaattttgtcaaaggccttttctgcatctattgagataataatgtggtttttgtctttggttctgtttatatgctggtttatgtttattgattttcatatgttgaaccagccttgcatcgcagagatgaagcccacttgatcatggtggataagctttttgatgtgttgctgaattcgatttgccagtattttatagaggatttttgcatcgatgttcatcaaggatattggcctaaaattctcttttttttgttgtgtctctgccaggctttagtatcaggatgatgctgtcctcataaaatgagttagggagaattccctctttttctattgattggaatagtttcagaaggaatggtaccagctccttcttgtacctctggtagaattcggctgtgaatccatctggtcctggactttttttggttggtaagctattaattattgcttcaatttcagagcctgttattggtctattcagagattcaatttcttcctggtttagtcttgggagggtgtatgtgttgaggaatttatccatttcttctagattttctagtttatttgtgtagagatgtttatagtattctctgatagtagtctggatttctgtgggatcagtgatgatatctcctttgtcattttttattgcatctatttgattcttctctcttttcttctttattagttttgctagtggtctatcaattttgttgaccttttcaaaaaaccagcccctggattcattgattttttgaagggttttttgtgtctctatttccttcagttctgctctgattttagttatttcttgccttctgctagcttttgaatgtgtttgctcttgcttctctagctcctttaattgtgatgttagggtgtcaattttagatttttcctgctttctcttgtgggcatttagtgctataaatttgcctctacacactgctttgaatgtgtcccagagattctggtatgttgtgtctttgttctcattggtttcaaagaacatctttatttctgccttcatttcgttatgtacccagtagtcattcaggagcagattgttcagtttccatgtagttgagtggttttgagtgagtttcttaatcctgagttctagtttgattgcactgtggtctgagagacagtttgttataatttctgttcttttacatttgctgaggagtgctttacttccaagtatgtggtcaattttggaataggtgtggtgtggtgctgaaaagaatgtatattctgttgatttgtggtggaaagttctgtagatgtctattaggtccacttggtgcagagctgagttcaattcctggatatccttgttaactttctgtctcattgatctgtctaatgttgacagtggggtgttaaagtctcccattattattgtgtgggaatctaagtctctttgtaggtcactaaggacttgctttatgaatctgggtgctcctgtattgggtgcatatatatttaggatagttagttcttcttgttgaattgatccctttaccattatgtaatggctttctttgtctcttttgatctttgttggtttaaagtctgttttatcagagactaggattgcaacccctgccttttttttgttgtccatttgcttggtagatcttcctccatccctttattttgagcctatgtgtgtctctgcccatgagatgggtttcctgaatacagcacactgattggtcttgactctttatccaatttgccagtctgtgtcttttaattcgagcatttagcccatttacatttaaggttagtattgttatgtgtgaatttgatcctgtcattatgatgttagctggttattttgctcgttagttgatgcagtttctttgtagccttgatggtctttacagtttggcatgtttttgcagtggctggtaccggttgttcctttccatgtttagtgcttccttcaggagctcttttagggcaggcctggtggtgaaacaatctctcagcatttgcttgtctgtaaagtattttatttctccttcacttatgaagcttagtttggctggatatgaaattctgggttgaaaatccttttctttaagaatgttgaatattggtgcctactctcttctggcttgtagagtttctgccaagagatccgctgttagtctgatgggcttccttttgtgagtaacccgacctttctctctggctgcccttaatattttttccttcatttcaactttggtgaatctgacaattgtgtgtcttggagttgctcttctcgaggagtatctttgtggcattctctgtatttcctgaatttgaatgttggcctgccttgctagattggggaagttctcctggatgatatcctgcagagtgttttccaacttggttccattctccccgtcactttcaggtacaccaatcagacatagatttggtcttttcacatagtcccatatttcttggaggctttgtttcttttctttttattcttttttctctaaacttctcttctcgcttcatttcattcattttgtcttccatcgctgatatcctttcttctaattggttgcattggctactggggcttgtgcattcgtcacgtagtt

SEQ ID NO: 12009 - DNA, 3689 bp, Homo sapiens
tctaacatttaagtctttaatccatcttgaattaatttttgtataaggtgtaaggaagggatccagtttcagctttctatatatggctagccagttttcccagcaccatttattaaatagggaatcctttccccatttcttgtttttgtcaggtttgtcaaagatcagatggttgtagatatgtggcattatttctgagggctccgttctgttccattggtctatatatctgttttggtaccagtaccatgctgttttggttactgcagccttgtagtatagttttaagtcaggtagcgtgatgcctccagctttgttcttttggcttaggattgacttggtaatgcagactcttttttagttctttaaagtagtttttttccaattctgtgaagaaagtcattggtagcttgatggggatggcattgaatctataaattaccttgggcagtatggccattttcatgatattgattcttcctacccatgagcatggaatgttcttccatttgtttatatcctcttttatttccttgagcagtggtttgtagttctccttgaagaggtccttcacatcccttgtaagttggattcctaggtattttattctctttgaagcaattgtgaatgggagttcactcataatttggctctctgtttgtctgttattggtgtataagaatgcttgtgaattttgcacattgatttttgtatcctgagactttgctgaagttgcttatcagcttaaggagattttgggctgagacaatggggttttctagatatacaatcttgtcatctgcaaacagggacaaattgacttcctcatttcctaattgaataccctttatttccttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatgtgtcccatcaatacctagtttattgagagtttttagcatgaagggctgttgaattttgtcaaaggccttttctgcatctattgagataatcatgtggtttttgtcattggttctgtctatatgctggattacgtttattgatttgtgtatgttgaaccagccttgcatcccagggataaaggccacttgatcatggtggataagctttttgatgtgctgctggattcggtttgccagtattttattgaggatttttgcatcgatgttcatcagggatattggtataaaattctctttttttgttgtgtctctgccaggctttggtatcaggatgatgctggcctcatgaaatgagttagggaggattccctctttttctattgattggaatagtttcagaaggaatggtaccagctcctccttgtacctctggtagaattcggctgtgaatccatctggtcctggactttttttggttggtaagctattaattattgcctcaattgcagagcctgttattggtctattcagagattcaacttcttcctggtttagtcttgggagggtgtatgtttcaaagaatttatccatttcttctagattttcaagttcatttgcatagaagtgtttatagtattctctgatggtagtttgtatttctgtgggatcggtggtgatatcccctttatcatttttttattgcgtctatttgattcttctctcttttcttctttattagtcttgctagcagtctatcaattttgttaatcttttcaaaaaaccagctcctggattcattgattttttcaagggttttttgtgtctctatttccttcagttcttctctgatcttagttatttcttgccttctgctagcttttgaatgtgattgctcttgcttccctagttcttttaattgtgatgttacggtgtcgattttagatctttcttgctttctcttgtgggcatttagtgctatatatttccctctacacactgctttaaatgtgtcccagagattctggtatgttgtgtctttgctctcgttggtttcaaagaacatctttatttctgccttcattttgttatgtacccagtagtcattcaggggcaggttgctcagtctccatgtagttgaatggttttgagtgagtttcttaatcctgagttctagtttaattgcactgtggtctgagagacagtttgttataatttctgttcttttacatttgctgaggagtgctttacttccaactatgtggtcaattttggaataagtgcagtgtggtgctgagaagaatgtgtattctgttgatttggggtggagagttccgtagatgtctattaggtctgcttggtgcagagctgagttcaattcctggatatccttgtgaattttctgtctcatcgatctgtctaatgttgacagtggggtgttaaagtctcccattattattgtgtgggagtctaattctctttgtaggtctctaaggacttgttttatgaatctcggtgctcctgtattgggtgcatatatatttaggatagttagctcttcttgttgaattgatccctttaccattatgtaatggccttctttgtctcttttgatctttgttggttgaaagtctgttttatcagagactaggattgcaacccctgtcttttttcgttttccattttcttggtagatcttcctccatccctttattttgagcctacgtgtgtctctgcacgtgagatgggtttcctgaatacagcacactgatgggtcttgactctttatccaatttgccagtctgtgtcttttaattggagcatttagcccatttacatttaaggttaatattgttatgtgtgaatttgatcctgtcattatgatgttagctggttattttgctcgttagttgatgcagtttcttcctagccttgatggtctttacaatttggcatgtttttgcagtggctggtaccagttgttcctttccatgtttagtgcttccttcaggagctcttgtagggcaggcctggtggtgacaaaatgtctcagcatttgcttgtctgtaaaggattttatttctccttcacttatgaagcttagtttggctggatatgaaattctgggttgaaaattcttttctttaagaatgttgaatattggcccccactctcttctggcttgtagagtttctgccaagagatcagctgttagtctgatgggcttccttttgtgggtaacctgacctttctctctggctgcccttaacattttttccttcatttcaactttggtgaatctgacaattatgtgtcttggagttgctcttctcgaggagtatctttgtggcattctctgtatttcctgaatttgaatgttgccctgcgttgctagattggggaagttctcctggataatatcctgcagagtgttttccaacttgggtccattctccctgtcactttcaggtacaccaatcagatgtagatttggtcttttcacatagtcccatatttcttggaggctttgttcatttctttttcttcttttttctctaaacttctcttctcgcatcatttcattcatttgatcttccatcgctgataaactttcttccagttgatcgaatcggctactgaagcttgtgcatttgtcatgtagtt

SEQ ID NO: 12010 - DNA, 5666 bp, Homo sapiens
atttatttatttatttatttttattgtactttaagttttagggtacatgtgcacaatgggcaggtttgttacatatgcatacatgtgccatgttggtgtgctgcacccattaactcgtcatttacattaggtgtatctcctaatgcatccctcccccctccccaaccacacaaaaggccccggtgtgtgatgttccccttcctgtgtccacgtgttctcattgttcaactcccacctatgagtgagaacatgtggtgtttggttttttgtccttgtgatagttcgctcacaatgatggtttccagtttcatccatgtccttacaaaggacatgaactcatccttttttatggctgcatagtattccatggtatatatgtgccacattttcttaatccagatcattgttggacatttgggttggttccaagtctttgctattgtgaatagtgctgcaataaacatacgtgtgcatgtgtctttatagcagcatgatttataatcctttgggtatatacccagtaatgggatggctgggtcaaatggtatttctagttctagatccctgaggaatcgccacactgaattccacaatggttgaactagtttacagtcccaccaacagtgtaaaagtcttcctatttctccacatcctctccagcacctgtttttccctgacttcttaataatcaccattctaactggtgtgagatggtatctcattgtggttttgatttgcatttctctgatggccagtgatgatgagcattttttcatgtgtctgttggctgcataaatgtcttcttttgagaagtgtctgttcatatccttcgcccatttgttgatggtgttgtttgtttttttcttgtaaatttgtttgagttctttgtagattctggatattagccctttgtcaaatgagtagattgcaaagattttctcccattctgtaggttgcctgttcactctgatggtagtttctcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggtttttgatctaacatttaagtctttaatccatcttgaattaatttttgtataaggtgtaaggaagggatccagtttcagctttctacatatggctagccagttttcccagcaccatttattaaatagggaatcctttccccatttcttgtttttctcaggtttgtcaaagatcagacagttgtagatacatggcattatttctgagggctctgttctgttccattggtctatatctctgttttggtaccagtaccatgctgttttcgttactgtggccttgtagtatagtttgaagtcaggtagcatgatgcctccagctttgttcttttggcttatgattgacttggcaatgcgggctcttttttggttccatatgaactttaaagtagttttttccaattctgtgaagaaagtcattggtagcttgatggggatagcattgaatctataaattaccttgggcagtatggccattttcatgatattgattcttcctacccataagcatggaatgttcttgcatttgtttgtatcttcttttattttgttgagcagtggtttgtagttctccttgaagaggtccttcacatcccttgtaagttggattcttaggtattttattcctttgaagcaattgtgaatggaagttcactcatgatttggctctctgtttgtctgttattggtgtataagaatgcctgtgatttttgcacattgattttgtatcctgagactttgctgaagctgcttatcagcttaaggagattttgcgctgagacgatggagttttctagatatgcaatcatgtcatctgcaaacagggacaatttgacttcctcttttcctaattgaataccctttatttccttctcctgcctgattgccctaaccagaacttccaacactatgttgaataggagtggtgagagagggcatccctgtcttgtgccagttttcaaagggaatgctcccaggttttgtccattcagtatgatattggctgtgggtttgtcatagatagctcttattattttgagataggtcccatcaatacctaatttattgagagtttttagcatgaagggttgttgaattttgtcaaaggccttttctgcatctattgagataatcatgtggtttttgtcattggttctgtttatatgctggattatgtttattgacttgcatatgttgaaccagccttgcatcccagggatgaagcccacttgaccatggtggataagctttttgatgtgctgctggattcggtttgccagtattttactcaggatttttgcatcgatgttcatcagggatattggtctaaaattctctttttttgttgtgtctctgccaggctttggtatcaggatgatgctggcctcataaaatgagttagggaggattccctctttttctattgattggaatagtttccgaaggaatggtaccagctcctccttgtacctctggtagaattcagctgtgaatccgtctggtcctggacttttttttgattggtaagctattaattattgcctcaacttcagagcctattattggtctattcagagattcagcttcttcctggtttagtcttgggagggtgtatgtgtcgaggaatttatccatttcttctagatgttctagtttatttgtgtagaggtgtttatagtattctctgatggtagtttgtatttctgtgggatcagtggtgatatcccctttatcattttttattgcatctatttgattcttctctcttttcttctttattagtcatgctagcagtctatcagttttattgatcttttcaaaaaaccagctcctagattcattgattttttgaagggttttttgtgtctctatctccttcagttctgctctgatcttagttatttcttgtcttctgctagcttttgaacgtgtttgctcttgcttctctagttcttttaattgtgatgttagggtgtcaattttagatctttcctgctttctcttgcgggcatttagtgctataaagttccctctacacactgctttgaatgtgtcccagagattctggtatgttgtgtctttgttctcattggtttcaaagaacatctttatttctgccttcatttcgttatgtacccagtagtcattcaggagcaggttgttcagtttccatgtagttgagcggttttgagtgagtttcttaatcctgagttctagtttgattgcactgtggtctgagagatagtttgttataatttctgttcttttacatttgctgaggagtgttttacttccaactatgtggtcaattttggattaagtccggcgtggtgctgagaagaatgtataatctgttgatttggggtggagagttctgtagatgtctattaggtctgcttggtgcagagctgagttcagttcctggatatccttgttaattttctgtctcgttgatctgtctaatgttgacagtgggatgttaaagtctcccattattattgtgtgggagtctaagtctctttgtaggtcactaaggacttgctttatgaatctgggtgctcctgtattgggtgcatatatatttaggatagttagctcttcttgttgaattgatccctttactattatgtaatggccttctttgtctcttttgatctttgttggtttaaagtctgttttaacagagactaggattgcaacccctgcctttttttgttttccatttgcttggtagattttcctccatccctttattttgagcctatgtgtgtctctgcacgtgagatgggtttcctgaatacagcacgctgatgggtcttgactctttatccaatttgccagtctgtgtcttttaattgaagcatttagcccatttacatttaaggttaatattgttatgtgtgaatttgatcctgtcattatgatgttagctgcttattttgcttgttagttgcagtttcttcctagcctcgatggtctttccaatttgcatgtttttgcagtggctggtactagttgttcctttccgtgtttagtgcttccttcaggagctcttgtagggcaggcctggtggtgacaaaatctctcagcatttgcttgtctgtaaagtattttatttctccttcacttatgaagcttagtttggctggatatgagattctgggttgaaaattcttttctttaagaatgtgtaatatcggcccccactctcttctggcttgtagagtttctgccaagagatccgctgttagtctgatgggcttccctttgtgggtaacccaatctttctctctggctgcccttaacattttttccttcatttcaactttggtgaatctgtcaattatgtgtcttggagttgctcttctcaaggagtatctttgtggtgttctctgtatttcctgaatgtgaatgttggcctgccttgctagattggggaagttctcctggataatatcctgcagagtgttttccaacttggttccattctccccatcactttcaggtacaccaatcagacgtagatttggtcttttcacatagtcccatatttcttggaggctttgttcatttctttttattcttctttctctaaacttctcttctcacttcatttcattcatttgatcttccatcactgataacctttcttccagttgattgaatcagctactgaagcttgtgcattcgtcacatagttcttgtgccttggttgtcagctccatcaggtcctttaaggacttctgtgcattggttattctaggtagccattcgtctaatcttttttcaaggtttttaacttctttgccgtgggttcgaacttcctcctttagttcagaaaattttcatcgtctgaagccttcttttctcaattagtcaaagtcattctccatccagctttgttccgttgctggtgaggagctgcgttcctttggaggaggagaggtgctctgatttttagaactttctgtttttctactctgttttttccccatctttgtggatttatctacctttggtctttgatgatggtgacgtacagatgggattttggtgtggatgtcctttctgtttgttagttttccttctaacagtcaggaccctcagctgcaggtctgtcagagtttgctggaggtccactccagaccctgtttgcctgggtatcagcagcggaggctgcagaacagcggatattggtgaacagcaaatgttgctgcctgatcgttcctctggaggttttgtctcagaggagtacccggccatgtgaggtgtcagtctgcccctactggggtgtgcccagttaggctactcgggggtcagggacccacttgaggaggcagtctgcccgttctcagatctcaagctgcatgctgggagaaccactactgtcttcaaagctgtcagacagggacatttcagtctgcagaggtttctgctgccttctgtttggctatgccctgcccccagaggtggagtctacagagacaggcaggcctccttgagctgcggtgggctccacccagttccagcttcc

SEQ ID NO: 12011 - DNA, 3694 bp, Homo sapiens
gtctaacgtttaagtctttaatccatcttgaattaatttttgtataaggtgtaaggaagggatccattttcagctttctacatatggctagccagttttcccagcatcatttattaaatagggaatcctttccccattgcttgtttttgtcaggtttgtcaaagatcagatagttgtaggtatgcggcgttatttctgagggctctgttctgttccattgatctatatctctgttttggtaccagtaccatgctgttttggttactgtagccttgtagtatagtttgaagtcaggtagcgtgatgcctccagctttgttcttttggcttaggattgacttggcgatgtgggctcttttttggttccatatgaacttgaaagtagttttttccaattctgtgaagaaagtcgttggtagcttgatggggatggcattgaatctataaattaccttgggcagtagggccattttcacgatattgattcttcctacccacgagcatggaatgttcttccatttgtttgtatcctcttttatttcattgagcagtggtttgtagttctccttgaagaggtccttcacgtcccttgtaagttgtattcctaggtattttattctctttgaagcaattgtgagtgggaattcactcatgatttggctctctttttgtctgttattggtgtgtaagaatgcttgtgatttttgcacattgattttgtatcctgagactttgctgaagttgcttatcagcttaaggagattttgggctgagacaatggggttttctagatatacaatcatgtcatctgcaaaaggggacagtttgacttcctcttttcctaattgaataccctttatttccttctcctgcctaattgccctggccagaacttccaacactacgttgaataggagtggtgagagagggcatccctgtcttgtgccagttttcaaagggattgcttccagtttttgcccattcagtatgatattggctgtgggtttgtcatagatagctcttattattttgagatacgtcccatcaatacctaatttattgagagtttttagcatgaagcgttgttgaattttgccaaaggccttttctgcatctattgagataatcatgtggtttttgtctttggttctgtttgtatgctggattacattgattgatttgcgtatattgaaccagccttgcatcccagggatgaagcccacttgatcctggtggataagctttttgatgtgctgctggattcggtttgccagtattttattgaggatttttgcatcaatgttcctcaaggatattggtctaaaattctcttttttggctgtgtctctgcctggctttggtatcaggatgatgctggcctcataaaatgagttagggaggattccctctttttctattgattggaatagtttcagaaggaatggtaccagttcctccttctacctctggtagaattcggctgtgaatccatctggtcctggactctttttggttggtaagctgttgattattgccacaatttcagagcctgttattggtcattcagagagtcaacttcttcctggtttagtcttgggagcgtgtatgtgccgaggaatttatccatttcttctagattttctagtttatttgcgtagaggtgtttgtagtattctctgatggtagtttgtatttctgtgggatcggtggtgatatcccctttatcattttttattgtgtgtatttgattcttctctcttttcttctttattagtcttgctagcggtctatcaattttgttgattgtttcaaaaaagcagctcctggattcattaattttttgaagggttttttgtgtctctatttccttcaggtctgctctgattttagttatttcttgccttctgctagcttttgaatgtgtttgctcttgcttttctagttcttttaattgtgatgttagggtgtcaattttgggtctttcctgctttctcttgtgggcatttagtgctataaatttccctctacacactgctttgaatgtgtcccagagattctggtatgttgtgtctttgttctctttggtttcaaagaacatctttatttctgccttcatttcgttatgtacccagtagtcattcaggagcaggttgttcagtttccatgtagttgagcggttttaagtgagtttcttaatcctgagttctagtttgattgcactgtggtctgagagacagtttgttataatttctgatcttttacatttgctgaggagagctttacttccaactatgtggtcaattttggaataggtgtggtgtggtgctgaaaaaaatgtatattctgttgatttagggtggagagttctgtagatgtctattaggtctgcttggtgcagagctgagttcaattcctgggtatccttgttaactttctgtctggttgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaatgtctgttttatccgagactaggattgcaacccctgcctttttttgtttttcatttgcttggtagatcttcctccatccttttattttgagtctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttgctcgttagttgatgcagtttcttcctagccttgatggtctttacaatttggcatgattttgcagtggctggtaccagttgttcctttccatgtttagtgcttccttcaggagctcttttagcgcaggcctggtggtgacaaaatctctcagcatttgcttgtctgtaaagtattttatttctccttcacttatgaagcttagtttggctggatatgaaattctgggttgaaaattcttctctttaagaaagttgaatattggcccccactctcttctgggttgtagagtttctgccgagagatccgctgttagtctgacgggcttccctttgtgggtaacccgacctttctctctggctgcccttaacattttttctttcatttcaactttggtgaatctgacacttatgtgtcttggagttgctcttctcgaggagtatctttgtggcgttctctgtatttcctgaatctgaatgttggcctgccttgctagattggggaagttctcctggataatatcctgcagactgttttccaacttggttcttttctccctgtcactttcaggtacaccagtcagacgtagatttggtcttttcacatagtcccgtatttcttggaggctttgttcgtttctttttattttttttctctaaacttcccttctcgcttcatttcattcatttcatcttccatcactgataccctttcttccagtttatcgcattggctcctgaggcttctgcattcttcacgtagtt

SEQ ID NO: 12012 - DNA, 20767 bp, Homo sapiens
gctacctttctttttttttttttttaatctaactttttttttttttttattatactttaagttttagggtacatgtgcacattgtgcaggttagttacatatgtatacatgtgccatgttggtgcgctgcacccactaactcgtcatctagcattaggtatatctcccaatgctacccctcccccctccccccaccccaccacagtccccagagtgtgatattccccttcctgtgaccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttacaagaaaaaaacaaacaaccccatcaaaaagtgggcgaaggacatgaacagacacttctcaaaagaagacatttatgcagccaaaaaatacatgaaaaaatgctcatcatcactggccatcagagaaatgcaaatcaaaaccactatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactggaaataccatttgacccagccatcccattactgggtatatacccaaatgagaagctacctttcttactttgtcccttccctccagttatccctcccccgctataatgtctgtcaaaagcctgtcgatccttcaaatattttctacaaggccatccaccccctacatggtgacactcctgatccctctcaccaactccatgaactttcaccttcttttgagcccacttcctaatctaatgtgtttataccttcactccagcggttaacttgtactgtttgattggacagccattcagataatcttcatattctgccattaacattcctgatccttccttctctgtgtatctttgtttatccttggcccaggtattcaatgctggttcaggttagtggaaacaccttgcttcagaatcaagtaaatacttcctttgagatgggactgtacactagaaagtttgtcttagaaagagatggtaagcttagaacatactgtttttaatgtgtttatgaccttagcggcatatatttttaatttttaagtcatttactaatggaattggataatgtagtattgcactgttgttttgatattagtaaagaggttaaacatattttcagatgtttattacctagttgtattttctttcttgtgagtggatatttttaggttttccccatttgcctttagaggtccttggtttagaggttttcagaggttcaagaaatccttataaatttctgtgcacacacaaacctatgaacagtccagcaattttgaaaggaaagtaatttggaggttgggcaggaatctaaaattttttttatcaacctatggttattaaaacagtagaactgactcaggaaaagataaatgggacacagagagcccatatataggcatttatactaagacgacagttcagattcatggaaaaaagtgaaatattcagtctgctgtgggtcctcaagaccatccacatgttcaatgatttgctagcaggacacacaggacttggcatatagttgtactcacagctgtgatttattacagtgaaaggatacaaaaccaaaccagcaaagggggaaaaagcatggagcaaaatctagaagaaaataggctcaagcttccaagagtcctcttgctgtgtgtggtcacacaggatatgcttaattcctccaacaattaattgtgacaacatgtgtgaaatgttttgtctaccaaagacaacattagagactcaatgcccaagatttttactgggggcttttcatgtatctgccctttgcctagcacaggccaaaattccagaatccaagaaggaaagaaagtattttgcatgaaccacattgtttgcacaaaaagtttatgtacagtgagccattcttatcagctctaggaatggtgggaattctcccttagtccaagttcccagactccagggccgtcctggcaagcaggagtttctaaggagagcaatctcaggcctgctatgttaacgtttttttttttttttttttgcatatttagtgaacggtgttggaataattagctagttatttgggaaaacaagttaaattccaatacacatgaacaaatcccaggaagattaaatgtcttaatgagtgttttaaatggagtggaaggagaaataaatactcatttacctagaatgaattttggctggtaaatgaaaaatggaagaggaaaatagaaatggatttttttctacataataccagtatcatttattcaataatacgcccctactccaacaatttctcatgtctcttttgaaattgatgatgtcattttcacatgtgtttctgaggtaactgttctctggtgttagaaacataccagttcacttactgcagtttataataagcattgtgtcttatctgagatgttatatacataactcacatacatagttgggctctctagttaatttcatctccaattaattttattttcatattccatcaattagattgattagtggtgagggacactaatattcttctataactcccttgaaactttcttggagtttcaaaatggaaaaggctgttgatcaggccaaaggatgtgtctctgtgttgccaggtctactggatgtcctcaagaagccatccataataacacttagtaccttgatggcattaaaagaagtacacaatatctggccctagaccataccagctcagaagctcaataacctcataacagaaaaatagatccatctgtgtgggaaaagctcatgtttagcaagttcacaagatttacaggattcaaaatatcagtttattaaattataaggagaaatagtaacagcataggaactagaatactagcatttagtggattcactcactttatacagacctagagaaaaataaaattaaaatcacaagaccaagtaattaattttgattgagaagtaaattttttaatttaattttaagttccaggatacatgtacagaatgtgaaggttttttatataggtaaatgtgtgccatggtggtttgctgcacctatcaactcatcacctagttattaaacctggcatgcaatagctcttctccctaatgctcttgcctcccctgccctcccccttcctcccccgacaggctccagtgtatgttgttcccttccctctgtccatgtgttctcattgttcagctcccactaataagtgagaacatgcagtgttgggttttcttttcctgcattagtttgctgaagataatgacttccagctccatccatgtccctgaaaggacatgatctcattcctttttatggctgcatagtattctatggtatatatggtaccacattttctttatccaatctatcattgatgggcatttgggttgattccacatctttgctattgtggatagtgctgcaatgaacatacatgtgcatgtatctttataatagaatgatttatattcctttgggtatatacccagtaatgggattgctgagtcaaatggtatttctggttctaggtctttgaggaattgccacactgtctttcacaatggttgaactaatttgcattcccaccaacagtgtaaaagtgttcctgtttctccacagcctcatcagcatctgttgtttcttgactctttaataattgccattctgattggtgtgagatggtatcttaatgtagttttgatttgcatttctgtaatgatcagtgatgtggagctttttttcatggttgttggctgtataaatgtcttcttttgagaagtgtgtgttcatgtcctttgcccactttttaatggggttgtttggggttttttgctaaatttgtttaagttccttgtagattctgaatattagacttttttcagatgaatagatttcaaaaattttctcccaacctgtacgttgtctgttcactctgattatagtttcttttgctgtgcagaagctctttagtttaattagatcccatttgtcaatttttgcttttgttgcaattgcttttgacatttttgttgtgaaatctttgcccgtccctacattttgagtggtattgcccagattttcttctgggtttttatggtttggggttttacatttaagtgtttaatccatcttgagttaatttttgtatatgatgtaaggaaggggtctaattacagttttctgcatatgactagacagtttttacagcaccatttattaaataagcaatcctttccctgttgcttttgtcagatttgttgaaaatcagatggttgtagatgtgcagtctgatttctgagatctctattctgttccattggtctatgagtctgtagtctatgtagccttgtagtatagtttgaagtagtgtgatgcctccaacttttttctttttgcttaggattgtcttggctatactggctctttttggttccatatgaattctaatgtagttttttctaattctgtgaagaatatcaatggtagtttaataggaatagcattgaatctataaattgctttgggcagtgtggccattttcacgatattaattcttcctatccatgagcatggaatgtttttctatttatttgtgtcctctctgacttttttgagcagtggtttctagttctccttgaagaggtccttcatttcccttgttagctgtattcctaggtattttattctctttgtagccattgtgaatgggagttttttcatgatttggctttctgcttgtctgttgttggtgtatagtaatgcttgtgatttttgcacattgattttgtatcctgactttgctgaagttgcttatcagcttaagaagatcttgggctgaggtgatggggttttctagatataggatcatgtcatctgcaaaaagagacaatttgacttcctctcctcctatttgaataccctttatttttttctcttgaccaattaccctggccagaacttctaatactatgttaaatagaaggggagaggccaggcacggtggctcatgcctgtactcccagcactttgggaggccgaggcaggcagattacgaggtcaggagatcgagaccatcctgtctaacatggtaaaaccccatctctactaaaatacaaaaaattagccaggtgcggtggcaggtgcctgtagtcccagctactcgggaggctgaggcaggaaaatggcgtgaacccgggaggcggaagttgcagtgagccgagatcgcactactgcactccagcctgggtgacagagcgagactccgtctcaaaaaaaaaaaaaaaaaaatagaaggggagagagagtgtgtttttatcttgtgctggttttcaagggaaatgctcccagcttttgcccattcagtatgatattggctatgagtttgtcataaatggctcttctttcttttctttttctttctttttttgagatggagtcttgctctgtcacccaggctggagtgcagtggcacaatctcggctcactgcaacctctgcctcctgggttcaagtgattctcatgcctcagcctcccgagtagctgggactacaggcacctgccaccatgccaggccaatttttgtatttttagtagggatggaatttcgccatgttggccaggctggtttcgaactcctgacctcaggtgatctgcccgcctcagcctcccaatgtgctgggattacagtcatgagcaaccacccctggccataaatggctcttattattttgaggtatgttccttcaatacctagtttgttgagagtttttaactcgaagagatgttgaattttatcggaggccttttctgcatctgttgagataatcttgtggtttttgtcattggttctgtttatgtgataaaatacgttaatttgatttcatatgctgaaccagacttgaatcccagagatgaagccaacttgatcgtggtggataagcttttcaatatgctactagattctgtttgccagtattttactgaggatttttgcattgatgttcataagggatattggcttgaagtttttttgtttttgttgtatctctgccaggttttgggtatcaggatgatgctggcctcataaagtgggttagggaggagtcccttcttttcagttgtttggaatagtttcagaagaagtggtcccagctcctctttgtacctctgggtgaattcagttgtaaatttgtctggtcctgggctttttttggttagtaggctatttattcctgcctcaatttcagaacttgttattggtctattcagggattcaacttcttcctggttcagtcttgagggtctatgtgtccaggaatttatccatttcttctagattttctagttcatttgcatagcggtgtttatagtattctctggtagttttttgtatttctgtggggtcattggtgatatcctctatcattttttattgtgtctatttgattattctgtcttttcttctttattagtctagctagtggcctatttatttatttatttatttatttatttatttatttattttatttcagaaaaccagctcctggattcatggactttttgaagggtttttcatgtctgtatctccttcagttcaactctgatcttggttatttcttgtcttctgccagctctggggtttgtttgctcttggttctctagttcttttagttgtgttgttagggtgttaatttgagatctttgtagctttttgatgtgcacatttagtgctacaaatttcccttttaacactgcttttgctgcgtcccggagattctggtactttgtatttttgttctcattagtttcaaagaacttcttgatttctgccttaatttcattatttacccaggagtcattcaggagcaggttgttcagtttccatgtagttgtgtggttttgagtgagtttcttaatctcgagttctaatttgattgtactgtggtctgagagactgttatgatttcagttcttttgcatttgctggggagtgttttacttccaattatgtgatcgactttagagtaagtgctacatggcaccaagaaaaatgtatattctgttgtttttggatggagtgctctgtagatatgtgtcaggtccacttggtccagagctgaattcaagtcctgaatatccttgttagttttctgtcttgacaatctgtctaatattgacagtggggtgttaaagtcttccactattattgtgtgggggtctaagtctctttgtagatctctaagaacttctttttatgaatctgagtgctcctgtattcggtgcatatatatttagggtagttagatctcctcgttgaattgaacttttaccattgtgtaatgcccttctttgtcttttttgatctttgttggtttaaagtctgttttgtcagaagctaggattgcaaccctgctttctttctgctttcatgagcctatgtgtgtctttgcatgtgagatgggtcttttgaatacagtacactgatgggtcttgactcttatccaccttgccattctgtgtcttttaattaaaaatacagaatgcttcatgaatttgcatgtcatctttgcacaggggccatgctaatcttctctatatcgttccaattttagtatatgtgctgccaaagtgagcacaatcttttttcatattaatttaaatgtgtaaaatgtagttataaagttggagcatatgatcaagcctgaatgatcctactcaaagtgctaatctgaagtttaaaaaaaaaaaaggaatctatgccagaatttatttaaattgacaacaaattacacattatttcatagcaggtttttttttttatgaaagtagcagtgagcacattgacattatgatgccagcttcttatgtctttgtggaatggtaacaagcagtttgccacaggtgactgaactggtttattaattctagtaagtttcttgtggatcttgggattttctatgtatagcatcacatcattaatgacgagagagagtttcactttttcctttccaatttatatgccctttattcttttgtcttgcctaattatctggctagacttccagtaccatgttgaattgatgcagtaaaagtgggcatccttgtcttgtttttgattataggagaaagtctttcatccttaagtatgatgctagctataagttttttgtaaatgccttttatcatgtgaaggaagttctcttttattcctggtttggtgagtgtttttatcatggtagggaattggaatttgtcaaaggccttttctgtatcaatttgtaagaacgtgatgtttttccttcattctcttaatgtgatgtattatgttgattttcatatattgaactaaatatgtattcctggaataaattccacttggtcatggagtataatattttaatatgctgtgagattcagtttgatagttgttgatatttttgagaatttttacatctatattcataagtgatattgatctatagttttcttgtgatatttttgtctggctgtgatctcagtttaagggtgtcttcatagaatgagttaggaaatgttgcaatcctcttctagtttttggaatacttcaagatgtgtttgtgttaattttttttttttttttttgagacagtctcgctctgtcacccaggctggagcacagtggtgcaatctcagctcattgcaacctccacctcccgggttcaagctattctcctgcctcagcctcccaagtagctgggattacaggcatgcaccaccatgcctggctaatttttgtatctttagtagagatggggtttcaccatgttggccaggctggtctagaactcctgacctcaggtgatcctgctcacctcagcctcccaaagtgatggaattataggcgtgagccactgcacccagctttatgttaattacttttaaatgtttggtacaattcaccactgaagccatttgatcctggacttttctttgctaggaggtttttggttactgattcattctctttacctatatctcatcagattttgtacttcttgagtcatttgggcagtttttgtgtttctaggaagttgtccattttatctaggttatctaatttgcagtagacaattgtccatagtatgttttataccacttcatatttctgtaaggtcgctagtaatgtccccacattttatttcattttaaaactatttaattgatatatgattgatatataaaaaagctctatacatttaatgttaatgataagggcataaatatatctatcactttccaaagagtcctcccatcccctttattatcattgtgtgtctgtgtgtgtgtgtttgtgtgtgtgttaagaacaattaacatatctactgtcttagcaaagtttaggtatataatacattattgttacctatcgatattatgctgtatattagtgcatttgataggaaaaaaaaacacaagatgttcttccttctctcaaatgctccattcaacacaacacagaacactttttgtggccaaaatgtgtggcttttttccctaaacaccaaacttttctgcaacagacaccaacagggtgtcctataattcaatttgattatgacactctctacctggaattagagtcaaatcctacaggttaagggctcagtcccacaagatggccccccacttctaatgccagttgaaagctccagattgttttacacatgcttctgacctaccagctaataatcagggtttttctagaccccttcctcaggtacaattaatttgttagcatgactcacagaatttaagaaaacacttacatttactggtttattatattaataaaggatatgacgaagggtatagttgaacattgagatgaagacatacatagggtgtggactggaaggttcctgagtgaaggagcttctgtccccttgtagttggggtgtgccaccttccagtagtctctcctgatccattgcatttatgtgctatcagctgtaatgtctcttccttcgtttctgattttttcgagtctactctctttttttctagtctagctaaaggtttgtcaatttggtttatctttttgagaaaccaactcttagttatctggtcatttcgattgtttttctagtctctatttcatttatttctgctgttatattgattattttctttttttctaatcactttaggcttgattttttcttctttttctctgtgagttataaagttaggttgtttatttcaaatcttttgtttttcttaatgttggcatttattgctatagacttctctgttataatggcttttgatgtatactataagtttggtatatgatattttcatttttgtttctctcaagataattttcatttccttttttatttaatctttgatttattggtttttcaggggaatgctgtttaacttccatgtatttgtgacttttccaagattcctcctgttgttgatttctagttttatattgctgatataagtattattattgattctagctgataacaagtttaatcacagacaataactacacttttacttctccactgccacattttaagttattgatgtcacaatttacatcattctgtattgtgtgttcattaaaaaattattatggctagagttatttttaatgcttttgtcttttaactttatactagagttgaaagtgatttatataacatcattacattattagactattctgaattcaactatatacttatttttactggtgagttttatactttcatatgttttaatgttgttaattatcatccttttgtttctaaacttgaagaactccctttagcatttggtaaggaaggcctattggtgataaactccctcagcttttatttgtctgggaacatttttatttatttatttatttattttcatttctgaaggacaacttgctggacaaagcattcttagttggtagtgttttttttttctttcagccctttgaatgtattatcccactctctcctggtctgcaaggtttcttctaagaaatcccttgtaatgttatggggattccctttatgtggtgagttgcttttctcttgctgcttacaaaattctccttgtcattgacttttcgcaatttgatcataatgtgtctcggtgaatacctttttatgttcaatctgttttgagttctttgggcttcaaagatctggatattaatttctctctctagatttgggaagttttctgtcatcatttatttaaatatgctttctctccctttctttttttctgctccttggcctttcataatgcatctattggttcacttggtggtcttccatagtcctgtaagcattcttcacccatttccattcttttttcttttcattctgtatactggataattttaaacaatctgtctttaagtttactgacttttttcctgcatgattaagcatgttgttgagctatctgttgaattgttcagttcagttattgttcagctccagaatttgtttggttcttttgtatagtttctatctctttgttaaatttctcattctgttcatgtgtttttaaaatttcatttatttatttatctgtgttatgttgtagctcactgagcttttctaagacaattattataattcttatcaagaagttcattgattttcatttctttggcatcagccattggagctttattttgttcctttggtgtctcatgtgtccttgattcttcatttcccttgaagccttgtgtctctgtcttcacatttgaagaaacagtaacctcctcgaggtaaagatcttcacaagtgagtctgactcaagattttgggggatctctcagatattttgtatggatatatctgctccaatcttctgaagtcttgggattgtgtaccttctcttgatttcacaatgccatgccagctgctgaaagcctcctaattattttctctatggcagtgcaatcttgaagtgtcaagattgagcattttctccaaatctagcagagttgcagtggctggtcatatctgtgtgctgtctattgaggctcatgcacactatctgtgggtgaatgcagggtctcagctcttggggaaggagcatgtggactaatgagggtgtatgtcagctagttggaaggtccacaggtgaaacatcctatgaggttcatgagtggaacttttggtggaatacacaagccagttcataggatccgtcagtttctgaggaggtctcttttggccctgagctctgccaccttgggcaggtgggtggtggggggtgacatgggtatatgaaattgttctacttaccctcttcaatacatctattcctaggttgtttttttgtttttttgtttttttctacagcagggagctcgaaactttcagctggattcctgggctcccctaaatgttttctcatctgtctcagtccattttatgtagtgacaaagaaatgcttgaggctgagttatttataaaggaaagaggtttatttggctcatggttctgcaggctgtacgaaaagcacagcaccagcatttacttctggtgatggcctcaggctgcttctactcatggcagatggtgaaggggagtcagggtgtataaagatcacatggtgagagagaaagtaagagagaaagggaggtgccaggctctttttaacaaccagctctcctgggatctagtagaacaggaactcactcaccccctccctgagggagggtattaatcttttcatgaaagatctactcccataaccaaaacacttcccattaggctccacctccaagattaggcatcaaatttcaacatgagctttttaggaacaaacatccaaactataaagttgtttgttaagatcaatgtatctgtggagatacgggggctggatcctcctattctgcaattgtgcattgtgctgatgtgttctctacttccaaatttccgtaaattgagtctctctctctgtattttttttgacagtcttgctagagatttgacaattttcatatcttttggagggagcaacttctggtttcattcaaactctctatttcttttctattctctattgattttatctctgctcccatatttaccctacagatctgcaaaataccagaactcattatttctatccagctataattccgtatccagaatttttatgtagtgctcttttacaacttctatctctattgatatcctcactttgttgagataatagttctccaggcttcctttagttctttgttcattgtttcccttagctctttgagcatatttaagacagtttatttaaagcataaagtctgcatttaatgtggcaaatatctaggcttactcagggtctatagctattaattttttttctttctgtgaatgaaccatactttcttactttgtttgtgcctcttttttgttgaaaactggacatttatattattataatgtggtaaccttataaatcaggttatctctcctccttggggttttttgttgctatttgttgtaggttgtgattttttgtttgtttggtgatttttctgatctatttttaaagactatattctttgtcatttttggtccctgaaatctctgttctgttatctcagtggtcacttagtaattaaacatgtttttaaaaatatctaaagttaaaaaaatgtttttagttatcctacaatctttgtagattggctctgtgttggtgcactcttttggtgcttagcttggccatttacatctctgcatagaccttcacttcctccttgctagagcctaaagtaaaggtcagtaagaagtgaaatcgtcaggttttctccagtgttttctgagcatgtatctctcccatagctttctgtttcccttctatatacaggggcttttaaaagcccttactccccacatatctccttcagtagcattttccccaaggatttttggtctgtctatggcttgttctattatttcttgtcctaggaggctgcagcctgcatgtttgcctttaaatgctttcaacaaaagttaaaaggctggcaaaacaaacaaacaaacaaaacaaacaaacaaaaaaccacaattctgagctaacccctctgggagctttcagacagatcaaaacacaaaaccacatttatgtgagaacagcgtccaaattgcctctctggctcctagcaagccacaacaggaaaacaagcagctgcccctatggcagcctaccagctaggtagtgtaggatggtagacaataagttaaaatgccataatgctctctcactgaaatttggtgccttttaaaaattaagtgttccctttcttgttgtaattcctaaattataatttgtcttccaaaatattttattctgaccattttttctttaatggatgaatgcagttttggagtttcttcctctaccattttcaatgatctcactcacttgagaaattttaaacctaagcctaccaacacacagagatgaaattctatttcacattaattgactggtcaaatgaatactacatagataattttgaggtcgcaaacaagtagtgagcctaggtacattagtgaaacaagcaaatccctggaattacctaccttcaccttaggacataaagaaatcctacaattgaaatttaaaggaaaataagtacctcatagttaaaaatcacaaaacacactaattttttttcttccttgttttaaattatactttaagttttagggtacatgtgcacaacgtgcaggttagttaaatatgtatacatgtgccatgttggtgtgctgcacccattaactcgtcatttaacattaggtatatctcctaatgctatccctcccccctcccccaccccacaacaggccccggtgtgtgatgttccccttcctgtgtccatgtgttctcattgttcagtacccactgacgagcgagaacatgtggtgtttggttttttgtccttgcgatagtttgctgagaatgatggtttccaccttcatccatgtccctacaaaggacatgaactcatccttttttatggctgcatagtattccatggtgtatatgtgccacattttcttaatccagtctatcattgttggacatttgggttggttccaagtctttgctattgtgaatagtgccgcagtaaacatacatgtgcatgtgtctttatagcagcatgatttataatcctttgagtatatatccagtaatgggatggctgggtgaaatggtatttctagttctagatccctgaggaatcgccacactgacttccacaatggttgaactagtttacagtcccaccaacagtgtaaaagtgttcctatttctccacatcctctccagcacctgttttttcctgactttttaatgattgccattctaactggtgtgagatggtatctcattgtggttttgatttgcatatctctgatggccagtgatgatgagcatttttcatgtgtcttttggctgcataaatgtcttcttttcagaagtgtctgttcatatccatcacccactttttgatggggttgtttttttcttgtaaatttgtttgaattcattgtagattctggatattagccctttgtcagatgagcagattgtaaaaattttctcccattctgtaggttgcctgttcactctgatggtagtttcttttgctgtgcagaagctctttagtttaattagatcccatttgtcaattttggcttttgttgccattgcttttgtgttttagacatgaagtccttgcccatgcctatgtcctgaatggtattgcctaggttttcttctaggttttttatggttttaggtctaacatttaagtctttaatccatcttgaattaatttttgtataaggtgtaaggaagggatccagtttcagctttctacatgtggctagccagttttcccagcaccatttattaaatagggaatcctttccccattgcttgtttttgtcaggtttgtcaaagatcagatggttgtagatatgtggcattattgctgagggcgctgttgtgttccattggtctatatctctgttttggtaccagtaccatgctcttttggttactgtagccttgtagtatagtttgaagtcaggtagcgtcatgcctccagctttgttcttttggcttatgattgacttggcagtgcgggctcttttttggttccatgtgaactttaaagtagttttttccaattgtgtgaagaaagtcattggtagcttgatggggatagcattgaatgtataaattaccttgggcagtatggccatttacacgatactgattcttcctatccatgagcatggaatgttcttccatttgtttgtatcctcttttatttcattgagcagtggtttgtagttctccttgaagaggtctttcacgtcccttgtaagttggattcctaggtattttattctctttgaagcaattgtgaatgggagttcactcatgatttggctctctgtttgtctgttattggtgtataagaatgcttgtgatttttgcacattgattttgtatcctgagactttgctgaagttgcctattggcttaaggagatttagggctgagacaatggcattttctagatatacaatcatgtcatctgcaaacagggacaatttgacttcctctcttcctaaatgaataccctttatttccttctcctgcctgattgccctggccagaacttccaacactatgtcgaataggagtggtgagagagggcatgcctgtcttgtgccagttttcaaaggcaatgcttccagtttttgcccatttagtatgatattggctgtgggtttgtcatagatagctcttattattttgagatacgtcccatcaatacccaatttattgagagtttttagcaagaagggttgttgaatttagtcaaaggccttttctgcatctattgagataatcatgtggtttttgtcattggttctgtttatatgctggattacatttattgacttgcgtatgttgaaccagccttgcatcccagggatgaagcccacttgatcatggtggataagctttttgatgtgctgctggattcagtttcccattattttattgaggatttttgcatcgatgttcatcagggatattggtctagaattctctttttttgttgtgtctctgccaaggtttggtatcaggataatgctggcctcataaaatgagttagggaggattccctatttttctttcgattggaatagtttcagaaggaatggtaccagctcctccttgtacctctggcagaattaggctgtgaatccatctggtcctggactttttttggttggtaagctattaattattgcctcaatttcagagcctgttattggtctattcagagattcaacttcttcctggtttagtcttgggagggtgtatgtgttgaggaatttatccatttcctctggattttctagtttatttgcatagaggtgtttatagtattctctgatggtagtttgtatttctgtcagatcggtggtgatatcccctttatcattttttattgtgtctatttgattcttctctcttttcttctttattagtcttgctagtggtgtatcaattttgttgatcttttcaaaatccagcccctggattcattgattttttgaagggttttttgtgtctctatttccttcagttctgctctgagcttagttatttcttgccttctgctagcttttgaatgtgtttgctcttgcttctctagttcctttaattgtgatgttagagtgtcaattttagatctttcctgctttctcttgtgggcatgtagtgctataaatttccctctacacactgctttgaatgtgtcccagagattctggtatgttgtgtctttgttctcgttgatttcaaagaacatctttatttctgccttcatttcgttatgtacctagtagtcattcaggagcaggttgttcagtttccatgtagttgagcgtttttgagtgagtttcttaatcctgagttctagtttgattgcactgtggtctgagagacagtttgttataatttctattcttttacatttgctgaggagtgctttacttccaactatgtggtcaattttggaatagatgtggtgtggtgctgagaacaatgtatattctgttgatttggggtggagagttctgtagatgtctattagatccgcttggtgcagagctgagttcagttcctggatatccttgtgaactttctgtctcgttgatctgtctagtgttgacagtggggtgttaaagtctcccattattattgtgtggtggtctaagtctctttgtaggtcattcaggacttgctttatgaatctggctgctcctgtattgggtgcatatatatttaggatagttagctcttcttgttgaattgatccctttaccgttatgtaatggccttcattgtctcttttgatctttgttggtttaaagtctgttttatcagagactaggattgcaacccctgcctttttttgttttccatttgcttggtagatcttcctccatccctttattttgagcctatgtgtgtctctgcacgtgagatgggtttcctgaatacagcacactgatgggtcttgactctttatccaatttgccagtctgtgtcttttaattggagcatttagcccatttacatttaaggttaatattgttttgtgtgaatttgatcctgtcattatgatgttagctggttattttgcttgttagttgatgcagtttcttcctagcctcgatggtctttacaatttggcatgtttttgcagtggctggtaccagttgttcctttccatgtttagtgcttccttcaggagctcttgtagggcaggcctggtggtgacaaaaatctctcagcatttgcttgtctgtaaaggattttatttctccttcacatatgaagcttagtttggctggatatgaaattctgggttgaaaattcttttctttaagaatgttgaatattggctcccactctcttctggcttgtagagtttctgctgggagatccactgttagtctgatgggcttccctttgtggtaacccaacctttctctctggctgcccttaacattttttccttcatttcaactttggtgaatctgacaattatgtgtcttggagttgctcttctcgaggagtatctttgtggcatcctctgtatttcctgaatttgaatattggcctgccttgctggattggagaagttctcctggataatatcctgcagagtgttttccaacttggttccattctccccgtcagtttcaggcacaccaatcagacgtagatttggtcttttcaaatagtcccatatttcttggaggctttgttggtttctttttattcttttttctgtaaacttctcttctcacttcatttcattcatttgatcttccatcactgatatcctttcttcctgttgatcgaatcggctactgaggcttgtgcattcgtcacatagttctcatgccttggttttcagctccatcaagtcctttaaggacttctctgcattggttattctagttagccattcttctaattttttttcaaggtttttaacttctttgccatgggttcaaacttcctcctttagctcagagtagtttgatcgtctgaagtcttcttctctcaagtcgtcaaagtcattctccgtccagctttgttccattgctggtgatgagctgcattcctttggaggagaagaggcactctgatttttagagtttccagtttttctgctctgttttttccccatctttgtggttttatctacctttggtctttgatgatggtgacgtacagatgggtttttggtgtggatgtcctttctgtttgttagttttccttctaacagtcaggaccctcagctgcaggtgtgttggagtttactggaggtccactccagaccctgtttgcctgcgtatcagcagcagaggctgcagaacagcggatattggttaacagcaaatgttggtgcctgatcattcctctggaagttttgtctcagaggagtacccggccatgtgaggtgtcagtctgcccctactggggggtgcctcccagttaggctactcgggggtcagggacccacttgaggaggcagtctgtccgttctcagatctccagctgcgtgctgggagaaccactactctcttcaaagctgtcagacagggacatttaagtctgcagtgttttctgctgccttttgtttggttatgccctgcccccagaggtggagtctacagaggcaggcaggcctccttgagctgcagtgggctccacccagttccagcttccaggccgctttgtttacctactcaagcctcagcaatggcgggcgcccctcccccagcct

SEQ ID NO: 12013 - DNA, 2910 bp, Homo sapiens
gaccattttcacgatattgactcttcctatccatgagcatggaatgttcttccatttgtttgtatcctcttttatttcattgaacagtgctttgtagttctccttgaagaggtccttcacatccctgctaagttggattcctaggaattttattctctgagtagcaattgtgagtgggagttcactcatgatttggctctctgtttgtctgttattggtgtataagaatgcttgctgtgatttttgcacattgattttctacctgagactttgctgaagttgcctatcagcttaaggagattttgggctgagacgattgagttttctagatatacaataatgtcatctgcccacagggacaatttgacttcctcttttcctaattgaataccctttatttccttctcctgcctgattgccctggccagaacttccaacactatgttgaataggagtggtgagagagggcatccctgtcttgtgccagttttcaaagggaatgcttccagttttggcccattcagtatgatattggctgtaggtttgtcatagatagctcttattattttgagatacgtcctgtcaatacctaatttattgagactttttaggatgaagtgctgttgaattttgtcaaaggccttttctgcatgtattgagataatcatgtggttttggtcattggttctgtttatatgctggattatatttattaatttatgtatgttgaaccagccttgcatcccagggatgaagcccacttgatcatggtggataagctttttgatgtgctgctggattcggtttgccagtaagttattgaggatttttgcatcaatattcatcagggatattggtctaaaattctctttttttgttgtgtctctgccaggctttggtatcaggatgatgctggcctcataaaatgagttaaagaggattgcctctttttctattgattggaatagtttcagaaggaatggtaccagctcttccttgtacctctggtagaattcggctgtgaatccacctggtcctagactttttttggttggtaggctattaattattgcctcaatttcagagcctgttattggcctattcagagattcaacttcttcctggtttagtcttgggagggtgtatgtgtggaggaatttatccatttcttctagattttctagtttatttgcatagaggtgtttgtagtattctctgatggtagtttgtatttatgtggaatcggtggtgatatcccctttatcattttttattgcatctgtttgattcttctctcttttcttctttattagtcttgctagcagtctatcaattttgttgatcttttcaaaaaaccagctcctggattcattgattttttgaaggattttttgtgtccctatctccttcagttctgctctgatcttagttatttcttgccttctgctagcttttgaatgtgattgctcttgcttctctagttcttttaattgtgatgttagggtgtcagttttagatctttcctgctgtctcttgtgggcatttagtgctataaatttccctctacacaatgctttaaatgtgtcccagagattctggtatgttgtgtttttgttcgcattggtttcaaagaacatctttatttctgccttcatttcgttatgtacccagttgtcattcagaagcaggttgttcagtttccatgtagttgagcagttttgagtgagtttcttaatcctgagttctaatttgattgcactgtggtctgagagacagtttgttataatttctgttcttttacatctgctgaggagtgctttacttccaactatgtgatcaattttggaataagtgtggtgtggtgctgagaagaatgtattttctgttgatttggggtggagagttctgtagatatctattaggtccacttggggcagagctgagttgaattcctggatatccttgttaactttctgtcttgttgatctgcctaatgttgacagtggggtgttaaagtctcccattattattgtgtgggagtctaagtctctttgtaggtctctaaggacttgctttatgaatctgggtgctcctgtattgggtgcatatatatttaggatagttagcttttcttgttgaattgatccctttaccattatgtaatggccttttttgtctcttttgatctttgttggtttaaagtctgctttattagagactaggattgcaacccctgctttttttttttgtttttcatttgcttggtagatcttcctccatccctttattttgagcctatgtgtgtctctgcacgtgagatgggtttcctgaatacagcacactgatgggtcttgactctttatccaatttgccagtctgtgtcttttaattggagcatttagcccatttacatttaaggttaatattgttatgtgtgaatttgatcctgtcattatgatgttagctggttgttttactcgttagttgatgcagtttcttcatagcctcgatggtctttacaatttggcatgtttttgcagtggctggtaccggttgttcctttccatgtttagtgcttccttcaggagctcttttagggcaggcctggtggtgacaaaatcgctcagcttttgcttgtctgtaaagtattttatttctccttcacttacgaagcttagtttggctggatatgaaattctgggttgaaaattcttttctttaagaatgttgaatattggcccccactctcttctggcttgtagagtttctgccgagagatcagctgttagtctgatgggcttccctttgagggtaacccgacctttctctctggctgcccttaacatttttcccttcatttcaactttggtgaatctgacaattatgtgtcttggagttgatcttctcaag

SEQ ID NO: 12014 - DNA, 5104 bp, Homo sapiens
gatccctgaggaatcgcaacactgacttccacaatggttgaaagagtttacagtcccaccaacagtgtaaaagtgttcctatttctccacatcctctccggcacctgttgtttactgactttttaatgattgccattctaactggtgtgagatggtgtctcattgtggttttgatttgcatttctctgatggccagtgatgatgagcattttttcatgtgtcttttggctgcataaatgtcttcttttgagaagtgtctgttcatatcctttgcccactttttgatggggttatttgtttttttcttgtaaatttgtttgagttcattgtagattctggatattagccctttgttagatgagtagattggaaaaattttctcccattctgtaggtggcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctaggagttttatgcttttaggtctaacatttaagtctttaatccatcttgaattaatttttgtataaggtgtaaggaagggatccagtttcagctttctacctatggctagccagttttcccagcaccatttattaaatagggaatcctttccccattgcttgtttttgtcaggtttgtcaaagatcagacagttgtagatatgcggcattatttctgaggcctctgttctgttccattgatctatatctctgttttggtaccagtaccatgctgttttggttactgtagccttgtagtatagtttgacgtcaggtagcgtgatgcttccagctttattcttttggcttaggattgtcttggcagtgcaggctcatttttggtttcatatgaactttcaagtagttttttccaattctgtgaagaaggtcattggtagcttgatggggatggcattgaatctataaattaccttgggcagtatggccattttcacgatattgattcttcctacccatgagcatggaatgttcttccatttgtttgtatcctcttttatttcattgagcagtgttttgtagttctccttgaagaggtccttgacatcccttgtaagttggattcctaggtattttattctctttgaagcaattgtgaatgggagttcactcatgatttgactttctgtttgtctgttattggtgtataagaatgcttgtgatttttgcacattgattttgtatcctgagactttgctgaagttgcttatcagcctaaggagattttgggctgagatgatggggttttctaaatatacaatcatgtcatctgcaaacagggacaatttgacttcctcttttcctaattgaataccctttatttccttctcctgcctaattgccctggccagaacttccaacactgtgttgaataggagtggtgagagagggcatccctgtcttgtgccagttttcaaagggaatgcttccagtttttgcccattcagtatgatattggctgtgggtttttcataaatagctcttattattttgagatacgtccaatcaatgcctaatttcttgagagtttttagcatgaagggttgttgaattttgtcaaaggtcttttctgcatctattgagataatcatctggtttttgtctttgattctgtttatatgctggattatgtttattgatttgtgtatgttgaaccagccttgcatcccagggatgaagcccacttgatcatggtggataaggtttttgatgtgctgctggattcggtttgccagtattttactgaggatttttgcatcgatgttcatcagggatattggtctaaaattctctttttttgttgtgtctctaccaggctttggtatcaggatgatgctggcctcataaaatgagttagggaggattccctctttttctattgattggaatagtttcagaaggaatggtaccagctcctccttgtacctctggtagaattcagctgtgaatccatccgatcctggactttttttggtttgtaagctattaattattgcctcaatttcagagcctgttattggtctattcagagattcaacttcttcctggtttagtcttgggagagtgtatgtgttgaggaatttatccatttcttctagattttctagtttatttgcttagaggtgtttatagtactctctgatggtagtctgtatttctgtgggatcggtggtgatatctcctttatcattttttattgcatctatttgattcttctctcttttcttctttattagttttgctagtggtctatcaattttgttgatcttttcaaaaaaccagctcctggattcattgattttttgaagggttttttgtgtctctatttccttcagttctgctctgatcttagttatttcttgccttctgctagcttttgaatgtgtttgctcttgcttctctagttctcttaattgtgatgttagggtgtcaatttcagatctttcctgctttctcttgtgggcatttagtgctataaatttccctctacacactgctttgaatgtgtcccagaggttctggtatgttgtgtctttgttcccattggtttcaaagaacatgtttatttctgctttccttttgttacgtacccagtagtcattcaggagcaggttgttcagtttccatgtagttgagcggttttgagtgagtttcttaatcctgcgttctagttagattgcactgtggtctgagagacagtttgttataatttctgttcttttacatttgctgagaagtgctttactgtggtcaattttggaataggtgtggtgtggtgctgaaaagaatgtatattctgttgatttgggctggagagttctgtaaatgtctattaggtctgcttggtgcagagctgagttcaattcctggatatccttgttaactttctgcccgttgatttgtctaatgttgacaatgcgggggtgttaaagtctcccattattattatgtgggagtctaagtctctttgtaggcctctaaggacttgctttatgaatctgggtgctcctgtattgggtgcatatatgtttaggatagttagctcttcttgttgaattgatccctttaccattatgtaatggccttctttgtctcttttgatctttttgttggtttaaagtctgttttatcagaggctaggattgcagaccctgcctttttttgttttccatttgcttgggagatcttcctccatccctttattttgagcctatgtgtgtctctgcacttgagatgggtttcctgaatacagcacactgatgggtcttgactctttatccaatttgccagtctgtgtcttttaattggagcatttagcccatttacatttaaggttaatattgttatgtgtgaatttgatcctgtcattatgatgttagctggttattttgctcgttagttgatgcagtttcttcctagcctcaatggtctttacaatttggcatgattttgcagtggctggtaccggttattcctttccatgtttagtgcttccttcaggagctcttttagggcaggcctggtggtgacacaatctctcagcatttgctcatctgtaaaggcttttatttctccttcacttatgaagcttagtttggctggatatgaaattctgggttgaaaattcttttctttaagaatgttgaatattggcccccactctcttctggcttgtagagtttctgccgagagatccgctgttagtctgatgggcttccctttgtgggacccggcctttctctctggctgcccttaacattttttccttcatttcaactttggtgaatctgacaattatgtgtcttggagttgctcttctcgagggtatctttgtggcattctctgtatttcctgaatctgaatgttggcctgccttgctggattggggaatttctcctggataatatcctgcaaagtgttttccaacttggttccattctccccgtcactttcaggtacaccaatcagacgtagatttggtcttttcacatagtctcatattttttggaggcttcgttcatttcttttttttcttttttctctaaacttctcttctcacttcatttcattcatttcatcttccatcactgacaccctttcttccagttgatcgaatcagctactgaggcttgtgcattcatcacatagttctcgtgccatggttttcagctccatcaggtcctttaaggacttctctgcattggttattctagttagccattcatgtaattttttttcaaggtttttaacttctttgccttggattcgaacttcctcctttagctcggagtagtttgatcatctgaagctttcttctctcaactcatcaaattctttctccatccagctttgttctgttgctggtgaggagctgcgttcctttggaggaggaaaggcgctctgatttttagagtttccagtttttctgctctgttttttccctatctttgtggttttatcttccttttgtctttgatgatggtgacgtacagatggggttttggtgtggatgtcctttctgtttattagttttccttcttacagtcaggacccttagctgcaggcctgttggagtttgtgggaggtccactccagaccctgtttgcctgggtatcagcagcagaggctgcagaacagtggatattggtgaacagcagatgttgctgcctgatctttcctctggaagttttgtctcagaggagtacccggccttgtgaggtatcagtctgcccctactggggggtgcctcccagttaggctactcgggggttagggatccacttgaagaggcagtctgtctgttctcagatctccagctgtgtgctgggagaaccactcctctcttcaaagctgtcagacagggacatttaagtctgcagagttttctgctgccttttgtttggctatgccctgcccccagagatggagtctacagaggcaggcaggcctccttgagctgcggtgggctccacccagttcaagcttcc

SEQ ID NO: 12015 - DNA, 5518 bp, Homo sapiens
tctcctaatgctatccttcccccatcccgccacctgacgacaggccccagtgtgtgatgttccccaccctgtgtccaagtgttctcattgttcaattcacctatgagtgagaacatgcgctgtttgattttctgtcttcgcgatagtttgctcagaatgatggtttcctgcttcatccatgtcactacaaaggacatgaactcatcctttttatggctgcatagtattccatggtgtatatgtgccacattttcttaatctagtctatcattgatggacatttgggttggttccaattctttgctattgtgaatagtgccacaataaacatacatgtgcatgtgtctttatagtagcgtgatttataatccgttgggcatatacccagtaatgggatggctgggtcaaatggtatttctagttctagatccttcaggaattgccacactgtcttccacaatggttgaactagtttacagtcccaccaacagtgtaaaagtgttcctgtttctccacatcctctccagcacctgttgtttcctgactttttaatgatcgccattctaactggtgtgagatggtatctcattgtggttttgatttgcatttctctgatggccagtgatgatgagcattttttcatgtgtctgttggctgcataaatgtcttcttttgagaagtgcctgttcatatcctttgcccactttttatggggttgtttgatgggtagactgcaaaaattttctcccattctgtaggttgcctgttcactctgatggtagtttcttttgctgtgcagaagctttttagtttaattagatcccatttgtctaatttggcttttgttgccattgcttttggtgttttagtcacgaaatccttgcccatgctgatttcctaagtggtattgcctaggttttcttttgggttttatggttttaggtctaacattgaagtctttaatccatctggaattaatttctgtgtaagttgtaaggaagggatccagtttcagctttctacatgtggctagccagttttcccagcaccatttattaagtttcccagcacctttccctattgcttgtttctgtcaggtttgtcaaagatcagatgattgtagatgtgtggtgttacttctgaggcctctgttctgttccattggtctgtatctctgttttggtaccagtaccatactgttttggttactgcagccttgtagtatagtttgaagtcaggtagcgtcatgcctccagctttgttcttttggcttaggattctcttggcaatgtggtctcttttttggttccatatgaactttaaagtagttttttccaattctgtgaagaaagtcattggtagcttgatggggatggcattgaatctataaattaccttgggcagtgtggccattttcatgatatggattcttcctatccatgaacgtggaatgttcttccatttgtttatatcctcttttatttcattgagcaggtttgtagttctccttgaagaggtccttcacatcccttgtaagttggattcctaggtattttattctctttgtagcaattttgaatgggagttcactcatgatttggctgtctgtctgttattggtgtgtaagaatgcttgtgatttttgcacattgattttgtatcctgagactttgctgaagttgcttatcagcttaaggagattttgggctgagatgatggggttttctagacatacagtcgtgtcatctgcaaacagggacaattttacttcctcttttcctaattgaataccctttatttccttctcctgcctaattgccctggccagaacttccaacactatgttgaataggagtgatgagagagggcatccctgtcttgtgccagttttcaaagggaatgcttccagtttttgcccattcagtatgatattggctgtgggtttgtcatagatagctcttattattttgagatacgtcccatcaatacttaatttattgagagtttttagcatgaaggttgttgaattttgtcaaaggccttttttgcatctattgagataatcatgtggtttttgtcgttggttctctttaaatgctggattatgtttattgattttcgtatgttgaaccagccttgcatcccagggatgaagcccacttgatcatggtggataagctttttgatgtgctgctggattcggtttgccagtattttattgaggatttttgcatctatgttcatcagggatattggtcgaaaattctctttttttgttgtgtctctgcccggctttgctatcaggatgatgctggcctcataaaatgagttagggaggattctctctttttctattgattagaatagtttcagaaggaatggtaccagctcctccttgtacctctggtagaattcggctgtgaatccatctggtcctggactatttttggttggtaagctattaattattgcctcaatttcagagcctgttattggtatattcagagattcaacttcttcctggtttagtcttgggagggtgtatgcgtcgaggaatttatccatttcttctagattttctagtttatttgcatagaggtgtttatagtattctctgatggtagtttgtatttctgtgggattggtggtgatatcccctttatcatttttattgcatctatttgattcttctctctttattagtcttgctagcggtctatcaattttgttggtcttttcaaaaaatcagctcctggattcattgattttttgaagggttttttgtgtctctatctccttcagttctgccctgatcttggttatttcttgccttctgctagcttttgaatgtgattgctcttgcttctctagttcttttaattgtgatgttagggtgtcgattttagatctttcctactttctgttgtgggcatttagtgctataaatttccctttacacactgctttgaatgcatcccagagattctggtatgttgtgtctttgttctcgttggtttcaaagaacctctttatttctgccttcctttcattatgtacccagtagtcattcaggagcaggttgttcagtttccatgtggttgagcagttttgagtgagtttcttaatcctgagttctagtttgattgcactgtggtctgagagacagtttgttataatttctgttcttttacatttgctgaggagtgctttacttccaactatgtggtcagttttggaataagtgcggtgtggtgctgagaagaatgtatattctgttgatttggggtggagagttctgtagatgtctattaggtctgcttggtgcagagctgagttcaattcctggatatctttgttaactttctgtctcattgatctgtccgatgttgacagtggggtgttaaagtttcccattactattgtgtgggagtctaagtctctttatatgtctctacggacttgctttatgaatctgggtgctcctgtattgggtgcatatatatttaggatagttagctcttctcattgaattgatccctttaccattatgtattggccttctttgtctcttttgatctttgttggtttaaagtctgttttatcagagagtaggattgcaacccctgcctttttttgttttccatttgcttggtagatcttcctccatccctttattttgagcctatgtgtgtctctgcacgtgagatgggtttcctgaatacagcacactgatgggtcttgactctttatccaatttgccagtctgtgtcttttaattggagcatttagcccatttacatttaaggttaatattgttatgtgtgaatttgatcctgtcattatgatgttagctggttattttgctcattagttgatgcagtttcttcctagcctcaatggtctttactatttggcatgtttttgcagtggctggtaccagttgttcctttccatgtttagtgcttccttcaggatctcttgtaaggcaggcctggtggtgacaaaatctctcaggatttgcttgtctgtcaaggattttatttctccttcacttacaaagcttagtttggctggatttgaaattctgggctgaaaattcttttctttaagaaagttgaatattggcccctactctcttctgccttgtagagtttctgccgagagatcagctgttagtctgatgggtttccctttgtgggtagcccgacctttctctctgtctttccttaacattttttccttaatttcaactttggtgaatctgacaattatgtgtcttggagttgctcttcttgaggagtatctttgttgtgttctctctatttcctgaatttgaatgttggcctgccttgctagattggggaagttctcctggataatatcctgcagagtgttttccaacttggttccattctctccgtcacttgcaggtacaccaatcagatgcagatttggtcttttcacatagtcccatatttcttggaggctttgttcatttctttttattcttttttctctaaacttctcttctcacttcatttcattcatttgatcttccatcactgataacctttcttccagttgatcgaatcagctactgaagcttgtgcattcatcacttagttctcgtgccgtagttttcagctccatcaggtcctttaaggacttctctgcattggttattctagttagccattcatctcatcttttttcaaggtttttaacttctttgtcatgggttcgaacttcctcctttagctcggagaagtttgatcgtctgaagccttcttctctcaactcatcagagtcattctccttccagctttgttccattgctagtgagtagctgcattcctttggaggaggagaggcactctgatttttagaattttcagtttttctgctctgttttttccccgtctttgtggatttatctacctttggtctttgatgatggtgacgtacagatggggttttggtgtggatgtcctttctgtttgttagttttccttctgacagtcaggaccctcagctgcaggtctgttggagtttgctggaggtccactacagaccctgtttgcctgggtatcagcagcggaggctgcagaacaatgcatattggtgaacagcaaatgttgctgcctgatctttcctctggagattttgtctcagaggagtactcggccgtgtgacgtgtcagtctgcccctactggggggtgcctcccagtcaggctacttgggagtcagggacccacttgaggaggcagtctgtctgttctcagatctcaagctgcatgcgggagaaccactactgtcttcaaagctgtcagacagggacatttaagtctgcagaggtttctgctgccttttgtttggctatgccctgcccccagaggtggagtctacagaggcaggcaggcctccttgagctgtgtgggctccacccagctcgagcttcctggccgctttgtttacctactcaagcctcagcaatggcgggcacccctcccccagcctt

SEQ ID NO: 12016 - DNA, 11740 bp, Homo sapiens
acttaataagacagagagggggaggagccaagatggccgaataggaacagctccggtctacagctcccagagtgagcgacgcagaagacgggtgatttctgcatttccatctgaggtaccgggttcatctcactagggagtgccagacagtgggcgcaggccagtgggtgtgcgcaccgtgcgcgagccgaagcagggcgaggcattgcctcacctgggaagcgcaaggggtcagggagttccctttccgagtcaaagaaaggggtgatggacgcacctggaaaatcgggtcactcccacccgaatactgcgcttttcagaccggcttaaaaaacggggcaccatgagactatatcccacacctggctcggagggtcctacgcccacggaatctcgctgattgctagcacagcagtctgagatcaaactgcaaggcagcagctaggctgggggaggggagcccgccattgcccaggcttgcttaggtaaacaaagcagccgggaagctcgaactgggtggagcccaccacagctcaaggaggcctgcctgcctctgtaggctccacctctgggggcagggcacagacaaacaaaaagacagcagtaacctctgcagacttaaatgtccctgtctgacagctttgaagagagcagtggttctcccagcacgcagctggagatctgagaatgggcagactacctcctcaagtgggtccctgacccctgacccccgagcagcctaactgggaggcacccccagcaggggcacactgacacctcacacggcagggtattccaacagacctgcagctgagggtcctgtctgttagaaggaaaactaacaaacagaaaggacatccacaccaaaaacccatctgtacatcaccatcatcaaagaccaaaagtaaataaaaccacaaagatggggaaaaaacagaacagaaaaactggaaactctaaaatgcagagcgcctctcctcctccaaaggaacgcagttcctcaccagcaacggatcaaagctggatggagaatgactttgacgagctgagagaagaaggtttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagcaagaagggaaggttagagaaaaaagaatacaaagaaatgagcaaagcctctaagaaatatgggactatgtgaaaagaccaaatctacgtctgattggtgtacctgaaaatgatgcagagaatggaaccaagttggaaaacactctacaggatattatccaggagaacttccccaatctagcaaggcaggccaacgttcagattcaggaaatacagagaacgccacaaagatactcctcgagaagagcaactccaagacacataattgtcagattcaccaaggttgaaatgaaggaaaaaatgttaagggcagccagagagaaaggtcggtttaccctcaaagggaagcccatcagactaacagcggatctctcggcagaaaccctacaagccagaagagagtgggggccaatattcaacattcttaaagaaaagaattttcaacccagaatttcatttccagccaaactaagcttcataagtgaaggagaaataaaatactttacagacaagcaaatgctgagagattttgtcaccaccaggcctgccctaaaagagctcctgaaggaagcgctaaacatggaaaggaacaaccggtaccagccactgcaaaatcatgccaaaatgtaaagaccattgagactaggaagaaactgcatcaactaacgagcaaaatcaccagctaacatcataatgacaggatcaaattcacacataacaatattaactttaaatgtaaatggactaaattctccaattaaaagacacagactggcaagttggataaagagtcaagacccatcagtgtgctgtattcaggaaacccatctcacgtgcagagacacacataggctgaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacatgagcacccagattcataaagcaagttctgagtgacctacaaagagacttagactcccacacattaataatgggagactttaacacctcactgttaacattagacagatcaatgagacagaaagtcaacaaggatacccaggaattgaactcatctctgcaccaagcggacctaatagacatctacagaactctccaccccaaatcaacagaatatacatttttttcagcaccacaccacacctattccaaaattgaccacatagttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacacaacataccagaatctctgggacgcattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaaaaagagaggagaatcaaatagacacaataaaaaatgataaaggggatatcaccaccgatcccacagaaatacaaactaccatcagagaatactataaacacctctacgcaaataaaccagaaaatctagaagaaatggataaattcctcgacacatacactctcccaagactaaagcaggaagaagttgaatctctgaatagaccaataacaggagctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagaaccaaagacaaaaaccacatgattatctcaatagatgcagaaaaggcctttgacaaaattcaacaacccttcatgctaaaaactctcagtaaattaggtattgatgggacgtatttcaaaataataagagctatctatgacaaacccacagccaatatcatactgaatgggcaaaaactggaagcattcctttgaaaactggcacaagacagggatgccctctctcaccactcctattcaacacagtgttggaagttctggccagggcaatcaggcaggagaaggaaataaagggtattcaattaggaaaagaggaagtcaaattgtccctttttgcagacgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaatttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaatttcatatggaaccaaaaaagagcccgcatcgccaagtcaatcctaagccaaaagaacaaagctggaggcatcacactacctgacttcaaactatactacaaggctacagtaactaaaacagcatggtactggtaccaaaacagagatatagatcaatggaacagaacagagccctcagaaataacgccgcatacctacaactatctgatctttgacaaacctgagaaaaacaagcaacggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaatcctagaagaaaacctaggcattaccattcaggacataggcgtgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaatacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcaattcctcagggatctagaactagaaataccatttgacccagccatcccattactgggtatatacccaaatgactataaatcatgctgctataaagacacatgcacacgtatgtttattgcggcattattcacaatagcaaacacttggaaccaacccaaatgtccaacaacgatagactggattaagaaaatgtggcacatatacaccatggaatactatgcagccataaaaaaggatgagttcatgtcctttgtagggacatggatgaaattggaaaccatcattctcagtaaactatcgcaagaacaaaaaaccaaacaccgcatattctcactcataggtgggaattgaacaatgagatcacatggtcacaggaaggggaatatcacactctggggactgtggtggggtggggggaggggggaggggtagcattgggagatatacctaatgctagatgacgagttagtgggtgcagcgcaccagcatggcacatgtatacatatgtaactaacctgcacaatgtgcacatgtaccctaaaacttaaagtataataataaaaaaaaaaaagacagagaaacacaacttgcatgaacaagcaaatactcagtttgattcaacagtaagagaaacctcctgtaatagaaggttctttatatgtggaatccaggccttgagaaaaaggaggtaaggttggaaactgagttgctgatacttctagcaagacccttttaatgtgcccgaatatttactctactaacaatagcaaacgagagaacaagagcgtataggtagtagtgctgcctaatataatggggtgacatgaggacttgggtgtgtgctttctgtcagagaagcccagggaataggagtttcagcattatatctcagacaacagcaaactttgagatcccttgctgtacagagaaggaaagcagaaactctatagtaaggcctaataatttgtggtgtaagccaatagtacataataaatgtatcctttatcagagctctatgatggaaagatgagaatgtttgagaaaaaataaatgaatacatttgggaatttatattttcttttgtctcagacactggatctatcatgtgcacagggacacacgcatgcatactcacacacatacaaacacaagaatgcctcattaatatctacctgcatgcaaatctatattgtacaaatcctggtgattacttaaaaatagcaattactcagatttcactatgtgccagataccattctaagtgatttaggtatattaactcaatctttacaacaaccttatcatgatcctcaattattttttatttattttattttatttttattatactttaagttctagggtacctgtgcacaacatgcagatttgttacatatgtatacatgtgccatgttggtgtgctgcacccattcactcgtcatttacattaggtatatctcctaatgctatccctccccacttcccccaccccacgacaggccccggtgtgtgatgttcgccttcctgtatccaagtgttctcattgttcagttcccacctatgagtgagaacatgtggtgtttggttttttgcccttgcgatagtttgctcagaatgatggtttccagcttcatccatgttcctacaaaggacatgaactcatccttttttatggctgcatagtattccatggtgtatatgtgccatattttcttaatccagtctatcattgatggacatttgggctggttccaagtctttgctattgtgaatagtgctgcaataaacatacatgtacatgtgtctttatactagcatgatttataatcctttgggtatatacccagtaatgggatggctgggtcaaatggtatttccagttctagatccttgaggaatcaccacactgtcttccacaatggttgaactagtttacagtcccaccaacagtgtaaaagtgttcctatttctccacatcctctccagcacctgttgtttcctgactttttaatgatcacccttctaactggtgtgagatggtatcttgttgaggttttgatttgcatttctctgatggccagtgatggtgagcattttttcatgtgtctgttggctgcataaacgtcttcttttgagaagtgtttattcatatccttcgcccactttttgatggggttgctttttcctcgtaaatttgtttgagttctttgtagattctagatactagccctttgtcagatgagtagattgcaaaaattttctcccattctgtaggttgcctgttcactctgattgtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaatatttaagtgtttaatccatcttgaattaatttttgtataaggtgtaaggaagtgatccagtttcagctgtctacatatggctagccagttttcccagcaccatttattaaatagggaatcctttccccatttcttcgttttgtcagatttgtcaaagatcagatggttatagatgtgtcgtattatttctgaggactctgttcttttccgtggtctttacatgctgttttggttactgtggccttgtagtatagtttgaagtcaggtagtgtgatgcctccagctttgttcttttggcttaggattgacttggcaatgtgggctcttttttggttccatatgaactttaaagtggtttttttccaattctgtgaagaaagtcattggtagcttgatggggatggcattgaatctataaattaccttgggcagtatggccattttcacgatattgattcttcctacccatgagcatggaatgttcttccatttctttgtgtcctcttttattttcttgagcaatggtttgtagttctccttgaagaagtccttcacatcccttgtaagttggattcctaagtattttactctctttgaagcaattgtgaataggagttcactcatgatttggctgtttgtctgctattggtgtataggaatgcttgtgattttttcacactgattttctatctgagactttgctgaagttgcttatcagcttaaggagattttgggctgagacgatggggctttctaattatacaataatgtcatctggaaacagggacaatttgacttcctcttttcctaattgaataccctttacttctttctgttccctgattgccctggccagaactttcaacactatgttgaataggagtggtgagagagggcatccctgtcttgtgccagttttcaaagggaatgcttccagtttttgcccattcagtatgatattggctgtagtttgtcataaatagctattattattttgagacatgtcccatcagtacctaatttattgagagtttttagcatgaagggttgttgaattttgtcaaaggccttttctgcatctattgagataatcatgtggtttttgtctttggttctgtttatatgctggattacattaatgatttgcgtatgttgaaccagccttgcatcccagggatgaagcccactagatcatggcagataagctttttgatgtgctgctggattcggtttgccagtattttattgaggacttttgcatcaatgttcatcagggatattggtctaaaattctctttttttgttgtgtctcttccaggctttggtatcacgatgatgctagcctcataaaatgagttagggagggttccctctttctctattgattggaatagtttcagaaggaatggtaccagttcctccttgtacctctggtagaattcggctatgaatccatccggtcctggactttttttggttggtaggctattaattattgcctcaatttcagagcctgttattggtctattcggggattcaacttcttcctggtttagtatttggagggtgtatgtgtccaggaacttatccatttcttctagattttctagtttatttgcgtagaggtgtttatagtattctctgatggtagtttgtatttctgtgggatcagtggtgatatcccctttatcattttttattgtgtctatttgattcttctctcttttcttctttattagtcttgctagcagtctaacaattttgttgatcttttcaaaaaaccagctcctgggttcattgattttttgaagggttttttgtgtctctatttccttcagttctgctctgatcttacttatttcttgccttctgctagcttttgaatgtgtttgctcttgcttctctagttcttttaattgtgatgttagggtgtcaattttagatctttcctgctttctcttgtgggcatttagtgctataaatttccctctacacactgctttaaatgtgtcccagagattctggtatgttgtgtctttgttctcattggtttccaaggacatatttatttctgccttcattccgttatgtacccagtagtcattcaggagcagtttgttcagtttccatgtagttgattggttttgagtgagtttcttaatcctgagttctagtttgattgcactgtggtctgagagacagtttgttataattcctcttcttttacattcgctgaagagtgttttacttccaactatatggtcagttttggaataagtgtgatgtggtgctgacaagaatgtatattctgttgatttggggtggagagttccgtagatgtctattaggtccgcgttgtgcagagctgatttcaattcctggacatccttgttaactttctgtctcattgatctgtataatgttgacagtggggtgttaaagtctccaattattattgtgtgggagtctaagtctctttgtaggtctctaaggacttgctttatgaatctgggtgctcctgtattgggtgcatacatatttaggatagttagctcttcttgttgaattgatccctttaccattatgtaatggccttctttgtctcctttgatctttgttggtttatagtctgttttatcagagactaggattgcaacccctgccttttttgttttccatttgcttggtagatcttcctccatccctttattttgagcctatgtgtgtctctgcacgtgagatgggtctcctgaatacagcacactgatgggtcttgactctttatccaatttgccagtctgtgtcttttaattggagcatttagcccatttacatttaaggttaatattgttacatgtgaatttgatcatgtcattatgatgttagctggttattttgctcgttagttgatgcagtttcttcctagcatcgatggtctttacaatttggcatgtttttgcagtggatggtaccggttgttcctttccatgtttagtgcttccttcaggagctcttgtagggcaggcctggtggtgacaaaatctgtcagcatttgcttgtctgtaaaggattttatttctccttcacttatgaagcttagtttggctggatatgaaattctgggttgaaaactcttttctttaagaatgttgaatattggcccccactctcttctggcttatagagtttctgccgagatccacggttcgtctgatgggcttccctttgtgggtaacccgacctttctctctggctgccttaaaattttttccttcatttcaactttggtgaatctgacaattatgtgttttggagttgctcttctcgaggagtatctttgtggtgttctctgtatttcctgaatttgaatgttggcctgccttgctaggttggggatgttctcctggataatgtcctgcagagtgttttccaacttggttccattctccccgtcactttcaggtacaccaatcagacatagatttggtcttttcacatagtcccatatttcttggaggctttattcgtttctttttactctgttttctctaaacttctcttctcacttcatttcattcatttgatcttccatcactgataccctttcttccagttgatcaaatcggctactgaagcttgtgcatgtttcatgtagttctcgtgccatggttttcagctccatcaggtcctttaaggacttctctacactggttattccagttagtcattcatctaatcttttttcaaggctttaagcttctttgcgatgggttcgaacttcctcctttagctcgg

SEQ ID NO: 12017 - DNA, 11741 bp, Homo sapiens
acttaataagacagagagggggaggagccaagatggccgaataggaacagctccggtctacagctcccagagtgagcgacgcagaagacgggtgatttctgcatttccatctgaggtaccgggttcatctcactagggagtgccagacagtgggcgcaggccagtgggtgtgcgcaccgtgcgcgagccgaagcagggcgaggcattgcctcacctgggaagcgcaaggggtcagggagttccctttccgagtcaaagaaaggggtgatggacgcacctggaaaatcgggtcactcccacccgaatactgcgcttttcagaccggcttaaaaaacggggcaccatgagactatatcccacacctggctcggagggtcctacgcccacggaatctcgctgattgctagcacagcagtctgagatcaaactgcaaggcagcagctaggctgggggaggggagcccgccattgcccaggcttgcttaggtaaacaaagcagccgggaagctcgaactgggtggagcccaccacagctcaaggaggcctgcctgcctctgtaggctccacctctgggggcagggcacagacaaacaaaaagacagcagtaacctctgcagacttaaatgtccctgtctgacagctttgaagagagcagtggttctcccagcacgcagctggagatctgagaatgggcagactacctcctcaagtgggtccctgacccctgacccccgagcagcctaactgggaggcaccccccagcaggggcacactgacacctcacacggcagggtattccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagaacagaaaaactggaaactctaaaatgcagagcgcctctcctcctccaaaggaacgcagttcctcaccagcaacggatcaaagctggatggagaatgactttgacgagctgagagaagaaggtttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagcaagaagggaaggttagagaaaaaagaatacaaagaaatgagcaaagcctctaagaaatatgggactatgtgaaaagaccaaatctacgtctgattggtgtacctgaaaatgatgcagagaatggaaccaagttggaaaacactctacaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcggtttaccctcaaagggaagcccatcagactaacagcggatctctcggcagaaaccctacaagccagaagagagtgggggccaatattcaacattcttaaagaaaagaattttcaacccagaatttcatttccagccaaactaagcttcataagtgaaggagaaataaaatactttacagacaagcaaatgctgagagattttgtcaccaccaggcctgccctaaaagagctcctgaaggaagcgctaaacatggaaaggaacaaccggtaccagccactgcaaaatcatgccaaaatgtaaagaccattgagactaggaagaaactgcatcaactaacgagcaaaatcaccagctaacatcataatgacaggatcaaattcacacataacaatattaactttaaatgtaaatggactaaattctccaattaaaagacacagactggcaagttggataaagagtcaagacccatcagtgtgctgtattcaggaaacccatctcacgtgcagagacacacataggctgaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagttctgagtgacctacaaagagacttagactcccacacattaataatgggagactttaacacctcactgttaacattagacagatcaatgagacagaaagtcaacaaggatacccaggaattgaactcatctctgcaccaagcggacctaatagacatctacagaactctccaccccaaatcaatagaatatacatttttttcagcaccacaccacacctattccaaaattgaccacatagttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacacaacataccagaatctctgggacgcattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaaaaagagaggagaatcaaatagacacaataaaaaatgataaaggggatatcaccaccgatcccacagaaatacaaactaccatcagagaatactataaacacctctacgcaaataaaccagaaaatctagaagaaatggataaattcctcgacacatacactctcccaagactaaagcaggaagaagttgaatctctgaatagaccaataacaggagctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatagaaacagaaccaaagacaaaaaccacatgattatctcaatagatgcagaataggcctttgacaaaattcaacaacccttcatgctaaaaactctcagtaaattaggtattgatgggacgtatttcaaaataataagagctatctatgacaaacccacagccaatatcatactgaatgggcaaaaactggaagcattcctttgaaaactggcacaagacagggatgccctctctcaccactcctattcaacacagtgttggaagttctggccagggcaatcaggcaggagaaggaaataaagggtattcaattaggaaaagaggaagtcaaattgtccctttttgcagacgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaatttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaatttcatatggaaccaaaaaagagcccgcatcgccaagtcaatcctaagccaaaagaacaaagctggaggcatcacactacctgacttcaaactatactacaaggctacagtaactaaaacagcatggtactggtaccaaaacagagatatagatcaatggaacagaacagagccctcagaaataacgccgcatacctacaattatctgatctttgacaaacctgagaaaaacaagcaacggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaatcctagaagaaaacctaggcattaccattcaggacataggcgtgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaatacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcaattcctcagggatctagaactagaaataccatttgacccagccatcccattactgggtatatacccaaatgactataaatcatgctgctataaagacacatgcacacgtatgtttattgcggcattattcacaatagcaaacacttggaaccaacccaaatgtccaacaacgatagactggattaagaaaatgtggcacatatacaccatggaatactatgcagccataaaaaaggatgagttcatgtcctttgtagggacatggatgaaattggaaaccatcattctcagtaaactatcgcaagaacaaaaaaccaaacaccgcatattctcactcataggtgggaattgaacaatgagatcacatggtcacaggaaggggaatatcacactctggggactgtggtggggtggggggaggggggaggggtagcattgggagatatacctaatgctagatgacgagttagtgggtgcagcgcaccagcatggcacatgtatacatatgtaactaacctgcacaatgtgcacatgtaccctaaaacttaaagtataataataaaaaaaaaaaagacagagaaacacaacttgcatgaacaagcaaatactcagtttgattcaacagtaagagaaacctcctgtaatagaaggttctttatatgtggaatccaggccttgagaaaaaggaggtaaggttggaaactgagttgctgatacttctagcaagacccttttaatgtgcccgaatatttactctactaacaatagcaaacgagagaacaagagcgtataggtagtagtgctgcctaatataatggggtgacatgaggacttgggtgtgtgctttctgtcagagaagcccagggaataggagtttcagcattatatctcagacaacagcaaactttgagatcccttgctgtacagagaaggaaagcagaaactctatagtaaggcctaataatttgtggtgtaagccaatagtacataataaatgtatcctttatcagagctctatgatggaaagatgagaatgtttgagaaaaaataaatgaatacatttgggaatttatattttcttttgtctcagacactggatctatcatgtgcacagggacacacgcatgcatactcacacacatacaaacacaagaatgcctcattaatatctacctgcatgcaaatctatattgtacaaatcctggtgattacttaaaaatagcaattactcagatttcactatgtgccagataccattctaagtgatttaggtatattaactcaatctttacaacaaccttatcatgatcctcaattattttttatttattttattttatttttattatactttaagttctagggtacctgtgcacaacatgcagatttgttacatatgtatacatgtgccatgttggtgtgctgcacccattcactcgtcatttacattaggtatatctcctaatgctatccctccccacttcccccaccccacgacaggccccggtgtgtgatgttcgccttcctgtatccaagtgttctcattgttcagttcccacctatgagtgagaacatgtggtgtttggttttttgcccttgcgatagtttgctcagaatgatggtttccagcttcatccatgttcctacaaaggacatgaactcatccttttttatggctgcatagtattccatggtgtatatgtgccatattttcttaatccagtctatcattgatggacatttgggctggttccaagtctttgctattgtgaatagtgctgcaataaacatacatgtacatgtgtctttatactagcatgatttataatcctttgggtatatacccagtaatgggatggctgggtcaaatggtatttccagttctagatccttgaggaatcaccacactgtcttccacaatggttgaactagtttacagtcccaccaacagtgtaaaagtgttcctatttctccacatcctctccagcacctgttgtttcctgactttttaatgatcacccttctaactggtgtgagatggtatcttgttgaggttttgatttgcatttctctgatggccagtgatggtgagcattttttcatgtgtctgttggctgcataaacgtcttcttttgagaagtgtttattcatatccttcgcccactttttgatggggttgctttttcctcgtaaatttgtttgagttctttgtagattctagatactagccctttgtcagatgagtagattgcaaaaattttctcccattctgtaggttgcctgttcactctgattgtagtttcttttgctgtgcagaagctctttagtttaattagatcccatttgtcaattttggcttttgttgccattgcttttggtgttttagacatgaagtccttgcccatgcctatgtcctgagtggtattgcctaggttttcttctagggtttttatggttttaggtctaatatttaagtgtttaatccatcttgaattaatttttgtataaggtgtaaggaagtgatccagtttcagctgtctacatatggctagccagttttcccagcaccatttattaaatagggaatcctttccccatttcttcgttttgtcagatttgtcaaagatcagatggttatagatgtgtcgtattatttctgaggactctgttcttttccgtggtctttacatgctgttttggttactgtggccttgtagtatagtttgaagtcaggtagtgtgatgcctccagctttgttcttttggcttaggattgacttggcaatgtgggctcttttttggttccatatgaactttaaagtggtttttttccaattctgtgaagaaagtcattggtagcttgatggggatggcattgaatctataaattaccttgggcagtatggccattttcacgatattgattcttcctacccatgagcatggaatgttcttccatttctttgtgtcctcttttattttcttgagcaatggtttgtagttctccttgaagaagtccttcacatcccttgtaagttggattcctaagtattttactctctttgaagcaattgtgaataggagttcactcatgatttggctgtttgtctgctattggtgtataggaatgcttgtgattttttcacactgattttctatctgagattttgctgaagttgcttatcagcttaaggagattttgggctgagacgatggggctttctaattatacaataatgtcatctggaaacagggacaatttgacttcctcttttcctaattgaataccctttacttctttctgttccctgattgccctggccagaactttcaacactatgttgaataggagtggtgagagagggcatccctgtcttgtgccagttttcaaagggaatgcttccagtttttgcccattcagtatgatattggctgtagtttgtcataaatagctattattattttgagacatgtcccatcagtacctaatttattgagagtttttagcatgaagggttgttgaattttgtcaaaggccttttctgcatctattgagataatcatgtggtttttgtctttggttctgtttatatgctggattacattaatgatttgcgtatgttgaaccagccttgcatcccagggatgaagcccactagatcatggcagataagctttttgatgtgctgctggattcggtttgccagtattttattgaggacttttgcatcaatgttcatcagggatattggtctaaaattctctttttttgttgtgtctcttccaggctttggtatcacgatgatgctagcctcataaaatgagttagggagggttccctctttctctattgattggaatagtttcagaaggaatggtaccagttcctccttgtacctctggtagaattcggctatgaatccatccggtcctggactttttttggttggtaggctattaattattgcctcaatttcagagcctgttattggtctattcggggattcaacttcttcctggtttagtatttggagggtgtatgtgtccaggaacttatccatttcttctagattttctagtttatttgcgtagaggtgtttatagtattctctgatggtagtttgtatttctgtgggatcagtggtgatatcccctttatcattttttattgtgtctatttgattcttctctcttttcttctttattagtcttgctagcagtctaacaattttgttgatcttttcaaaaaaccagctcctgggttcattgattttttgaagggttttttgtgtctctatttccttcagttctgctctgatcttacttatttcttgccttctgctagcttttgaatgtgtttgctcttgcttctctagttcttttaattgtgatgttagggtgtcaattttagatctttcctgctttctcttgtgggcatttagtgctataaatttccctctacacactgctttaaatgtgtcccagagattctggtatgttgtgtctttgttctcattggtttccaaggacatatttatttctgccttcattccgttatgtacccagtattcattcaggagcagtttgttcagtttccatgtagttgattggttttgagtgagtttctcaatcctgagttctagtttgattgcactgtggtctgagagacagtttgttataattcctcttcttttacattcgctgaagagtgttttacttccaactatatggtcagttttggaataagtgtgatgtggtgctgacaagaatgtatattctgttgatttggggtggagagttccgtagatgtctattaggtccgcgttgtgcagagctgatttcaattcctggacatccttgttaactttctgtctcattgatctgtataatgttgacagtggggtgttaaagtctccaattattattgtgtgggagtctaagtctctttgtaggtctctaaggacttgctttatgaatctgggtgctcctgtattgggtgcatacatatttaggatagttagctcttcttgttgaattgatccctttaccattatgtaatggccttctttgtctcctttgatctttgttggtttatagtctgttttatcagagactaggattgcaacccctgccttttttgttttccatttgcttggtagatcttcctccatccctttattttgagcctatgtgtgtctctgcacgtgagatgggtctcctgaatacagcacactgatgggtcttgactctttatccaatttgccagtctgtgtcttttaattggagcatttagcccatttacatttaaggttaatattgttacatgtgaatttgatcatgtcattatgatgttagctggttattttgctcgttagttgatgcagtttcttcctagcatcgatggtctttacaatttggcatgtttttgcagtggatggtaccggttgttcctttccatgtttagtgcttccttcaggagctcttgtagggcaggcctggtggtgacaaaatctgtcagcatttgcttgtctgtaaaggattttatttctccttcacttatgaagcttagtttggctggatatgaaattctgggttgaaaattcttttctttaagaatgttgaatattggcccccactctcttctggcttatagagtttctgccgagatccacggttcgtctgatgggcttccctttgtgggtaacccgacctttctctctggctgccttaaaattttttccttcatttcaactttggtgaatctgacaattatgtgttttggagttgctcttctcgaggagtatctttgtggtgttctctgtatttcctgaatttgaatgttggcctgccttgctaggttggggatgttctcctggataatgtcctgcagagtgttttccaacttggttccattctccccgtcactttcaggtacaccaatcagacatagatttggtcttttcacatagtcccatatttcttggaggctttattcgtttctttttactctgttttctctaaacttctcttctcacttcatttcattcatttgatcttccatcactgataccctttcttccagttgatcaaatcggctactgaagcttgtgcatgtttcatgtagttctcgtgccatggttttcagctccatcaggtcctttaaggacttctctacactggttattccagttagtcattcatctaatcttttttcaaggttttaagcttctttgcgatgggttcgaacttcctcctttagctcgg

SEQ ID NO: 12018 - DNA, 7969 bp, Homo sapiens
aatttcttttttttttattgcactttaagttttagggtacatgtgcaaaacgtgcaggtttgttacatatgtgtacatgtgccatgttggtgtgctgcacccactaactcgtcatttaacattaggtatatctcctaatgctatccctccccactcccctcaccccacaacaggccccggtgtgtgatgttccccttcctgtgtccaagtgtcctcattgttcaattcccacctatgagtgagaacatgcggtgtttggttttttgtccttgcgatagtttgctgagaatcatggtttccagcttcatccatgtccctacaaaggacatgaactcatccttttttatggctgcatagtattccatggtgtatatgtgccacattttcttaatccagtctatcattgttggacatttgggttggttccaagtcttcgctattgtgaatagtgccactataaacatacatgtgcctgtgtctttatagcagcatgatttataatcctttgagtatatacccagtaatgggatggctgggtcaaatggtatttctagttctagatccttgaggaatcaccacactgtcttccacaatggttgaattagttgacagtcccaccaacagtgtaaaagcgttcctatttctccacatcctctccagcacctgttgtttcctgactttttaatgatcgccattctaactggtgtgagatggtatctcattgtggttttgatttgcatttctctaatggccagtgatgatgagcattttttcatgtgtctgttggctgcataaatgtctccttttgagaagtgtctgttcgtatcctttgcccacttgttgatggagttgtttgtttttttcttgtaaatttgtttgagttcattgtagattctggatattagccctttgtccgatgagtagactgcaaaaattttctcccattctgtaggttgcctgttcactctgatggtagtttcttttgctgtgcagaagctctttagtttaattagatcccatttgtcaattttggcttttgttgccattgcttttgctgttttagacttgaagtccttggccatgcctatgtcctgaatggtattgcctaggttttcttatagggtttttgtggtatgaggtctaacacgtaagtctttaatccatcttgaattaatttttgtataaggtgtaaggaagggatccagtttcagctttctacatatggctagccagttttcccagcaccatttattaagtagggaatcctttccccatttcttgtttttgtcaggtttgtcaaagatcaggtggttgtagatacgtggaattatttctgagggctctgttctgttacattggtctatatctatgttttggtaccagtaccatgctgttttggatactgtagccttgtagtatagtttgaagtcaggtagcgtgatgcctccagctttgctcttttggcttaggattgacttggcgatgcaggctcttttttggttccatatgaactttaaggtagttttttccaattctgtgaagaaagtcattggtagcttgatgggggtggccttgaatctataaattaccttgggcagtatggccattttcacgatattgattcttcctacccatgagcatggaatgttcttccatttctttgtatcctcttttatttcattgagcagtggtttgtagttctccttgaagaggtccttcacatgccttgtaagttggattcctaggtattttattctctttgaagcaattgtgactgggagttcactcatgatttggctctctgtttgtctgttattggtgtataagaatgcttgtgatttttgcatattgattttgtatcctgaggcttttctgaagttgcttatcagcttaaggaggttttgagctgagatgatggggttttctaaatattcaatcatgtcatttgcaaatagggacaatttgacttcctcttttcctaattgaataccgtttattcctttctcctgcctgattgccctggccagagcttccaccactatgttgaataggagtagtgagagagggtgcccttgtcttgtgccaattttcaaatggaatgcttccagtttttgcccattcagtatgatattgtctgtgggtctgtcataaatagctcttattatttttatatatattccatcaatacttagtttattaagagtttttagcatgaagggctgttgaattttgctgaaggccttttctgcatctattgagataatcatgtggtttttgttgttggctctgtttgtatgctggattatgtttattgatttgcgtatgttgaagcagccttgcatcccggggatgaagcacacttgatcatggtcgataagctttttgaggtgctgctggattcggtttgccagtattttattgaggattttcgcatcaatgtttatcagggatattggtctaaaattctctttttttgttgtgtctctgccaggctttggtatcaggatgatgctggcctcataaaatgagttagggaggattccttctttttctattgatgggaatagtttcagaaggaatggtaccagctcctccttgtacctctggtagaattcggctgtgaatccatctggtcttggactttttttggttggtaagctattaattattgcctcaatttcagggcctgttattggtctattcagagattcaacttcttcctggcttagtcttgggagggtgtatgtgtccaggaatttatccatttcttctagattttctagtttatttgcatagaggtgtttatagtattctctgatggtagtttgtatttctgtgggatcggtggtgatatcccctttatcattttttattatgtctatttgagtcttctctcttttcttctttattagtcttactagtggtctatcaattttgctcatcttttcaaaaaaccagctcctggattcattgattttttgaagggctttttgtatctctatttccttcaattctgctctgatcttagttatttcttgccttctgctagcttttgaatgtgtttgctcttgcttctctagttcttttaattgtgatgttagggtgtcaattttagatctttcctgctttctcttgtgggcatttagtgctataaatttccctctacacactgctttgaatgtgtcccagagattctggtatgttgtatctttgttctcgttggtttcaaaggacatctttatttctgccttcatttcgttatgtacccagtagtcattcaggagcaggttgttcagtttccatgtagttgagtggttttgagtgagtttcttaatcctaagttctagtttgattgcactgtggtctgagagacagtttgttataatttctgttcttttacatttgctgaggagtgttttacttccaactatgtggtcagttttggaataggtgtggtgtggtgctgaaaagaatgtatattctgttgatttggggtggagatttctgtagatgtctattaggtccacttggtgcagagctaagttcgattcctggatatccttgttagctttctgtctctttgatctgtctaatgttgacagtgggatgttaaagtctcccattattactgtatgggagtctaagtctcttttttttttttttattgtccccctggcaaatctttttttcttttttcttttttttgtatttatttatttattttattgatcattcttgggtgtttctcgcagagggggatttggcagggtcataggacaatagtggagggaatgtcagcagataaacaagtgaacaaaggtctctggttttcctaggcagaggaccctgcggcctttcgcagtgtttgtgtccctgggtacttaaggttagggagtggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaagaatttttcttagtacagaacaaaatgaaaagtctcccatgtctacttctctctacacagacacggcaaccatccgatttctcaatcttttccccacctttcccgtctttctattccacaaaaccgccattgtcatcttggcctgttctcaatgagctgttgggtacacctcccagacggggtcgtggccgggcagaggggctcctcaattcccagtaggggtggctgggcagaggcgcccctcgcctcccggacagggcggctggccgggcggggggctgacccccccacctccctcccggacggggtggctggctgggcagaggggctcctcacttcccagtaggggcagccgggcagaggcgcccctcacctcctggacagggcggctggccaggcaaggggctgaccccccccccacccacctccctcccggacggggcggctggccgggcggggggctgaacccccacctccctcccggacggggcggctggccgggcagaggggctcctcaattcccagtaggggtggccgggcagaggcgcccctcgcctcccggacggggcggctggccggatggggtggctggccgggcggggggctgacccccccacctccctcccggacggggcggctggccgggcagaggggctcctcacttcccagtaggggcggccaggcagaggcgcccctcacctcccggacagggcggctggccgggcggggggctgacccccccccacctccctcccagacggggcggctggccgggcagaggggctcctcacttcccagtaggggcggccgggcagaggcgcccctcacctcccgtccgggaggctggccgggtggggggctgacccccccacctccctcccggacggggcggctggcctggcgggggctgacccccacctccctcccggacggggtggctgccaggcagagatgctcctcacctcccagaccgggtggctgccggacggaggggctcctcacctctcagacagggcggttgccaggcagagggtctcctcacttatcagacggggcagccgggcagagacgctcctcacctcccagacggggtcgcggccgggcagaggtgctcctcacataccagacggggcggcggggcagaggcgctccccacatcccagacgatgggcggccgggcagagacgctcctcacttcctagatgggatggcgggggggaagaggcgctcctcatttcctagatgggatggcggccgggcagagacgctcctcactttccagactgggcagccaggcagaggggctcctcacatcccagacgatgggcggccaggcagagacgctcctcacttcccagacggggtggcggctgggcagaggctgcaatctccgctctttgggaggccaaggcaggcggctgggaggtggttgtagcaagccgagatcacgccactgaactccagcctgggcaccattgagcactgagtgaacgagactccgtctgcaatcccggcacctcgggaggccgaggctggcggatcactcgcggttaggagctggagaccagcccggccaacacagcgaaaccccgtctccaccaaaaaaatacgaaaaccagtcaggcgtggcggcgcgcgcctgcaatcgcaggcactcggcaggctgaggcaggagaatcaggcagggaggttgcagtgagccgagatggcagcagtacagtccagctttggctcggcatcagagggagtacagtccagctttggctcagcatcagagggagaccgtggaaagagagggagagggagaccgtggggagagggagagggagagggagaggtctaagtctctttgtagctttctaaggacttgatttatgaatctgggtgctcctgtattgggtgcatatatatttaggatagttagctcttcttgttgaattgatccctttaccattatgtaatggcctggtttgtctcttttgatctttgttggtttaaagtctgctttatcagagactaggattgcaacccctgcctttttttgttttccatttgcttggtagatcttcctccatccctttattttgagcctatgtgtgtctctgcacgtgagagggtttcctgagtacagcacactgatgggtcttgactctttatccaatttgccagtctgtgtcttttaattggagcatttagcccatttacatttaaggttaatattgttatgtgtgaatctgatcctgtcattatgatgttagctggttattttgcttgttagttgatgcagtttcttcctacccttgatggtctttacaatttggcatgtttttgcagtggctggtaccagttattcctttccatgtttagcgcttccttcaggagctcctgtagggcaggcctggtggtgacaaaatctctcagcatttgcttgtctgtacagtattttatttctccttcccttttgaagcttagtttggctggatatgaaattctgggttgaaaattcttttctttaagaatgttgaatattggcccccactctcttctggcttgtagagtttctgccaagagatcagctgttagtctgatgggcttccttggtgggtaacccgacctttctctctggctgcccttaatattttttccttcatttcaactttggtgaatctgacaattatgtgtcttggagttgctcttctcgaggagtatctttgtggcattctctgtatttcctgaatttgaatgttggcctgccttgctaggttggggaagttctcctggataatatcctgcagagtgttttccagcttgattccattctccctgtcactttcaggtacaccaatcagacatagatttggtcttttcacatagtcccatatttcttggaggctttgttcatttctttttattcttttttctctaaacttctcttctcgcttcatttcattgatttgatcttccatcactgataccctttcttccagttgatcaaatcagctactgaggcttctgcatttgccacgtagttctcgtgccatggtgttcagctccatcaggtcctttaaggacttctctgcattggttattctagttagccattcgtctaatcttttttcaaggtttttaacttctttgccatgggttcgaacttcctcctttacctcagagtagtttgatcatctgaagccttcttctctcaactcgtcaaagtcattttccatccagctttgttctgttgctggtgaggagctgtgttcctttggagaaggagaggcattctgatttttagaattttcagtttttctgctctgttttttaccccatctttgtggttttatctacctttggtctttgatgatggtgatgtacagatggggttttggtgtggatgtcctttccgttttttagttttccttctaacagtcaggactctcagctgcaggtctgttggagtttgctggcggtccactccataccctgtttgcctgggtatcagcatcagagtctgcagaacagtggatattggtgaacagcaaatgttgctgcctgatcgttcctctggaagttttgtctcagaggagtacctggccgtgtgaggtgtcagtctgcccctacttggggggtgcctcccagttgggctactcaggggtcagggacccacttggggaggcagtctgtctgttctcagatctccagctgtgtgctgggagaaccactactctcttcaaagctgtcagacggggacatttaagtctgcagaggtttctgctgccttttgtttggctatgccctgcccccagaggtggagtctacagaggcaggcaggcctccttgagctgcagtgggctccgcccagttcaagcttcccagccactttatttacctactcaagcctcagcaatggcgggcg

SEQ ID NO: 12019 - DNA, 4504 bp, Homo sapiens
tcttgtaaatttgtttgagttcattgtagattctggatattagccctttgtccgatgagtagactgcaaaaattttctcccattctgtaggttgcctgttcactctgatggtagtttcttttgctgtgcagaagctctttagtttaattagatcccacttgtcaattttgacttttgttgccattgcttttggtgttttagacatgaagtccttgcccatgcctatgtcctgaatggtattgcctaggttttcttctagggtttttatggttttaggtctaacatgtaagtctttaatccatcttgaattaatttttgtgtaaggtgtaaggaagggatccagtttcagctttctacatatggctagccagttttcccagcaccatttattaaatagggaatcgtttccccatttcttgtttttgtcaggtttgtcaaagatcaggtggttgtagatgtgtggtattatttctgagggctccgttctgttccattggtctatgtctctgttttggtacaagtaccatgctgttttggttactgtagccttgtagtatagtttgaaatcaggtagcatgatgactccagctttgttcttttggcttaggattgtcttggcaatgcaggcccttttttggttccatatgaactttaaagtagttttttccaattctttgaagaaagtcgttggtagcttgatggggatggcattgaatctataaattacctcgggcagtacagccattttcacgatattgattcttcctatccatgagcgtggaatgttcttccatttgtttgtgtcctcttttatttcgttgagcagtggtttgtagttctccttgaagaggtccttcacatcccttgtaagttgggttcctaggtattttattctctttgaagcaattgtgaatgggagttcactcatgatttggctctctgtttgtctgttattggtgtataagaatacttgtgatttttgcacattgattttgtatcctgagactttgctgaagttgcttagcagcttaagaagattttaggctgagacaatggggttttctagatatacagtcatgttatctgcaaacagggacaatttgacttcctcttttcctaattgaataccctttatttctttctcctgcctgattgccctggccagaacttccaacactatgttggataggagtggtgagagagggcatccgtcttgtgccagttttcaaagggaatgcttccagtttttgcccattcagtatgatattggctgtgggtttgtcataaatagctcttattattttgagatacgtcccatcaataactaattcattgagagtttttagcatgaagggctgttgaattttgtcaaaggccttttctgcatctattgagataatcatgtgctttttgtctttggttctgtttatatgctggattacatttattgatttgtgtatgttgaaccagccttgcatcccagggaggaagcccacttgatcatggtggataagctttttgatgtgctgctggattcagtttgccagtattttattgaggatttttgcatcgatgttcatcagggatattggtctaaaattctctttttttgttgtgtctctgccaggctttgatatcaggatgatgctgggctcataaaatgagttagggaggattccctctttttctattgattggaatagtttcagaaggaatggtagcagctcctctttgtacctctggtagaattcagctgtgaatccatctggtcctggacttttttggttggtaagctattaattattgcctcaatttcagaacctgttattggtgtattcagagattcaacttcttcctggtttagtcttgggagggtgtgtgtgtcaaggaatttatccatttcttctagattttctagtttatttgcatagaggtgtttatagtattctctgatggtagtttgtgtttctgtgggatcggtggtgatatcccctttatcattttttattgtgtctatttgattcttctctctcttcttctttattaatcttgctagcggtctatcaattttgttgatcttttaaaaaaaaccagctcctggattcattgatttttttgaagggttttttgtgtctctatttccttcagttctgctctgatcttagttatttcttgctttctgctagcttttgagtgtgtttgctcttgcttctctacttcttttaattgtgatgttagggtgtcaattttagatctttcctgctttctcttgtgggcatttagtgctataaatttccctctacacactgctttaaatgtgtcccagagattctggtttgttatgtctttgttctcattggtttcaaagaacatctttatttctgccttcattttgttatgtacccagtagtcattcaggagcaggttgttcagtttccatgtagttgagcggttttgagtgagtttcttaactctcagttctagtttgattgcactgtggtctgagagacagtttgttataatttctgttcttttacatttgctggggagtgctttacttccaactacgtggtcaattttggaataagtgtgatgtgatgctgagaagaatgtatattctgttgatttggggtggagagttctgtagatgtctattaggtctgcttggtgcagagctgagttcaattcctggatatccttgttagctttctgtctcgttgatctgtctaatgttgacagtgcggtgttagagtcttccattattattttgtgggagtctaagtctctttgtaagtctctaaggacttgctttatgaatctgggtgctcctgtattgggtgcatatatatttaggatagttagctgttcttattgaattgatcccttcaccattatgtaatggccttgtttgtctcttttgatctttgttggtttaaagtctgtttttatcagagactaggattgcaacccctgccttttttttgttttccatttgcttggtagatcttcctccatccctttattttgagcctatgtgtgtctctgcatgtgagatgggtctcctgaatacagcatactgatgggtcttgactctttatccaatttgccagtctgtgtcttttaattggagcatttagcccatttacatttaaggttaatattgttatgtgtgaatttgatcctgtcattatgatgttagctggttattttgcttgttagttgatgcagtttcttcctagccttgatggtctttacaatttggcatgtttttgcagtggctggtaccagttgttcctttccatgtttagtgcttccttcaggagctcttctagggcaggcctggtggtgacaaaatctctcagcatttgcttgtctgtacagtattttatttctccttcacttatgaagcttagtttggctggatatgaaattctgggttgaaaattcttttctttaagaatgttgaatattggcccccactctcttctggcttgtagagtttctgccgagagatctgctgttagtctgatgggcttccctttgtgggtaacccgacctttctctctggctgcccttaacattttttccttcatttcaattttggtgaatctgacaattatgtgtcttggagttgctcttctcgaggagtatctttgtggcattctctgtatttcctgaatttgaatgttggcctgccttgctaggttggggaagttttcctggataatatcctgcagagtgttttccaacttggttccattctccccatcactttcaggtacaccaatcagacgtagatttggtcttttcacatagtcccatatttcttggaggcttttttcatttctttttacttttttttctctaaacttctcttcttgcttcatttcattcatttgatcttccatcactgataccctttcttccagttgatcaagttggctactgaagcttgtgtgttcatcacgtggttctcttgccatggttttcagctccatcaggtcatttaaggacttctctacgctggttattctagttagccattcgtctaatcttttttcaaggtttttagcttctttgcgatgggttcaaacttcctcctttagctcggagaagtttgatcatctgaagccttcttctctcaactcgtcaaagtcattctccaaccagctttgttccatcgctggcagggagctgcgttcctttggagggggagaggtgctcgatttttagaattttcagcttttctgctctgttttttccccatctttgtggttttatctacctttggtctttgatgatggtgacgtacagatggggttttggtgtggatgtcctttctcttggttcgttttccttctaacagtcaggatcctcagctgcaggtctgctggagtttgctaaaggtccactccagaccctgtttgcctgggtatcagcagtggaggctgcaaaacagcgaatattggtgaacagcaaatgttgctgcctgatagttcctctg

SEQ ID NO: 12020 - DNA, 16344 bp, Homo sapiens
  misc_feature (4124)..(4124): n equals a,t,g, or c
  misc_feature (4127)..(4127): n equals a,t,g, or c
  misc_feature (4130)..(4131): n equals a,t,g, or c
  misc_feature (4136)..(4136): n equals a,t,g, or c
  misc_feature (4141)..(4141): n equals a,t,g, or c
  misc_feature (4151)..(4151): n equals a,t,g, or c
  misc_feature (4162)..(4162): n equals a,t,g, or c
  misc_feature (4170)..(4170): n equals a,t,g, or c
  misc_feature (4202)..(4202): n equals a,t,g, or c
  misc_feature (4220)..(4220): n equals a,t,g, or c
  misc_feature (4229)..(4229): n equals a,t,g, or c
  misc_feature (4382)..(4382): n equals a,t,g, or c
  misc_feature (4391)..(4391): n equals a,t,g, or c
  misc_feature (4400)..(4401): n equals a,t,g, or c
  misc_feature (4404)..(4404): n equals a,t,g, or c
  misc_feature (4415)..(4415): n equals a,t,g, or c
  misc_feature (4421)..(4421): n equals a,t,g, or c
  misc_feature (4428)..(4428): n equals a,t,g, or c
  misc_feature (4438)..(4438): n equals a,t,g, or c
tttttcttagttcatattctttttcttttcttttctttattattatactttaagtttcagggtacatgtgcatattgtgcaggttagttacatatgtatacatgtgccattctggtgcgctgcacccactaactggtcatctagcattaggtatatctcccagtgctatccctcccccctccccccaccccactacagtccccagagtgtgatgttccccttcctgtgtccatgtgatctcattgttcaattcccacctatgagtgagaatatgcggcgtttggttttttgttcttgcgatagtttactgagaatgatgatttccaatttcatccatgtccctacaaaggacatgaactcatcatttttaatggctgcatagtgttccatggtgtatatgtgccacattttcttaatccagtctatcattgttggacatttgggttggttccaagtctttgctattgtgaataatgccacaataaacatatgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgtttttggctgcataaatgtcttcttttgagaagtgtctgttcatgtccttcacccacttttcgatggggttgtttgtttttatcttgtaaatttgtttgagttcattgtagattctggatattagccctttgtcagatgagtaggttgcgaaaattttctcccattttgtaggttgcctgttcactctgatggtagtttcttttgctgtgcagaaactctttagtttaattagatcccatttgtcaattttggcttttgttgcctttgcttttggtgttttagacatgaagtccttacccatgcttatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggttggtcaaagatcagatagttgtagatatgcagcattatttctgagggctctgttctgttccattgttctatatctgtgttttggtaccagtaccatgctgttttggttactgtagccttgtagtatagtttgaagtcaggtagtgtgatgcctccagcttttttcttttggcttaggattgccttggcaatgcgggctcttttttggttccatatgaactttaaagtagtttcttccaattctgtgaagaaaggcattggtagcttgatggggatggcattgaatctgtaaattaccttgggcagtatggccattttcacgatattaattcttcctacccatgagcatagaatgttcttccatttgtttgtatcctcttttatttcgttgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgacttttgtacattgattttgtatcctgagactttgctgaagttgcttatcagcttaaggagattttgggctgagacaatggggttttctagatatacaatcatgtcatctgcaaacagggacaatttgacttcctcttttcctacttgaataccctttatttccttctcctgcctaattgccctggccagaacttccaacactatgttgaataggagtggtgagagagggcatccctgtcttgtgccagttttcaagggaatgcttccagtttttgcccattcagtatgatattggctgtgggtttgtcatagatagctcttattattttgaaatacgtcccatcaatacctaatttattaagagtttttagcatgaagggttgttgaattttgtcaaaggccctttctgcatctatgcagataatcatgtggtttttgtctttggctctgtttatatgctggattacatttattgatatgtgtatattgaaccagccttgcatcccagggatgaagcccacttgatcatggtggataagctttttgatgtgctgctggattcggtctgccagtattttattgagggtttttgcatcaatgttcatcaaggatattggtctaaaattctcttttttggttgtgtctctgcctggctttggtatcagaatgatgctggcctcataaaatgagttagggaggattccctctttttctattgattggaatagtttcagaaggaatggtaccagttccttcttgtacctctggtagaattcggctgtgaatccatctggtcctggactctttttggttggtaagctattgattattgccacaatttcagatcctgttattggtctattcagagattcaacttcttcctggtttagtcttgggagagtgtatgtgtcgaggaatttatccatttcttctagattttctagtttatttgcgtagaggtgtttgtagtattctctgatggtagtttgtatttctgtgggattggtggtgatgtcccctttatcattttttattgcatctatttgattcttctctctttttctctttattagtcttgctagcagtctatctattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctatacactgctttgaatgcgtcccagagattctggtatgttgtgtctttgttctcgttggtttcaaagaacatctttatttctagcttcatttcgttatgtacccagtagtcattcaggagcaggttgttcagtttccatgtagttgagcggttttgagtgagattcttaatcctgagttctagtttgattgcactgtggtctgagagatagtttgttataatttctgttcttttacatttgctgaggagagctttacttccaagtatgtggtcaattttggaatacgtgtggtgtggtgctgaaaaaaatgtgtattctgttgatttggggtggagagttctgtagatgtctattaggtccacttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttgaagtctgttttatctgagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaatttgccagactgtgtcttttaattggagcatttagtccatttacatgtaaagttaatattgttatgtgtgtatttgatcctgtcattatgatgttagctggttattttgctcgttagttgatgcagtttcttcctagnctnganngtctntacantttggcatgnttttgcagtgnctggtacnggttgttcctttccatgtttagtgcttccttnaggagctcttttagggcnggcctggtngtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagngtttctgcngagagatcnnctnttagtctgatnggcttncctttgngggtaacccnacctttctctctggctgcccttaacattttttccttcatttcaactttggtgaatctgacaattatgtgtcttggagttgctcttgtcaaggaatatctttgtggcattctctgtatttcctgaatctgaactttggcctgccttgctagattggggaagttctcctggataatatcctgcagagtgtttttcaacttggttccattctccccatcactttcaggtacaccaatcagacgtagatttggtcttttcacatagtcccatatttcttggaggctttgctcatttctttttattcttttttctctaaacttcccttcttgcttcatttcattcatttcatcttccatcactgataccctttcttccagttgatcgcatcggctcctgaggcttctgcattcttcacgtagttctcgagccttggttttcagctccatcagctcctttaagcacttctgtgtattagttattctagttatacattcttctaaatttttttcaaagttttcaacatctttgcctttggtttgaatgtcctcctgtagctcagagtaatttgatcgtctgaagccttcttctctcagcttgtcatagtcattctctgtccagctttgttccgttgctggtgaggaactgcattcctttggcagaggagaggcgctctgctttttagagtttccagtttttccccatctttgtggttttatctacttttggtctttgatgatggtgatgtacagatgggtttttggtgtggatgtcctttctgtttgttagttttccttctaacagacaggaccctcagctgcaggtctgttggagtaccctgccctgtgaggtgtcagtctgcccctgctggggggtgcctcccagttaggctgctcgggggtccggggtcagggacccacttgaggaggcagtctgcccttctcagatgtccagctgcgtactgggaggaccactgctctcttcaaagctgtcagacagggacatttgagtctgcagaggttactgctgtctttttgtttgtctgtgccctgcccctagaggtggagcctacagaggcaggcaggcaggcctccttgagctgtggtgggctccacccagttcgagcttcctggctgctttgtttatctaagcaagcctgggcaatggggggcccccctcccccagcctcactgccgccttgcagtttgatctcagactgctgtgctagcaatcagcaagactcagtgggtgtgggaccctccaagccaggtgcgggatatagtctcgtggtgcgccgtgttttaagctcgtcagaaaagcgcagtattcgggtgggagtgacccgattttccaggtgccgtccgtcacccctttctttgactaggaaagggaactccctgacccctgtgcttcccgagtgatgcaatgcctcgccctgcttcggctcgcgcatggtgtgcacacccactgacctgcgcccactgtctggcactccctagtgagatgaacccggtacctcagatggaaatgccgaaatcacccgtcttctgcgtcgctcaggctgggagctgtagacgggagctgttcctattcggccatcttggctcctcccccccaggcacaatactttctaaaggcaccttgaagcctaaaagagcccttcttatactctgaggtatctcaccactgaaactggttacatacatctgtattgggaattaatggataagggtggaacaaatgaaatgcatttctgggggccagatattccaaagcagtttggggtagccttcttcctcctcctctgcaatgctttgttagttggaggctgtaaacatgccgatgctttcccaaatttgtgggaatgaatgtgaatcacagtttttggggcttcaatctcctctgcggacacataaaaaggaactttcatcaatttctaacaaggtttgagatctatgcctggatagagctggatattgatgcaaaagtaagaagcaaaagatgatttccttgagttccagcaatttcaataaaaaacacagagaccagacttgcaacaacactatagtgtcaaagagctggttcccaaaggggagcatagagtccacccataccagagacagacgagatctaacactttttgagtttaatattaatgttgcagcatggtaatgaaaactagtaaaagaatctctcttggtaaatgaatcttcactcccaaacggcaagcaggaaaaaccctaaataaataatgtgagattgatatcagaggcccatgtgcagggactcgattacaattcttggcttgtactcaggggccctcatgcattttttaagagctcatcaatattgtgatccttctgcttgctggtgaactttaaaaactacaccgaggtataaaagtagggctttgactttgttgaggcttatgattcttctcaaataaagtagatctgaataaaagacggattggaaaatcttccctggcctttaggcaagcacagaacttagcagtggttttggagcacccactatggaacgatccatgagatccaaagatggatacagttcccacacaacagccacaaggaaccacacattggggaccacctgaagcagaaccctagctgggggcttggccttgttctgccatgaagctgacagagctgtttctacaacaatgtgcatcttgaatcatcccacagaaggagctgagttaggctggaaatgagagaattccagacagagggaaggtatatttgtggagttgtaggaggccagaaagttgaaggctggagactaggggcaaggttggaggctggagaccaggggtcaaggcaaggaagacaaggctgacccctcagacgctagtaagtctctactgtgagagcagcaggaagccatggaagggggttaaacagaggaaggttgactcttactggaaatgatggcttgtctcccatttctggtttgggatacaggatgccttaggccctggtgccagcagagtgtacaggaggccacattggaagacgatggtctttgctgtcttcttacctttctgtatgctccctgggccttcgtgtggctttagcttctcacaaggcctcactgggctgtgtatgtgtgtgcgtgtttgtgtgtgtaggtggtgactgaccatcttctatgagctgggctttgtattatttcttgaccttctcaagatttgcctgtctcatgtcttcagaacccattgcctgcagtctttgatacacactattctgataaatgaatgagactgtgaggagtgttaatttaagatattaacccttttatgtgttagggtaatacccagtgtctttttactcaggagatattcaatcagtagggattcaatacacgagtgtcgtatatttgtgttttaaccgggtctgtctgagatgcagtgaacgttcagttagcctgggcagccttctttcttgtcatctgtagagctggaatctgggagcttccttctggtcactcagcagggacaaagaggcctctacccccacatcactgttctctaaggtacatgcctcccccatcactttccacctctcgaggaactggcacagcccaggatttcgcaatgattagaactgaaccccaataagctacccaagaaaaacagtgagccttttaaggggctcagaagtcagacaagagaatcagaacacagggaatacatgttctggaacaagaggacacaaacaccagcttagcaactgcagcaagtacagtgaaccagccagaccaccggacaaggtcagaggtacaggggatggcctcttgaacacagtggcaggaggatggttgcagggtagtggctgcagaagaccccatgtacatacatgctaagcttttatttcaggcaaagggcttagagttctaagcttgagaacccctcagaacaggtcctactgtcactttctgagtctgagggagagttactaagaagacactgaaattctataagagcccttaagaagctaaaattgcaaatactcctcagagagacctggatttccagcagaaatcaggattagcacatgccaatatttaggtcgacatcgagtgggcgtgaacagcagtatgtggaggctttgttggatggccccagggttcttttaacctaaaattctatgggagtgtttgaagggtcgtagttcagagggaactcttgatccctgttgtgaacgccaagctcattcctatctcctggcctttatctttgctcagctctctggaccaccagaaggatctttgcagggctccttccatcccatcatttacgtctcattgcctgagaggcctttccgggccattctttccaaaatactcccctcccacgttttatccccttcctggatttgcttctccacccagcactcaccacagtcgggaacgatactatttgtttgtttacttgatcagtggggatctctgtgggtcttgtctatcaatcactgcatcctcagttcccaaaacaggaccagtcatttagtgtccactcaacacacgcatggcaaaaaaagacagaggagcagggaggctgagagggagggagcaagccttcctctagaagggtggaacgcagagcagtgcagtgagaatgtgtgtgtgcctgtgtgtatccatgcatgggagcatgtgcttatgtatccacgtacatgtgcatgtgtgtcaacatatatgtgtccatgcatgtgtacttgtgtgtgaatgtgtatgtgtgcacgcatgtgtgtgcgcaagcacacgtgtaggcatcaaagagacttgcatttgaaaggagacccttagtataatatttatgataaacatttcaaaactgagttttagtgatgtgcagaacagaggaggaagatgcaagccccgaggcttggcaccccagctgcctgagccaagtcctcaggcagtgagggagatataggtaagtgaagctgggggtgggggttatttagctctgaagattggactgctggtgtcttgttttgatttcagagccaacatgacagatacccagacttcagagagggaaaacagcatggtcaaaatgacaactgagaatacggtggccagccttggtcagaatagtgctgacctgtgcagaggtaggctctttcttcaggtaagggctcctggcctctctgcatgccttggggcccgcctcctactctccaccctcacaccctcaggagagagtgatgcaagatgaatggatcctaaaattaaaatccagtaactctttcgaattactggcaatttagtgaattaacaagttggcaccaggcagtggccttttcccactaaaaaaaaaaaaaacaacctcaaatgcattccccaaggaaggggctgaaactcataaccttgtgtctggggcccagagggcatgagcacagagatccaaaggggctgatgctttccctaccactagtggggcaggctgtgttagggtgcatgtctgaaacttgaaactgaattaagtagcttcatgtaatggcttctcttgacggcacaggataaacatcataagaagaagaagcagtaatccaagaaggtttgcaactggctcaaaatgctacctgaaaccaagaattggaagccaccttgacccagaggaaaaaaaattgttaaactttgcagctatttctcaaaagaatagagaattttgttttctgtttgtagagatgggaatagtcatcccttatggaagaagacaataatttgctgcatttttaggacttgtaattgtacaggcaaattcaaaattcaggtagcattaaaattacagctagataatgctgcctgctttgtggatagctatcctcatttcaagggagagcacccctttatctgttgaagagatgtctttttgatttgctaagggcaagaatggaaaataagtgcgaataggaacagctccggtctgcagctcccagcgtgagcgacgcagaagacgggtgatctcggcatttccatctgaggtaccgggttcatctcactagggagtgccagacagtgggtgcgcacactgtgcgtgagccgaagcagagcgaggcattgcctcactcgggaagcacaaagggtcagggagttccctttcctagtcaaagaaaggggtgacggacggcacctggaaaatcgggtcactcccacccgaatactgtgcttttctgacgggcttaaaacatggcgcaccacgagattatatcccgcacctggcttggagggtcctacgcccatggagtctcgctgattgctagcagagcagtctgagatcaaactgcaaggtggcagccaggctgggggaggggggcccgccattgcccaggcttgcttaggtaaacaaagcagcctggaagctcgaactgggtggagcccaccacagctcaaggaggcctgcctgcctgcctctgtaggctgcacagacaaacaaaaagacagcagtaacctctgcagactcaaatgtccctgtctgacagctttgaagagagcagtggtcctcccagtacgcagctggacatctgagaagggcagactgcctcctcaagtgggtccctgaccccggacccccgagcagcctaactgggaggcaccccccagcaggggcagactgacacctcacagggcagggtactccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaactggaaactctaaaaagcagagcgcctctcctctgccaaaggaatgcagttcctcaccagcaacggaacaaagctggacagagaatgactatgacaagctgagagaagaaggcttcagacgatcaaattactctgagctacaggaggacattcaaaccaaaggcaaagatgttgaaaactttgaaaaaaatttagaagaatgtataactagaataactaatacacagaagtgcttaaaggagctgatggagctgaaaaccaaggctcgagaactacgtgaagaatgcagaagcctcaggagccgatgcgatcaactggaagaaagggtatcagtgatggaagatgaaatgaatgaaatgaagcaagaagggaagtttagagaaaaaagaataaaaagaaatgagcaaagcctccaagaaatatgggactatgtgaaaagaccaaatctacgtctgattggtgtacctgaaagtgatggggagaatggaaccaagttgaaaaacactctgcaggatattatccaggagaacttccccaatctagcaaggcaggccaaagttcagattcaggaaatacagagaatgccacaaagatattccttgacaagagcaactccaagacacataattgtcagattcaccaaagttgaaatgaaggaaaaaatgttaagggcagccagagagaaaggtcgggttaccctcaaagggaagcccatcagactaacagtggatctctcggcagaaaccctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcactaccaggcctgccctaaaagagctcctgaaggaagcactaaacatggaaaggaacaaccggtaccagccactgcaaaatcatgccaaaatgtagagaccatcaagactaggaagaaactgcatcaactaacgagcaaaataaccagctaacatcataatgacaggatcaaatacacacataacaatattaactttacatgtaaatggactaaatgctccaattaaaagacacagactggcaaattggataaagaaagagtcaagacccatcagtgtgctgtattcaggagacccatctcacgtgcagagacacacataggctcaaaataaaaggatggaggaagatctaccaagcaaatggaaaacaaaaaaaggcaggggttgcaatcctagtctcggataaaacagactttaagccaacaaagatcaaaagagacaaagaaggccattacataatggtaaagggatcaattcaacaagaagagctaactatcctaaatatatatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaactcagctctgcatcaagtggacctaatagacatctacagaactctccaccccaaatcaacagaatacacatttttttcagcaccacaccacacctattccaaaattgaccacatacttggaagtaaagctctcctcagcaaatgtaaaagaacagaaattataacaaactgtctctcagaccacaggtcaatcaaactagatctcaggattaagaatctcactcaaaatcgctcaactacatggaaactgaacaacctgctcctgaatgactactgggtacataacgaaatgaaaccagaaataaagatgttctttgaaaccaacgagaacaaagacacaacataccagaatctctgggacgcattcaaagcagtgtgtacagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagtagaaccgaagcaaatagagacacaaaaaacccttcaaaaaattaatgaatccaggagctggttttttgaaaggatcaacaaaatagatagactgctagcaagactaataaagagaaaaagagagaagaatcaaatagatgcaataaaaaatgataaaggggacatcaccaccaatcccacagaaatacaaactaccatcagagagtactacaaacacctctacgcaaataaactagaaaatctagaagaaatggataaattcctcgacacatacactctcccaagactaaaccaggaagaagttgaatctctgaatagaccaataacaggatctgaaattgtggcaacaatcaatagcttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccaggcagagacacaaccaaaaaagataattttagaccaatatccttgatgaacattgatgcaaaaatcctcaataaaatactggcagaccgaatccagcagcacatcaaaaagcttatccaccatgatcaagtgggcttcatccctgggatgcaaggctggttcaatatacacaaatcaataaatgtaatccagcatataaacagagccaaagacaaaaaccacatgattatctcaatagatgcagaaaaggcctttgacaaaattcaacaacccttcatgctaaaaactctcaataagttaggtattgatgggacgtatctcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaatgaagggtattcaattaggaaaagaggaagtcaaattgtccctgtttgcagatgacatgattgtgtatctagaaaaccccactgtctcagcccaaaatctccttaagctgataagcaacttcagcaaagtctcaggatacaaaatcaatgtacaaaagtcacaagcattcttatacaccaataacagacaaacagagagccaaatcatgagtgaactcccattcacaattgcttcaaagagaataaaatacctaggaatccaacttacaagggatgtgaaggacctcttcaaggagaactacaaaccactgctcaacgaaataaaagaggatacaaacaaatggaagaacattctatgctcatgggtaggaagaatcaatatcgtgaaaatggccatactgcccaaggtaatttacagattcagtgccatccccatcaaggtaccaatgcctttcttcacagaattggaagaaactactttaaagttcatatggaaccaaaaaagagcccgcattgccaaggcaatcctaagccaaaagaaaaaagctggaggcatcacactacctgacttcaaactatactacaaggctacagtaaccaaaacagcatggtactggtaccaaaacacagatatagatcaatggaacagaacagagccctcagaaataatgccgcatatctacaactatctgatctttgaccaacctgagaaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaaaggcaacaaaagccaaaattgacaaatgggatctaattaaactaaagagtttctgcacagcaaaagaaactaccatcagagtgaacaggcaacctacaaaatgggagaaaattttcgcaacctactcatctgacaaagggctaatatccagaatctacaatgaactcaaacaaatttacaagataaaaacaaacaaccccatcgaaaagtgggtgaaggacatgaacagacacttctcaaaagaagacatttatgcagccaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggacctagaactagaaataccatttgacccagccatcccattactgggtatatacccaaaggaatataaatcatgctgctataaagacatatgcacacgtatgtttattgcggcattattcacaatagcaaagacttggaaccaacccaaatgtccaacaatgattggattaagaaaatgtggcacatatacaccatggaacactatgcagccataaaaaatgatgagttcatgtcctttgtagggacatggatgaaattggaaatcatcattctcagtaaactatcgcaagaacaaaaaaccaaacaccacatattctcactcataggtgggaattgaacaatgagatcacatggacacaggaaggggaacatcacactctggggactgtagtggggtggggggaggggagagggatagcactgggagatatacctaatgctagatgactagttaatgggtgcagcacaccagcatggcacatgtatacatatgtaactaacctgcacaatatgcacatgtaccctaaaacttaaaataataaaagaaaaaaagaaaagaaaa

SEQ ID NO: 12021 - DNA, 2662 bp, Homo sapiens
gagttctgtagatgtctattaggtccgcttggtgcagagctgagttcaattcctgggtgtccttgttaactttctgtctcgttgatctgtctaatgttgacagtggggtgttaaagtctcccattattaatgtgtgggagtctaagtctctttgtaggtcactcagggcttgctttatgaatctgggtgctcctgtatcgggtgcatatatatttaggatagttagctgttcttgttgaattgatccctttaccattatgtaatggccttctttgtctcttttgatctttgttggtttaaagtctgttttagcagagactaggattgcaacccctgcctttttttgttttccatttgcttcgtagatcttcctccatccctttattttgagcctatgtgtgtctctgcacatgagatgggtttcctgaatacagcacactgatgggtcttgactctttatccaatttgccagtctgtgtcttttaattggagcatttagtccatttacatttaaagttaatattgttatgtgtgaatttcatcctgtcattatgatgttagctggttattttgctcgttagttgatgcagtttcttcctagcctcgatggtctttacaatttggcatgattttgcagtggctggtaccagttgttcctttccacgtttagtgcttccttcaggagctcttttagggcaggcctggtggtgacaaaatctctcagcatttgcttgtctgtaaagtattttatttctccttcacttatgaagcttagtttggctggatatgaaattctaggttgaaaattcttttctttaagaatgttgaatattggcccccactctcctctggcttgtagagtttctgccgagagatccgctgttagtctgatgggcttccctttgtgggtaagctgacctttctctctggctgcccttaacattttttccttcatttcaactttggtgaatctgacaattatgtgtcttggagttgctcttctcgaggagtatctttgtggcattctctgtatttcctgaatctgaatgttggcctgccttgctagattggggaagttctcctggatagtatcttgcagagtgttttccaacttggttccattctccctgtcactttcaggtacaccaatcagacgtagatttggtcttttcacatagtcccatatttcttggaggctttgttcgtttctttttattcttttttctctaaacttcccttctcgcttcatttcattcatttcatcttccattgctgataccctttcttccagttgatcatatcggctcctgaggcttctgcattcttcacgtagttctcgagccttggctttcagctccatcagctcctttaagcacttctctgtattggttattctagttatacattcatctaaatttttttcaaagtttttaacttctttgcctttggtttgaatttcctcctgtagctcggagtagtttgatcctctgaagccttcttctctcaactcgtcaaagtcattctctgtccagctttgttccgttgctggtgaggaactgcattcctttggaggaggagaggggctctgctttttagagtttccagtttttctgctctgtttttttcccatctttgtggttttatctacttttggtatttgatgatggtgatgtacagatgggtttttggtgtggatgtcctttctgtttgttagttttccttctaacagacaggaccctcagctgcaggtctgttggagtttgctagaggtccactccagactctgtttgcctgggtatccgcagcggtggctgcagaacagcggattttcgtgaactgtgaatgctgctgtctgatcgttcctctggaagttttgtctcagagtagtacccagctgtgtgaggtgtcagtctgcccctgctgagggttgcctcccagttaggctgcttgggggtcaggggtcagggacccacttgaggaggcagtctgcccattctcagatttccagctgcgtgctgggagaaccactgctctcttcaaagctgtcagacagggacatttaagtctgcagaggttattgctgtctttttgtttgtctgtgccctgcccccagaggtggagcctacagaggcaggcaggcctccttgagctgtggtgggctccacccagttcgaacttcccggctgctttgtttacctaagcaagcctgggcaatggggggcgcccctcccccagcctcgctgccaccttgcagtttgatctcagactactgtgctagcaatcagcaagactccatgggcgtaggaccctccgagccaggtgcgggatataatctcctggtgtgccgttttttaagcccgttggaaaagcgcagtattagggtgggagtgacccgattttccaggtgctgtctgtcacccctttctttgactaggaaagggaactccctgaacccttgcacttcccgagtgaggcaatgccttgccctgctttggctcgcgcacggtgcactacacccactgtcctgcgcccactgtctggcactccctagggagatgaacccggtacctcagatggaaatgcagaaatcacccgtcttctgcgtcgctcacgctgggagctgtagaccagagctgttcctattcggccatcttggctgccc

SEQ ID NO: 12022 - DNA, 46917 bp, Homo sapiens
gtctaatatttaagtctttaatccatcttgaattaaattttgtataaggtgtaaggaagggatacagtttcagctttccacatatggctagccagttttcccagcaccatttattaaatagggaatcctttccccattgcttgtttttctcaggtttgtcaaagatcagatggttgtagatatgtggcattatttctgagggctctgttctgttccattggtctatatctctactttggtaccagtaccatgctgttttggttactgtagccttgtagtataatttgaagtcaggtagtgtgatgcctccagctttcttcttttggcttaggattgacttggcaatgtgggctcttttttggttccatatgaactttaaagtagttttaccaattatgtgaaggaagtcattggtagtttggtggggatggcattgaatctataaattaccttgggcagtaaggccattttcacgatattgattcttcctacccatgagcatggaatgttcttccatttgtttgtatcctcttttatttcattaagcagtggtttgtagttctccttgaagaggtccttcacgtcccttgtaagttggattcctaggtattttattccctttgatgcaattgtgaatgggagttcactcatgatttggctctctgtttgtctgttattggtgtataagaatgcttgtgatttttgcacattgattttgtatcctgagactttgcttaagttgcctatcagcataaggagattttgggctgagacgatggggttttctagatatacaatcatgtcatctgcaaacagggacaatttgacttcctcttttcctagttgaataccctttatttccttctcctgcctgattgccctgggcagaacttccaacactatgttgaataggagtggtgagagagggcatccctgtcttgtgccagttttcaaagtgaatgcttccagtttttgcccattcagtatgatattggctgtgggtttgtcatagattgctcttattattttgagatatgtcccatcaatacctaatttattgagagtttttagcatgaagggttgttgaattttgtcaaaggccttttttgcatctattgagataatcatatggtttttgtcattggttctgtttatatgctggattatgtttattgattttcatatgttgaaccagccttgcatcccagggatgaagcccacttgatcatggtggataagtttttgatgtgctgctggattcggtttgccagtattttactgaggatttttgcatcgatgttcatcagggatattggtctaaaattctctttttttgttgtgtctctgccaggctttggtatcaggatgatgctggcctcataaaatgagttagggaggattccctctttttgtattcattggaatagtttcagaagtaatggtaccagctcctccttgtacctctggtagaattcggctgtgaatccatctggtccgggacttcttttggttggtaagctattaattattgcctcaatttcagagcctgttattggtctattcagagattcaacttcttcctggtatgatcattaaaaagtcaggaaaaaacaggtgctggagaggatgtggagaaataggaacacttttacactgttggtgggactgtaaactagttcaaccattgtggaagtcagtgtggtgatccctcagggatctagaactagaaataccgtttgacccaacaatcccattactgggtatatacccaaaggattaaaaatcatgctgctataaagacacatgcccacgtatgtttattatggcactattcacaatagcaaagacttggaaccaacccaaatgtccaacaatgatagactggattaagaaaatgtggcacatatacaccatggaatactatgcagccaaaaaaatgatgagttcatgttctttgtagggacatggatgaagctggaaaccattattctcagcaaactatcacaaggacaaaaaaccaaacaccgcatgttctcactcataggtgggagttgaacagtgagaacacatggacacaggaaggggaacatcacacactggggcctgtcatggggtggggggagggggaagggatagccttagggatatacctaatgttaaatgacgagttaatgggtgcagcacaccaacatggcacgtgtatacatatgtaactaacctgcacgttgtgcacatgtaccctaaaacttaaagtatagaaaaaagataaagctagcagttgaattaaacaaaccccagtatatgtcatagctcatagatattaaaagtgtatttattactcatgtaaaaattttaaatggcatttttcatcaagaacagattcctccagaaataattttgggaccaaggtccccatgcctggctgctctatcattgtccacatgtaactttcaatgtactcatctacatcaagctagagaaagggtaacagagatggagaaaatactctcattttctcatagtcttggccttacacatgtacttctactcagattctactcacaagaattagtcacgtggcctcacctaaatgccagggcactgcgaaatacaatccccgattgggcaactgcttcctaatagcagccctacactatgagaggaagagcatgaatatggatgggttggttgcagcatgtgtcagatagttcatgttttaattagttaaaaaggcaacatatgggagttccttcctcaaaaatttatacagaattaccatatgacccagcaattctactcctgggtatatgcccaaaagaatagtacacagtcttcagacaaaaacttaaacacaaatagtcacagcaacactatttgcagtagcaaaaaggtagaatcaacccaaatatctataaaatgataaataggtaaacaagtgtagtatatccatacaatggaatattatttagtcataaaaatactcatacatgctacaacatggatgaaccttgaaaacattacgctaagtgaaaaaagccatacacaaaaggccacatattatttcatttatactaaatatccagggtagaaaaattgatagagatggaaaacagatttgtgactgctagcagctagcaagaagagaagatatggagtgagtgcttaatgggtgcagggtttccatttggggaaattaaaaagttctggaactaaatagtggtgatggttgcacaacactgtgaatgtacctaatgccattgaattgtatactttaaaattgttaaaatgatcgatttaatattatgtttatcttactacaatttaagaaggcagcatggctttctggagacatgtactgaatcaaaccattagcttataatattttattatatttaatgacataaatagcatacgacctcaagcaaaaagagtagttaatgctattccttctctatgttttcttttctttgggaattttataattttttcttccttcaacccaacaaatatttttttaacagcttattggttccagacactggtctgtgtgtttacgcttatcataaactcaaagctctgaaagagtcctaaggtatacttagagaagatatgggtcctggatcaagatagatagtaatagaaacttgccagtggtccaacatgctaataataccatcttataatgcgccaaaaatgctgggacacttggtccattttgtcattaaagatagttgaccactggagctagcaaacaacacaccaagtgtgttgatgctattgtaaggctttagagcaagtgtagagttatgatatcacactcagagttagatgaaaagccttgccaatctaaaccttagttaatatctaaacatttctactctgatataagatgctgatgttcaggactttgaagaaaccagtgcgtcattccataattctctatgcaggtggataaatgtggcatcctgaatgatacataacaaaataacttgaaatccatttatatttgcatttgcattttgatttttttctttgttgtcattgcacatttgctttcataatcatatcttagctaactgtaacagtaaatgtggtttatcttctcaaatgacagatgacaacgacaggcagtcttaaatgatctgactggcatattgagctggttgaatttaaatttaactgagaaaagtcatataatcctagaactggaaggatgcctagggaaaacttaactttatctcttcatttgtatataagagtgaactaaaactcagagatgtgtatttatattattttcagaaggagctggtttggacgtgttgtctcaatgtaattattaataatgcctcttttctttctcaaagatctcctgatttagaaggtaaattagatattcacctcatctatatctttttggtattgtggattctttagataatattttacaaactcaggcaacccatccataaaaagcatatatatatatatatatgcttttatatatatatatatgcttttatatatatatatatatatataaaacatttggatctagtttaccagcaacctcaagctgcgagcctttgatgtagattttacatccaataaaaacatattgatcaactcctgtggactgcaaaagcaaagctgccattaaccaccacaccccaacaaggtatgtcttagtgaacacatcagatcagaaactaagctaagagtcaccatgacatggtatggttgggtaatgacttgacctcaggcctcctaatccagtggcctttttaacataagaagtgctgagtatagggttacagatataatatcttagtttatatcctgactgacacttactatgttacttcagacaagttgcttaactctttttgctttatttttccaatttgtgaaatgaagatgatagtagaagtacctacctcattctgagttgtaaggattacataaaataatataccagcagtgcttgcaagactacctgaaatacaaaaatctttcaataaatgtttcatattattggtaagcaattgcttctgtgcaattacacgtgactaagtgaacacataagaatattaatccctaagttaattaataaatatcaataagattaatattaaactactacttcaggttattaatacttattatacaatacaaaaaaaacaagagttgagaaacaatggagaatttaacaaagtatgaaactgtcttcacagtacacatgtgtcctcaaaatatttgatcctgtaaaaatggtgatacgtatcagagacagtggagagtggactgcagaatgtgaaactatgagtatgtatctgcttagcttcagaaaacttcatgagttttagagatacactaagcaaggtatttacaacctacacaccatcatcatgctacttttcttacaaaaagcatcagtaacttcaatgaagtatcaacattcaaattttgataacgtcattctatcccttcttcctaaaatcattcctcattgtgtagggcatattgtagctatgtcttattctatagattgattaattgattaatttcaaggtacaaccctggaggtgggtgtcagtgacttgaagtatttcattggtaggaggttattactctataaataatgagctgacacagccacctgaaatgaggcagaatagaagaaagagagataatgttctagctaaattatgccctgcatattcatacaaactcttcattttcttcaaatatcagaatgtgactttgaatttttttctaagttagaaatcttactttcagtaacagaaactaaactttaaattgcttgagctaaaaaggggttttcttgatgtgccacaatagctttgagggaactagttgtctctttatatgttatttctacctctgttccgcattggcctcactattccttgaaattttttctcctcaatttatttagcagaatgatatcaaaaagtcccctggttcacatttcatattgtaatattatttcttcaaaatgaattcctagtaaataaaaatcttactaatacattatcactcatagtaaacagatagatggagacaaaggtaaggtcagttgacagaagaacaggattaaataatatttaaaaattagtgtctacaacaaatttctttaaaatgcctcattttatgcacaattatccacaataatagttgactggatgtctaagaatgaattgcaatgttcacttccttgaaatagtttgcacctgatggaaaataactttttttagctgaactccatgtttcatttatagtaaattatcatcttatcaaaaaatattatcatttgaatttgtaaacagttgtcaaaaatgagaaatccaagtgatcaaagacaaatgaaagtggcagatcaagtgaaccaaacgcttgcaccattttgtaaaaggaggttaaatgtatcctgggaaaagggttagtttaaaaggagatgataaagcaagaaatggccagctgtggtggctcacctctgtaatcccagcactttgggaagttgaggtgagtggatcacttggggtcagaagttcaagagcagcctggccagcatggtgaaactccgactctacaaaaaatgcaaaaattagtcaggtgtggcgttggacgcctataatcccagctactcaggaggctgaggcaggagaatggcttgaaccctggagacagaggttgcagtgagcagagatcatgagcagagatcgtgccactacactcctgcctgggcaacaaagagagagtctgtcacaaaaaaaaaaaaaaaaaaaaaaaaaggcaagatatatttgtgagatccttagaattctgcaaaattactattcattgtaaccatttgttccccaaatccttaaagaaatcaatgaaaattgaaataataagatgtattccagcatatggtattccaataaaggttagttttgctagaatccacattaaatagactactatataacaccaattctgcactttttaaataagcataattcctgccatcaaagggtttccatgtcatgaggaggcagaataagctaacaactcctattcccactaaaaggagttcttgctaggatagagaaaggaacaaagtgcgagagaaggacatgagggagttatcatttcagtctttgcatgttgaacatacttcacaggaaaggtcatgatgtgcaagcaagttgcttggaatagaaagttcctaggaaaacaagactgtaagattcagtcatgtagaggaataccaagaaagtttgaaaggacttgacctacttgggaaatgtctattcagttggggctagcagagttcactgcataaatagaatagtagccagagataaatctaaaaaggaaatcgtttttcatttattcatttttcattattcatttaacaaatatttatatagttgccttctcttccaggcattgagtttggctttaaaggtacaatgatgaagaagcctcaactcacaatatgatgggagaacaagaggcacaaataaatagccattgtccaattgtgcaatgtgtttgtgttttcagtacaggaagatatcaaaagctctaaagtgggccgggcaccgtggctcatgcctttgggaggctgaagagggcgaatcactcgaggtcaggagttcaagaccagcctggccaacatggtgaaacctcatttctagtaaaaatacagaaattagccaagtatgttggcacgcacctgtaatcccagctacttgggaggctgaggcaggaaaatcacttgaacccaggaggtggaggttgcaatgagccaagattatgccactgcactccagcctgggtgacagagcgagactcagtctcaaaaaataaataaataaaataaaacaaaagctcagccaggtgcggtggctcatgcctgtaatcccaggaccttgggaggccgaggcgtgtggatcacgaggtcaggagatcaagaccatcctggctaacacggtgaaaccccgtctgtactaaaaatacaaaaaattagccaggcatggtggcgggcgcctgtggtcccagctactcaggaggctgagactggagaatcccttgaacccgagaggcggaggcggaggttgcagtgagcagagatcacaccactacattccagcctgggcaatagagcgagactctaactcaacaaaaaaaaaagaaaaaagaaaaaaaagctctaaattgccaaggacaggacaagaagaacaagcccaatctcaggttaggttcacttcaagggaatgtttgtctgggctttaaagggggatttgggcttcactggtcaaatggaaccaggaaggtgaggaagaagagtagtctaggaatcctctacatgtcctcaaacattaaaatgtaaagaattcctggaaactaaaatattaccaactctcttttggaggtagtaaaatgaaacatgtaaaagtagaataaatgaaatggagcaggaatatacaatgtggcaaaattggagcaggaatatgcaattatgaagtctacctaatattaatatatttcttaataccaaacaatagtagaaaagaccagtgatgttaagcatactaactagtccttctgtaccttcatgctgtacatgacagaagtactcccctgattcatttagggggcatccacatgctccctgctggcttgccaagagcttctaaaatgcttttcctttctccacattatatactcgccagcatatgtgcatcaacagtgaaataaagtatagattaagaaaaattattccaaagcttttagtaagacattatcagacatggtaggcattaaaaagacatctccttttaaattttgaggacgggttattgttgatattaaaatgtttcagtttggtgaggtttttcaggacatggaggaaaattgagtactggtcaagaagattcaagttcaattactaacccaatgtttgattcattattccttaggcagaaaaataaataaaaaaaatagcatgcatcatctctttcctcaattgtgaaaaagcagtgaatttctatttgtcttgacaggtgactcacaggatggggaaaataatctcaaaatgctattaggaaatgctcaaagaatgaggatttactgaatttatcaacaggagcctattctaatttcatctgtagggtttacaaaacacttcctatgtgttctactcagaactttgagggtgacctactaagtccatgtaatgtttgtattagtttgttgacctttatgaagaagctagtaattagatatccttggacccaagaggaccaattgtaggagatgttacagcactcaacagtaaatgagattatagagtgaacatccttagttcatgatctgggaatatagaaggcgccaaagcaatgcaagtcctcatgttcctcttgaaagcagaaatacagttcacggtgacttatacttgtagaggattctcataaggaagttcctgaagtactcattcttagaaaccttgatgaagaaactaaataatagcatggtgagagatggcacaggtgtgtcccttagtacacatatttctcttgctgctctctaacccctggcatctggatctttggagctgtctcatcatctgtaacattccttcagcatattaggaatgcttgtgtcaggcagagcccttactttacttagaagttgatcagaatgattggagtagccttaatagtggcatccactttctaatacagtaagtaaagaaaatgtcaaagaaacagctgattttttaaaaactcattgaatagtgcctggaacacagtatgtactcagtaaatatttttattattattagtgtttattgttatgttatcattgatgtttttattacttagcaatcagaaaattaaaggcataatttagagactttagcaatagaatagtatacatactatttccctaaattatatagtgaagaatattttgtaacaatagactattattacagggtttccagcaggacttccaacaggcacactgtgctacaagtttatgtcttcaaccaggagttgacaaacttgtcctgtaaagtgccagagagtaaatattgtgggggccaatggacaatgccctcaactctttgagcaactattattgctgaaacgccaacagtatcttttagagtttatgttttacatttaaaaatgtaaacaatggctgggcgaggtggctgatgcctgtaatcccagcactttgagaggctgaggcaggcggatcacctgaggtcaggagttcgagaacagcctgaccaacttggtgaaaccccgtctctactaaaaatacaaaattagctgggtgtggtgacgcatgcctgtaatcccagctactctggatgctgaggcaggagaattgcttgaacctgggaggcggaggttgcagtgaaccgagaccacaccattgcactccagcttgggcaacaagagtgaaactcagtctcaaaaaaaaaaaaatgtaaacactagtcaaaacttatgggtcacatgaaaacaggtattgcgctggatttgacacatggacagtgatctgccaaccctgtgctagagaattatgttttttatcttagggagggcacactgctgctacataatcacacagacatctatgtgtgtgtgtttcaaatcttagctataaataattctacactttacattaataaaaaatatgatttgcatcattttgatttcagacatacctacaaacactcttgaaaataagacagcactaatgccttgaaaaaaattcagtttgagggctgccagttcaaataaaacaaaaatagactttctttccttattgtttctttcactctcacaatagaagttttattttgagaaaaccataaatttattattaatcaaatagttagatacctgaaagatcataagctgattccttcaggaggagtcattcagccttgtgtggctcttcacagccccaaagccttaaggagttctacaaaatttgagttgaggaaatatttcatgtggaaagactaggaccagggctccagagcaaagctttttagaactttatgtaccatatcctgcgtggtcatttcctatacccgaagccatcaagatttgctagacggagtttccttttgtctacttaggtttatttttattcaacaagtattacattcataaccctctagcataaagcctgaacacaacaaagtgtacataagcattttttgttttttccctcatggaagtcacattttagtggtggaagagagggcaggtggcaggcaagtaacaagagaacaaataattcaaacaacatcaggataatttttgatctacaggaaacaaggaaggtgcagttcagaatgattgcagggggtggacctcctttggataggctggttggtgaagctttcttcaggaagttggcatttgaatggggccctgaggattgagaaggagccaggcaggaaaacagcacatggaatatcttccaaaatgaggactagcaagagaaattcctaggcagaattttctatgcttaagaaattgtcagaaagccatggggctaaagcagaacagcaagagagagagcatcataagattggataaatagagcatgtagaacatggaaagtagctcaaatacaattccaagaagtttgaatatgattctaaagcagtgggaaatcatgaacaagattttacccacccttgagaggtatagatgtgaaacacaatgaattgagcaaagggaagaagagttcacttaaacctagtggtttactttttttgacattagtctttctagtaactctaatagatgacatagtacttacaataccccttggtttcactgtggactctgtatgtgtgggaacactcatgactgacaattttgaaatctctgctcacatgcctcatgaggccatgtcataattttagtaatcgccatggtgatttggccacccctaccaaagtgaaaaagacattgtcatcccccataagttaccatgctctcaacactgacagtgttaagcaggggaaaacaatccccagtttagaatcatcacacagatcgtagcccctttgggaagctatggtgttggttgttgtcacacctccagacattaacactaactcctttgagcagtctttatcactgcaaattatcataaccacaaactgctagcatataaaggtcaaggacgcacaaagaaactagtcaaccactacaagagcactcattcactcattcattcattcattcattcattcattcaacaactgcatttgggtactgttctaggtgctgaaatgttagactgaacaaaacaaaatctcctatcctcctggagcatacatacagtttggaaggaattctatctccacataaatataacatgctagattcaataacaatctcctgaaaagtattggtcacttatttccctttttctcaaaaacaacattattttccagggtcagggctctcagctgaaattatatctctcctgtgcttccaaactaaaaaaggggactgtgatggttcatcttaggtgtcaacttgattggattaacgtatacccagacaaaaggtaaaaaattatttctggctgcgtctgtgaggaggatgtttcttgaggaaattggcaggtgagttgatggactgcataggaaagatctgcctacaatgtaggtgggcatcattcaattggctgggggcgagggggccaagatagaacaaaaaggcagaggaaaggtgaatgcatgcttgctttctcctggagcagagacactcttcttctccagcccttcaacatcagaactccaggttctctggcctttggactccaagacttgtaccagctgcttcccaggttctcacaccttcagatagcctttcataggacttctcagccttcataatcatgtgagccaattccattaataaagctcctctcctctctctctctctcccggtgtgtgtgtgtgtgtgtctgtgtgtgtgatctcctattggctctgtctttctagagaactctgactaatatagggactaagttctaaggttgtatgatacaaaggctgaggattctgggtttaacatacctggaaaggcaacaaaatcatctagtcaatttcaatgcaatctattgacaaaaagcaaaactgagattcagaaaacagaaacactctaatttaatgtgcacagcaacatgataatcattgaatcaaggtgttggcactccagtgttatccctgccacttctcaaaggaagctctcagtgccccttccttttatagacaaagtggggaaactcagagaggtacaggagcttgtccaaaggcatacatgtttaaaggagcagaactagagttagaacccaaaggcatacatgtttaaaggagcagaactagagttagaacccaacttctcttattcccagtgcagtcttctttccactaaatgaaaagatcattacttataaaagtcttattttgcaatatgatctcttcaatacgagctttcttgacttctattgaaggaatttcatgggattcattcagagaatatcgactgcaacacacttcctccatataatccaaactctaggctcatgagtctgcaacgcacttcctccatataatccaaactccaagccccctaaatcttggccagatcgttgaagaaagcaatctgtgcaatagagttattactacagagtttcccagagaattttacacctagcgtactgtgaacctccaggaatgggatatgctatgcagtttccaaaacttattggaaaaagactgcttttgttttatgacgcatcttaaaaagtgggaagttctatagaccattcaggggtatgtgaatacaatgaattcaacaagctttcagttattgaatgctcatgatgtcctaggcaatgtgcagtgtgacagaggactggttaatcaattattagactaatcaattaggagaagggttgaaacagagaaagctcagtaacactctttggcatcccctgggctagcgctgaattcttctaccccaagtactggcattcaggaggatgccaactgctgttgtctttgctttttgcctgtctataaggagatttttttttcttttcacaagaaagtgtcactgaagggaaatccaatttgtgaggcaagcaaaggccccctgcattgtgatgcaaagattggcagttggctgaagagaggagcttttggttttactagctgcagttttcaaagagtttgattagatatagcaacattgccattggtcaatagaaatgtatagaatctatgtacaaagaggaccatctaatctgtctgaccacctccagtactaattcatgggcaatgtggctttaggcgttcatacccccacctttgctggtcatctgcagaaccacagtatctgcatcacctgggagctggttagaaatgaggaatttcaggcctgccaccaaacctactaaatcagaatctgccttttcccaaggtccccatgcaattttaatgtatgtagaagcttgagaagcacagcttcatgtgccacttccaggagcattgagtggaatcttccttacagaggactattgcatccttcacgactgcaagatctttgccaagggaaaatggccaggatttggacctgagttcacccaacgtaccaaacctccatgttcctcattctaaaatattgtcacctaaactcttgagcttttgcttttccatgtgtgaaacaaggataatcttgcctaattcatagaattcatggtgaaattcttggtgaaatatataaagtcgctacaccagtatttgcttggtaaatgttggctctttataatgatgaaaagaaagattataatgataacaagtgataataattatgttagtaataattaggaggaggaggaggagtgtattagtcagggttctctaaagggacagaactaataggatagatgtatatgtgaaggggagtttattaaagagtattgacacacatgatcacaaggagaagtcccataataggtcgtctgcaaaagctgaagagcaaggaagtcagtcagggtcccaaaacctcaaaagtagggaagctgacagtgcagccttcagtctgtggccaaaggtgtgagagcccctggcaaaccactggtgtaggtccaagacccccaaagctgaagaacttggactctgatgttcaagggcagaaagcatccaacaagggaggaagatgaaggctagaagactcagcaagttggcttctcccaccttcttctgtctgctttattctagctgtactggcagttgattagatggtgccacccacactgagggtgggcctgcctctcccagtctactgactcaaatgttaatctcctttggcagcaccctcacagacacacccaggaacaatgcttcacatccttcaatccaatcaagttgacactcagtattaaccatcacaagtagtaaaatgcttatattcttcacaggtaattggaagacaacagctatcacaggaagtgaatctgggacaaatgttgatgttaaaggtaaagcacaagaagaataaaaaatgaaaggaccacatgcccatgtccctaccactatcattttaatgagacgtttcctgcaaaatatcctgttcctcctcttgagtgacttagaaggaaagctctaaacaatcttagccagtcaagttttcctgactccacagaagacaggaagtaaaacaagctgtgactggccaggctcggtggctaatgcctgtaatcccagcactttgggaggctgaggcgagcggaccacaaggtcaggagattgagaccatcctgactaacagagtgaaaccccgtctctactaaaaatacaaaaaatgagctgggcgtggtggtgggcgcctgtagtcccagctactctggaggctaaggcaggagaatggcatgaacccgggaggcggagcttgtagtgagccgagaccgtgccactgcactccagcctgggtgacagagcaagactccatcaaaaaaaaaagaaagaaggaaaaaaaaacccatgagaccaactaaactggactgaagcaattttaggaagatgtgttttacagagatgtttcagtccctaccacaacctgatgcaagcagggttgtctcaggcattgaagagggggagcaaggtgtgttaattataattcttctcacaccaaggggcagaaatttagtctaaaacacactatgcaaagggggcttttattaagagtattgaccagtaagatggttttattctggcttaaaatctcccctaagttcaccaaccacaccagtttccctgagattctcccagttttagcactgaaagtcctaacccagaaaatcccccagtcctgggtaaactggtatagttgatcaccctaggtcagcttgtatactgccttattccgattcagtgcatggaaaatctctctcttaattcttttaaattctgtttctttataaaattactttaagtccttctatctatcatagctacatagatgatgatgattgataaatatataggtaggtagagagagaaacagagagatgtttctctcttcctctctttaagattatttccttaaggacaacaaacatggccacaaatccagagacacaaccaatgagttaattggggggaaagcaacattatcagataggtgcttttatgccgcgtttttatttgttccctgttacccataaaccttacagctttcagggacaaacaccaggaccaacctgaagaccttctagcatgtgcagaacaaaaatgtcaggctagaacaaataagcaattctggtctgggaatgcagtctgggatttgccctttcaaagggcagcaatctaacagcttgttagttcgcctttttaaaggccagcaaccaggaaaatagaccactgagtgtgggtcactccacagaaaacaagccacgttcctgtggctatttgcaatgcaataagaagctccagtccacaagtaaacccagtcactcttggtcaggagcaccagaatggaatttcagaatattgttgtaactctacaagtgcttgacctgggagcacctattgaggattttattctaaagaaatatgccaaattaccaagaatactttatatacaaaaatgcacatttcagggttattcagaaatctttaagacaaatcaaatttttagccataacagaatgattgcataaacaatagtatgcctgtataatagctaccacaaaaataaaaataatggtaattgagcaagatagcatactccgtgccttaaatagcctatgccatttaatccttacaataactcctttagggaggcactatattccttcctcattttattcattagaaaacagaggcttaaagagattaaagtgaattgcccaaagtcacacagctcataatttgcagaaagaggatacatatcaaggtcttatatattccagagacaaaatttatctgctctgtaaaactttaaaaaattaaaatatgactatgtagtaaactgaattttttcatccttttcaataagagtagtacctgttgtagctcagactctgcctatattttagtagaatgtgtttgggacctggatataattctttttttgttaaacatagtatttgaggaagaaaaataactaaaagcgatataacctaatattaaacattttagctgaattaatctaaaagagctatcaataatgattaatttctaaacctaacttttacagtgtctaatttctctggcctgcctagaatatgcctctagattttgttttactctccttttatcctctgtttagaagatatattatctttaaataagaaggcaaatgttatttgagcaaaggctagggacacattctgtgcccttaatacaaataattttaagcaatttgacagatagagtgccattacatcatttcagatactaatgggcataataattcttcaacttcctcatgaaagagagctctaaaatgagacaactgagtgaaaagaaaacgtcaagttattgatggcttccatcatgattttatgactcatagatggaaggtggttccttcgtggagccaggtgtctagctcgaccttgtctgcagggctgtttgttgctttttgccaaccagcatcttctttcactgccttgggtcactctacccagatttgatttgggaaccacccttccttgatcttagcgcacatggttcatggatactgactcattgccagccccaggggcagtcttatgataaaaagccaacataatcagagccttatgtcttcttgccatagataattcaggatagacacttgacacatggaaggccactgagagccaagaagattcaattctgggacttttgctagaacatttaggaaagagaatattcctcctcagagcttgctaagtttataggtgatacaggaaattatttaggcatatagagtaaaagagtcctcggcagaatttcccttttaacaaaaagcagcccccaaatcatttcttttctaacaaagaggagcctgaaaaatcgagctgcagacatagaaaagcaagctggaagcttgcacgggtgaatgccggcagctgtgccaatagaaaatggctacctggaaaccagttatgttcaacatgaaggctccgtcttcccttttctttgtcaccacgtgtacagtattgaaccaggtaacatggcagtgggacaggtagagaataatttgcataataaaagattagggtgcggtggcctttttttttttttcttgccatgaaaatggcatacctagtcctaaccagtttttcacaccttatgcaaatagatcaccgggtccaaccaatctttcataccctatgtaaatcagacactgactcctcaagctcatctataaaaccttctgcatttcaccacagaagcagcaacccatttctccaggacccctttctgtgcggcagagagagctcttctctttctttcacctattaaacttctgctctgaaattcactctttgcgtgtccatgtcctagttttccatggccgtgagacaatgacccttgggtatttatcccagacaacaatgccacttcacaggaatgtgagtctgaagcttctgcaatgcatggcctcgaggagtttatggtccatacattttcctccctggtgtgattctaataagagaaatcttggtcacagtagaagaaatatcttattaatttagtgaaccaattcagtaaccatgagaattaaaataagactatagtctggggggaaaaaactagccattaaccaattattaaaattgatatatgttattgttatcaatttatcaataaatactcaaactaaacagtggttttcttcatcattgcctgtcatataaaaaccctagtgaattaacaaagcaagcatcaaaatccattttttctttctccctggcatccacactagattgtatttacagatctgaaaactcattttgcatagaagttgtcaagtgtttgcactgaactgcaaacttaactcaaaaagtgtttaaaaagagaaagcagaactggggaggtaaaaggacattagagggcatttagccctttgggaaatttttccaagtctcacagttagctgatgcaaagaaaatctaggctttacatcctcaagccagtgttttttctacagcactacaaaatattttattctatcaccgaagcaatcatctctaaatataaagataccacctacacacaaaacatacattataacattataaatgtgttttaattttctgtaaaacacacagttctgtcatgtatttggattcctcttcgaattagaacatgtttcttgggcttacaacaaacttccttcctctttgcttatagaaataggaattgtattttggatctcagcttaaattttgcttctttctctgacttctgccacatatgaacatgttcgcctgctatattgtttatgttttgtgaaacagctatttaggggtggatgtgtctccctattagaatgtcagatttttatttgctttagaaattgtcctctctagttagtaacacaaatcagtgtgtggcaccccgtaaacattgtacatttgtaaattattagtaattatataattgccacatgctaggaactattctaatagtataagtacagacagtcattgcatttaatatttattattaaaatccttattttacaggaaatgttacaggtagttaggcatgagcagggcaggagagggctctcccccacccaataggaatgttaggtgatggtttgacaataatcacattgcccctctaaaaatgataatttggcagccagtgccagggagaggccatttcctgagggtccacacctgttgcattgaagtgttaattggatgcaggcactaggaagaagcaaaaagggtttccaataaaatctcaggtattgggcgagtgatcctgggtgtacgcattaagacacaaaatggtggagtatgaccttccaggggcacaccaccagaaaagggaagaaagcttcagatgggcatgcgtacaacctcctaaacacactgggcatgctcacttcccaagggtaaggagggcacagtgcatgtgggcagcccaccctaaaggaagagtcatgggataaggggcacaagacaccagaggtgggccagcctatatagtcccaggatcaaggataaacactgtacttgttcttcaaatcacccacttggatctcttccaagtgcactttccattatttcctgctctaaagctttttaataaacttccactcctgctctgaaacttgcctcagtctctttttctgccttatgcccctcagtcgaattctttcttctgaggaggtgagaattgggattgctgcaaacttgtatggatttgccaccagtaacttggatctcttctaccagtaacaaaaagaaaactgaaacacatgttatagcgatagtaagagacagagctagaatttaaacccagatgatctgattctactgtccatgattttgccactataatgcaatgttttaatgcatacttttgagtgtattatgttacaatttaaaattatgaaatttaatatgcatagcgcagatgatgaattcaaagcaaaaagaagctgacttgtgttggaaatctcttgtaaatcctctgagaagtttgaatgacgtgtaaaccaaaaataaaattcgaaggctccctgtgaccatttgaatggacctcctccttggccagggcactttaaatttaaccttcaagacttgttcagaccatgatgggaagagggggttggacaagcctcatgatgccctcctccattttgaaattcaggaaaatccaaccagcatttaacatcaacacagaccttaagtctgacaagaaacatttacatctattctctctgaagcctgctaccccgaggcttcaactccatgacaaaacctcggtctccacaacctctcatcctaaaccaggcattcctttctattgataataaccctttcaatcaattgccaatcaggaaacttttaaatctacctataacgtggaagccccccaccaccatctttttgaggtgtcccacctttctgaacccaaccaaggtacatcttaaatgtatttgattgacgcctcttgtctccctaaaaggtataaaaccaagcttcactccaaccatattgggcacatgttctcagggtctcctgagcagtgtgtcatggtccacggacactcatatctggctcagaataaatttcttcaaatattctacagagttggactcttttcatttacagatgtttagttagcatgggctgatacacactaggtgaccaatgattgttagatgaatgggttcctggagaaacaagtgaaaccaacacaggctgtatacattgaaaagggttggttaaaagtaacttgatatcatgcctgaaaaatgttttatattatgaaaatttttaaattctttgtatttgtatttgctgtacattatttgtataggaaaatgaggctttaaagtgttgaaagtttatagaaatataagtcctgaggctaattctttgcaagatgtagattagaaagttccttatttctttgcactttaaatctcatcttcttaaaaatatttcactggtctagcataaattcatgctgaaatgttacattaaaagatacgtcaacacaatattaagtgttcatgtcatttcttctagataccattcaatgagttttttctagatataattttctgattaaaatgaagctgattaaaaagaaattaaaagtaaacatgcatggattgttttctattctgatcttgatttcaaggaagaaataggaatgtcttattctgttcaacctaattgtggctatcctagtgcagctttgatcatttacataaaagaaacagttgggagttcttggtccattgaattgcagacatgaggaccaccagcagttatttgaatcagataaggatacttgaatagataaacattttctattacccagatgtgagatttgcatggttgaaaccaaatacctaatacctacatgtctgcaatattccaagtagagacgtttttcagggatttctaggattgatgtaaagttgctgtttatgtttagagtcaaagcaaggatttcattttaaataacagaaaaaaatgtaaatgctacttatatatagtcccatcctccatccttgcatgcacacacatagacaagctcacaaaccccaaaatgtaaatatctgtactctcttctatgagtctgattgctccagatttctctcaatatcacaaaagactgcacactaggaatatcttccatgtcaaaactaattgcctcttggctggtcactggagttagaaacctacctgttttatagcaagttccttttatctctaaagtatgactgagcctggcgcggtggctcaagcctgtaatcccagcacgttgggaggcggaggtgggcagatcacgaggtcaggagttcaagaccagcctggccaacatgatgaaaccccatctctactaagaacacaaaaagaattagccaggtgtgttgttacgtgcctgtaatcccagctacttaggaggctgagacaggagaatcgcttgaactggggaggcggaggttgcagtgagccgagatcatgtcactgcactccagccagggcaacaaagcgagactccgtctcaaaaaaataaaaataaaaataaataaagtatgaatatgagcatcagacacttggagagtcaatttgacccagtgaaacttgtttccggaagtgtgcaggtatatcaaactatagccagtcatatacctcagatccttttctttggaggttattttattttcctgaagtattcactgacatatagcttattattttggggattttcattactgttgctgaagtttcagcctaagtaatatatcttaacattacacttttaaaagatagtggaagctattggcagtatatcacagatatttagaatcataaggaacttaatcggttataaagttccatctctgtgattttatttggtttagcaaagtctgtataataacactttagaaacaagagtaagcatgttctttagaggtgtaagttctgtctcaaacatttatagccctctttcttctctgagatcttagagttaataatattcagcattaagatgtgctggatgagtgtcctctccccagagcaattaagatgacaaatatcctcctctctgctgaccactgacgacatggtggcctcaaattgcaaaagttcctgcgtcctaattactgccaagaagaggtcagtatccactctgctaagattaataatgtggtttttggcagacattcttcacaattcaggcaagcattctcagttgcctcatccagtcaggcagccggttcagccataggaggaatccaggctactgtgtggctaagaggaaaggaaggtattcatgccctagtgaggcaaaccaggctcatgcagtagctgtgcttacaaaggatctggagtgaatatagtttatttgggaggtaattctgggaaaaacctggagaaggtagaagccattccatggagggaaggaagcccatttacagggagcattagcgagcagcttacttctgaggcccaagtcttctgggcctcagaggcccagcagaagaaggtgttcatgccctagtgaggcaaaccaggctcacgcagtagctgtgcttacaaaaggttaacagctggctctccagcagcaggcgggagactagggggcaggaaacagtttgtgatgtttaccaatttctatgatctaaatactcccaccaaggcctattctaagctgtcaacataatgttaataaattcttagaacaatgggcttttgcaaaccagtgccagctaactgcagcacatcataaataaatgtaaaatgaccaatgtggtaagtgctgcaaagaagtgtataactgcagtatttttccttggcaatgaagtcaatagaggagtagcaggtgctggtgtctgctccctacacacacacacacacacacacacacacacacacacacacacaccccgtatcctattggcattcaccatttcattatatgctaatagcattctacggcaaacacctgagactttccatctgagggctttctctcagcccacacatggagaagaccagaagtgccagggaaaaaacatccttgggagcaaccctcagacaatgacaaatgggagtaggagggtgaacatccaagttttattgtccccaggtaagacaactctaaaatgtatttccaccccatctctcaaaagggcccagcagacttgggcctcagaagtaagctgcttgctaatgctccttgtaaatgggcttccttcccttcatggactggcttctaccttctccaggcttttcccagaattacctcccaaataaactatattcactccagatccttgtgtcttagtctactctatgaacaataagccaaagatattacacttttctagagaaatagaggtaagtctgaagaaagaataggactcaagtagaaaaataagaaggaaagcatgttccaggcagagagaacgacatggaaggcacacaaacatatactactacacatatgttcctcagtgtcactatgccatgcaaaatcgtgcgctggaattaggggcaaaatgctcaaagatgtcatgagtggcatacaaaactgacaggaacccagttaaaaatggttgcatggttatgtatacatgttaaatggtgcataaaccattggcagaaggggttgaaagaaaattgtagttcacatgcgtatcattttgtgtgtgtgtgtgtatgtgtgttaagaacacttaaagtctactccatttgcaattttcaagaatataatatgtcgttattagctatagtcaccatgttgtacaacagatctcttgaacttattcctcttatctaattgaaacttgcatcctttctccttgtccccaaactgcagccccccagcccccagtaaccacaatgtatacatatttcaaaacaacatgttgtacaagataaatatacataatttttatttatcaattaaaaataaatagaagaaaaatattaaaaaagaaaagaaaactagattgtagttagtcacttactggaattagtggaaggttatcaaaatctgaaatcttttgcagacttaaatcctgaggcatgtttctctgcctttgagatatatgtcctttgggaaatgcatttttaatagatacctattttgtcaaaactgaaaattcaatccagtgaataccttcttcaattaacttctggtatcagcactaggaagatttcctttcgtggctttctcatctgcactcagggcttcaccaaacggctgaaagctttggaaattgtagcaatgtttgaaaccttcaaaccagcctctactaacactaaaaagagccgcttttgtaggattagatgatttcatttaaggtcttcatatattgatagtactttctctttgattatgagaaagattgttcctgatttttttctctctttagtcttcaatccatatgcttaacaatctttccacttcttttatctcttcaggccatgttcttattgacttcacagcactggaagccacagacttttcttttattttcatggcattgtctctgatggtctgcaatgtagattcctttaagcctgttactcaggagatatcgcatgttctctcttctctttcaatacataaagctttacttttgcatccattgctggtaattttgacccattacattgaaacacgtttggcatattgagggagtgttttgttttgttttttgatataaaaaagctcataaatgcaaaagaagagcaaaaggcaacattataagacaacatgtacagcaaatcaaggtaactggtctactgtctgaggggtgcaatggtctgaatctgtcccccagcagattaagtgtaggaaacttaatccccaatgcaacagtgttgggaggtggggcctaacaagaggtgattacaccatgaggactctgccctcatgaatgaattaatgtagttattgagagaatgggttagttatgatgagcgtggacttgttataaaagcaaatttagtcccctcttgctctcttgcttgcttgcactttctctcttgccgttttgccttctgccatgagatgatgcagcaagaaagcccttgccaaatgtcgacccttgatgctggacttcccagcctccagcgggaaataaatctcacctgtatgcagtggatgcctgtaatcccagaactttgggaggctgaggtgggaggatcacatgattccaggcatttgagaccagcctgggcaacatagtgggaccccatctctacaaaaaataaaaagaattagcctagcatggtggcatacgcctgcagtcccagctgctcaggaggctgaggtgaaaggattgcttgagtccaggaaattgaggctgtagtgagccataattgtgccactgcactccagcctgggcagcacagggagatcctatctctaaataaataaataaatatctgttccttataaatttcccagtctaagacaagaggggatgtgtgtgtgtgtgtgtgtgtgtgtgtgtgtgtgtgtgtgtgtgtgtttaggtgcacgcatttttttctatccctgcaagactcaggtcagctcagtgtagtttcctgaattcaactagtgtttctcagggatgaaattgaacataagcaaacacaaatttcacatcttgctcaaattgttccctaatatatcaatgatgttggaacaaattcacattttaaaatagacatttatagcagaacttgtgtgtgtgtgtgtgtgtgtgtgtgtgtgtgtctgtgtgtgtataaaacaaaataaagtgctgattacagattaaagtgctaattacagatctgggtcaacaaaataaagaaaactatatgccccctgattgccctgctacaatattctactctctttcaatatatttaggttggggaaatatttcttgttttaaatgagtacagaggaagggatatgtctttcatctccagtaatggaggaaatcagaatataaatttctctagtagagctgaacactgaagaatttgtgtcaacatggacacaatgcttgaataatgtcttagggcaacttctcctggaaacagaacatgagagagttattcatgttctctatttattaataaattagtggtttattaagggagtgctctcaaggagagatgcataaggaaggaaggggtacaagatggagaatgagaagaaactaagcaaagatgtgcttagcggtgaagtctaacttcagcctgatctaggagctctagggtataaactgcactgcagaggttttcccaccttgatgcaagggagctggagttttgaatccttgccataatcgaccattagtcaaggggcaggaagataacataagtccaagatacaatcaggaaaggctgtccaatcacccaagaacagctctctgagaaagacatgggggtgagcccttcacagtattacctacagcagcaggtggatgtatgcatcaaatagataaaagggatcccagaatatctgaacagtgagccaacggtgtctcccacagaaaggaggcactatttttggaggccatgtgtcagaatccaatacattatctttttcatactctccaattaccttgtgtgatagacattgctattagcaccattttacaaataaatttgagtctcttagtgcttaagcaatatgttcaccatcacacattagtgtgagactctatactacacaatcctcttaacccatagctaatcattgcctttctccacaataatgtcatattgcatgtttgttttattttcttttgagcttttttctgtttcctagattggtttggttttaaccgtggaaatctttctctaagtgaaagcttacagagaaatcctctatgtaaaacatgaaatggaagtgactgctcttagatctccatctcatcctgtccatggaggcaaaaatgagtcgctttcacaaaaccacactgtattagtccctactgaaagacaattctccatgggtttctgtgtctctcccagtttgcaagcaatggcactgagagctttaattctaaataatctttccaaagacactttagcaaacagtctgggaagataaagacagtatctccctctaagacaaatggtggatttgatgcctgagcagaaggtctctgggacaaagtttggacaggtctgttagcacctcccaccatcagctcttagaagactggatgttttcccaagctcaggtttctcagctggcccacctctgccccatcccatggcatgtgggggcaagagaaaacactgtcaccgtgaagtgtatgctgcctactatgctgtgagtaataaagtcctctgcctctggcccagaagtctgtatcttctaccagcatctctgaaactagcaaactaacttgttagcttttgtggagaataaaaatctctgagccatcacagctcctggcatgcccaccatctgtttatataggtcatactgaggtaaaactcattaattagcattgccaaatggtgcactttctggatttcaccacataattcagttaggaaatggtggtcattttcctccaggatattccaaaccaaaccgacatctgagacaaaccctaggaaggacctagcctttgacactcaggatcatattcaggcatgccaacagctcactcatatgccatggatgttctcaaatgaaacagttaggaacaaagctggcaaacagaatggtcctctaaaaagctgtgaagggcatttggccattgaggctacttattggaagtagtgcaagtttgtatttgacttgattgcctggtgtttcttctctgtgtgagttccctttataaaatcactgcacagtatgattttgagaattaggagaaacacagatactatagggtctgttgcaaatgtcaagatggaggaatctatagcagaagcaataacaatcaataaagctaggaaaattttgatagatgcataatatataggacatcaactatactatactaatattcactatattcgatatttaaagtattataccaattggattcaaagtccaatactgtcagatatatctatagctctgcacaaaagctgccaatgcctgatattgaggactttcagaagttaggcatatgattatcctccttttcagcaggtaggaaatgaaaagagtgttcattataactgattaaataattgtaactaacattggtggattatttacaaaatgcctggttctgtgctaagctttttacctgcattctctacttaactgcaatcaccaccaaggagaaaacgagtattatttcacacagtttgcaaataaaggaactgcatctgagagatattcatgatatagtctggccacagtaacctagctaataagtagcatacttgtgctatttattggcacaaatagcacatgattaataagccatagctaagattatcagtgatattaatgttaataatataagcatagaagtatctaggggctaaaattggtgcaggttatttgtctattttagatgcttcatctttaaaagacaggagtaaattttataaactctaaagctgatttctgactttaacctactatgattctgtgccatttgtttctcctctatcttgattggatcttacaggtcctcaattcaccagagcctgagtgcttattcactcctgcagactgtagttcacccaagttccttttgcttatgggaaggtctctgctcccatattcttcatctgctctagccccaggtgatgaaaatgatgtatgcttttataatttttccaaaggagctttccttttcttatactttgagataagaacttcttttggaactgctttggtagatgctgtagagtatttctgaacagatggtgcattgtcttcaaggaaagggttggctttgtttatttggaaaccactctgaccctgatcacaagagttacctgctaagtacactacggatgttatttctaacacatggagagtcagcatggtgacccggaaacatgagggaaccccaggggagtggctgtgaacaactttctcttttgtgattttcatttttcattatgtctgacatttttgaagctgagctttttaagaaataccagttttagaagaacagactggggatgtgtttcaaggaaatgtagagcagtcacaagagaaaacaggcacagtggaaaacgtgcccatttgagatgggaaatggtgtataggcggcgtcttttattttctcccgttagccgaatgaagtgtcagtgcattgttcttagaactttcagaaataaacaaataatcaaatcgcatttgccttttgtttgttttgaaacatctgtgatgtgagctgtcagcctagtgtttgatgtatacaactgcagaatacatctgtgcacagtagagaaatttcaaagtacctctcattttaggtactgagatggaatctatgctttctatgttactaaaagctgaaatatattggtctggcaatttagttgatattgtttccattcttccctggatatggatgttctaaaacttgacaaataggaagatggttatttatctttttttaaaaaaaaatctattttcatcgtaacaacttctttttattgggagacttttacaaataataaaaggttaaaacgacctgtctatccagggcatagaaaacgtagaggtgactacatccattttttgtaaatttatttaatgatcatttattgatcaccactaccagactcctggcattgtggtaccagctggagagaagagtaaggtgaagaagccataacctctgtctgcacttaaggaaacgcttcccaactgatgtgcagcaaattggttacaggtgttccgtgagatattgatcacctcagcctccacaggagcagaaatgaccagaggtcatcaggcttcctagcaggtcactttcctccatgagtagtcttttctagggctcttgggagtctggccttagctgagtggtatctgactgttctccttcctccaactcactaagctgacagatccagtgagcattacctggtactacccaacatggcatgctgcaggtggccaaggagttcctccatcatctgggcaaatatgtcaacagtcagatgcaaatgtattattattggatttctggaaattgtgtctgatgaactgctgaaggagacttttttccaggcacccacagaacatggcaggtgggctcaagtgtggtctgttgatgttggggaaaagatcaccaagccaagtagggactttgaagaggagtagctccaggaggcagggcaaaaactgtcttctcatatttctttcatttctgtccatttattttgttttgtttgtttgtttttgcagcatacaagctaacttccagatgactgttttagtaaaagggacatactctacaaattatggcttcatcagggttttgaaatatttgacatgaaaaagtttgattaaattctaaacccattcccattatgataacttgtttcaacattacatttagctatgaaagataagaaaaagcagtttgattccttaaatgtaatgtcaagtgccacaaatttttgaatgactataaaaaaaatttacgttatcacttatgtgaatgaagttcctctcttaatgacaacttccaagagtttgaagaggtcaaatagctatctgaagaacaaaagcgatgtaaaaaaaataaagagttaggaatttcactctggaataatgaagcagagaggtggggttttcccctctattcctccaagtacaacagctatgcactgaatatttgtgtccctcggaattcatatgttgaaactctgggatggtatcaggaagcggaatcttcagaaggtaataaagtcagatgaggtcataagtgtggtaggctcatgatgggattagtgcccttataagtggatacatgagaaaacttggttctttctctgctccctgccatgtgaggatacaagaagacagccatctgcaaacaaaaaagcagacccttgcccaaaacctgatcagccaacaccttgatctcagattccccagccttcagaactgtgaaaaataaatttctgtgtttaagccactcagtttatgatactctgttatagcagcctggactgaccctggacaatatgtttaaaacaaacagaagactttgaatagtggagagaaggaggcagactgactaaagatcatgagacttgaggaacaacacagtagtgagttccgtggcttttctttttggctcatatatgccaggtttggggctgaagaaaccagaaatccagagatgccaaaaggtgcagacaaacaaaaaagcttgaaaaagttcccattctctccagccagcagaccaggaaaggggcatctgagcaagacaaaaaccattagacagtagtcacaccactccaatcacacacttgttaaaagtaaacattctgctaaacaaactcatgactattccaataggggactgatattgtttggatgtgtgtcccctccaaatctcatgttgaaatgtgatccccagtgttggaggtagggcctggtgtttgggtcatgggaagggtgggacagatccttcctgaatggcttggcatcctcttcatagtaatgagtgaattctcattctgttagttcacacaaaagctggttgtttaaaggagcatggcacctcctcctctcttccttgcccctttttctcttgctccctttctcaccttgtgacatgcctattcccacttcaccttctgccatgagtaaaagcctcctgaggcctcatgagaagcagatgccggcatcaggcttcttgtgcaatctgcagaacggtaagtcaaaacaacctcttttctttataaattatccagtctcaggtattccttcagagccatgcaaaacagactaatacagggggaagaactaaactcacctccacttaaacaaaaagcatgatggtttttaagcactggggtgagaaagtagaaacataatgcgatatgttgagaagaggttgatcaacagaacctgtagagcacattgaattattcctgaatttgcaaatgttcttctctggaattaggccatctgtgtttgctaattggtgcctatggaagttctcctgctcccattcctccaccagagatcgggagatccatgtaaaatctccctccaagtttacctttcaaagagatggtccccaggtcctgaagaaagatttctgggttgtaaaactggcaaaaggcttttaaaaaatgtacatctcagagaggcagagcaaagtattacaagttttttaaagtaaatgctctaaggagagggaggccagtagcataaaggcaggaaaaaagcctgtctaaaatttggtcaaggagagggaaacactaagttgtcttggtcacaccactgatgaaagtgtggcgtggccacacactcccactcatgcaagcaaatgttgttatcaagcaaatggtctcatttcccgatgcacacataagccaataactatggtactagcttttgagaaaagaaaggtttaattgcaaaaccaacccacaaggagataggggtcagattcaaatctgtctcctcaatttggtgtctggggcaagtttcaaaggatcatagagcaaaggatttaaggatgatggcttggctgaatctgattgaagtcctttaaattcgaccatttacagtaagatttgttgaggcagattttagttctgaatcttccgggccaatggaacacttgcttctgaaagagttccagcattgaacttctggtcatatcctaatcttcttggttctgaggggggaattgttggttctgggtgttgttagaggtcaaaggtgtttttttgttgttgttgtttgtttgtttgtttttcattgttcatgcctgggcttcatgactcacagttttgggctctgttatacctataaggtaactcactgttttgttatcaacagagtaggctcagtttggactggtcctccaacttcaacagggaagccaagacttccacccttgcaagatggtataaaggtgccccaacaaccccatccagggttatcaaaggaggccaggtaaggaaccaggacttttatctccatccagcagtaacaaggcacttcttggtttggagctaaagaagctagaaatccataaatgtcaaaagatgcaggaaaagtcttaaatcaataatccaagctcccacatcaagaaccttaaaagcaaaataaccccaaagcaagaagaaggaaataaacaataaagacaaggtcacaaatcaattaaattaacaacagaaaaacaatagacacaatcaatgaaatgaagagttggctctttgaaaacatcaataatatccacaaaactctagcaagattagcagagaaaaaagaagagaagacataaattgccaatgtcaggaatgaaacaagaatataagtcctgcacatatcaaaaagatcacaatgaaatactacaaacaactctacacacgaatttgacaacttagataaaattgactgcttcctcaaatttgtaatgttaaaactctccaaatagaaatttccagatctagatgggttcactggaggattctaccaaacatttaaagaagaactaacatttctacacaatcttatccagacagtagaaaagggggaaacactgcccaaatttttgttgtaaatgttgcataaggctgtaccaaaccaaacaaaacaaaaaactgcagacccctattcttaatgaatataaattcaaaaatccttaacaaaatagaatttggcaatatatttttttaaaaagtgtacatcgtgatcaaacggggttaattccagggatgcagggctggtttaaaatctatcaatgtaatctaccatatgatcacatcacttaataaagaaaaagaactggacaaaattaaacatgtatttataaaggctttaaaatatatgaaggaaacttcctcaactcattaagagcacctatcaaaaaaacaatacttattattatttttatcagtgaaaacctgagtgcttccctctacatgtaggaacaatgtgagatggacactctcactactctttttcaacagagtctagaaattctaatcagtataacaagaaaagaaaagaaaatacatacaaattgaaaggaagaaataaaactgcttctattttcagatgacatcatggcctttgtagaaaacatgaggaacctacaaaaactcctagaactaataagtaagctcagcaaggtcatatgaataatgtaaatgtcaaaaaatgtatttttacaaactagcaatgaacattttgatatccaaaattaaaaatacaataccacttacatcactcaaaaaataaaatacttaggtgtaaatcaaacaaaataagtacaggacttgtatgctaaaaactatataatactgatgaaagaaataaaagaagatctaaataaaagaagaaaggatgactcagcattgtaaaggtactatttctccccaaatatatatacaggtttaatgcaattcccattaaaaatatcagcaaatattttgtagataaataaaatattattctaaaatgtatatggaaagacaaatgaattggaatagcttaaataattattaaaaagaaagtgtatttggaaagatcattctacaattttaagacaatatttagctacagtattcaagactatgtgatacaagccaagagatagagccacaggtcaatagaacagaacagagagccccagaattgacccacacaaatatgatcaagtgatatttctatgaaagtacaaaagtaatgtaataaaagaaagattttttttcaacaaatgggtgctagaaaaactggacatcaatgggcaaaaaaaaaaaaaaaaaaaggaaagaagggaggaagggaagaaggaagggagggagggagggagagaggatcgatggaaggaaggaataagtgtatcaatcttgatctaagtctcacatttcacacaaaattaaataaaaatgagtcatggacttaaatgtaaaaggtaaacctgtacaactttttgaaaaaagaaaaaacctgggagaaaagtctttaacgtctagggataggcaaatagtttatagacttgacatccaaagcacaatctatttaaaaaaatcaataaattgagcttcatcaaaatttaaaacttttcctccacagacgaccctgttaagaagatgaatagacaagttggagagtgggagaaatattcacaaaccacacaatccatcaaaggtctggtatctagagtatataaagagttcccaaaatgcaataggcaaaacaacacagtccaataagaaaatggataaaactcttgaagagacatttcactaatgaaatgatgaactaatggcaatggtggttttggtggtggtgattaaataataaagtgatggcaaatacacacaggcgaagatggtcaacaccataagccatcagggaacttgcaaactaaagcaacagttcagtatcactaaacaactatcagaatggccaaagcaaaacatagtgacaatgccaaatactggcaaggatgtgaagaacctggatcatcattcattgctggtgggaatgtaaaatggtacagccactctggaaacagtttggtggtttcttaacatgtaaccacacaactacaatacaagccagcatttgcaatcctggacatttatcccagagaaattaagacaggttccacaaaaacctgttgacagatgttcatcagaactttatttttaatggccaagctctggaaacattatgtccttcaatgggtgagaggttaaacaaactgcagtacgcccaagaccaaggaacattactgaacagtaagtgggaacaaactactgatatgtgcaacaaactgggtgactctccagagaattatgctcagcgaaaaaaagccattcccaaaaggttgtatactgtatgattccatttatataacatttttgaaatcacaaaattatagaaatgaagacagtgtagtggtttccagtgactcaagaggaggttagatggtagagaagtaggcttggctatgtgaaagctcaaaatgataaattgttctgcatccagactgcatcaaatcagtatccaggttgagatacagtcctatagttttgcaagaagtgactattggaggaaactgggtaaaagggtactcacgatctctctgtattatttcttacattgcatgtgaatctacagttgtctccaaacaaaaagtattacaaataaataaatagttacattcacaaaagcaagtccaacttctcatttaatctttatgttcagtattttaaaactttactaatttttgttttatttcatcatcataattacctcattttaagaaaatgcatttttctcacatgctccaacacatctacagtttaagccaagagtcatacaaaaattataacttacgtaaagtctgtgacataaaacaagatgggaaactgactaaagacttcacttaaacaacaataatgaaacaacagtaaccattgttgaataattagactccactaaaatttcagtgtgcttttctcaattaatcttcaaaaagaacctacatgaaagctattaccattcttattgttttgatgaggaaactaatactaacaaagttaattaaattgctcaggaattggattaagatctattgttaaacacttgaaattttcaaagtataattttttaacatgaaattttctaattttccaactttacctactatttatttacttatttatttaaacacaagactctctctttatatagggcaaagaaaaccatgtctgtgcacacgatttcagatccaggccaacagtttgcaacttctgcaataagcaatggaaaatttcttagatgatcgagtgtgctctcaggtgctctcttacccacaattccaaaattcaagaggctctcaaaacagatggtttttgtctgtttgtttgtttttccataaattcacagtaaactcgtttgcctacaaagctgcacttgaattgatataagcctattttaaatttttatttattgttagtgtttatctcttttaatacagaaatgttaatttatttgattttgggacattatcctactcttgctgatccatactatataacacatatatgtttcatattacctttctaaaactgcccccatcttctaagttctgaagcctaaattacaactactccaaagaagtttggataaaagactgtgaaactgccttagaaaaatcactggtggcattgtgaaagatagacggtcctttcctgaatcattaaatttcccaacaatcctcttttattaaaagccaagtctttcctctgcccatccatcgtctatttactcaacaaatatttgcttaaaacaaaacaaaatcgtgattgaacctttactacctgtcagacattgtatagggcactggagatacagaaatgaatgatttttcatttaatccaaagacttatggggagactgcacgggggccagttaggcaaacacacacttaaaatacccccaaatagataatctgtgaagtatatacaaatgacctgataatgagtcatttgagtgttgttttaaaaaatagagactcgccaaggcgggcggatcacgaagtcaggagattgagaccatcctggctaacacggtgaaaccgcatctctcctaaaaataaaaaaaaaaattagccgagcgtggtggtgggcccctgtagtcctagctactcgggaggctgaggcaggagaatggtgtgaacccgggaggtggagcttgtagtgagctgagatcatgccactgcactccagcctgggcgacagagagagactctgtctcaaaaaaaaaaaaaattgagactcacagtattaatttgtatgaaaatataaccagccaaagcactagtaaagaatgtagctgaggcatgagaagaaatttgggaaactattagatggaaattaaaatgactgtgtcaggagggggccagctaagctgaaacaggaggaggttgccggctggagatttgttacaggcagagcattagaagaagaaagaggctagagtaaggataggaagagattctactttcaagcagattagaacttagtagcttataaaatgatttttgtatcataagttcctaatacagtaaaagcttattaattcggactaaaaagggattagatttgttagccacctttctgattttttttattctaaagtattaattgtggggggaaaatatgtagtcattagatcttcagaggctaatagagagtttcagcaattttgacttccaaacatgtgactatagaatccaaggtactaactaaactttgcttgttgaataaccttcactgcctgcgttcagaatctacacgttccatggtatttctgtcaccttctggtgttagatgcagggactgctgattcagtctgagtcgtagcagccagggatgatgcttaatggttttataaagtatcacagcatcagtattctgtccctgtatgaaaatctagtgtttgcttgttcccatcagggagtctctcttcctgtaaaatacccactgccactacttaaagcagaaggctaatggcacagaatggaagacaatcacccaggaaactccagacggtattagggagcagtaaaaagctgttctgagcgtccaaggcaattgtcattgtccctgtattctttgacatcaagtcattattttcaaccgcattgtgaattgtctttattttcctagagcactcatcaaaaaaggctcacttctgaaggttatgagcagatgctgagatttaaaaacctcaaataaagacttccagatacagagaaggttgcctcaaaaaccagggttacctccagtttccaaaagcctatagtccctgccaaaaaaaaaaaaaaaaaaaaaatggcctaaacaaattagcaaacgcatggtaaaaacttgtgtgcacttgaactaaactaactttacttatacgaggttttaaaggtctaatttctttttaattaaagaaagggaggtgattgtaagaggcttatgcatctggaaatacacaagtcaccaaagccatttcaggaaagggctttaacctacatccaccactcacctgctcccatacctcaccatggaaaattgcaatcgaggcattttgttccaataatcttgttttgttttatttgtgttttttacttcaaatttgcttctcctgttattctttatctttgtttaatctttttttaatggaatctttgccctctggaacagtgaggctatgtcaggaaaaaaaaagaaaataaataagaaatctttctatgtctttcaaacggaggaactgcattcaaagaaattggttatttaggtgttagaaaaaataaagagccgaagataatggcgaggtgacccagagattagcaagagcaggaaggtgcggtcacaccagggttgtgcaatgacaggaggaattggtgatttagaacctagaagccaagcacatcccgggagtgaaaactatagcaaaggtatcagtatattagtccccccttattcatggttttcctttctgtggtttcagttacccaaggtcaactgcagtctgaaaatattaaattaaaaattccagaataaacatttaataattttgaattgcgcaccattttgagcagagtgatgaaatctcaaggtgttcattaccatcccacccagctcatgaatcttccttttgtttgcccgtttattcacgtggtctgtgctactttcctgttagtcacttagggagccctctgggttatcagatagcctgttggtatagcagtgcacttgttcaattaacctttgttttacataataatgggcccaaatcgcaagagtagcgatgctggtaatttggatatgcggaagagaagttgtaaagtgcttcctttaagtgaaaaggtgaaagttcttaagaaaaggaaaaaaatatctatgctgaggtttccaatgttcacactaagaatgaaacttctagccataaaattttgaagaagaaaagaaaaatttgtgttagttttgctgttgcacctcaaaatgcaaaacttatggccacagtgtgtgataagtgcttagttaagatagaaaagacattaaatgtgttagtggaagaaatatattcaattgacagcaattgggttcagtactactcatagtttcacatatccactgagggtgtcagaacgtattcgccatggataaggggaaactatggtaccatagagggaaggtttttccagtgggagatggaactgaagcagcatcattgtctggggtaaacacctggggtctgtcatctcggaccaagaagataacgacgctgacacatgtggatgggttaaggagcggaaagcttaataggctgaagaaaggaaagaggacagccgttctctgtctctgtcgcaagagagaggcatcggaaaggaaaaagcccacctgcaagggatcacagtagattttataggcaggcttgaggaggtggtgtctgatttacatagggcccacagattggttcaatcaggtgtgagtttacatagtgcacctaccctaatcttattattatgcaaataggctttctacttggccagcaccatcttatctgctccttactgtacatgtgctggcaaagagaagatggagctgcctttttttttgagacagagtctcgctctgtcactcaggctggagtgcattgttgccaacttggctccacctcccgggttcaagccattctcccgcctcagcctcctgagtagctgggattacaggcatgcgccaccacatccagctaatttttgtgtttttagtagagacaaggtttcaccatgttggccaggctggtctcgaactcctgacctagtgatccgccggcttcggccccccaaagtgctgggactacaagcatgagccactgtgcccggccagagccatgatttttaacatgcctgttcccagttaggcttttcctattggcacaactgccggcatttgcctgtgcaagtttccagcttgcttgtctatgtctgcagctcaatttaacaagctgctctttgttagaaaagaaaattacttgggggctgctttttattaaaaggaaaaccttactgaggactcccgtgccttatctgcctaagtaagttcttcttaactcctatatcagaaccaaagaggagacccagtccctcatgcagatgacatcagaaacagaaaggaaggaaagacatcccagttgtccccttctcctgctctccagtattctgccagtgcctcccacagcccaaacccaattggaggccaggaagcaaagtaaatgcactaacctgtggcaaaaaaataaagcaagggaaaggaaggcaatgaatctgagagcaaagaaacagctgacctgcaacccttcatatggtgttttcccatgtatcttcacttgatgacaaaatactggcgaatctacttgataatatcttaatgatgtcaattcactatttctccattcacaaagatgtgtttatatattacaagagtcagaaaatgttggtgagtctcactgaattctttttttcttccatgtgtatgctgttctttgtgaaaaagccactgcattgtttcaaatatctctgagaagttttcatggagctgctccaaacagcttaagacttgttcagaatcagtcactctccaaaatttcctaaccagggccactgatgttgctctttatgctgaaagataactatcatcaaggacaggaaacccatcagcctgctataaactttgttacagagttctctgagaccaaaccaaaattactacctaggaccttgaacctgagcctaagtcagtttgacagcaaaatactttaagaggttgaaagttaatcattttctgtgatccctttcatcacagtaattcttagtcatcaaacagggtaaccttcccagtaaattattttcttctataactctgcttttcttccctaactcttttttctgtaactctaagtcttatattctaaatcctcctcaacctctaaatttcacaaatggctttctctgtcttctattttaacagaaatgaggttcttattcaactcctctccagtgcggaccaatcatttacccacagcctattagttgtgatgagggaatccacacttgtgttccaactactggaccatcatttttcttctctctgattaaagttcatcctactctctagtggcaactgtcccctcagtctctgaaatttgcttaaggccatgaaagaaggatcccaatcaacccctacacaaactacttcttattatactcctagtagattttattctgttgatttggggtggagagttctgtagatgtctattaggtccgcttggtgcagagctgagttcaattcctgggtgtccttgttaactttctgtctcgttgatctgtctaatgttgacagtggggtgttaaagtctcccattattaatgtgtgggagtctaagtctctttgtaggtcactcagggcttgctttatgaatctgggtgctcctgtatcgggtgcatatatatttaggatagttagctgttcttgttgaattgatccctttaccattatgtaatggccttctttgtctcttttgatctttgttggtttaaagtctgttttagcagagactaggattgcaacccctgcctttttttgttttccatttgcttcgtagatcttcctccatccctttattttgagcctatgtgtgtctctgcacatgagatgggtttcctgaatacagcacactgatgggtcttgactctttatccaatttgccagtctgtgtcttttaattggagcatttagtccatttacatttaaagttaatattgttatgtgtgaatttcatcctgtcattatgatgttagctggttattttgctcgttagttgatgcagtttcttcctagcctcgatggtctttacaatttggcatgattttgcagtggctggtaccagttgttcctttccacgtttagtgcttccttcaggagctcttttagggcaggcctggtggtgacaaaatctctcagcatttgcttgtctgtaaagtattttatttctccttcacttatgaagcttagtttggctggatatgaaattctaggttgaaaattcttttctttaagaatgttgaatattggcccccactctcctctggcttgtagagtttctgccgagagatccgctgttagtctgatgggcttccctttgtgggtaagctgacctttctctctggctgcccttaacattttttccttcatttcaactttggtgaatctgacaattatgtgtcttggagttgctcttctcgaggagtatctttgtggcattctctgtatttcctgaatctgaatgttggcctgccttgctagattggggaagttctcctggatagtatcttgcagagtgttttccaacttggttccattctccctgtcactttcaggtacaccaatcagacgtagatttggtcttttcacatagtcccatatttcttggaggctttgttcgtttctttttattcttttttctctaaacttcccttctcgcttcatttcattcatttcatcttccattgctgataccctttcttccagttgatcatatcggctcctgaggcttctgcattcttcacgtagttctcgagccttggctttcagctccatcagctcctttaagcacttctctgtattggttattctagttatacattcatctaaatttttttcaaagtttttaacttctttgcctttggtttgaatttcctcctgtagctcggagtagtttgatcctctgaagccttcttctctcaactcgtcaaagtcattctctgtccagctttgttccgttgctggtgaggaactgcattcctttggaggaggagaggggctctgctttttagagtttccagtttttctgctctgtttttttcccatctttgtggttttatctacttttggtatttgatgatggtgatgtacagatgggtttttggtgtggatgtcctttctgtttgttagttttccttctaacagacaggaccctcagctgcaggtctgttggagtttgctagaggtccactccagactctgtttgcctgggtatccgcagcggtggctgcagaacagcggattttcgtgaactgtgaatgctgctgtctgatcgttcctctggaagttttgtctcagagtagtacccagctgtgtgaggtgtcagtctgcccctgctgagggttgcctcccagttaggctgcttgggggtcaggggtcagggacccacttgaggaggcagtctgcccattctcagatttccagctgcgtgctgggagaaccactgctctcttcaaagctgtcagacagggacatttaagtctgcagaggttattgctgtctttttgtttgtctgtgccctgcccccagaggtggagcctacagaggcaggcaggcctccttgagctgtggtgggctccacccagttcgaacttcccggctgctttgtttacctaagcaagcctgggcaatggggggcgcccctcccccagcctcgctgccaccttgcagtttgatctcagactactgtgctagcaatcagcaagactccatgggcgtaggaccctccgagccaggtgcgggatataatctcctggtgtgccgttttttaagcccgttggaaaagcgcagtattagggtgggagtgacccgattttccaggtgctgtctgtcacccctttctttgactaggaaagggaactccctgaacccttgcacttcccgagtgaggcaatgccttgccctgctttggctcgcgcacggtgcactacacccactgtcctgcgcccactgtctggcactccctagggagatgaacccggtacctcagatggaaatgcagaaatcacccgtcttctgcgtcgctcacgctgggagctgtagaccagagctgttcctattcggccatcttggctgccc

SEQ ID NO: 12023 - DNA, 4503 bp, Homo sapiens
tttttttaattttttaatttttatttaaaaattttttttaatatactttaagttttaggatacatgtgcacaacgtgcaggttagttacatatgtatacatgtgccatgttggtgtgctgcacccattaacttgtcatttaacattaggtatatctcctaatgctatccctcccccctcccccaccccacaacaggccccagtgtgtgatgttccccttcctgtgtccatgtgttctcattgttcaattcccacctatgaatgagaacatgtggtgtttggttttttgtccttctgatagtttgctgagaatgatagtttccagcttcatccatgtccctacaaaggacatgaactcatcattttttatggctgcatagtattccatggtgtatatgtgccacattttcttaatccagtctatcattgttggacatttgggttggttccaaatctttgctattgtgaatagtgctgcaataaacatacgtgtgcatgtgtctttatagcagcatgatttctaatgctttgggtatatacccagtaatgggattgctgggtcaaatggtatttctagttctagatccctgaggaagcaccacactgacttcacaatggttgaactagtttacagtcccaccaacagtgtaaaagtgttcctatttctccacatcctctccagcacctgttgtttcctgacttattaatgaccgccattctaactggtgtgagattgtatctcattgtggttttgatttgcatttctctgatggccagtgatgatgagcattttttcatgtgtcttttggctgcataaatgtcttcttttgagaagtgtctgttcatatccttcacctactttttgatgaggttgtttgtttttttcttgtaaatttgtttgagttcattgtagattctggatattagccctttgtcagatgagcaggttgcgaaaattttctcccattctgtaggttgcctgttcactctgatggtagtttcttttgctgtgcagaagctccttagtttaattaggtcccatttgtcaattttggcttttgttgccattgcttttggtgttttaacatgaagtccttgcccatgcctatgtcctgaatggtattgcctacattttcttctagggtttttatggttttaggtctaacatttaagtcttcaatccatcttgaattaatttttgtataaggtgcaaggaagggatccagtttcagctttctacatatggctagccagttttcccagcaccatttattaaatagggaatcctttccccatttcttgtttttgtcaggtttgtcaaagatcagatggttgtagatatgcggcattatttctgagggctcttttctgttccattggtctatatctctgttttggtaccagtaccatgctgttttggttactgtagccttgtaatatagtttgaggtcaggtagcatgatgcctccagctttgttcttttggcttaggattgacttggcaatgcgggctcttttttggttccatatgaactttaaagtagttttttccaattctgtgaaaaaagtcattggtggcttgatggggatggcattgaatctataaattaccttgggcagtatggccattttcatgatattgattcttccaacccatgagcatgtaatgttcttccatttgtttgtatcctcttttatttcattgagcagtggtttgtagttctccttgaagaggtccttcatgtcccttgtaagttggatccctagatattttattctctttgaaggaattgtgaatgggagttcactcatgatttggctctgtttgtctgttattggtatataagaatgcttgtgatttttgcacattgattttttatcctgagactttgctgtagttgcttatcagcttaaggagattttgggctgagacaatggggttttctagatacacagtcatgtcatctgcaaacagggacaatttgatttcctcttttcctaattgaataccctttacttcctactcctacctgattgccctggctagaacttccaacaccatgttgaataggagtggtgagagagggcatccctgtcttgtgccagctttcaaaggaatgcttccagtttttgtccattcagtatgatattggctgtgggttgtgggtttgtcatagatagctcttattattttgagatatgtccaatcaatacctaatttattgagagtttttagcatgaagggctgttgaattttgtcaaaggccttttctgcatctattgagataatcatatggtttttgtcattggttctgtttatatgctggattacatttattgatttgcatatgttgaaccagccttgcatgccagggatgaagcccacttgatcatggtggataagctttttgatgtgctgctggatttggtttgccagtatttcattgaggatttttgcatcgatgttcatcaggaatattggtctaaaattctcttttttgttgtgtctctgccaggctttggtatcaggatgatgctggcctcataaaatgagttagggaggattccctctttttctatttattggaatagtttcagaaggaatggtaccagctcctccttgtacctctggtagaatttggctgtgaatccatctggtcctggactttttttggttgttaagctattaattattgcctcaatttcagatcctgttattggtctattcagagattcaacgtcttcctggtttagtcttgggagggcgtatgtgttgaggaatttatccgtttcttctagattttcagtttatttgcttagaggtgcttatagtattctctgatggtagtttgtatttctgtgggatcggtggtgacatcccctttatcattttttattgcatctatttgattcttctctcttttcttctttattagtcttgctagcagtctatcaattttgttgatcttttcaaaaaaccagctactgaattcattgattttttgaagggttttttgtgtctctatttccttcagttctgctctgatcttaggtgtttcttgccttctgctagcttttgaatgtgtttgctcttgcttctctagttcttttaattgtgatgttagggtgtcagttttggatctttcctgctttctcttgtgggcatttagtgctataaatttccctccacacactgctttgaatgtgtcccagagattctgatatgttgtgtttttgttctcattggtttcaaagaacatgttgacagtggggtgttaaagtctcccattattattgtgtgggagtctaagtctctttctagctctctaaggacttgctttatgaatctgggtgctcctgtattggatgcatatatatttaggatagttagctcttcttgttgaattgatccctttaccattatgtaatggccttctttgtctcttttgatctttgttggtttaaagtctgttttatcagagactaggattgcaacccctgccttttttgttttccatttgcttggtagatcttcctccatccctttattttgagcctatgtgtgtctctgcacgtgagatgggtttcctgaatacagcacactgatgggtcttgactctttatccaatttgccagtctgtgtcttttaattggagcatttagcccatttacatttaaggttaatattgttatgggtgaatttgatcctgtcattatgatgttagctggttattttgctcgttagttgatgcagtctcttcctagcctcaatggtctttacaatttggcatgtttttgcagtggctggtaccggttgctcctttccatatttagtgcttccttcacgagctcttttagggcaggcctgctggtgacaaaatctctcagcatttgcttgtctgtaaaggattttatttctccttctcttatgaagtttagtttggctggatatgaaattctgggttggaaattcttttctttaagaatgttgaatattggcccccactctcttctggcttgtagagtttctgccaagagatcagctgttagtctgatgggcttccctttgtgggtatcccgacctttctctctggctgcccttaacattttttccttcatttcaactttggtgaatctgacaattatgtgtcttggagttgctgttctcgaggagtatctttgtggtgttccctgtatttcctgaatttgaatgttggcctgccttgctagattggggaagttcccctggataataccctgcagagtgttttccagcttggttctattctccctgtcactttcaggtacaccaataagacgtagatttggtcttttcaaatagtcccatatttcttggaggctttgttcatttctttttattcctttttctttaaacttctcttctcacttgatttcattcatttgatcttccatcagtgataccctttcttccagttgatcaaatcggctactgaggcttgtgcattcatcacatagttttcgtg

SEQ ID NO: 12024 - DNA, 3148 bp, Homo sapiens
ttgctgaagttgcttatcagctgaaggagattttgggctgagacaatggggttttctagatatacaatcatgtcatctgcaaacaggggcaatttgacttcctcttttcctaactgaataccctttatttctttctcctgcctgattgccctggccagaacttccaacactatgttgaataggagtggtgagagagggcatccctgtgttgtgccagttttcaaagggaatgcttccagtttttgcccattcagtatgatattggctgtgggtttgtcatagatagctcttattattttcagatacgtcccatcaatacctaatttattgagagtttttagcatgaagggctgttgaattttgtcaaaggccttttctgcatctattgagataatcatgtggtttttgtctttggttctgtttatatgctggattacatttattgatttgcatacgttgaaccaggcttgcatcccagggatgaagctcatttgatcgtggtggataagctttttgatgtgctgctggattcggtttgccagtattttattgaggatttttgcatcgatgttcatcagggatattggtctaaaattctctttttttgttgtgtctctgcctggctttggtatcaggatgatgctggcctcataaaatgagttagggaggattccctctttttctattgattggaatagtttcagaaggaatggtagcagctcctctttgtacatctggtagaattcggctgtgaatccatctggtcctggactttttttggttggtaggctattaattattgcctcaatttcagagcctggtattagtctattaggagattcaacttcttcctggtttagtcttgggagggtgtatgtgtcaaggaatttatccatttcttctagattttctagtttatttgtgtagaagtgtttatagtattctctgatggtagtttgtatttctgtgggatcggtggtgatatcccctttatcattttttattgcatctatttgattcttctctcttttccttttttattagtcttgctagtggtctaacaattttgctgatcttttcaaaaaatcaactcctggattcattgatttgttgaagggtttttttgtgtctctagctccttcagttctgctctgatcttagtaatttcttgccttctggtagcttttgaatatgtttgctcttgcttctctagtacttttaattgtgatgttagggtgtcaattttagatctttcctgctttctcttgtgggcatttagtgctataaatttccctctacacactgctttgaatgtgtcccagagattctggtatgttgtgtctttgttctcattggtttcaaagaacattttttttttttaatacttttaagttttacggtacatgtgcccaacgtgctggttagttacatatgtatacgtgtgccatgttggtgtgctgcacccattaactcgtcatttaaccttaggtatatctcctaatgctatccctcctccctcccctcaccccacaacaggccccggtgtgtgatgttccccttcctgtgtccatgtgatttctgccttcatttcgttatgtacccagtagtcattcaggagcaggttgttcagtttccatgtagttgagtggttttgagtgaatttcttaatcctgagttctagtttgattgcactgtggtctgatagacagtttgttgtaatttctattcttttacatttgctgaggagtgctttatttccaactatgtggtgaattttggaataagtgtgatgtggtgctgagaagaatgtatattctgttgatttggggtggagagttctgtagatgtctattaggtccgcttggtgcagagctgagttcaatacctggatatccttgttaactttctgtctcgttgatctgtctaatgttgacagtggggtgttaaagtctcccattattattgtgtgggagtctaagtctctttgtaggtctctaaggacttgctttatgaatctgggtgctcctgtattgggtgcatatatatttaggatagctagctcttcttgttgaattgattcctttaccattatgtaatggccttctttgtctcttttgatctttgttggtttaaagtgttttatcagagactaggattgcaacccctgcttttttttgttttccatttgcttggtagatcttcctccatccctttattttgagcctatgtgtttttctgcatgagagatgggtctcctgaatacagcacactgatgggtcttgactctttatccaatttgccagtctttatcttttaattggagcatttagcacatttacatgtaaggttaatattgttatgtgtgaatttgatcctgtcattatgatgttagatggttattttgctcattagttgatgtagtttcttcctagcattgatggtctttacaatttggcatgtttttgcagtggctggtataagttgtgcctttccatgcttccttcaggagctcttgtaaggcaggcctggtggtaaggcaagcaaatctctcagcatttgcttgtctgtaaagtattttatttctccttcacttatgaggcttagtttggctggatatgaaattctgggttgaaaattcttttatttaagaatgttgactattggcccccactctcttctggcttgtagagtttctgctgatagatccgctgttagtctgatgggcttccctttgtgggtaacctgacctttctctctggctgcccttaacattttttccttcatttcaactttggtgaatctgacaattatgtgtcttggagttgctcttcttgaggagtatctttgtggtgttctctgtatttcctgaatttgaatgttgtcctgccttgctaggttgtggaagttctcctggataatatcctgcagagtgttttccaacttggttccattctccccgtcactttcaggtacaccaatcagatgtagatttggtcttttcacttagtcccatatgtcttggaggctttgttcatttctttttactcttttttctctaagcttgtcttctcacttcatttcgttcatttgatcttccatcactgataccctttcttccagttgatctaatcggctactgaagcttgtg

SEQ ID NO: 12025 - DNA, 5256 bp, Homo sapiens
ccacaatagttgaactagtttacagtcccaccaacagtgtaaaagtgtttctatttctccacatcctctccagcacctgttgtttcctgactttttttttatttttattatactttaagttttagggtacatgtgcacaatgtgcaggtttgttacatatgtatacatgtgccatgctggtgcactgcacccactaacttgtcatctagcattaggtatatctcccaatgctatccctacccccccccaccccacaacagtccccagagtgtgatgttccccttcctgtgtccatatgttctcattgttcaatttccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattcttggacatttgggttggttccaagtctttgctattgtgaatagttccgcaataaacatacgtgtgcatgtgtctttatagcagcatgatttataatcctttgggtatatacccagtaatgggatggctgggtcaaatggtatttctagttctagatccctgaggaatcgccacactgtcttccacaatggttgaactagtttaccgtcccaccaacagtgtaaaagtgttcctatttctccacatcctctccagcacctgttgtttcctgtctttttaatgattgccattctaactggtgtaagatgatatctcattgtggttttgatttgcatttctctgatggccagtgatggtgagcattttttcatgtgttttttggctgcataaatgtcttcttttgagaagtgtctgtatcctgactttttaatgatcgccattctaactggtgtgagatggcatctcattgtggttttgatttgcatttctctgttggccagtgatgatgagcattttttcatgtgtctgttggctgcataaatgtcttcttttgagaagtgtctgttcatatccttcacccacttgttgatggggttgtttgattttttcttgtgaatttgtttaagttccttgtagattctggatattagccatttgtcagatgggtagattgtaaaaattttctcccattctgtaggttgcctgttcgctctgatggtagttacttttgctgtgcagaagttctttagtttaattggatcccatttgtcaattttggcttttgttgccattgcttttggtgttttagacatgaaatccttgcccatgcctatgtcctgaatggtactgcctaggttttcttctagggtttttatggttttaggtctaacatttaagtctttaatccatcttgaattaatttttgtataaggtgtaaggaagggatccagtttcagctttccacatgtggctagccagttttcccagcaccatttattaaatagggaatcctttccccatttcttgtttttgtcaggtttgtcaaagatcagatggttgtagatgtggggtattatttctgagagctccgttctgttccactggtctatatctctgttttggtaccagtaccatgctgttttggtgactgtagccttgtagtatagtttgaagtcaggtagcgtgatgcctccagctttgttcttttggcttaggattgtcttggcaatgcaggctcttttttgcttccatatgaacttgaaagtagttttttccaattctgtgaagaaagtcattggtagcttgatggggatggcattgaatgtataaattaccttgggcagtatggccattttcatgatattgattcttcctatccatgagcatggaatgttcttccatttgtttgtgtcctcttttatttcgttgagcagtggtttgtagttctccttgaagaggtccttcacatcccttgtaagttggattcctaggtattttattctctttgaagcaattgtgaatgggagttcactcatgatttggctctctgtttgcctgttattggtgtataggaatgcttgtgatttttgcacattgattttgtatcctgagactttgctgatgttgcttatcagcttaaggagattttgagctgagatgatggggttttctaaatatacaatcatgtcatctgcaaacagggacaatttgacttcctcttttcctaattgaataccctttatttctttctcctgcctgattgccctggccagaacttccaacactatgttgaataggagtggtgagagagggcatccctgtcttgtgccagttttcaaagggaatgcttccaggttttgcccattcagtgtgatattggctgtgggtttgtcataaatagctcttattattttgagatacgtcccatcaatacctcgtttattgagagtttttagcatgaagagctgttgaattttgtcaaaggccttttctgcatctattgagataatcatgtggtttttgtctttggttctgtttatatgctggattacgtttattgatttgcatatgttgaaccagccttgcatcccagggatgaagccaacttgattgtggtggataagctttttgatgtgctgctgaatttggtttgccagtattttattgaggatttttacatcgatgttcatcagggatattggtctaaaattctctttttttgttgtgtctctgccaggctttggtatcaagatgatgctagcctcataaaatgagttagggaggattccctctttttctgttgattggaatagtttcagaaatggtaccatctcctctttgtacctctggtagaattcggctgtgaatctgtctggtcctggactttttttggttggtaggctattaattattgcctcaatttcagagcctgttattggtctattcagggattccacttctcctggtttaatcttgggagggtgtatgtgtccaggaatttatccatttcttctacattttctagtttatttgcatagaggtgtttatagtattctctggtggtagtttgtatttctgtgggatcggtggtgatatcccctttatcattttttattgtgtctatttgattcttctctcttttcttctttattagtcttgctagcggtctatcaattttgttgatcttttcaaaaaaccagctcctggattcattgattttttgaagggtattttatgtctctatctccttcagttctgctctgatcttagttattttttgccttctgctggcttttcaatgtgtttgctcttgcttctctagttcttttaattgtgatgttagggtgtcaattttagatctttcctgctttctcttgtgggcatttagtgctataaattttcctatacacactgctttaaatgtgtcccagagatttgggtatgtggtgtctttgttctcattggtttcaaagaacatctttatttctgccttcatttcgttatgtacccagtagtcattcaggagcaggttgttcagtttccatgtagttgagcggttttgagtgagtttcttaatcctgagttcttgtttgagtgcactgtggtctgagagacagtttgttataatttctcttcttttacatttgctgagaagtgttttacttccaattatgtgtcaattttggaatatgtgttaagtggtgctgagaagaatgtatattctgttgatttggggtggagagttctgtagatgtctattaggtctgcttggtgcagagctgagttcaattcctggatatccttgttaactttctgtctcgttgatctgtttaatgttgacattggggtgttaaagtctcccattattattgtgtgggagtctaagtctctttgtaggtctctaaggagttgctttatgaatctgggtgctcctggattgggtgcatatatatttaggatagttagctcctcttgttgaattgatccctttaccattatgtaatggccttctttgtctcttttgatctttgttgatttaaagtctgttttatcagagactaggattgcaacccctgcctttttttgttttccattttcttggtagatcttcctccatccctttattttgagccaatgtgtgtctctgcacgtgagatgggtctcctgaatacagcacactgatgggtcttgactctttatccatttgccagtctgtgtcttttaattggagcatttagcccatttacatttaaggtgaatattgttatgtgtgaatttgatcctgtcattatgatgttagctggttattttgctccttagttgatgcggtttcttcctggcattgatggtctttacaatttggcctgtttttgcagtggctggtactggctgttcctttccatgtttagtgcttccttcaggagctcttgtaaggcaggtctggtggtgacaaaatctctcagcatttgcttatctgcaaaggattttatttctccttcagttatgaagcttagtttggctggatatgaaattctgggttgaaaattcttttctttaagaatgttgaataatggctcccactgtcctctggcttgtggaatttctgccaagagatctgctgttaatctgatgggcttccctttgtgggtaacctgaccttactccctggctgccctcaatattttttccttcatttcaactttggtgcatctggtaattatgtgtcttggagttgctcttctcgaggagtatctttgtggcactctctgtatttcctgaatttgaatgttggcctgccttgctagattggggaagttctcctggataataccctgaagagtgttttccaacttggttccattctccccatcactttcaggtacaccaatcagacgtagattttgtttcacatagtcccatatttcttgaaggctttgtttgtttctttttactcttttttctctaaacttctcttctcacttcatttcatttatttgatcttcaatcactgataccctttcttccacttgatcgaattggctactgaagcctgtgcattcctcacatagttctcgtgccatggttttcagctccatcaggtcatttaaggtcttctctacattgtttattctagttagccattcatctaatcttttttcaaggtttttagcttctttgtgttgggttcaaacatcctcctttagctcggagaagtttgttattaccagtcgtctgaagccttcttctctcaactcatcaaagtca

SEQ ID NO: 12026 - DNA, 3499 bp, Homo sapiens
gtttcagctttctacatatggctagccagttttcccaacaccatgtattaaatagggaatccttttcccgtttcttgtttttgtcaggtttgtcaaagatcagatggttgtagatgtgtggtattatttctgagggctctattctgttccattggtctatatctgtgttttggtaccagtaccatgctgttttggttactgtagccttgtagtatagtttgaagtcaggtagcatgatgcctccagctttgttcttttggcttaggattgtcttggcaatgtgggctcttttttggttccatatgaactttaaagtagttttttccaattctgtgaagaaagtcattggtagcttgatggggatggcattgaatctataaattaccttgggcagtatggccatttccatgatattgattcttcctatccataagcatagaatgttccttcatttgtttgtgtcctcttttatttcactgagaatggtttgtagttctccttgaagaggtccttcacatcccttgtaagttggattcctaggtattttattctctttgaagcaattgtgaatgggaattcactcatgatttggctctctgtttgtctgttattggtatataggaatgcttgtgatttttgcacattgattttgtatcctgagactttgctgaagttgcttatcagcttaaggagattttgggctgagacgatggggttttctaaatatacaatcatgtcatctgcaaacggggacaatttgacttcctcttttcctaattggataccctttatttctttctcctgcctgattgccctggccagaacttccaacactatgttgaataagagtggtgacagttttcaaagggaatgctcccagtttttgcccattcaggatgatattggctgtgggtttgtcataaatagctcttattattttgagatacgtcccattgatacctaatttattgagagtttttagcatgaagggctgttgaattttgtcaaaggccttttctgcgtctattgagataatcatgtggtttttgtctttggttctgtttatatgatggattacgcttattgatttgcgtatgttgaaccagccttgcatcccagggatgaaaccaacttgatcatggtggataaactttttgatgtgctgctggattgggtttgccagtatttcactgaagatttttgcatcgatgttcatcagggctattggtctaaaattctctttttttgttgtgtctctgccaggctttggtatcaggatgatgctggcctcataaaatgaattagggaggattccctctttttcttttgattggaaaagtttcagaaggaatggtaccagctcctccttgtacctctggtagaattcggctgtgaatcagtctggtcctggacttcttttggttggtagcctcttaattattgcctcaatttcagagcctgttattggactattcagggattcaacttcttcctggtttagtcttgggagggcgtatgtgtcaaggaatttatccatttcttctagattttctagttgatttgcatagaggtttttatagtattctctgatggtagtttgtatttctgagggattggtggtgatatcccctttatcattttttattgtgtctatttgattcttctctcttttttcgttattagtcttcctagtggtctatcaattttgttgatcttttcaaaaaaccagctcctggattcattgattttttgaagggttttttgtgtctccatctccttcagttctgctctgatcttagttatttcttgccttctgctagcttttgaatgtgtttgctctggcttctctagttcttttaattgtgatgttagggtgtcaattttagatctttcctgctttctcttgtgggcatttagtgctataaatttccctctacacacgctttaagtgtgtcccagagattctggtatgttgtgtctttgttctcattggtttcaaagaacatctttatttctgccttcatttctttatgtacccagtagtcattcaggagcaggttgttcagtttccatgtagttgagcggttttgagtgagtttcttaatcctgagttttagtttgattgcactgtggtctgagagacagtttgttataatttctgtccttttacatttgatggggagtgctttacttccaactatgtggtcaatattgaaataagtgcaatgtggtgctgagaggaatgtatattctgttgatttggggtggagagttctgtagatgtctattaggtctgcttggtgcagagctgagttcaattcctggaaatctttgttaactttctgtctcgtggatctgtctaatgttgacagtggggtgttaaagtctcccattattattgtgtgggagtctaagtgtctttgtaggtctctaaggacttgctttatgaatctgggtgctcctgtattgggtgcatatatatttaggatagttagctcttcttgttgactggatccctttaccattacgtaatggccttctttgtctcttctgatctttgttggtttaaagtctgttttatcagagactaggattgcaacccctgcctttttttgtgttttccatttgcttggtagatcttcctccatccctttattttgagcctatgtgtgtctctgcacgtgagatgggtttcctgaatacagcacactgatgggtcttgactctttatccaatttgccagtctgtgtcttttaattggagcatttagcccatttacatttaaggttaatattgttatgtgtgaatttgatcctgtcattatgatgttagctggttattttgctcgttagttgatgcagtttcttcctagccttgatggtctttagaatttggcatgtttttgcagtggctggtaccagttgttcctttccatgtttagtgcttccttcaggatttcttgtaaggtaggcctggtggtgacaaaatctctcagcatttgcttgtctgtaaaggattttatttgtccttcacttatgaagcttagtttggctggatatgaaattctgggttgaaaattcttttctttaagaatgttgaatattggccccccctctcttctggcttgtggagtttctgccgagagatcagctgttagtctgatgggcttccctttgtgggtaacccgacctttctctctggctgcccttaacattttttccttcatttaaactttggtgaatctgacaattacgtgtcttggagttgctcttctcgaggtatgtctttgtggcattctctgtatttcctgaatttgagtgttggcctgccttgctaggttggggaagttctcccggataatatcctgcagagtgttttccaacttggttccattctccccgtcactttcaggtacaacaatcagacgtagatttggtcgtttcacatagtcccatatttcttggaggctttgttcatttctttttactcttttttctct

SEQ ID NO: 12027 - DNA, 675 bp, Homo sapiens
caacccctgcttttttttttgttttccatttgcttggtagatcttcctccatccctttattttgagcctatgtgtgtctctgcacgtgagatgggtctcctgaatacagcacactgatgggtattcactctttacccaatttgcccatctatgtcttttaattggagcatttagcccatttacatttaaggttaatattgttatgtgtgaatttgatcctgtcattatgatgttagctggttagtttacttgttagttgatgcagtttcttcctagcatcgatggtctttacaatttggcatgttgttgcagtggctggtatcagttgttcctttccatgtttagttcttccttcaggaggtcttttagggcaggcctggtggtgacaaaatctctcagcatttgttcgtctgtaaaggattttatttctccttcacttatgaagcttagtttgactggatatgaaattctgggttgaaaattcttttctttaggaatgttgaatattggcccccactctcttctggcttgtagagtttctgctgagagatccagggtttgtccaatgggcttccctttgtgggtaacccgacctttctctctggctgcccttaacactatttccttcatttcaactttgttaatctgacaattatgtgtcttggagttgatctt

SEQ ID NO: 12028 - DNA, 4940 bp, Homo sapiens
ttttattattgttatactttaagttctaaggtacatgtgcacaacatgcaagtttgttacacatgtatacttgtgccatgttggtgtgctgcacccattaactcgtcatttacattaggtatatctcctaatgctatccctccccactcccgccaccccacaataggccccagtgtgtgatgttccccatcctgtgtccaagtgttcccattgttcaattcccacctatgagtgagaatatgtggtgtttgcttttctgtcctcgcgacagtttgctcagaatgatggtttccagcttcatccacgtccctacaaaggacatgaactcatccttttttatagctgcatagtattccacggtgtatatgtgccacattttcttcatccagtctatcactgatggacatttgggttggttctaagtctttgctactgtgaatagtgccacaataaacatacgtgtgcatgtgtctttatagcagcatgatttataatcctttgggtatatacccagtaatgggatgactgggtcaaatgatatttctagttctagatccttgaggaatcgccacactatcttccacaatggttgaactagtttacagtcccaccgacagtttaaaagtgttcctatttctccacatcctctccagcacctgctgtttcctgactttttaatgattgccattctaactggtgtgagatggtatctcattgtggttttgatttgcatttccctgacggccagtgatgatgagcattttttcatatgtctgttggctacataaatgtcttcttttgagaagtgtctattcatatcctttgcccactttttgatggggttgtttgattttttcttgtaaatttgtttaagttcttcacagattctggatattagccctttgtcagatgggtagattgcaaaaattttctcccattctgtaggttgcctgttcactctgatggtagtttcttttgctgtgcagaagctctttagtttaattagatcacatttgtcaactttggcttttgttgtcattgcttttggtgttttagacatgaagtccttgcccatgcctatgtcctgaatggtattgcctaggttttcttctagggtttttatggttttaggactaacatttaagtctttaatccatcttgaattaatttttgtataaggtataaggaagggatccagttccagctttctaatatggctagccagttttcccagcaccatttattaaatagggaatcctttccccatttcttgtttttgtcaggtttgtcaaagatcagatggttatagatgtgtggtattatttctgagggctctgttctgttccattggtctatatctctgttttggtaccagtaccatgctgttttggttactgtaggcttgtagtatagtttgaagtcaggtagcgtgatgcctccaggtttgctctttttgcttaggattgacttggcaatgtgggctcttttttgtttccatatgaactttcaagtagttttttccaattctgtgaagaaagtcattggcagcttgatggggatggcattgaatctataaattaccttgggcagtatggccattttcatgctattgattcttcctatccatgagcatggaatgttcttccatttgtttgtgtcctcttttattttgttgagcagtggttggtagttctccttgaagaggtccttcacatcccttgtaatttggattcctaggtattttattctctttgaagcaattgtgaatgggagttcactcatgatttggctctctgtttgtctgttattggtgtataggaatgcttgtgatttttgcacattgattttgtatcctgagactttgctgatgttgcttatcagcttaaggagattttgggctgagacaatggggttttctaaatatacaatcatgtcatctgcaaatagggaaaatttgactttctcttttcctaattgaattccctttctttctcttgcctgattgccctggccagaacttccaacactatgttgagtaagagtggtgagagaggacatccctgttttgtgccagttttcaaagggaatgcttccagtttctgcccgtacgtatgatattgactgtgagtttgtcataaatagctcttattattttgagatatgtcccatcaatacctaatttattgagagttgttttagcaagaagggctgttgaattttgttgaaggccttttctgcatccattgagataatcatgtggtttttatctttccttctgttaatatgttggattacgtttatggatttgtgtatgttgaaccagccttgcatcccagggatgaagcccatttggtcatggtggataagctttttgatgtgctcctggattcagtttgccagtattttatttaggattttcacatcaatgttcatcagggatcagggatattggtctaaaattctctttttttgttgtgtctctgccaggctttggtatcaggatgatgctggcctcataaaatgagttagggaggattccctctttttctattgattggaatagtttcagaaggaatggtaccagctcctccttgtacctctggtagaattcggctgtgaatccatctggtcctggactttttttggttggtaggctcttaattattgcctcaatttcagaacctgttattggtctattcagggattcaacttcttcctggtttagtcttgagagggtataagtgtccaggaatttatccatttcttctagattttctagtttatttgcatagaggtgtttacagtatactctgatggtagtttgtatttctgtgggatcagtggtgatatcccctttatcattttttattgcatctgtttgattcttctctcttttcttctttattagtcttgctagcggtctatcaattttgttgatcttttcaaaaaaccagctcctggattcattgattttttgaagggttttttgtgtctctatctccttcagttctgctctgatcttagttatttcttgccttctgctagcttttgaatgtgtttgctcttgcttctctagttcttttaattgtgatgttagggtgtcaattttagatctttcctgctttctcttgtgggcctttagtgctataaatttccctctacacactgctttaaatgtgtcccagagattctggtatgttgtatctttgttctcattggtttcaaagaacatctttatttctgccttcatttcattatgtacccagtagtcactcaggagcagcttgtgcagtttccgtgtagttgggtggtttgggtgagtttcttaatcctgagttctagtttgattgcactgtggtctgagcgactgtttgttataatttctgttcttttacatttgccgaggagtgctttacttctaactatgtggtcaattttggaataagtgtgatgtggtgctgagaagaatgtatgttctgttgatctggggtggagagttctgtagatgtctattaggtccacttgctgcagagctgagttcaatttctggatatcgttgttaactttctgtctcattgatctgtctaatgttgacagtggggtgttaaagtcttccattattactgtgtgggagtctctttgtaggtctctaaggacttgctttatgaatttgggtgctcctgtattgggtgcatatatattcaggatagttagctcttcttgttgaattgatccctttaccatcatgtaatggcctttgtctcttctgatctttgttggtttaaagtctgttttatcagagactaggattgcaacccctgcttttttttgttttccatttgcttggtagatcttcctccatccctttattttgagcctatgtgtgtctctgcacatgagatgggtctcctgaatacagcacactgatgggtcttgactctgtatccaatttgccagtctgtgtcttttaattggagcatttagcccatttacatttaaggttaatattgttatgtgtgaatttgatcctgtcattatgatgttagctggttattttgcccgttagttgatgcagtttcttcctagcatcgatggtctttacaatttggcatgtttttcaatggctggtaccggttgttcctttccatgtttagtgcttccttcaggagctcttgtagggcaggcctggtggtgacaaaatctctcagcatttgcttgtctgtaaaggattttatttctccttcacttatgaagcttagtttggctggatatgaaattctgagttgaaagttcttttctttaagaatgttgaatatcggcccccactctcttctgacttgtagagtttctgccgagagatccgctgttagtctgatgggttaccctttgtaggtaacctgacctttctctctggctgcccttaacattttttctttcatttcaaccttggtgaatctgacaattatgtgtcttggagttgctcttctcgaggagtatctttgtggcgttctctgtatttcctgaatttgaatgttggcctgccttgctaggttggggaagttctcctggataatatcctgaagagtgttttccaacttggttccattctccctgtcactttcaggtacaccaatcagacgtagatttggtcttttcacatagtcccatattacttggaggctttgttcgtttctttttactcttttttctctaaacttctcttttcgcttcatttcattcatttgatcttcaatcactgataccctttcttccacttgatcaaatcggctactgaagcttgtacatgcgtcacatagttctcgtgccatggttttcagctccatcaggtcttttaaggacttctctacgctgtttattctagttagccatttgtctaatttttttttcaaggtttttagtttctttgcaatgggctcgaa

SEQ ID NO: 12029 - DNA, 4885 bp, Homo sapiens
tttttttttttttatactttaagttctagggtacatgtgcacaacgtgcaagtttgttacatatgtatacatgtgccatgttggtgtgctgcacccattaactcgacatttacattaggtgtttctcctaatgctatccctcccccctccccacgacaggccccagtgtgtgatgctccccaccctgtgtccaagtgtgctcattgttcaattcccatctatgagtgagaacatgcagtgtttggttttctgtccttgcaacagtttgctcagaatgatggtttccagcttcatccatgtccctacaaaggacatgaactcatcattttttatggctgcatagtattccatggtgtatatgcgccacattttcttaatccagtctatcattgatggacatttgggttggttccaagtctttgctattgtgaatagtgccacaataaacatacatgtgcatgtgtctttatagtagcatgatttataatcctttgggtatatacgcagtaatgggattgctgggtcaaatggtatttctagttctagatccttgaggaattgccacactgtcttccacaatggttgaactagtttacacttccacccacagtgtaaaagcattcttatttctccacatcctctccagcacctgttgtttcctgactttgtgatgattgccattctaactggtgtgagatggtatctcattgtggttttgatttgcatttctctgatggccagtgatgatgagcattttttcctgtgtctgttggctgcataaatgtcttactgtgagaagtgtctgttgatatccttcacccactttttgatgggattgattttttcttgtaaatttgtttaagttctttgtagattctggatattagccctttgtcagatgggaagattgtaaaaattttctcccattctgtaggctgcctgttcactttgatggtagtttcttttgctgtgcagaagctctttagtttaattagatcccatttgtctattttggcttttgctgctattgcttttggtgttttagtcatgaagcccttgcccatgcctatgtccctgaatggtattgcctaggttttcttctagggtttttatggttttaggtctcacatttatgtctttaatacatcttgaattaatttttgtataacatgtaaggaagggatccagtttcagctttctacatatggctagccagttttcccagcaccatttattaaatagggaatcctttccccatttcttgtttttgtcaggtttgtcaaagatcagatagttgtagatgtgtggtattatttctgaaggctctgttctgttccattggtctatatctcccttttggtaccagtaccatgctgttttggttactgtagccttatagtatagtttgaagtcaggtagcatgatgcctccagctttgttcttttggcttaggattgtcttggcaatgcaggctcttttttggctccatatgaactttaaagtatttttttccaattctgtgaagagtcattggtagcttgatggggatggcatggaatttataaatttccttgggcagtatggccattttcacaatattgattcttcctatccatgagcatggaatgttcttccatttgtttgtgtcctcttttatttcattgagcagtggtttgtagttctccttgaagaggtccttcacatcccttgtaagttggattcctaggtattttattctctttgaagcaactgtgaatgggagttcactcatgatttgcctctctgtttgtctcttattggtgtataggaatgcttgtgatttttgcacattgattttgtatcctgagactttgctgaatttgcttatcagcttaaggagattttgggctgagatgatggggttttctaaatatacaatcatctgcaaacagggacaatttgacttcctcttttcctaattgaataccctgtatttctttctcatgcctgattgccctggccagaacttccaacactatgttgaataggagtggtgagagagggcatccctcctcttgtgccagtttttaaagggaaagcttccagtttttgcctattcagtatggtattggctgtgggtttgtcatacatagctcttattattttgagttatgtcccaccaatacctagtttattgagagtttttagcatgaaggctgttgaattttgtcaaaggctttttctgcatctattgagataatcatgtggtttttgtctttggttctgtttataagatggattacatttattgattttcatatgttgaaccaaccttgcaccccagggatgaagccaacttgatcgtggtggataagctttttgatgtgctgctggattcggtttgccagtattttattgaggatttttgcatcgatgttcatcagggacattggcctaaaattctctttttttgttgtgtctgccagacttaggtatcaggatgatgctggccttataaaatgagttagggaggattccctctttttctatgattggaatagtttcagaaggaatggtaccagctcctctttgtacctctggtagaatttggctgtgaatctgtctggccctggaatttttttggttggtaggctattaattattgcctcaatttcagaacctgttattggtctattcagggattcaacttcttcctggtttagtcttgggagagtgtatgtgtccaggaatttatccatttcttctagattttctagtttatttgcgtagaggtgttcataatattctctgatggtagtttgtatttctgtgggatcggtggtgatataccctttatcattttttattgcatctatttgattcttctctcttttcttattagtcttgctagcggtctatcaattttgttgatcctttcaaaaaaccagctcctggattctttgatttcttgaagggttttttgtgtctctatctccttcagttctgctatgatcttagttatttattgccttctgctagcttttgaatgtgtttgctcttgcttctctagttcttttaattgtgatgttagggtgtcaattttagatctttcctgctttctcttgtgggcatttagtgcataaatttacttctacacactgctttaaatgtgtcccagagattctggtatgtcatgtctttgttctcgttggtttcaaagaacatctttatttctgccttcatttccttatttacccagtagtaattcaggagcaggttgttcagtttccatgtagttgagtagttttgagtgagtttcttaatcctgagttctaatttgattgcactgtggtctgagagacagtttgttataatttctgttcttttacatttgctgaggagagctttacttccaaccatgtggtcaattttggaatgagtgcaatgtggtgctgagaagaatgtatattctgttgatttgggatggagagttctgtagatgtctattaggtctgcttggtgtagagctgagttcaagtcctggatatttttattaactttctgcctcgttgatctgtctaatgttgacagtagggtgttaaagtctcccaatattattgtttgggagtctaagtctctttataggtctctaaggacttgctttatgaatctgggtgctcctgtattgggtgcatatatatttaggatagttagcacttcttgttgaattgatccctttaccattatgtaatggccttctttgtctcttttgatctttgttggtttaaagtctcttttatcagagactaggattgcaacccctgcttttttttgttttccatttgcttggtagatcttcctccatccctttattttgagcctatgtgtgtctctgcatgtgagatgggtctcctgaatacagcacactgatgggtcttgatttatctgatttgctagtctgtgtcttttaattggggcatttagcccatttacatttaaggctaatattcttatgtgtgaatttgatcctgtcattatgatattagctggttattttgctcgttagttgatgcagtttcttcctagcctcgatggtctttacaatttggcatgtttttgcagtggctggtaccagttgttcctttccatgtttagtgcttccttcaggagctcttgtaaggcaggcctactggtgacaaaaatctctcagcatttgcttgtctgtaaaggattttatttctccttcacttatgaagcttagtttggctggatatgaaattctgggttgaaaattcttttctttaagaatgttgaatattggcccccactctcgtctggcttgtagagtttctgcagagagatccactattggtcggatgggcttccctttgtacgtaacctgacctttctctctggctgcgcttgacatttttttcttcatttcaaccttggtgaatctgacaattatgtgtcttggggttgctcttcacgaggagtatctttgtggcattctctgtgtttcctgaatttgaatgttggcctgccctgctaggttggggaagttctcctggataatatcctgcagagtgttttccaacttggttccattctccccgtcactttcaggtacaccaatcaaaagtagatttggtcttttcacatagtcccatatttcttggaggctttgtttgtctctttactcttttttctctaaacttctcttcttgcttcatttcattcatttgatcttcaatcactgacccccttcttccacttgatcgaatcggctactgaagcttgtgcatgtgtcacgtagttctcgtgccatggttttcagctccatcaggtcatttaaggtctcctctatgctgtttattctagttagccatttgtctaatcttttttc

SEQ ID NO: 12030 - DNA, 3593 bp, Homo sapiens
gtctaacatgtaagtctttaatccatcttgaattaatttttgtatataaggtgtaaggaagggatccagtttcaactttctacatatggctagccagttttcccagcaccatttattaaatagggaatcctttccccattgcttgtttttgtcaggtttgtcaaagatcacatagttgtagatgtgtggtattatttctgagggctctgttctgttccattgatctatgtctccgttttggtaccagtaccatgctgttttggttactgtagccttgtagtatagtttgaagtcaggtagcgtaatgcctccagctttgttcttttggcttaggattgacatggcgatgcgggctcttttttggttccatatgaactttaaggtagttttttccaattctgtgaagaaagtcattggtagcttgatggggatggcattgaatctataaattaccttgggcagtatggccattttcacgatattgattcttccaacccatgagcatggaatgttcttccatttgtttgtatcctcttttatttcattgagcagtggtttgtagttctccttgaagaggtccttcacatcccttgtaagttggattcctaggtattttattctctttgaagtaattgtgaatgggagttcactcatgatttggctctctgtttatctgttattggtatacaagaatgcttgcaatttttgcacattgattttgtatcctgagactttgctgaagttgcttatcagcttgaggagattttgggctgagacaatggggttttctagatatacagtcatgtcatctgcaaacagggacaatttgacttcctctttttctaattgaataccctttatttccttctcctgcctaattgccctggccagaacttccaacactacgttgaataggagtggtgagagagggcatccctgtcttgtgccagttttcaaagggaatgcttctagtttttgcccattcattatgatcttggctgtgggtttgtcatagatagctcttattattttgagatacatcccatcaatacctaatttattgagagtttttagcatgaagggttgttgaattttgtcaaaggccttttctgcatgtattgagataatcatgtggtttttgtctttggttctgtttatatgctggattatagttattgatttgcgtatattgaaccagccttgcatcccaggggtgaagcccacttgatcatggtggataagctttttgatgtgctgctggattcggtttgccagtattttattgaggatttttgcatcaatgttcatgaaggatattggcctaaaattctcttttttggttgtgtctctgccaggctttggtatcagaatgatgctggcctcataaaatgagttagggaggattccctctatttctattgattgaaatagtttcagaaggaatggtaccagttcctccttgtacctctggtagaattcggctgtgtatccatctggtcctggactctttttggttggtaacctattgattattgccacaatttcagagcttgttattggtgtattcagagattcaacttcttcctggtttagtcttgggagggtgtatgtgtcgaggaatttatccatttcttctagattttctagtttatttgcgtaaaggtgtttgtagtattctctgatggtactttgtatttctgtgggatcggtggtgatatcccctttatcattttttattgcatctatttgattcttctctcttttcttctttattagtcttgctagcggtctatcaattttgttgatctttttaaaaaaccagctcctggattcattgattttttgaagggttttttgtgtctctatttccttcagttctgctctgattttagttatttcttgccttctgctagcttttgaatgtgtttactcttgcttttctagttcttttaattgtgatgttatggtgccaattttggatctttcctgctctctcttgtgagcatttggtgctctaaatttccctctacacactgctttgaatgtgtcccagagattctggtatgttgtgtctttgttctcattggtttcaaagaacatctttatttctgccttcttttcgttgtgtacccagtagtcattcaggagcacattgttcagtttccatgtagttgagcggttttgagtgagtttcttaatcctgagttctagtttgattgcactgtggtctgagagacagtttattataatttctgttcttttacatttgctgaggagagctttacttccaagtatgtggtcaattttggaataggtgtggtgtggtgctgaaaaaaatgtatattctgttgatttggggtggagagttctgtagatgtctattagttccgcttggtgcagagctgagttcaattcctgggtatccttattaactttctgtctcattgatctatctaatgttgacagtggggtgttaaagtctcccattattattgtgtgggagtctaagtctctttgtaggtcactcaggacttgctttatgaatctgggttctcctgtattgggtgcatatatatttaggatagttagctcttcttgttgaattgatccctttaccattatgtaatggccttctttgtctcttttgatctttgttggtttaaaatctgttctatcagagagtaggattgcaacccctgcctttttttgttttccatttgcttggtagatcttcctccatccctttattttgagcctatgtgtgtctctgcacttgagatgggtttcctgaatacagcacactgatgggtcttgactccttatccaatttgccagtctgtgtcttttaattggagcatttagcccatttacatttaaagttaatattgttatgtgtgaatttgatcctgtcattatgatgttagctggttgttttgctcgttagttgatgcagtttcttcctagcctcaatggtctttacattttggcatgtttttgcagtggctgttaccacttgttcctttccatgtttagcgctcccttcaggaactcttttagggcaggcctggtgttgacaaaatctctcagcatttgcttgtctgtaaagtattttatttctccttcacttatgaagcttagtttggctggatatgaaattctgggttgaaaattgttttctttaagaatgttgaatattgtcccccactctcttctggcttgtagggtttctgccaagagatccgctgttagtctgatgggcttccctttgtgggtaacccgacctttctctttggctgcccttaacattttttccttcatttcaactttggtgaatctgacaattatgtgtcttggagttgctcttctcgaggagtatctttctggcattctctgtatttcttgaatctgaatgttggcctgtcttgctagattggggaagttctcctggataatatcctgcagagtgttttccaacttggttctgttctccctgtcactttcagttacaccaatcagatgtagatagtcccatatttcacatagtcccatatttcttggaggctttgttcatttctttttattctttttattct

SEQ ID NO: 12031 - DNA, 4783 bp, Homo sapiens
cttcctgtgtccaagtgttctcattgttcaattcccacctatgagtgagaacatgcggtgtttggtttttttgtccttgcgatagtttcctgagaatgatggtttccagcttcatccatgtccctccaaagacatgaactcatccttttttatggctgcatagttttccatggtgtatatgtgccacattttcttaatccagtctatcattgatggacatttgggttggttccaagtctttgctattgtgaatagtgccacaataaacatacgtgtgcatgtgtctttatagcagcatgatttataatcctttgggtatatacccagtaatgggatggctgggtcaaatggtatttctagttctagatccctgaggaatcgccacactgtcttccacaatggttgaactagtttacagtcccaccaacagtgtaaaagtgttcctatttctccacatcctctccagcacctgctgtttcctgactttttaatgatcgccattctaactggtgtaagatagtatttaattgtggttttgatttgcatttctctgatggccagtgatgatgagcattttttcatgtgtctgttgagtgcataaatgtcttcttttgagaagggtttgttcatatcctttgcccacttgttgatggggttgtttgtttttttcttgtaaatttgtttgagttctttgtagattctggatattagccctttctcagatgagtagattgcaaaaattttctcccattctgtaggttgcctgttcactctgacggtagtttcttttgctgtgcagaagctcttgagtttaattagatcccatttgtcaattttggctttggttgccatcgcttatggtgttttagacatgaagtccttgcccatgcctatgtcctgaatggtattgcctaggttttcttctagtgtttttatggttttaggtctaggatgtaagtctttaatccatcttgaatgaatttttgtataaggtgtaaggaagggatccagtttcagctttctacatatggcaagccagttttcccagcaccatttgttaaatagggaattgtttccccatttcttgcttttgtcaggtttgtcaaagatcagatagttgtagacgtgtggtattatttctgagggttctgttctgttccattggtctatatgtctgttttggtaccagtactatgctgttttggttactgtagccttgtagtatagtttgaagtcaggtagcgtgatgcctccagctttgttctttgggcttaggattgacttggcaatgcgggctcttttttggctccatatgaactttaaagtatttttttccaattctgtgaagaaactcattggaagcttgatggggatggcattgaatctataaattaccttgggcagtatggccattttcatgatatcgattcttcctatccatgagcatggaatgttcttccatttgtttgtatcctcttttattttgttgagcagtggtttgcagttctccttgaagagttccttcacatcccttgtaagttggattcctaggtattttattctctttgaagcaattgtgaatgggagttcactcatgatttggctctctgtttgtctgttattggtgtataagaatgcctgtgatttttgcacattgattttgtatcctgagactttgctgaagttgcttatcagcttaaggagattttgggctgagacgatggggttttatagatatgcaatcatgtcatctgcaaacagggacaatttgacttcctcatttcctaattgaataccctttatttctctctcctgcctgattgccctggccagaacttccaacactatgttgaataggagtggtgagagagggcatccctgtcttgtgccagttttcaaagggaatgcttccagtttttgcccattcagtatgatattggctgtgggtttgtcataaatagctcttattattttgagatacttcccaacaatacctaatttattgagagtttttagcatgaagggttgttgaattttgtcaaaggccttttctgcatctattgagataatcatatggtttttgtctttggttctgtttatatggtggattacatttattgatttgcgtatgttgaaccagccttgcatcccagggatgaagcccacttgatcatggtggataagctttttgatgtgctgctggatttggtttgccagtattttattgaggatttttgcatcgatgttcatcagagatattggtctaaaattctctatttttgttgtgtctctgccaggctttggtatcaggatgatgctggcctcatcaaatgagttagggaggattctctctttttctatggattgaaatagtttcagaaggaatgataccagctcctccttgtacctctggtagatttcggccttgaatccatctggccctggactttttttggttggtaagctattaattattgcctcaatttcagagcctgttattggtctattcatagattcaacttcttcctgttttagtcttgggagggtgtatgtgtcaaggaatttatccatttcttctagattttctagtttatttgcatagagttgtttatagtattctctgatggtagtttgtatttctgtgggatcggtgatgatatcccctatatcattttttattgcgtctatttgattcttctcttttttcttctttattagtcttgctaatggtctatcaattgtgttgatcttatcaaaaaaccagctcctggattcattgatttttgaagggttttttgtgtctctatctccttcagttctgctctgatcttagttatttcttgccttctgctagcttttgaatgtgtttgctcttgcttctctagttcttttaattgtgatgttggggtgtcaattttaaatctttcctgctttctcttgtgggcatttagtgctataaatttccctttacacactgctttgaatgtgtcccagagattctggtatgttgtgtctttgttctcattggtttcaaagaacatctttatttctgccttcatttcattatgtacccagtagtcattcaggagcaggttgttcagtttccatgtagttgtgtggttttgagtgagtttcttaatcctgagttctagtttgattgcattgtggtctgagagacagtttgttataatttctgttcttttacatttgctgaggagtgctttacttccaactatgtggtcaattttggaataagtgtggtgtggtgctgagaagaatgtatattctgttgatttggggtggagagttctgtagatgtctattaggtccacttggtgcagagctgagttcaattcttggatatccctgttaactttctgtctcgttgatctgtctcatgttgacagtggggtgttaaagtctcccattattattgtgtgggagtctaagtctctttgcaggtctctgaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcttttctttttttgttttccatttgcttggtagatcttcctccatccctttattttgagcctatgtgtgtctctgcacgtgagatgggtttcctgaatacagcacactgatgggttacttgactctttatccgatttgccagtctgtgtcttttaattggagcatttagcccatttacatttaaggttaatattgttatatgtgaatttgatcctgtcattatgatgttagctggttattttgctcgttagttgatgcagtttcttcctagcatccatggtctttacaatttggcatgtttttgcagtggctggtaccggttgttcctttccatgtttagtgctaccttcaggagctcttttagggcaggcctggtggtgacaaaatctctcagcatttgcttgtctgtaaaggattttatttctccttcacttatgaagcttagtttggctggatatgaaattctgggttgaaaattcttttctttaagaatgttgaatattggcccccactctcttctggcttgtagagtttctgccaagagatcagctgttagtctgatgggcttccctttgtgggtaacccgacctttctctctggctgcccttaacattttttccttcatttcaactttggtgaatctgacaattatgtgtcttggagttgctcttcttgaggagtatctttgtggcattctctgtatttactgaatgtgaatgttggcctgccttgctaggttggggaagttctcctggataatatcctgcagagtgttttccaacttggttccattctccccgtcactttcaggtacaccaatcaggtgtagatttggtcttttcacatagtcccatatttcttggaggctttgttcatttctttttattcttttttctctaaatttctcttctcacttcatttcattcatttgatctttaatcactgataccctttctttcagttgatcgaatcagctactgaagcttgtgcatttgtcacgtagttcttgtgccatggttttcagctgcatcaggtcctttaaggacttcttttcattgattattctagttagccatttgtctaatcttttttcaaggtttttaacttctttgccatgggttcgaactgcctcctttagcttgg

SEQ ID NO: 12032 - DNA, 6631 bp, Homo sapiens
tttttttgtttttttttttttttttttttttttttttttttttttttttttttttacttgttatcgctgaattctacttttatttatttattttaattatactttaagttttagggtacatgtgcacaacgtgcaggttagttacatacgtatacgtgtgccatgttggtgtgctgcacccattaacttgtcatttaacattaggtatatctcctaatgctatccctcccccgtccccccaccccacaacaggccccggtgtgtgatgttccccttcctgtgtccatgtgttctcattgttcaattcccacctatgagtgagaacacgtggtgtttggttttttgtccttgtgatagtttgctgagaatgatggcttccagcttcatccatgtccctacaaaggacatgaactcatcattttttatgggtgcataaaaatatacattgtattccatggtgtatatgtgccacattttcttagtccagtctatcattcatggacatttagcttggttccaagtctttgctattgtgaatagtgccgcaataaacatacgtgtgcatgtgtctttatagcagcatgatttatagtcatttgggtatatacccagtaatgggatggctgggtgaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgtcttttggctgcataaatgtcttcttttgagaagtgtctgttcgtatccttcacccactttttgatggggttgtttgtttttttcttgtaaattcgtttaagttcattgtagattctggatattagtcctttgtcagatgagtagattgcaaaaattttctcccattctgtagtttgcctgatcactctgatggtagtttcttttgctgtgcagaagctctttagtttaattagatcccatttgtcaattttggcttttgttgccgttgcttttggtgttttagacatgaagtccttgcccatgcctatgtcctgaatggtattgcctaggttttcttctagggtttttatggttttaggtctaacatttaagtctttaatccatcttgaattaatttttgtataaggtgtaaggaagggatccagtttcacctttctacatatggctagccagttttcccagcaccatttattaaatagggaatcctttccccattgcttgtttttctcaggtttgtcaaagatcagatggttgtagataagtggcattatttctgaggactctgtttggttccgttggtctatatctctgttttggtaccagtaccatgctgttttggttactgtagccttgtagtatagtttgaagtcaggtagcgtgatgcctccagctttgttcttttggcttaggattgacttgaccatgtggtctcttttttggttccatatgaacttttaagtagttttttgcaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattgagcagtggtttgtagttctccttgaagaggtccttcacatcccttgtaagttggattcctaggtattttattgtctttgaagcaattgtgaatgggagttcactgatgatttggctctctgtttgtctgttattggtgtataggaatgcttgtgatttttgcagattgattttgtatcctgagactttgctgaagttgcctatcaggttaaggagatattgggctgagatgatggggttttctagatatacaatcatgtcatctgcaaacagggacaatttgacttcctcttttcctaaatgaataccctttatttccttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacatcccatcaatacctaatttattgagagtttttagcatgaagtgttgttgaattttgtcaaaggccttttctgcatctattgagataatcaggtggtttttgtctttggttctgtttatatgctggattatgtttattgatttgcatatgttgaaccagccttgcatcccagggatgaagcccacttgatcatggtggataagctttttgatgtgttgctggattcggtttgccagtattttattgaggatttttgcatcgatgttcatcagggatattggtctaaaattctcttttttttgttgtgtctctgcctggctttggtatcaggatgatgctggcctcataaaatgagttagggaggattccctctttttctattgattggaatagtttcagaaggaatggtacgagatcctcctgtgcctctggtagaattcagctgtaaatccatctggtcctggactttttttcggttggtaagctattaattcttgcctcaatttcagagcctgttattggtctattcagagattcaacttcttcctggtttagtcttgggaggttgtatgtgtcgaggaatttatccatttcttctagattttctagtttatttgcatagaggtgtttatagtattctctgatggtagtttgtatttctgtgggatcgttggtgataccccctttatcattttttattgcgtctatttgattcttctctcttttcttctttattagtcttgctagcagtctatccattttgttgatcttttcaaaaaagcagctcctagattcattgattttttgaaggtttttttgtgtctctatttccttcagttctgctctgatcttagttatttcttgccttctgctagcttttgaatgtgtttgctcttgctcctctagttcttttaattgcagagctagggtgtcaattttagatctttcctgctttctcttgtgggcatttagtgctataaatttccctctacacactgctttgaatgtgtcacagagattctggtatgttgtgtctttgttttcattggtttcaaagaacatctttatttctgccttcatttcgttttgtatccagtagtcattcaggagcaggttgttcagtttccatgtagttgagcggttttgactgagtttcttcttcttttttttgttttgcctatactttaatttacaaggccacataccgaatgactgaaatgtacataaacattcttttatgatagaccagaacctctacattatcatgatttagaaaaagaaaacacatgcaaaatagtgttaagagattttctggcctgaaattacaagactaagtatgtgtgtacatgcgtgtgtacatatatttaaatcattttattctcatttaatccttttggctgaactttattcatatattatctgcccttcttcttatagtctctctcatgaaagacatcattatccagtcattgaagccaaacttccttcaccagcccccaatctctagacatcaagggttaacaagacatcttcctaaatttctctggaattaagctcttctctgttagaatttcctttccaagtccatttcttcataaatctggcacgtgagatttgaattgctctgccgcagttttctcttctttagtcagtggtgacagatccaggtctgtttgcttctgtagtttttgtatcacattcatagttttagtcataccagcacaaatgcggctcttagtctctttctgctcaacagcaactggtttaaagcgggcatacaaagtttgatattgagactttatcactgacaattcctttaagagtgtaactggatttttctcacttgctgaatcaggatgattagtcttgatttcatattccagcctgtattgaatgtaatccagatcagactcagctttctggaacatcagttccagcttatcgacctccgcctccatgttaatagttgacattcctccgactgagtttcttaatcctgagttctagtttgattgcactgtggtctgagagacagtttgttctaatttctgttcttttacatttgctgaggagtgctttacttccaactatgtggtcagtttttgaataagtgcggtgtggtgctgagaagaatgtatattctgttgatttggggtggagagttctgtagatgtctattaggtctgcttggtgcagagctgagttcaattcctcgatatctttgttaactttctgtcttgttgatctgtctaatgttgacagtggggtgttaaattctcccattattgttgtgtgggagtctaagtctctttgtaggtctctaaggacttgctttatgaatccgggtgctcctgtattgggtgcatatatatttaggatagttagctcttcttgttgaattaatccctttaccattatgtaatggccttctttgtctcttttgatctttgttggtttaaagtctgttttatccaagactaggattgcaacccctgcctttttttgttttccatttgcttggtagatcttcctccatccctttattttgagcctatatgtgtctctgcatgtgagatgggtttcctgaatacagcacactgatgggtcttgactctttatccaatttgccagtctgtgtcttttaattggagcatttagcccgtttacatttaaggttaatattgttatgtgtgaatttgatcttgtcattatgatgttagctggttattttgcttgttagttgatgcagtttcttcctagccttgatggtctttacaatttggcatgtttttgcagtggttggtaccggttgttcctttccatgtttagtgcttccttcaggagctcttttagggcaggcctgggggtgacaaaatctctcagcatttgcttgtctgtaaaggattttatttctccttcacttaagaagcttagtttggctgaatatgaaattctgggttgaaaattcttttctttaagaatgttgaatactggtccccactctcttctggcttgtagagtttgtgccgagagatcagctgttagtctgatgggcttccctttgtgggtaacctgacctgtctctctggctgcccttaacattttttccttcatttcaactttggtgaatctgacaattatgtgtcttggagttgctcttctcaaggagtggcattctctgtatttcctgaatctgaatgttggcctgccttgctagattggggaagttctcctggataatatcctgcagagtgttttccaacttggttccattctccccatcattttcagatacaccaatcagacgtaaatttggtcttttcacatagtcccatatttcttggaggctttgttcgtttctttttattcttttttctctaaacttctcttctcacttcatttcatttatttgatcttccatcactgataccatttattccagttgatcaaatcggctactgaggcttctgcattcgtcacgtagttctcgtgccatggttttcagctccatcaggtcctttaaggacttctctgcattggttattctagttagccatttgtctaatcttttttcaaggtttttaacttctttgccgtggtttcgaacttcctcctgtagcttggagtagtttgattgtctgaagtcttcttctctcaagtcgtcaaagtcattctccatccagctttgttctgttgctggtgaggagctgcattactttggaggaggagaggcgctctgatttttagattttccagtttttctgctcgttttctccccatctttgtggttttatctacctttggtctttgatgatggtgacgtacagatggggttttggtgtggatgtcctttctgtttgttagttttccttctaacagtcaggaccctcagctgcaggtctgttggagtttgctggaggtccactccagaccctgtttgcctgggtatcagcagcagaggctgcagaacagtggatattggtgaacagcaaatgttgctgcctgatcgttcctctggaagttttgtgtcagaggagtacctggccgtgtgaggtgtcagtctgcccctactggggggtgcctcccagttaggctagtcggggatcagggacccacttgaggcagtctgtccgttctcagatctcaagctgtgtgctgggagaaccactactctattcagagctgtcagacagggacatttaagtctgcagaagattctgctgccttttgtttggctatgtcctgcccccagaggtggagtctacagaggcaggcagccctccttgagctgcagtgggctccacacagtttgagcttcccggctgctttgtttacctactcaagccttggcaatggcgggcacac

SEQ ID NO: 12033 - DNA, 3561 bp, Homo sapiens
gactaatgtttaagtctttaatccatcttgaattaatttttctataaggtgtaaggaagggatccagtttcagctttctacatatggctagccagttttcccagcaccatttattaaatagggaatcctttccccattgcttgtttttttcaggtctgtcaaagatcagatagttgtagatatgcggcgttatttctgagggctctgttctgttccattgatctatatctctgttatggtaccagtaccatgctgttttggttactgtagccttgtagtatagtttgaagtcaggtagcatgatgcctccagcttttttcttttggcttaggattgacatggcgatgcgggctcttttttggttccatatgaactttaaagtagttttttccaattctctgaagaaagtcattggtagcttgatggggatggcattgaatctataatttcacgatattgattattcctacccatgagcatggaatgttcttccatttgtttatatcctcttttatttccttgagcagtggtttgtagttctccttgaagaggtccttcacgtcccttgtaagttggattcctaggtattttattctctttgaagcaattgtgaatgggagttcactcatgatttggctctctgtttgtctgttattggtgtttaagaatgcttgtgatttttgtacattgattttgtatcctgagactttcctgaagttgctttccagcttaaggagattttgggctgagacagtggggttttctagatatacaatcatgtcatctgcaaacagggacaatttgacttcctcttttcctaattgaatacactttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagacagctcttattattttgagatatgtcccatcaatacctaatttattgagagtttttagcatgaagcgttgttggattttgtcaaaggccttttctgcatctattgagataatcatgcggtttttgtctttggttctctttatatgctggattacatttattgatttgtgtatattgaaccagccttgaatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccagctttggtatcaggatgatgctgccctcataaaatgagttagggaggattccctctttttctattgattggaatagtttcagaaggaatggtaccagttcccccttgtacctctggtagaattcggctgtgaatccatctggtcctggactctttttggttggtaagctattgattattgccacaatttcagagcctgttattggtctattcagagattcaacttcttcctggtttagtgttgggagaggtatgtgtcgaggaatttatccatttcttctagattttctagtttatttgcatagaggtgtttgtagtattctctgatggtagtttgtatttctgtgggatcggtgttgatatcctctttatcattttttattgcgtctatttgattcttctctcttttcttctttattagtgttgctagtggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttctcgttggtttcaaagaacatctttatttctgccttcatttcgttaggtacccagtagtcattcagaagcaggttgttcagtttccatgtagttgaatgcttttgagtgagtttcttaatcctgagttctagtttgattgcactgtggtctgagagactgttataatttctgttcttttacttttgttgaggagagctttacttccaagtatgtggtcaattttggaataggtatggtgtggtgctgaaaaaaatgtatattctattgatttggggtggagagttccgtagatgtctattacgtccgcttggtgcagagctgagttcaattcctgggtatccttgttaactttctgtctcgttgatctgtctaatgttgacagtggggtgttaaagtctcccattattactgcgtgggagtctaagtctctttgtaggtcactcaggacttgctttatgaatttgggtgctcctgtattaggtgcatatatatttaggatagttagctcttcttgttgaattgatccctttaccattatgtaatggccttctttgtctcttttgacctttgttggtttaaagtctgttttatcagagactaggattgcaacccctgcctttttttgttttccatttgcttggtagatcttcctccatccttttattttgagcctatgtgtgtctctgcatgtgagatgggtttcctgaatacagcacactgatgggtcttgactctttatccaatttgccagtctgtgtcttttaattggagcatttagtccatttacatttaaagttaatattgttatgtgtgaatctgatcctgtcattatgatgttagctggttattttgctcgttagttgatgcagtttcttcctagcctcgatggtctttacaatttggcatgattttgcagtggctggtaccagttgttcctttccatgtttagtgcttccttcaggagctcttttagggcaggtctggtggtgacaaaatctctcagcatttgcttgtctgtaaaggattttatttctccttcacttatgaagcttagtttggctggatatgaaattctgggttgaaaattcttttctttaagaatgttgaatattggtccccactcccttgtggcttgtagagtttctgccgagagatccgctattagtctgatgggcttccctttgtgggtaacccgacctttctctctggctgcccttaacattttttccttcatttcaacattggtgaatctgacaattatgtgtcttggagttgctcttcttgaggagtatctttatggcgttccctgtatttcctgaatctgaatgttggcctgccttgctagattggggaacttctcctggataatatcctacagagtgtttttcaacttggttccattctccccgtcactttcaggtacaccattcagacatagatttggtcttttcacatagtcccatatttcttggaggctttgttcatttctttttattcttttttctct

SEQ ID NO: 12034 - DNA, 326 bp, Homo sapiens
ttttttttgctttccatttgcttggtagatcttcctccatccctttattttgagcctatgtgtgtctctgcacatgagatgggtctcctgaatatagcacactgataggtcttgactctttatcccatttgccagtctgtgtcttttaattggagcatttagcccatttacatttaagtttaatattgttatgtgtgaatttgatcctgtcattatgatgttagctggttattttgctcgttagttgatgcagtttcttcctagcatcaatggtctttacaatttggcatgtttttgcagcagctggtactggttgttcatttccc

SEQ ID NO: 12035 - DNA, 82553 bp, Homo sapiens
gtctatcaattttgttgatcctttcaaaaaaccagctcctggattcactgatattttgaagggttttttctgtctctatctccttcagttctgctctgatcttagtaatttcttgccttctgctagcttttgaatgtgtttgctcttgcttctctagttcttttaattgtgatgttagggtgtcaattttagatctttcctgctttctcttgtgggcatgtagtgctataaatttcgctctacacactgctttaaatgtgtcccagagattctggtatgttctgtctttgttctcattggtttcaaagaacatctttatttctgccttcattttgttatgtaccctgtagtcattaaggagcaggttgtccagtttccatgtagttgagtggttttgagtgagtttcttaatcctgagttctagtttgattgcactgtagtctgagagacagtttgtatgccttcaccctaaagaggcctagaagagctgtggcaagatgagggcgtttatagccctatcttatccatatgaacaggcacccctcatgcatccatttataggctctccacaagggtcgcattccattcccagaattatgaacatctgcttttctgagataggaatcttggtgatgtgaaacctccctgactgcacatccattcataggctctctgcagggggaagcacattacacactgttggctcattctggcagtccaacctggcattgtctttacacaatcctgcatgcaattttgtacttacaattatcagaagcatttcatcttttattccatagcaatagtttcagggggtctccctacatctcctcattttctctgatttaaatgaaccatagcaatcatagcttggcgctgatcatgattggattgaataatattttttccaattttacacatgaacaataaaccaatagcacaaattatacacagaacaaaattaccgatagtggatcctcccaaagattttactcattgaatggggttgagattagataacccctcagagataccatctaaaacttcatcactgggtaaagaagttaagtgtgcttgagaggcctcaaaaatcttttcttttagcttgcttatgtctaaactcaaattatcttcacttccttgtaaatggcgttttactgattcccaattgtgaacagactcattatattggaacggagctatacaaaaatcagaaatattccaatcacattgcatttgtaatccgtgttctaaactcttaattctatctcccatccatataatagtttgtcttagatcattaatttgattggccaatttttgatcaatacctgactgagaattccacattcaaatagaatttttttgccatttatccgcaaaatgagcagtttgaatagattgatgtaatgcaactccagcagtagcagcagtcaccgtaacagcaatcaagcccattattactgcaattaatgtaaaaataaatcgtttactccttttaagaattttctttagaatattattaataacatcgatagaagaggaagatttccaaggcctatgtaaggctacagggagccaactaccttctctggctctgactattaaaatactatgatattgattaaaggatgagtcaatacaagtatacaagtaacaattaacacaggtaattatgttggtttttgaactaatatgcatctttcctactaataacatatatggtggtttaacacaacttttaagtggtatagttttgttggactccatatagatagtatatatattttgggatggtactcttttttgtgaatgtggggtggggggaataggttgtatgagaggtggcagggggacattagcaacaggggggtataagtcctcataatctttactgtcccatctttgaattgaccttttgatgattgccatagtgatatttttggctgtgtggaaatagtagtgtaaatcaatctgttgtcttagttttcaaggtgacaaggtggatttacttataaccctttctccagcccaaactctcataccaatcatagctatggttaatctccataattctgaatgttcaggtcctaagtggggaacaacaagccttggctttggaggggcaatccctgcccctttccactttaaaggaaaaaaggagttaaatctatgatataatagggaagggttgtcactacttttttgataagtaatatcatagagaaaatgttgacaatctctgtggccttgagagcaatcattagtaatatgacctttaggagcccagtcaacaatggtgtagtgagaagaattaaataacacagttccttctgaactaacacaatccttccatattaatttgtcagcatttgaagacaagttgagaggacacacaggtcctaaaggcttatattgggatgtgtgaatataatcagcgattcctattttgatctgtcttagaggttttaatgagagccctgataccaagtgtcctaaaggagggacagagtgaccagatggtagtgtgacctccaaggtttgaatatctaatgagaaacatccattagtgggtctcaggcacaaaggtggatacctaaaacctaaagtgatattgaaaggggttccttcttctgaaggttgggcaggacaacgatcatctacagaaccaggcatccaaatactatcattaacatagacctcagtaggagcgtccatccatgtcatggctcgaataagaggaggaaaaggaatataggcccaatatgtatagtttttaacagtctatagagtgacagagggtagaaggagcaatgtcatcaggaggaggcagaggttgagctggacctggatcgctggagacaagttgttcaggatggctgactggattgtctgttgtaaaggagttagcatggtcattttcttcttttttgacaattggatgtgttagttgtttcctgctgtggcattttttcagcaaatttctctgtctcgttgttgcatgcatcttcaggacacaatttcaggtgtctagcagtaatctaaacaggagattgatgttcacctggggaaacacaagcgtagactcttccccacattaaaatagaaacttttgaccatatattagattgaacatctttccaccatacttcccttccttggtttaccatgggacggttaccagagaaatgtttttcgacagcagtaacagaactagatttaggaatattaagaaaatttaatgtgagcaatgccaagtttagttgtatgtgaggggtagactccttatccccctctttttgtttaagtaattgtaattttaaagttctgttacttctttctacaatagcttggccttgtgggttataaggaataccagtaatatgtttaatatgccactgatcaagaaaatttttaaaagctttactgcaataggctggaccattgtctgttttgagctcactaggaattcccataaccgcaaaacatgaaaacatatgttttttaacataagaagtggcttctctggtttgacaggtagcccagatgaaattggaaaaggtgtcaactgtgacatgcacataagctaattttccaaaagatgggtgccagatattgcgggatctggccagcaaaccacaatgcaatggggctctttcttttgttcccaggcagatcagcaggtcaaaaaataatagacacacacaagatagtgaaagctggatccaggggggtcaccaccttctggtcccacggtgccaccaatgcactagatataccagcatttattattaagtttagtgagggtgggggtaggttagtgagggatttagggtcatttgattgtgtgtgtgagatggtcacatggggatgaagtaattctttaacataacatctgtatgcagaagtacagtatacagagataagaatttacaatatagtgtgtgcatcagtaatttctaacagagccttaaaacagaaacacagtcttttcataacctatgattagcaagatattaatcagcagtaacagttgcagcaaaagctggttacaaacaatccatagaaacaggacgtgaagctagacaaccggttagaccagaaattctcagaaggaagtatgccctaaagaggcctagaagagccatggcaagatgagggtgtttatagccctatcttatgcatatggacaggtgcacctcatgcatccgtttataggctctccacaagggtcacattccattcccagagctatgaacatctgcttttctgggataggaatcttagtgatgtgaaacctccctgactgcacatccattcataggctctctgcagggggaagcacatcacgcatgttggctcattctggcagtccagcctggcattgtccttacacaatcctgcatgcaattttgtacttacaataatcaggagcatttcatcttttattccatagcaatagtttcaaggggtctccctacataaggtgaggcttttcaattactctttctcttctacaggagtaaaaacatcaacttagtaaaattgtcctttattgtatccatgaatacttaaactattgccctgcaaataaacattggaattaactataaaaccaggttttgttttgcaatgcaggtaaatttccatggcctgtttcttaagattaagtaaatatttacacaggcatattctgtaagtcctgacactgtttgtctcagagaaaaaggcctgtggtagaataaaacataaaatgctttttttttgggggtgttgttttacttgtacccaaatttgctgaattgtaaacatgggctcttttcctatttgaaatggagtttgcctgaaggatggtggcagccctagtatttccagacttttctaaaatggtgttaatttagttcaaaaaacacttatcaatctctgtagatgtgccccacccttttttggtttgaggaaacaaatccacataggtaaggtttatgccttgctgggtgctctaatcctcaccctctttctatagctggcagagtcaagtttcaaatttacagttaatctccaaagacatcactctttactttttaaaaccttgtttttaatggagacattaaggtatactttgtataggtggaatgcaggattgtaagtctacagtttgttaaattctgataaatgtatacccttacataacttacaccatcatcaagatacagaatatttccatgacctcagaaagttctgtgtttctttccagtcaatcttgcctcacctatttgaattttcatcactataggttaattgtgcctgctctagaatgttatgtaaatggaatcatataagatgaacctttgtgccaggcttctttcactcagcatcatgtttttgaaaatcatccatgctgtcgcatgtattggtagttcattattgcaaaattgtattcaattgtatgaatgaagcaattgttcatcctttctcctgatgttggacacatgggtgtttcgagtttggggccataataaattaagctgcaattaacattcttgtacaaagctttttgtggcacatgttttcatttcattatcttggataaattcctagaattgaaattgctggattatagaatggctatatggctgggggccatggctcactcctgtaatcccaacactttgggaggcgaaggcaggcagatcacttttagtcaggagtttgagaccagcctggtcaatgtggcgaaaccctgcctctactaaaaaatacaaaaattagccaggtgtggtggtgcatgcctatagtcccagctactcaggtgaggtaggagaaacctgggaggcagatgttgcagtgaattgagatcacgtcactgcactacatcctgggtggaaaaaaaaaaaaagagaaaaagaatggctatatgtataacttttaaggaaacttcctgttttccaaagagactgtataacattatacattcccactagcactgcatgacagtctggttgctccatatcctcaccaacacttaatgttgttggtctttttcatttcagctattctggggggtgggtgggtcaggaagcggtatcacaatgtgtttttaatttccatttccctgattattaatggtgttggccagattttcatttgcttatgggtcactgtatatcttcctttatgaactatcttttgcttaatttttaagggctatttgtcttttctttattgaatataagtcttttgtctgttatatgcactgtgaatattttctccaaggctgacttgcctatttattttttcctggtgtctttagtaaaaaaaggtttacattttgatgacatttgattcattagttttttccttttacagttagtgctttctgtgtatcatctaaaacatgtttgcctacctcaaaatcacagatatgatattttcttatagttttagcctttatactcaatttttagctgtatattcttagctcttaggcttatagctattatccatctcaaaatagttttggagtattgtgtaaagtaggggttgaggttcatatgcttgcaaacacgtgtccacttgttccagcaccattcattaaaaagacgttcctttccctactgaattgttaaacatggttgtctccacaaagctgagtaggcatagtctttgccttcaagggcttatagtcctcagaataacttttgtacaaaaatttattgctcacttttcacacaaaaatagcgcatttagtccaactattctgatgcatataaatactattcttttagaaaggataaagttcacttgtcccatccaagaatagttatataaagtaaactaattaatgcaaattagtgtaattgtagttgatgtattgccttgaaggaatgcagtgcaagtaacagtttaacttgagagagttctctttcctttgtcctcagaagaaaaaaacacttaaatatattcagttcttggatcactatttttattcaggttttaaaaattgtacctttgaccttagaagtttcaagctggagtaaatagacattttatttttgaaggatttaaaaatatttacataacttttatatataaccagtgaaattaattttttaaagaattttctttcaccattaatacattttttaataatttcaaagcatgaaataaattgttaacattgtatagctcttaaatctttccctgtgtaaacatttatactccagatattgctgctttaacatttttaaattttattttattttgaaagagtatctcactttgtcacccaggctggagtgcagtggcacaaaccatgactcctgggctcagttgatcccctcaactcagcctcctggtagctgggacaacaggcaagtgccgccaccatacctggctaatttttgtatttttgtattttttgtagagacaggatcttgccatgttgcacaggctggccttgaactcctgacctcaagcaatcttcccacctcagcctcacaaagtgttgggattacaggtgtgagccattgtgcctggacatttttttatttgtaaataatagcgcttatgactgtcactatgactctaaatgtttttagatggcaaagagatgagttatgatagaaagggtattagattaggatgctaaaaaaatctgggatgtaggattctaagccatttacaaagtcaagatagtaatatctttgtgctttggcttcctttggtgtaaaactggaagaataataccagattccagaggtggtagaaggcataacatggcggttaagagctttaaccactgtggtgggtggttaaaacctttaaccagcatggtggtttaagatcaggatactgaagttcaaatcctggctgtccaattgtgtgaccctgggcagattccttaagcttcctgaaccttggttttctcatctttaaaatggggatgataatagtactacctatcccatgcttttgtgaggattgagtcagtccatccttcagacgcttagtgccgttgttctttgatctcctgaatctctgcatgtcttgtgagcagaggcagacattgattaccttttattctgcactatcttttcaaggattaccttttattctgcactatcttttcaagagaacagctttggaggtagaaatatatctccttccagagcaaagggtaagcatgcttactacccagtataataaagatgtctcccttcagtgctgtgagcaatgagctccttcaaccctgagcaggagtcttgtgtcttctaccaacatccataaaacgatggcaggcaaacttgcccatatctgagaagtttcccagaatgtggacctctcagtgctaaaagcaagaaagtcctgggcaaactgaaatgagttgctggcaaactggaataggttggtcaccctaaagtagggtcaaatctcagagcctctgcagttttggagaagcacggtctttgccacataggaagcaatcaaaacttgtaacttgcattggtagtattacataaagaaaaaaatctggcataagttgaagtgttttcaaactatgaaatagtctatacatattatataactgaataaatttgatgtgctggcagatttagaaattaatcttaaaattaaataataaaatagctatgatgagcatagcttttatatataaattttgacacaaatttatagatataaaatataagtaaccttttatttcaatataaatgttttagtatcattctatttatgaattcttactatattaaggtgggtgtttacatgttcctttctaaatcttttgattgtttttatctaacttaaaatatcccctttcctcctcttaggcactatgataacatccctttgccctagaggacacttgccagtttgcatcctgtgctcttctctttgctggttttctctttcactcagggagcagacatgtgattggatcctcactttgagatttaattatttgtgagaggcaagccatatatttattcattgatttcttgcaaactacagctcacaatgctgacaataccaactgatagcaacatttttaatcttttataactttttgtagaggttattggcacattatacacaaactgacctgattaatttgttaaactgtgtgggtcacagtctaacaatctaattccaaatttagttctttataataacatttacatgtatataaggcaaaactggttaatgtgaaaaatacatgtacaaagtaaaataaactactgaaaggatttcagcctttggaagaggttcatgattccccctcccctccattttaataagtaaaatcagttatattgtttataaaaggagaattgactacttttagtctgtattgtagtcaaagttcataaactggcttcactttgtatgatattcacatttgaactgtgtatcaatgtagacatagaaaagtcacaaacttgaaagatttaaaaatagcactattaggagagtctagatccacagattatctttagcacctcaatcaatagagataaaaatgttacaaattaggcattctatcatattcttctgctttttactgagtgatgatggattttagtgttagtttgttgttccatctttggtttcttttagtctatgatcattatttttattttataggctgatagaacgttacggctgtaaaaagctctagcatttatctagtcaactctcccattttgccgatgagaaaacaggctcagcaaggttgcatcacccaggtcacagaattaactaatggttgagcctcatcaggaacccaggcacagtaaagttggtgagaatgtcatttcctattacttttaaaatttctctttcatatatttaaatctggccttcacatatcaggtcaactaatacgtacaataatgactgaatatctaatgtggtatctggtggtgaaatgggtttttgaatgtctatgaactgactacattattataggtgttttggtatctatcagatcatatctccaccattacttatgtacttgttttgaattctttcttagtagacatacagattgtattacatttggtttcttttgttaagatcaagaaaatatggactctagtatagggaatatgttttgtgtgaatgaaatttgttacttattcagagattgaaatgactatattttacaaaagattttaagtactatgtttagcaagaaaggttaaaggtcactatgaataaaccattgttcaaagtaatttccatgaattatgtaattaaaaattcatgcaactctatgaaagaactactgcattctatagatgaggctgagagaggttgttattatagatatctcatgggggtgaagcttgacagaaccaagatttcagcccagacgttaggttccagagccacacttaatcatagcaatataaaataaactagaaagtctgcttaccatataaaattggatgaaagagccaacagttaagagaatagaattcaaattaatattgattcaataactaggtatagattaacaagattaaatataagaggaaaagtttaaagttattcacccatggaagaaaagcatacttctaaaacaggagatgaaaaagtaaacttttaccaatcctggcagaaaaatacgagccagtcatgacttgctattataatttttaaaaagtataataaaaatatagaatttatgaactaacagttacatttccagcatggttagaatttgtaaaattgcagtttcgtcttttcttctcaatttataatccactccattagtaaaaagctataaccacaaatctctgtgacaaatttttttctatcttgggctttatatgaggctgttatggaacatcacccctaagatcctagagagacttttgcctgacagaatgctctaaagctccatcttagatccttctgagattttagcacaaaattttacagtcacgcctggattcgatgtttgctctgaagttctatcttaatttgagaattttggagaggccgagaataagaaacaattttttaattgaactcagcaaatttcgattcctttatatttaacagttcttctttaactgttgcctctcctttatattttattacctaaaacacaccagggagtagtttcaatactctttgtggaactatccttaggtagaccacattgcattgagtatgtttttgattttccatgtggaccacaggtgacagtgctgctaaactttttgctactcagtagcaaggatcctctttcctctagtttccagcaacattttcctcacttttcttcaagccctcactgatagccttcctgaaggcccaaaggcttctgctaacaattctgaaagtgagacatcctgaagatgcttgcaactggaagctgtccgctaaccgcattgcttgcagctgattctctcttgaagggagtattgagcaagtcaccttcatggtcaccatatatgacattcatgccaagccatgttcttgcttccaccagtctttctagacttctctactgccattgccagcatctcactctatatcttttgccacacaaagcttgcattacctcaatataccttcaaatcacataaaaccataacctattccaggttgagttaggtgtctctgagcaccctataatacttacaatactgtaagtactttcatagcacctttgaaagatctttattactgtattatggcattctatggtacctggattaaagtcttggctctgacactaattagctttgtgaccttggccaagttattgggtccctctgaggcctcatctttaacatagggatagatgaagtctgagcttcatctttaacataggaataataatatcattttctcataggattattgagattacatgtgataatacaggtaagtgcttagtacataatctagcacagagtgaatgctcaataagtattagccatgattattaatgatctgaactaatggacaggatatgttcaccgagattgctggattgcagagcaaaactgacataaaggtgactctgcttcatccctcaaagcacttctgtttatagggagacagtgtagatccctactttctcaagaggcaggatgtaaactgaagtcatcagaataatctttgtcaacctttcccaccttctgttttaggtctacaggacaatccttggttctgtgactgtcatatttccaaaatgattgagttgtcaaaggtcgttgaccctgctatagtgcttctggatccactgatgacttgcagtgaacctgagcgcctcacaggaattttgtttcagcgggctgaattggagcattgtctgaaaccatcagtgatgacctcagccaccaaaatcatgtctgctctgggcagtaatgttctactgcggtgtgatgccactggcttccccaccccacagatcacatggaccagatctgacagctcgccagttaattatacaggtattttcttaattcagccccatgatcaaaggagtttactaagctttgaagttaacatcatgtgttgtgtgatttgaaattagctagttaacactaataaaatatttcaagattattgggtgcaagggattttaaaggtacattttattcattagtattctcctcagtttatctaactacctagataaaattaaacaatctaaactctttttcttaggtagaatgaaacaatgcagtggatggatcaatggcagacaaggtctttgtcttgcttcatcaacttggatacagcttacttcaaaatgtacagcctttacaattttttaaaaagggccttttgctggttgggtgcggtggctcacacctgtaatcccagcactttgggaggccgaggtgggtggatcacctgaggtcaggagtttgagaccagcctggccaacatggcaaaactccgtctctactaaaaatacaaaaatcagctgggcttggtagtgtgcacctgtaatcccagctactcaggaggctgaggcaggagaattgcttgaatttggggggtggaggttgcagtgagttaagatcgcaccactgcagagtaagactgtcttaaaaaaaaaaaaaaaaaaaaaaggacggggggcttttgtacaagtctctcatttttgaataattatttaaataataaattacatggacaccttattatgaatcaaaaagtataatttttagaaatattgattatatagacttttcagatcctagtgtgacaatgtgtatgctttgtgcccaatttcaagagtgatattctgacaattaaagtgatatatttttaaaactcttcaatattaaactaaaattcaggttgaaataatgaaacctgatggaaataaagaagttaaggcctaatgttcctatatataggtagtcaatggtccacagtttcagctagtgagttaagttttgggctactgggctactgttctgcgcattattattattctttgaaaagcttctgaaatcaaggaagaatgaaaatatacccagatatcagagtttaggatagcaaaattctgattttttaaaaaactatatgttatttgcaaacaaaagaatccttgatttgccagtttacctaagttaaatataaaataaattattcggaatacaaatgatgactctgccatgccagaaaatgatctgctgtacctctggctatagagatatatgcattttattaccatgaaaacatataataagaaatacttaagtaagatcttatgaaaaacattccatagaatcacagtgacttaaaattgaaagggacctttgagattacttcgtctcatcctcttattttataaatgcagaaacagaagcctaaagatatgaattgacttatctacaaccaaacactgtttagtgggcaaaagtttctaaaacccaagtgtcctgattcccagccttttgtcttttaaaaatactattccctgtacagacctcacaacacctggcaggtcctagaccttgatgtaagcagtttgcagaactatcacccactgtcagagacttgcagggtgccatttccctcttggcttctgtgagaggatgcatgtagagtggatagttgtttcctcctcagttggcatggtggcttgaattttctttttgttcctcacagactatacatttgttttcttccagtaatacaagaatctccagaggaaggagtcagatggtccataatgagcttgacaggcatttcttccaaagacgctggggattacaaatgtaaggccaaaaatctggctgggatgtcagaagctgtggttactgtgacagtgcttggcattaccacaactccaataccaccagacacttctgaaagaactggagatcatcctgagtgggatgtccagccgggatctggaagatctacatctgtatctagcgcatcatcatatctttggtcctcttccttctcccccacatcttctttttctgcttctactttgtctcctccctctactgcttccttctctttatctcctttctcctcctccactgtttcttcaaccacaactctgagcacaagcatctcagcaagtaccaccatggccaacaagcgatcattccagctccaccaaggtgggaaaagaaatttaaaggtggcaaagaatggaagtaagcttcctccagccagcacaagtaagaaagaagagctggcattgttggatcaaacaatgcttacggagacaaatgccgcaatagaaaacctcagggtggtcagtgagactaaagagagtgtgacattgacgtggaatatgatcaacaccacacataactctgcagtgactgtgttgtattccaagtatggtgggaaggacctgctgctgttgaatgcagactccagcaagaaccaagtaaccatagatggcttggaacccggtgggcaatacatggcctgtgtctgtccaaaaggagtgcctccccagaaagaccaatgcatcaccttttctactgaaagagttgaaggagatgattctcaatggtctctccttctcgtggtgaccagtactgcctgtgttgttatcttaccattgatttgtttcttgttgtacaaagtttgcaaactgcaatgtaaatcagaacctttttgggaagatgatttggcaaaggagacttatatccaatttgagaccctgtttcccaggtctcaaagtgtaggtgagctctggacacgaagccacagggatgactcagagaaattgctgctttgttctaggtcaagtgtggaatctcaggtgacttttaaaagtgaaggttccagaccagagtattattgctaaggttctgcagctcaggtgcatgtgagctacaaaactagcatctaagggtataattgaccctaggtttggatgacttttggacagactttcacattgtacatgaaaatcacaaatggaatgcttttaagtatgtttaaaaaataccatgagacctctgaactgaaaagacaaataatgttgattttttttcttgtgtggaaaaggtctacagaaataatttttagagtggtgcttaataaattattaatactttttagggtaatgttttagttcttaaaaataagttcatgtgaaagtagcaagtgaactctgtatttaaaaatatagttttttgagtcatgaggaaacattagcaaaaccagctaagccttgatgtttattcatgttcgaagtgcattatagcatttgctgtggatgttttctgacattgcctaatggagagcgtgggatcataaaggattttgtgttcactaaggttaaatctaactcacgggagagagagggctctgtctcttggtaccattatgcattgtgatactatagagttgtgttcatatttcttgtaagaaaaatttttgcttttctttagaaatataggtattagcaaaagtaagtatacaaagaggattatgacaaatagaccatttctttaaaaatggtaactgttgcatttaaacacatcgactgacagattatatggatatttaaaaataactttaaatcaatcttttaatattttgctgtttgctcttatgttctcccttctttcttccttccttgtcttccctccctttccttccttcattctttctttcttctgctctgtcagaagatatacaagtagccaaagcatcacgagccaagctgtttgtcttttgccatattgtcttttgattctcttgataaagagaaagcttttgaaattacttactgccctttgaaagtctgttttacaaccccaaaggatattttaggactttaaaagggaagcttcagtggattcatttggttagattcttttcctaggttaaaaacatcggggaacttaaatacataggaaaggagttcacaaataaaatttagtttttttagaaagagaatattttaataactgtagtatactacaagaaacatctcatggctttaagattaacgatagcgataaggcccactcaagcatctcacagtggtgatattacatgtcacttagcaggatgcaacctggcctagggatttccagaagacaaggccacctcagcacagatgcaactttcataaattttagaacaaagcctaaccttactagattaaacttgctctatgaaagaaacacttggtaattgacccagactgaatacatgtataagaaatgggaaagatctcccaaactctgagaacggtcctcaaatagaagctctcctagtcagttggtcatctgacctctgactatatccggcctatgacaccagccagctcctgctttctgtcttgtaagagcactgctggaataaactacttgagcattagatggtgtctaagactcatctttgatgacagggataaatcacccttgtgaagctggctagctgggaccacccaaaacctcagaacacaactagcagtgaggatgaaatttgagtaagccaatgagtgatgacacccatttctacaggaggatcaagggagagtggccagggcctggctctgatcgagagattgggtgaggtctgaggaacactctacagtgggtctggcagtttttgttctgttttcacatgtgttgctgccttctatctttactttgtgcctctgttttggaggtcaccaccaggtaaaatttgccaaaattacttttaagaccactctggtcccacaggaaggtgggcttctaggaggagggtggtaggaatgctgtaggctgggggacaccctgggcttgaagagccaaccaccagctggtatgtttctagcctcagctgtgggagaggagctcctcgtccccaaaggtcctggcatcatgaccccatagaccaagaaggctcaagtacatcttctccacagaaagcttatctgttgtctgccaactggggaaagagacttctccaacataccccggtctaatgccgttagcaaagtcaccaaatcaccaacgggcatgttgctgccatccctgttcctctgcatgctcccagtgagacagtgcggcttctccagggctttaccaccccctacaatgcctgctgggtgctgccagcagcagcccatgagcagcacatccaaatcataggggctcacctcagagttgccactctgcacctggctgacctggaggcctgtgagctgtgatcatcctgagtgcaccagattacccccagcagcaccacaggcattgccagtcaccacctggacacagttaagaaagcagctgccacctccgcaaacagcgagggtgaggaagaactaatctcggatcccaaagcaagcactctgtctagcaggactcggttagtaactgtcagagctggttgttacaaagtgaggttcttccttgccttggctccctttggcacactcacttccttttccacttctctgccatgctgtgacatggcagaggcctcactggaagctgaccagatatagtgggcagatctttgactcctaggcctccagaattgtaagccaaagtaaacctctcttctttataaattactcagtgtcctgttctggtgactctcccttatgcctgtctattctgttatgaccacagaaaacagactaagaaaattcttatggatagaagatgcattcttaccttaaatctttagaaacctatgagggtttcttacgcttcatagaagcatatgagggttttttgtttttctgttttttaccttattaagtcaggaacttgcaccttttcacgtaaaggaagcactttacagcttctctttggcatatccaagttgcctgcgtcactattcttgtgctttgggaccactgtcaagtaaaataagggttactggaatgcaagcaccgtgataccacgacagtccatctgataaccacggcggcttctaagtgactgatgggcagggagtgcatggtgtggatcctccagacaaagtgatgacttatgtcctgggtgggacggagcaggatggcaaaatatttcatcagacaactcacagccacacctcctggaaacactcaagagccctacttgcatttggcagccatctgaaacggacaaaacctgaaactctagcttgactggaccacctccaagatcaacttaaaatttatgaattgtttatttgtagattttccattaaaaattttcggactgtggttgaagttgggtatctgaaaacgtggaaaacaaaacctcaaataagggggtactactgtaggccctttgacacaagcagaaattcgaagcctgctcaaacacctgatgcagaggcccaacaggaaaagtgccacctggctgtggtgtgcgtactgaacaggaagggtctacaattcacaggccaagaatacaacagctggcagctatctccaaagatgggaagattgatttcattacttaaagatcctgtcaagcttctccaggaagcacagtcaggtgggactctgggcccagagcaggcagacgtgacagaagctattcctgtgctctgtcacaatggctgtttatggcctggcaagcagcacaatccagcatgagcctccttacaaccagggctgaaagtggatgaggtacctaccacaaaggaaggaagagagctactgagacgtttaggtgtgctccagtgggtttacacaccttccatcttcacaggacagaggcaacactcatctagcccttaaccccagcttgactctatctggtctatgaggagctgcctcgtgcacaaaagtttctctaccttcacgtcacagacacactttgggcccaggcactgcctgtgcaccttgtatcagcattatgaggacccctgccccatcatatctgcagtgactacttcatgccctcttggaccaaacatagacttctctacctgctgaaagacaccttcaccgttaacacccaggatagccatggagactggcccaccaaccttgactaatcgctagctggcatttgcctagtaggccacctccaccgcagtttctatggcctgcacctcctggaaaactcagttgtgctgggcagccatctgggatggacaaaacctgaaactctgacttcactggaccacctccaagatcacacttttgtatctacaacatcctccagtgcacagtgtctgcagccattactgcttagttctgagttctcctggtcctcctcttccattttggcctgtcattgctctgcaatcaagcagctccaagcctgctactgccaagtccattcagctccttttatgtccctagagccattttccaagccccagtttgcctgctgtctttcactgctccaggtggcccaacattccacatcgacatgttgcttcttgagacctactcactgattactcagcactgaagtcactgacaatttccaccacagggtcattttggtcacccactgagtggccaaacctggcttgctgagcatcccttcaccaaccttcagccacttgtccactcttcacaatcaagccctggttactgtcaactgcccctcctttgccattagtgtgactgccccctatccatggtgagactgccccctatccatagtgagacttccccctatccattggtgagactgcccccatccatggtgagactgcctcctatccatggtgagactacccccatccatggtgagactgccccctatccatggtgagactgctccctatccatggtgagactacccccatccatggtgagactgccccctatccgtggtgagactgccccctatccatggtgagactgccccctatctgtggtgagactgccccctatctgtggtgagactgcccccatccatggtgagactgccccctatccatggtgagactgccccctatccatggtgagactgctccctatccatggtgagactccctatccatggtgaggtgcacccatccgtctcacctatccatggtgagactgctccatatccatggtgagactgctccctatccatggtgagactgcccccatccatggtgagactgccccctatccatggtgagactgcccctatccatggtgagactgccccctatccatggtgagactgctccctatccatggtgagactgcccccatccatggtgagactgccccctatccatggtgagactgccccctatccacggctggacgctgctctcatgatctcccttaattgctcaactggatgctggacttgccatatcccctctgccgatgcagtttaactcccaccagatagttccaaggatgccactcattcctgtctttccttcataatatgctttctgcaggacaccctaatgctgattggggtacctggactcgctggctgggcacctctcacctggctgcccaaagaaggtgtagaggtcctgttctagtgactctcccttactcctgtctacaagtctcacccactcccttcttggattcccttacctctaccccgacatgggtagaagtccccctagtgttctgggcctccatccccttccctttcttgatgccacaagcatgcagtgggggcagttgtggccgccatcttgctaaagattatattctagttacagggaggatttgggagtatagaatagatttctaaagctgtgtcagcagtcctgaaatagaaagaaaatttaataatttttaaatttaaaataataagaaaatacaatattttgtgtaagaaatagattggctttaaggtaccactttctagaaattataatacaagcagctgtagaatggaaaaattgttcattctaaatggttcttaattaaaaagaaaaaataattctagtttaggcataatctgtatgaatggatagccttctcagaactccccaaattccccttcttatgtaattttctttcctttcctttccttccccctcccttcctttcctttcttttccttttattcctttcctttttccctcccctcccctcccctcccctcccctcctctctcctctccttccctcccctcatctctcctctcctcccctcccctctcctttcctttctttcaggcctggttgtccttggtgctttcatcactcagtgcattgtctaatgagctaacagttttcaattcagtattcattgtttcaatttttaaaaaatacctttcgcagacaattttgtgtttagcttgaatttattttagatcaacttattttaaattaaaaggttacgaaacttttatgtctttactctgctatatgatgtcatgcaatttcattgccatgaatttaaaaggctcatagaaacagaatactaaaatactaccaatattagaaataatatgactgtataatgttacagactaccgagccaaatggtggatatggaaaggtgcctgaattgtacaaaggcaggttatttgtcaaggcagtttacttggaccatcctgatcagaaaaattactcactgtcctcatattgaaaatcaagcgaagcctggacttaattttgacggagtaaaaaagctagttgatagtgtggagggggataggaacctcaggagaacgcacctggactatttctcagcttggttttgacacatggggtgtgttgcaagtaatttattactaatagtgaaagcactaaatttgcacatgatctgccttctaaaaatacatacatttgagtgtagtcaaggttatctcaatgatatcattgctctcatgttcttacaagtatgttttcttaagtgagagagaaagattggtgttagcaaaagtagcacagaatgccacataatcaatagcttgtttatcaatatccccagaaacattgtagagagcaagcctaactagtatatagccaatatatgtggcaattaaaaatgattacaacgttttattttcaggaaaaatgtatttgagttttgtgaaaattatggtataccagtgagagtgtgtcacctgtgagactattatcaataatatgctgtgacatgaaaaactgtgagcgttcaaagctcttatcatggccagaaaagggaaccctgaatagagtcaggcaaataccctggctttggggaaactttaaaaaaattcaaggaaaaaaattgttttgacccatgaaattgagtctcaaataagattatggctaatgaagggagattttttaaaaccaagaaataattcaaataaaatgggagacagctcaggaaagttgaatcgttgtctatttatctcaaattttaaatgacatgtttataagatataagaagggagagtaaccaaaggtgaatagggaaatgtagcaaatctactataaaagttctataaagtaagacccaaatgaatagaggattttaaaaaaggtaaatgtggcctttttttgagaaaaaaaaaaggtaaagatgattttgaggaaaaaaaaaaggtaaaggtgacctttttttgaggaaaaaaaaaaaaggtaacaatgaccaaaaggagccatgaggctttattttattttatttatttatttttctagagatagggtctcactgtattgtccaggctgtagtgcagtggcatgatcatggctcactgcagcctcaacctcctggcctaaagctgtcctctcaccctgacctcccaaagggctgtgattatagccattagccactgcaccagacggatgcttcttttagtcaaaaagaacaaggaggggagagtgacaacagcaagatgttgaatgggaaggtcccagacttcacgtcccttcaacaaaatatccaactaacaactatccacagacaagaacttatgtgaaaaaacccctaaattgggaatgagcctgacactagtgtggaccacagaactggataaaaaccacattaaaatggtaagagaaatggtcttattttgaccgcatctctcctcccttccccccaagttggcagagggccacacagacagaattcccctgggtcccatgattctattttatttatccttgagccataacattttattggtagatcagggaagagccaggagtaagtgtcccttccttcccatcctcctacccaggagacaccctctaaaggagagcagaagcccaggagcctgcctccttagaggatcttggaggtggacaggctattgtagtgctcttcctggccctcgagcaggctgaggtaggtggcgagctcctgctccagccacaacttgatgtccatgagcagctggtactcctgattctgcctctcactgtcagctcgcacatcgcccagctgagcttcaatactgctgatcagcgcctggatctgcgccagctgtggtccaaagcgtgctggtgaccttccaaggcggctttcatgctaagctgccactgcagctcaatctcaagaccctggaggttgcaccgcaggtcggtgacctgggacctgttcatctggagctgctccatgtggccaacaacttcccagttcagttcctcagtgcagctggtgaaccagcgttcagcatcctttcggttctgcttggcatgacctcatattggctctgcatgtcactcaggatattggtggcatcagcgcccagagccgaatccacttccacactgatctggcctcccacctggcccctcagggcattaatttccccctcatggttcttcttcaggtaggccagctcttccttcagcccttcggtctgcatctccaggtcggtcctggccagggtcagctcaaccagcaccccgtgcaggccattatgtcagcctccacactcacgagcagagtctgctccctctcatacttagttcagaagtcatctgcagccagacaggcattgttgatctgcaggacaatcctggaattctcaatgatgtcaccaagaatcttgtagcacaggtactcgatggtcccgtagtagtggctgtagtcatgggagggcctggggcacatgattttaaaatgggaaaacaacaagagacagacatccagcttccctagcattctgaggtgcattcctggaagctcagaccagtcttgccttatgggggacactgggagtaatggcatggttagactgtgtggggtcagttagaaacaaaaaaaggaggcagagctcacagtgaccagtgtgcagatcttggcagtagctctgtgttcctgccagctgtggtgcctagtcagagataccagccaacagcacagcccaagtccaaagctggactgatcactcccagaatcatggtgggaagttcaagctggctttagactctagacatccagcatccacgaccagcctcagagcctatttcaaggccctgcctactcagggagatgcccacaacattgcatttcttcaaagcacaggtgccaaacctgcctgacatgggaggccaaaaagtggcttgatctggccccagagcccacatcaaggcaccacccaggcagggcaacaagcctcaactgtgcatttctatggagtatagcctctgatcccatttgtcccgaatggcaactctgctagcatcaaaacccagcctgcagccctgcccagctgtggaacccaaacagtgataccacccagccagggatataccctgttacctggctgatcagggaccatcatgttgcttggccatcagcttcacctgatagcagagcccagccagtggtctcacttcacagcagagcccagccagcagtctcagacaacctcagagcaacggcagtggcccaaccaaccagagaacccaacagcaactctacctactgtggccattactagctgatctatccagaatcacagggtagactaaatagtgaaagtctatccctgccaaagaacacctgtagactgtaagaggtggctgtctcctcaaatacacagacaccaacccaggacacaaggattatgaagaatcagaaaatcatgacacctccaaaagaaactaataaagctccaatgatggaccataaaataagggagttctataaaatgactgacagagaactcagaataattcttttaaagaagctcagtgaactacacaaatatattgacagaaaattaaatgaaatttagaaaacaaacatgaacaaaatgagatgtttgacaaaaaaataaagaaataggtacttttaaaaaaattagaaatcctagagatgaggaatacaattactggactgaaaacactgcatagaaaacttcatcagcagactcagtcaagataaagaaccagtgatctcaaagacagaacattttaaattattcagtcagaggagaaaaaagaataaagaatgcctacaggaattatgcaacaccatcaatagaactaacatgcatataataggaattcaagaagaagagagaaaaaaagtgtcagaaagcatatttaaagaaatggtgcctgaaaactccccaaatttgggagaaaagatacctaggtacagtaagtgcaggagtttgcaatcaatttcaactcaaagaagagttaaccaagacatgtaataatcaaactatcaaaaatcaaagactaattaaaaattctgagagcagcacaagataaacatatcacatacaaggtagtctcaatgtcagtggatttctcagcagaaatgagggagaaataaaagctttcctagacaaagaaaagctaagagagctcattaccataagctaagggagctcataagggtacaaagtttcagttaaacaggaggaaggaattattttagatatagtgtatagcatggtaactatatttaataataatgtatatttcaaaattgctaagacaatatattttaaatgttcttgccacaaaaaagataagtattgaagtgatggatatattaattagcttgatttagtcatttcatgttgtatacatatgtcataacattactttgtaccctgtatatatatatacatatgtgtatatatatatgtgtatatatatatatataaacacacacacatacatacacacacacaaggtaaatacatatatacacacacacaaggtatatatgtgtatgtatatacacacacacaaggtatatgtatatatatacacacaaggtatatgtgtgtgtatatacacacacacacacacacacaattacaatttgtcaatccatgatttcaaaaagaacaaggaaataagtctacttcttagagatgatagcagaaggtatatcagagacaagacagcatcattcaattctttttttttctcctctcttttctagattggggtttaaattgaatatggagaataaactatgaaaagtagaaattgcagcccaagataaaagagggattggcaagctaactccaagatgtttaaaatgagaccagataaattatgtaccagggtgcaaatagaatttccagctataaactgtttggtagtctttgaaaagtcatggcaaataggagaggtgccacaagaccacagatgggtacatttcatgtttatttttaagagaggaacagaaaggattcaggaaattatagacaacttgattcatatttgcagatttaacaacagattgttaaaaatgctctagtttttgagcattcagaaatgaatgttaaggtcattagtaaccaacaaatgtgaagtaaggacaagtttgatacactcatctgatttattttttatgaggatactaagcacatagatcaacggatttcttgaaaatcaaattgaaacagctagcaattggtatcaccgtgatggagcaatatgggattgtctcttttcaagagtgtctattaatggctttatagtctctagtagcgtgcctttaccctattttattcagcattttcaccaatggctggatgaacatagaggcttctcaactttgtagagggcatgaaaatagacagtgtatcttatttcagtgcttctcacactttttcactgaatattcctaatggaggggaaaataaacatgtgctcctggagaaaccaggacaattgtcctaagtggctgccagaagagagacatttctacaaattttattttatttaaacattatgtaaattttgcattctatgccatgattttttaaaatataaaataattctacctctagtcaatcttatttctctagtaattggcatttctgtgcctttgaatatctcccatattctcccaaagtgctgagattccaataaatgttttgccatagctgtaagcctgtggatatggagagcgaaagcaggaaggcttgagagactacaagaaagagaagaggagagcttaggatgtatgcgaagcacaaacaaaattacatccagaaggtgaaaaccaaaccagtgccaatattctgaacaaaggcctgagacttggtaatttgtagcatggcctacagggaaggggcatgaaagggagaggaccagagttggaagccctggaaaagcattgctactagggtaaaaggagctagagaaggcgtgatgtccttcaaaaacatgacaataggagaaaagaaggaagcaaaatggagaaaattaagtccaaagtatagacattgagcatttaatacaattaattgtagatcaagactaaaacaagagtgatcatatgggtagaagaataatatgtaaacattatttatacatactgatagagtagaaagaatgcacctaaaagcaggaagagaaggaagtcagaaataagagagtggaaaaaataattgcctgctgtataagtaatatgtggtagtcaaaaaatactatttaaaaattatagatcacaaagaaaatgtacatatacataacggagtactattcagccataaaaataatgagatcctgtcatttgcaacagcatggatggaactggagatcattatgttaagaaaaataagccagacacagaaagacaaacatcacgtgttctcacttatttgtgggatttaaaaatcaaaacagttgaacttgtggacatagagagtagaaggatggttaccagacgcagggaagcatagtggggggatggaagagaggtagagatggttaatgggtacaaaaaaagttagactgaataaagacctactatttgaaaaaaaacagggtgactgcagtcaataataatttaattgtacattttgaaataactaaaagagtataattggattgttcgtaacacaaaggaaaaatgcttgaagggatggataccccattctccatgatgttattattaggcattcaaaacatctcgtgtgctccataaatatatacacccactatgtacccacaaaaattaaaaactaaaaattatagaccagatagtaaaatgttagatagaaaaaaagagaatggaaagagactataagagacactaaaacaacaagaacaaaatgcatctcttcctaaaagccagcttaaaacaaagacaaacaagagatcaaatatagaaagactaaaactatcaatgtttatttttttgtatttaaaagaaaaacattttattgactctttaaataaaactctatccacaacaataaaggaaaatggggaaatatgacctgtcacacaatcacataaaaatttacgtcacagataaaatactacaatcgcttcatgaaataactttcatccatcaaccatggagatgggcaaggaaatataaccatcctcattttatagaggtaagaacaaagataaagataagaatatataaatgcagaggttagaattataaaaagagtcagccttgccaaagtctcaggaaaggctcagcagtacaaatgactccaggttagaagtaggtgagttcctaacaagaggtcatggatttctggacaaaggtggtgtccttacaggcaccatgcctggaaaatagctagtaagataggcgcctactatatttggcaacctcaaatagaattggcctctcaattttcttttttttctatatatatatatatattttttgttatactttaagttctagggtacatgtgcgcaacgtgcagttttgttacatatgtatacatgtgccatgttgttgtgctgcacccattaactcctcatttacaatagctatatctcctaatgctatcccttccccctcctcccaccccacaacaggccccttcctgaatccaagtgttctcattgttcagttcccacctatgaatgagaacatgtggtgttcggttttttgtccttgtgataaaaactatcaatctttaaagataaagaaaagatcaagcaaaacacatcgggttagttataagattaagaaaattaggctgccatcagacttcttaaaaacagcacttaaactaaggtaacagcagaactgcatttttaaattgaggcgtattctcaaaaataactggcttgtattctttaaaaatatctgtgtcattaagcattttaaaaaggctgggaaattgttctagattaaagaagactaaagactaaataacgactaagtaacatgttatcctgggcaggaggggaagaacgtaaaaaggacattatggagataatggaaaatattaagataagaatggcagattaggtaaaagtattatatcaatgctaaattttttgaatttaataactgattgagattatgtaagataatgaaggcaatattcaatattcatgttcttaggagagacacatataataataataaaaaaggagcaaatgcaatctatgctgtctataatgaggccttgattttttgatgtattagatgtatgcaagctatattttaatatatatttggagatagcaagagattaacattgcaaatgtagcataatcttaacaactggtgaatctggataaaggatattttggaactcacttgcaagttttctgtgagttagaaattatttcaaagtaaaaaaaaatttatttaaaagatgatagtagatcaactactaaaatgaaggtaggaaataaaaaccctgctcaagcctcatcctatctttataacagaaatctgttataaaactttttttgttcaggttggtgatgcttatgatttttataatcattttccacatgttcaacatgtactggagaaaagcaccagcaccttgatgaacatgattagatcagggtccttagcttgttgaggaaaaactaactttgaaggagaagtagtgaaaattgaaaaattgaaatttgatattaatgtaattaaggtgcatctttaattcaatggtgctcatgtattattagaatatgactactttagggaggcaggcaattttggtatttgcttaaacaggatctatgccatttaatagccaatgtccaaacacagcagctgattctctttcttctggacaaatggagtccttaaccctgggatatacttataaactcaacatttattgagttaacttcccttagggctcccatcacaccccacccctgcccacacatccctgccaatcctgatatcattttacccttagcagaatcttatttcactctagcaatgtgcacatttgtaaaatggaacatctagggttttcattttcaaagcattgctcaagaggtgtgtcccacatcttggcttttaaaaatatatgtgtgtgtctgtgtgtgcatgattgcatgcctgcaagatagtctgcttcttgataaactggccctgtagtcatctcttggagttcaaataggtttcttgatgtatggctataagtttattgactgtgatcacattttagagaccaaactcttggaaggaaatgaccatgtctgtcaacttactaaaacaacgtgtggttgtttcacgtgtgttaccatgatgaccaaggaactaaagtcttttggagaatacagttttatggttctgatattcactaatatttttgactagtctgagccaaattattatctttttttacttggtggcagaaaaaagtccttataaaggataatcgaagattaaaatggatcagttatttccccatcaaaaaattaagatctcattatagtcagcatagatttccttgatttgttcattcattcatttacctattcactgggaagatactttatgttctcgtaattagtgaaggctggaaaagaaaaaataatgttagtatcctttttaagccaattatatacaactggttcgctttgtaatgcaaaaattactaaccatgaattttatataattaattaacagctgaacacagcgtagagaaggagctcaaaagacacttgcttgaaataattccataaactgcatcagcctttgtcaggctcagcccttaagcttgtaggccccatagtgaggctgtttgaagggtctacttcctttcaaaggggcccacgtattcttgggagtgtgcaaacgcaggcacgtggcctagagtatcacagacaggaggtatttgttttgtttttccaaaacggaagcagctttttttgtgtttggtgattgttaatgtatgaatttttttcaagcaacttagaaatgtgtagagtcaaaagttcttacttgttccatctgccacttctcctaaagataacaacgattagtaatttgtatatacctttctagacttttaaatttaaataaacattttttacattaagtaagatgaaattacatacgttgttctgaaatcggcttttaaaaaatagcaatatattgatggcatcatctcttgtcagtagataaagaccaacttcatccctttacaattttctctaataaagatgaagcacattaatttagccaagttcctattgatgaataatgaggttgcttccatatttttgatattataaagaatgctccagtgaatatcctaatttgttcatgtttgcctacatgttctgttttctcaggataaacccctagacaggattgttgagtcaaagtgtatttaaaaattatagtacgtattttcaaactattctcagctgaaagatcggactccggtagtgcattaaagtgtctgtttcccacaccattgaaatcactgacttaatcaaatcatggcaatcagataagtactcaaacatttcttcattatttcaatttcaatttcttttttctcgctgagatcgaatatctcttcatctagtttggttgtttatgcttctttgtgaatagtttatttggagactttacgtgtttttctactgggttggtaatctttgcctttttagtttgtaaaaacattgaactcttaaggatattaactcttcatctgctatatatactgcaaatattcatcccctgtttttcacttgtctttcagcttttatttatgaagttttaaataaagaagttttacatcattgtgtagtatcagttcatattactcttatggtttctggctttattaccatgcttgaaaagatctcctcatcctgaaattgcttagatattctccaaaagttctggacttttcataattgtattttactttggagtttctaatctatataaaatttaatttatgtatgatatgaaatagagggcaaatataatgccaaacggggtgaattgaaattaacttggtttgtaaatttaaaaatattttttggaactatacagtagaaggatcagacttgaaatgtatgaaatgtaatacatttacaataagtgttagggaaaataatatagctgagaaaaacatacctctctgattatctcagtcatctctgaggtgaattgattgtgagggttactacttatgaatggtggaacaccgaaccacaagacggatatatgatctgcttaggtaatctgcatcatgggacaagtgaatgacatatgttttggccatttagacgaaacattctatacattctaagaattattgagggggtggagttccattttcttctctaaagcagagttctcaatcttaagtgttccattggaatcacttgcttttattttattttattttatttttttgccatcagctttctcaggttaaagtaatcacttgcttttagaaatgctcctgccagatcctggagattctgattttattggtcagggcctagctgtcttggattttaaaagctcaccaggtgattatatagtgcgtggctaaggttgagaaccacagccttaaagattcctaatgatgcctatctgatattatttgctaaaagtttaactatgatttaagtaatatttctctaaatttcagttctaaggccttcccaccctgggccataatccattgttctaaggaaaccactaggaccttggtattgggttgataaaatctacacaatcttctgagtgcattttaatctacacaatggatttaagagaactgaagaactgatcagtctaataaaagttttcagcataatttcccatgacagtgaatttattaatttgttttataagtattactttctactatgatttaattgcacattcaaaatggaaaacttttgcaagagctttgtaaggcaaaatgctaacatgagtgtgttcgtttttcattttcctttttaataaagcaacataacaacataccaattatggatactagagcccctgttggcacacaggtttccttactttcatgcgggtgaattactcaaagccaagtgttagactagcagaacacaatttgctttagatttactgacttaaatatccaacagacttttgctcaacataaacagcataaaacaaatgcattcaatctaaggggatctcaggtgaaacacattcccttgagcatcaactggacattctttgctccaggtagtaaacgtggttggggaaatagctgtggatatcattgtttctgtgcccgagaaatgtcaccttctcaggaatgcaattaactgagtgttcaggaacataaaaaagcatgggaaataaactggtgggtgctgaaaattttcctttcttcatttcaaaataaatagcatgtttataacaaactaagtaaaaggcctattattgggttttggtgagcctggtgttctctaactcttgatttggttcctttataatcagtaacttccaagtgaatgttaagtaagggtcagtaaatgtgaattaccccaagctatgtggcgtgttggaaaaaataagaacaaggggtcatcaaatgcatcaaatgaagttctagtttaaaataaattaattctaggacagatcaatttgtttagatattgttcagccaacaaattcattcctatgacctgagccaaagtcttctgactttactctcagttggcctcctccttgtccctcccatccaagaacagcatggacagctgtgacccaaaacagggtgtgtctctggctatgggactcagatgccacattctagattttctctctcatcatggcatttgaggttgagatccacatgttggctttgcttcctgggcagctgggaggttgtatagggtcacagggcttctcacaggagggcattgcttctccttcccagtggcctaatttccctctagggtagaaatgacacatttctgttccccttgcagattcctcaaaagtttccaaatgatcaggtggtttttaccttggactgatgctatattttggggacaatttccacaagggagaggcactttacatgaccatcagccttgtgaaggctattattgcagcatttttgaaaactatttgcctatgagttgattttttgagtctttatgtttgtatacacacacacacacacacacgtgccacaagattttttttctgctttttttcacttttaacccactggtcattcatttattgacttgacaaagacatactgagtgcctgctctgttgcagacagtgtctctggattgacaaaatgtctggttggtcatatgacttaggaatattgtagaagcactttggagaggtttcctctgagatcattaactttgaataaaaaataaggcagtcatcaagcagtaatatattttcaggactcaaaaaaaaaaaagaagtgggaaaattttaagatccaggctcttttcccagcacaagccttctcagttatgtgattttgagttaatctgaagggtttgttgtagtttcatttgttcctggagtactataggaatcagattcctacattgaaactacaccaaacccttcagataaatgtcaaggctatctcatatgtttgttgaatccagaagatcctacagctatcatatataaattatcagtgatataatcaaaaaagatttctaacttttaatttgattttatggttctggtactcctctcggtaaatgtaggagataagaaattgtttttctccataaatgaaaaaaatcttcaatttatagcccaaagacatgtctttgtcttttaatcctatgccaatattaccctcttggggctatgttttctgccactctcaagactaggcatttatgttttcctcaaagaatggtgattcatgagaccaactcttctcattgaagactcagatgtggtaagattgctacacatgaaacattccacatggaaactggtttaaaaaatttataatgatcagggaaatgcaaatcaaaaccacaatttgatatcactttactcctgcaagaatggccataatcaaaaaaccaaaaaacagtagatgttggtgtggatacggtgaaagggaaacacttctacactgctgcttggaatgtaaactaatacaaccactatggaaaacagtgtggagattccttaaggaactgaaggtagaactaccatttgatccagcaatcccactactaggtatctacccagaagaaaagaagtcattatatgaaaaagatagttgcacacacatgtttatagcagcacaattcacaattgcaaaaatgaggaaccaacccaaatgcccatcaatcaacaagtggataaagaaactgatatatatatataaatatatatatattgcccacattagtcttgaactcctggcatcaactgatccttctgctttggcctttcaaagtactaggatcataggcctaagccactgtgcctggccagcacattaatttttttatcaacacttcacgtatttccagcataggaagagaaacacaaagcctcaacaggacacttttccccagacaatgactaaaaatgcatatatatatcaatatcaatatatataaatgcatatatatatctatatatatattgatcagaaactgatctatatatatatatatatatacacacaatggaatactactcagccataaaaaggaatgaattaacagcatttgcagtgacctggatgagatgggagactattattgtaagtgaagtaactcaggaatggaaaatcaaacattgtatgttctcactcttaaatgggaactaagctatgaggatgcaaagggataagaatgacacaatggactttggggactcagggggaaaggatgggaagggggtgaagtataaaagactacaaattgggttcagtgtatattgcttgggtaatgggtgcaccaaaatctcagaaaccaccgtaaacaaacacatgtaaacaaacacaacctgttcccccaaaacctatggaaataaaatattaaaaaatatataactgcattacattattactttaacacttacttgaatataagaaaaacatttaacactataagaccaacgaacatatagaaagtgatggaaagtctcatcttgaagagacacagcggtgggctaactccagatattctcaaaggagttttgaaagaaatactttaatacatccatacatacacatcaaaaaatagacagaagggaaacaagtaaggtagaaatagaaaactatcatacaaaataaaactgattaagcacatgtattaccaatatatccttactttcaatcattatgttaagtaaacatctatttttttagtcattgtccggggaaaagtgtcctgttgaggttttgtgtttctcttcctatgctggaaatatgtgaagtgttgataaaaaaattaatgtgctggccaggcacagtggcttaggcctatgatcttagtactttgaaaggccaaggcagaaggatcagttgatgccaagagttcaaggctaatgtgggcaatctctacacaaatttaaaaaattagtcaggcatggtggcatgtgcctatagtcccagcttaagtctcaaattaacttaattacaatgggaaatacagagacttgaaattttaagccatacatcctctggagaatatttttaatcttaatacctcaatttttaaagagaatgtttgtttttgactcagaatgttcttgacatgaactatcaggattaggttctagaatcattacatatatgaagtcttgaattctgcatgaaatttttagtagtttagctgtgactcagctagaagcagaacactctaaagagtctgatatggtttggctctgtgtccccacccaaatctcatgttgaattgtaatccccagttttgggggagggacctggtgtgaggtgattggatcatgggggcagatttccaccttgctgttctcgtgatagtgagtgagttctcatgaaatctagttgtttaaaagtatgtagcacctcctccttcactctctctcttgctctgccatgtgaaaattgtacctgcttctccttcaccttctgccatgattataagtttcccaaggcatccccagccatgcctcctgtggaactgtgagtaaattaaacctcttttctttacaaaccatccagtctcaggtagttctttactgcaatgtgaggatggactaatacagtgtgcctttaaaacgtttttactactggtttgatcaccaatatccatgttttgctgtttaaagagaaattatttatcagagctctagagctagaataaagcaagttttattaatctgggttccactaattaagtctgcaaaattatttatttgattggaatggctttagtgttgcattgtttatacagaaaaattttgctactttgcaaattagtacgcaaaatttgtagtgtctgatttatcaaacactacactagtgtcaaaaaaaatccatttttttgagaaaaggaaagttctcaaacttctcagtttaattctgtattaccagatatagctaattatgaatatgttgttacgctctcctctttttcttccatgtaagttttaaaatgcatttttattatgactcatatttcatcatattacagtatctagcacatggcttttccctcttagataaggcacaattgaattgggtcttaatcagttttttaaatctagagtagtgctttgcataaataaaatatgtgttgagtgaataatattaactcaataacaataaacatttatgagtgctttttaaaattttattatgttattgtactttaagttttagggtacatgtgcacaacatgcaggtttgtgacatatgtatacatgtgccatgttggtgtgctgcacccattaactcgtcatttagcattaggtatatctcctaatgctatccttcccgcctccccccaccccacaacaggccccagtgagtgatgttccccttcctgtgtccatgtattctcattgttcaattcccacctatgagtgagaacatgcggtgtttggttttttgtccttgcgatagtttgctgagaatgatggtttccagtttcatccatgtccctacaaaggacatgaactcatacatttttatggctgcatagtattccatggcctatatgtgccacattttcttaatccagtctatcattgttggacatttgggttggttccaagtctttgctattgtgaatagtgctgcaatgaacatacatgtgcatgtgtctttatagcagcatgatttgtaaccctttgggtatatacccaccaatgggatggctgggtcaaatggtatttctagttttagatccctgaggaatcgccacactgacttccacaatggttgaactagtttacagtcccaccaacagtgtaaaagtgttcctatttctccacatcctctccagcacctgttgtttcctgacattttaatgattgccattctaactggtgtgagatggtctctcattgtggttttgatttgcatttctctgatggccagtgatgatgagcattttttcatgtgtcttttggctgcataaatgtcttcttttgagaagtgtctgttcatgtccttcactcacttgttgatggggttgtttgtttttttcttgtaaatttgtttgagttcattgtagattctggatattagtcctttgtcagatgagtaggttgcaaaaattttctcccattctgtaggttgcctgttcactctgatggtggtttcttttgctatgcagaagctctttagtttaattagatcccatttgtcaattttgtcttttgtgccattgcttttggtgttttagacatgaagtccttgcccatgcctatgtcctgagtggtattgcctaggttttcttctagggtttttatggttttaggcctaacatgtaagtctttaatccatcttgacttaatttttgtataaggtgtaaggaagggatccagtttcagctttctccatatggctagccagttttcccagcaccatttattaaatagggaatcctttccccattgcttgtttttgtcaggtttgtcaaagatcagatagttgtagatatgcggcgttatttctgagggctctgttctgttccattggtctatatctctgttttgataccagtaccatgctgttttggttactgtagccttgtagtatagtttgaagtcaggtagggtgatgcctccagctttgttcttttggcttaggattgacttgggaatgcgggctcttttttggttccatatgaactttaaagtagttttttccaattctatgaagaaagtcattggtagcttgatggggatggcattgaatctataaattaccttgggcagtgtggccattttcacaatactgattcttcctagccatgagcatggaatgttcttccatttgtttgtatcctcttttatttccttgagcagtggtttgtagttctccttgaagaagtccttcacatcccttgtaagttggattcctaagtattttattctctttgaagcaattgtgaatgggagttcactcatgatttggctctctgtttgcctgttgttggtgtataagaatgcttgtgatttttgcacattggttttgtatcctgagactttgctgaaattgcttatcagcttaaggagattttgggctgagacgatggggttttctaggtatacaatcatgtcatctgcaaacagggacaatttgacttcctcttttcctaattgaatgccctttatttccttctcctgcctgattgccctggccagaacttccaatactatgttgaatacgagtggtgagagagggtatccctgtcttgtcccttttttcaaagggaatgcttccagtttttgcccattcagtatgatattggctgtgggtttgtcatagatagttcttattattttgagatatgtcccatcaatatctaatttattgagagtttttagcatgaagcgttgttgaattttgtcaaaggtcttttctgcatctattgagataatcatgtggtttttgtcattggttctgtttatacgctggattacatttactgattttcgtatgttgaaccagccttgcatcccagggatgaagcccacttgatcatggtggataagctttttgatgtgctgctggattcggtttgccagtattttactgaggatttttgcatcaatgttcatcaaggatcttggtctaaaattctctttttttgttgtgtctctgccaggctttggtatcaggatgatgctggcctcataaaatgagttagggaggattccctctttttctattgattgtaatagtttcagaaggaatggtaccagctcctccttgtactcctggtagaatttggctgtgaatccatctggtcctggcctttttttggttggtaagctattaatcactgcctcaatttcagatcctgttattggtctattcagagattcaacttcttcctggtttagtcttgggagggtgtatgtgttgagaaatttatccattccttctagattttctagtttatttgtgtagaggtgtttatagtattctctgatggtagtttgtatttctgtgggatcagtggtgatatcccctttgtcatttttcattgtgtctttttgtttcttctctcttttcttctttattagtcttgctagcagtctttcaattttattgatcttttcaaaaaaccagctcctggattcattgatttttttgaagggtttttttgtgtctctatttccttcagttctgttctgatcttagttatttcttgccttctgccagctcttgaatgtgtttgctcttgcttctctacttcctttaattgtgatgttagggtgtcaattttggatctttcctgctttctcttgtgggcatttatgctataaatttccctctacacactgctttgaatgtgtcccagagattctggtaagttgtgtctttgttctcattggtttcaaagaacatctttatttctgccttcattttgttatgtacccagtagtcattaaggagcaggttgttcagtttccatgtagttgagcagttttgagtgagtttcttaatcctgagttctagtttgattgcactgtggtctaagagacagtttgttataatttctgttcttttccatttgctgaggagcactttacttccaactatgtggtcaattttggagtaggtgtggtgtggtgctgaaaagaatgtatattctgttgatttggggtggagagttctgtagatgtctattaggtccacttggtgcagagctgagttcaattcctggatatccttgttaactttctgtctcattgatctgtctaatgttgacagtggggtgttaaagtctcccattattattgtgtgggagtctaagtctctttgtaggtcactaaggacttgctttatgaatctgggtgctcctgtattgggtgcatatatatttaggatagttagttcttcttgttgaattgatccctttaccattcttggccttctttgtctcttttgatctttgttagtttaaagtctgttttatcagagactaggattgcaacccctgactttttttgttttccatttgcttggtagatcttcctccatccctttattttgagcctatgtgtgtctctgcatgtgagatgggtttcctgaatacagcacactgatgggtcttgactctttatccaatttgccagtctgtgtcttttaattggagcatttagcccatttacatttaaggttaatattgttatgtgtgaatttgatcctgtcattatgatattagctggttattttgttcgttagttgatgcagtttcttcctagccttgatgatctttacaatttggcatgtttttgcagtggctggtatcagttgttcctttccatgtttagtgcttccttcaggagctcttttagggaaggcctggtggtgacaaaatctctcagcatttgcttgtctgtaaaggattttatttttccttcacctatgaagcttattttgtcttgatatgaaattctgggttgaaaattcttttctttaagaatgttgaatattggcccccactctcttctggcttgtagagtttctgctgagagatcagctgttagtctgatgggcttccctttgtgggtaacccaatctttctctctggctgcccttcttaacattttttccttcatttcaactttggtgaatctaacaattatgtgtcttggagttgctcttctcaaggagtatctttgtggcgttctctgtatttcctgaatctgaatgttggcctgccttgctagattggggaagttctcctggaaaatatcctgcagagtgtttttcaacttggttccattctccccgtcactttcaggtacaccaatcagacgtagatttggtcttttcacatagtcccatatttcttggaggctttgttcgtttctttttaatcttttttctttatacttctcttctcacttcacttcattcatttcatcttccatcactgataccctttcttccagttgatcgcattggctactgaggctcgtgcatttgtcatgtagttctcgtgccgtggttttcagctccatcagatcctttaaggactactctgcattggttattctagttatccatttgtctaattttttttcaaggtttttaacttctttgccattggttcaaactttctcctttagctcggagtagtttgatcttctgatgtcttcttctctcaactcatcaaagtcattctccatccagctttgttccattgctggtgaggagctgcattcctttggaggaggagaggcactctgatttttagagtttccagtttttctgctctgttttttccccatctttgtggttttatctacctttgttctttgatgatggtgacgtacagatgggtttttggtgtggatggtctttctgtttgttagttttctttctaacagtcaggaccctcagctgcaggtctgttggagtttgctggaggtccactccagaccctgtttgcctgggtatcagcagcggtggctgcagaacagcagatattggtgaaccgcaaatgctgctgcctgatcattcctctggaagttttgtctcagaggagtacccagccgtgtgaggtgtcagtccacccctactggggggtgcctcccagttaggccactcaggggtcagggacccacttgaggaggcagtctgcccgttctaagaactcaagctgcgtgctgggagaaccactactctcttcaaagctgtcagagagggacatttaagtcttcagaggttatttgtctgtgccctgtccccagaggtggagcctattgaggcaggcaggcctccttgagctgtggtgggctccacctagttcgagcttccagaccgctttgtttaccaactcaaaccttggcaatggcgggcgcccctctcccagccttgctgccgccttgtagtttgatctcagactgctgtgctagcaatgagtgaggctctgtgggtgtaggaccttccgagccaggtgcgagatataatctcctcgtgtgccttttgttaagcctgttggaaaagcgcagtattagggtgagagtgacctgattttccaggcaccgtctgtcacccctttctttgactaggaaagggaattccctgacctcttgtgtttcccaggtgaggcgatgccttgccctgcttcagctcacgcacagtgcactgcacccactgtcctgcacccactgtctggcactccccagtgagatgaactcggcacctcagttggaaatgcagaaatcacccgtcttttgcatcgctcacactgggagctatagactggaactgttcctatttggccatctttgctccaccctctgtgagtgctttcaataaatatttattgagtggataaaggacagaatgatgactactctctatctgaagagactctgtgaggcaaaggagagtgtgaaatggtaacaaattgcaactaggagtcccgaggtgacagttttaccattaagggaagagtaggtagtttggtagtgaaggcaaggaaagtaaacttgacttttcaaaaaattaggttaattcttcctaggttaatacttccaactcctaggaagtttttagagagttctggggtgttttcagttatcagaatgattgtgggaggggggattgtctaactggcaattattggtagggagacaggaatcctagatgtccccatgtattagaaagtcccacaccataaagagttttccaaatctcaaacagcccctggatgttctgctggattttcaggctaatggagcacatttttgtgtgattatctgagcctagaccagtgtttctcaaactttaataggcatatgaaccacttgggagccttcatgtagtgaagggtttttttttgtatttttaaaacggatatatcatagatgtatatatttttgaggtacatgtggtgttttaatacatgtatacaatgtggaatgatcaagtcaggtaattgggatatccattacctgcaacactgatcctctctttgtgttgggaacattacaattcttctcttctagtgattttgaaatatacaataaattattatttattataatttccctactgtattattgaatattataacttatcctttctatctacttatatttatgtaatgaagattctaattcttcaggtcttatatgtggcctaagagtcccatataaccagctccaggtgacgcaaagacactggttcatgggtccccctcccagaaggtgtgattgaactgactggggtgagtcctatgcatctggagcattgaaggcttcctgggctgttttaatatgcaatcatggttaacaattactagcctagagactaactctttttagatataaacacaatgtaatttttacatggttttaggtacagggaatcttttatgacaccatgtaaatggaagaaaggctgtactttgatttgttttgaactgttcctaagagctgttcaccctttggaaagttgagcccctgatggcaagaccagtcatagtatttgagatgttaattcattctatctgtattggtagcttttgaattcacagtgatccacctaacttggtaagtttttgacactttcaatgggtcttccctagtataatcatgcccaaacatttatatatttatatacatatgttgatttactttctttttatttctcatttataatacaattaataattatgttgattttttaaaaatatgtgggcagggaggttattatctgtcaatgtcattttgggatattagtggggcaattgggtctgatagagctgaaaacttctgaatcagaatggagggcaggggagcaccatcataggcagcagacttgaggaaaggggctttaggctataagagaactgaatacagtgtcttcacctgaaggtcagtggatggcttcataagtctcattaaaattatgcctttttttttttttttttgctttgagacagtctcactctgtcacccaggctggaatgcagtggcacgatcttcgctcactgcaacctctgtctccccattcaagcaattctcatgcctcagcctcctgagtagctggaattacaggtgcgccaccacgcctggctagcttttgtatttttaatagcgacagggttttgtcatgttgaccaggctggtctcaaactcctgaccacaagtgagctgcctgcttcagcctcccaaagtgctgggattataggcatgagccactgtgcttggcctaaaattacaactttaaataacaaaaatttaaatcaaaaaggaaaaagcccataatctgactacctattcaaataagctattttcatttttttctgtttcttatccatgtatatgaaaataaaaaataatgtaattgtagagtagatatgattttgtattttttctattaatattgtggtaaacacttcccttttaatgactgtatcatgttcttataacaatgtcttaaccgtttcgctaattgtaactgaaaatggatttaaatgtttgctactatgaataacattgcaatatatatttgtatgattagaatttctttttatagtggagagattattcctttagggagaattgccaggagtgagattacatggtcaacacctatgaatatttttatgactaaaatgtgttgccacatagcttgctggaagggctataccaaaagcaagttggcttttaaaggtcaaacttattttgatacaagatctacatatgtgccacattaactaaccatttatcaactggtgagaaataaaatatatcatttcttaacatacagaataagaatataatccagcaattgtgccaaaatcttcatgttgtgaatgggccaggcaatcacaaacctcagttctcttcattttggtcataattttttttctaattatgacggagtcttgctctgtcgtccagcctggagtgcagtggcatgatctcggctcactgcaacctctgcctcctggtttcaagtgatttttctgccttggcctcccgcgtagctgggattacagcaccctccaccacacctggctaatttttgtatttttattagagatggggtttcaccaggttggtcaggctggtcttgaattcctgacctcaagagatccgcctgccttggcctcctaaagtgctgggattgcaagtgtgagccatcatacctggccctttggtcataattttaaagtagatcccctcttctctaagtcacattttggaaactctgtggcccaagcctcaggtatggttatttccattcttctttttgccatagcatacgtgagagggctgaggctgtaattttacttgtgtatatgcatgttagatctcattttacttcataatctccaacacttgagaggattaaaaatgaagattatggccggtgagatgggtcatgcctgtaatcccagcactttgggaggctgaggtaggaaggttgcttgagcccagaagtctgagaccagcctgggcaacatggagaaccccatctcaacaaaatatttttaagatgagccaggtgtcatgtgcctgtagtcctagctacttggaaggctgaggcgggaggagcccttcaggggttgaggctgtcatgggctgtgattgcactccactgcactccagcctggaacacagagtgagaccttgtttcaagaaaaaaaaaaaaaagaaaattacaactggttcccaaacttcttggaaacaacataactttcctcttaataaataaagcagtcagattctgaggtatagtttaaaaaataccttacataagtgatttcatctgcacagtgccagagttgcattgttctattattcttgatttagcagatgcatttcatgaaatggctaaaatatacatgtgatagcacttagggaaattggagccataggtgatgtcagagagaatagatcccttccatgacattgatttaaatcaggtgacaggatctgagatctggtgtttttaaaactgcctcatgatgacttttagtcttagcaaaagtggctaaatccctttctttcttctccctccaaaatacttaaaatctttgtgtaaaattgggaataacaccatttattggctattccacaagtaagacactcacttgcattcattcttggggttgctttcttttcttacattcttatttgattttcccgtcttgagcactgatttaaacttccttgaagatcagggcatctgtttatttaatttcatggctgcctctttttcttattatctccagggacatctttatggatcactgaagaagaatacttcatttctcaaacaacacaaattatggcattcagcagcagccagatataccttacacgtggaattttaaatgcaggggaacaccaaataagttggtaaaaccaggaagaatggatgggatggtcttaggagcaagcatgggggaatgggtgctcattataacattattagtgaaataaaataaaccttaaaaaagagtgtgttttaggttcatgtactagagacggttgtgagactttgggcaaattccttatcttttctgttttgagacatagtcttgcgctattgtctgggttgaagtgtagtggcacaatcatagctcagtgcagcctctgggctcaagagatcctcccacctcagcctctcgagtagctgggactataggtacatataccaccaccactcccagctaatttaaaaaatttttttgtagagacagggtctcactctgttgcccaggctggtctccaactcctggctttaagcagttcttctgctttggcctcccaaagtgctggaattacaggtgtgagtcaccatgtggagccttctttaacttttctaacctcagatttatcttccataaattgggttaatgcctactttcatcaaggttagataatgcttttcttcctcagtcttcttccttgtggtgggtcctgaatgatggcaaacgaaggtggctgatatttgaaaaacccagataggcattttattctattatttttattttacctctggtattgtgggagaaatattagcctttggactcaataaacaaactccagacataatgaagtatttagcaaggtggaaagatgcaaggcccatagacaaaactcaattttatttatataaagcaccagcaaaaaattggaatataaaacaaatagaagtatcctatccataaaagcatccaaaaaacacaaaacaaaaataaatttaacaaaagatgtgtaaagctctacactaaacagtcaaaaatataaatgagagaaattaaagaagatctatataaacggagaaatatgctatgtttataggctgggagactcaatattgttaagattgttcttcccaaattggactatatattcattgacatcccaatcaaaactccaaaagaaatttttggtagaaattaacaaactatttttaaaatgtatatggaaatgcaaagaaccaagaatagccaaaaataatcttgaaaaaaacaacagcaaagtctgaggatgtaccctaccagattttaaagacttactacaaagcaatagtaatcaagaccatatggtattggcatgaggacagacaaagcagtcaacaaatcaagtctgaaaacagacccacacatagatgttcaaatgatttttcagtaagtgtcaaagtgattcaagaggaaagaaaactctcttcataagatgacattgaagcaactgaatatctaaatagagaaaaaaacccttcaacttcagctttacataatatacaaacattaattaatatgaatcacaaacccaaacacaaaaagcaaaaacttcaaaagtacctagaacaaaatagaatgatttattatgatttctgcaaaatctattaattcaatgcaattcccattgggtacagtgtacactgcttaggtgaagggtgcaccaaaatctcacaaatcaccactaaagagaacacaaaaaatgctaaccacaaaagaaaaaaatgataaattgaactttatcaaaattaaaatcacctgcttatcaaaagacactatggtcttagccagagctagtcaaactcttgctgcttgctcatgacatgatcctgtacctagaaaactctaatgactcatccaaaaagctcctaggactggtaaatgaattcagcaaagtttcaggatacaaaattaatgtacacaaattagtagccctgttatacaccaacagcggccaagctgagattcaaatgaagaactcaactccttttacaatagcttgaaaaaaaatacaatacagaggaatatacttaaccaagaaggtgaaagacttctacaaggaaaactacaagacactgctgaaagaaatcatagatgacacaaacaaacggaaacaaaacccctgctcgtggccgggtagaatcaatattgtgaaaatgaccatactgccaaaaacaatctacaaattcaatgcaattcccatcaaaatacacagtcatttttcacagaactagaaaaaacaatcatgaaattcatatgaaacaacaaagagtccacatagccaaagcaagactgggcaaaaagaacaaatcaggaggcatcacgttacctgacttgaaactatactataaggccatagtcaccaaaacagcatggtactggtataaaaacaggcacatagaccaatggaacagaatagagaacccagaaataaacccaaatacttacagtcaactgatcttcgacaaaacaaacaaaaacataaagtggggaaaggacatcctattcaacaaatggtgctgggataattggcaagccacatgcaaaagaatgaaactggatcctcatctctcatcttatacaaaaatcaagtcaagatgatcaaagacttaaatctaagatctgaaaccataagaattgtagaagataacattggaaaaacccttctagactttggcttaggcaaagacttcatgaccaagaatgcaaaagcaaatggaacaaaaacaaaggtaaataaatgagacttaactaaactaaaaagcttctgcacagcaacagaaataattggcagagtaaatagataacccacagagtgggagaaaatcttcacaatctacacatccaacaaaggactaatatccagaatctacaaggaactcaagcaaatcagcaagaaacaaacaaacaaacaatcccatcaaaaagtgagctaaggacatgaatagacaattctcaaaagatgatatgtaaatggccaacaaacatatgaaaaaatgctcaacatctctaattatcagggaaatgcaaatcaaaaccacaatgagataccaccttactcctataagaatggccgtaataaaaaaatactggatgctggagtggatgtggtgaaaaggcaacatttttatgctgttggtgagaatgtaaaccatggaaaacaggtgtggagattctttaaaaactaaaagtaagtctaccatttgatgtagcaattccactccttggtatctacccagatgaaaaaaagtcattatacaaaaaagacacttgtacacacatgcttgtagcagcacaatttgcaattgcaaaaatatggaaccagcccaaatgcccatcaatcaacaagtggataaagaaaatgtggtacatatataccatggaataccagtcagccataaaaaggaacgaaataatggcatttgcaacactctggggtggaattggaaaccattattttaagtgaagtaacccagaaatggaaaaccaaacatcgtatatgttctcactcataagtgggagctaagctatgagtacacaaaggcataagaatgatacaaaggactttggggacctgggggaagtgtgggaaggatatgaggcataaaagactacacattgggtacagtgtacactgctcaggtgcaccagaatctcagaaatcaccactaaagaacttattcatgtaaccaaacaccacctcttccccaaaaacctattggaaaaaaaaagacaccatgaagaaaataaatagagggcaggtgtggcggcttatgcctgtaatcccaacactttgggaggccaatgtgggaggattgcttgaagccaggagtttgagaccagcctgggcaacatagtgagacctccatctccacaaaaagtaaaaatactagccagacgtggtggtgtgcacttataatcctagctacttgacggactgaggcaagaggattgcttgaaatttgatgttacaatgagctatgattgtgccactatactccaacctaggcaatagagtgagaccttttcttaaagaaagaaaaagaaaaagaaaaggaatacataagccccaaactagaaaaaatatttgtaacacaaagatttgacaaggattttgaatctagattatatataaagaacttctacaaatcaataatgaaactttgagcaatacagtaaacataggcaaaaggtttgaacagatgtattacaaaagaggatatatgaatgatcaattaacacaaaaaaagatggtcaataccattagtccttaggaaaaggcaaattaaaattgcaatgtgttacgtcacatgtacaaaaacggttaacatttaaaagactaacaataccaaatgtgggtgaagacatggaaaaatggatctcacatatattgctggagagagtataaaatggaacagccactttggaaaaatatttggcagttacttatgaagttaaacatatatctaccctatgaactagtaattaggtattaaatgttgagaaatgaaaacattcattgagccaaacctggaaacaatccaaaggttcatgaacaagagaatagataaacaaattgtactatattcatacaaaaatacttcccagcaataaaaaagaataaagtactgatatgcacaacctacaagagtctcaaaaacattatgttaaacaaaagaagcaagacccaaagttaaacgtgctgtatgattgcctttatataaagttcaagaacagacaaaacttatctatgatgagagaaagaagaacaatggttacctatgagcgggattcactggaaggagtatatggaaaattttgacggtaaaggaaatgttctatgcttggaaatttctaccaaaaatggtgttttttaaaagacagtttgaggtattgatgaagtgtatatatacatttatcacaactcatcagattgtacacttaagatctgttcactttatataaattttactttaatgaaaatgaaaaagaatgcatcttaattagaaatcaggctgggaaaaccaaaggaaagcaacttaatttattttgtttctctggtatttaaaattgaaataatccatatgtcaccaactcaaatattttctctccaccatctattttatacatctttccagttttgagtggcaagcaaagaggatactaattcacagttttttgttttgttttgtatttttagtagagatggagtttcaccatattggccaggctggtcttgaacttctgaccttgtgatccacccacctcagcctcccaaagtgttgggattacaggcgtgagccaccgtgccctgcctgattcacagttttatacatataataagagctgcaaatagtggtttgcattttcattacttccagcaagtagtgtttcattatatgcattttacagtatctttagttctcttgtcaagccttgtagagcacttgaagtgctcttcatttaatggtactctacttctcataggttgagcagaactgaagggtagggaaagattgttttgggaaatccagaattctttccctaaacctttacatttttagaaactaaaatacctgggagaatgatgaggagacatgctgtaattaaggaagtaatctgttgatggtgtggcggtggcaatgattagtaagaggtgctgagcacagtaaatacataacccaggagaactaggtgccctgtgtttcaatgaggaaatttcatcggaaaagttagaattttatgacaagcacacataaacatatgtcccaatagtcccttccagctattgctgtccactcacacttataaccattcagagctatctccttgctattaatgtctaactttcttactgacctaccagcagggtttcccccacccagctgtgtcccttcaggatctaaggaactattaaataagaaaaaaaatttttgtccattcctgttccacatcctgtcagcatgacccttctccttctctatgtccttctgaggcatcctaattactccacagagcttcacactgcatgctgtagtccaaagtacattgcagctcccctccttctttcctgacacccagtttgtgaccagtcatgtacttggtggctggtcattcattagctcatactcatactctctgttgttgctgttaatcaacctcagcaagctcttgatgttaaggactacgacttctgtttcttgtactccaggcagtgctctatcatatatagctgtttaattaacgaatgaattagttaactttaactcaattccagaaattaaatcatatttggcagctcaaacctataagttatagtgcatttcttatcaattttaaaataaagagtttatttcaacctttcttgagtgcaagaaaggttcagttttatccagaagtaggaacataaacttattatttatttatttatttatttttttgagatagagtcttgctctgtcacccaggctggagtgcagtggcgtgttatcggctcactgcaacctccgcctcctgggttcaagcaattctcctgcctcagcctcatgagtagctgggactataggcatgtgccaccacgcctggctaactttttgtatttttagtagagatggggtttcaccgtgttagccaggatggtctagatctcctgaagtgtgatctgcccaccttggcctcccaaagtgctgggattacaggcatgagccaccacgcccggctggaatataaacttattaaatatctctgtaaatccttcccagttgggtagctctgtcctatgattttgctatctgggcaactgtagatgatgaattagctgcgattgattttcatcatcagtcatcagccatagcatctgctatacctctgttgactccgtcatctcctagggagcttgtactcaacattaatgacaacattagcccaggtgacatgtaattaagaaagcaaacctttttccaaccaaaaataatatgagagattccaaatccaaacagaacagagctgtggatcatttcatgtttgtcttcatatcattctctccactccactccactgacacagcgtgatgcttgattgtcctctaagccccttccattgctgtcatctgggatgctggcaatgtattgtgctgaaagggaagcttattaataaagttagtaactcgaagagtcagtgcaggttatttgtaggatgctcattatgagtcttgagtctgactcagtccagaaagcaatggaatattccgcataaccacctaaaggacttctctttcccccttccccagggtctgtttctcctgtaagggttcagagctgcctggcagaggctggctgaaataggagaaatcctgacttaagctgtttcaggaaagtgatccagtctttggagaataatcaggacataattaagtatgagtaaaaggcttagagttagtctgttctcctctgtaatggggtgttcactagtgtgacagttgtttttgtgactattgcttttacgtacatttttgaccagcacttggaacactacctcagggtaacttaaatgaaagtccattttccaggatggagtaaactgacagaaatttccatcgtgcatcaaatctgctataagttgtttgccttctgggtatttttgggccctagttgtactcctgaagaaataaccactgttgctccaagtagaaagtggttgaggagacagctaacagatacgtccagttcttattttctatcacagagatgtgaaaaaaaaaaagcctaaattatcttagaaggaaaagcattcctctgtgctggatttccagtgcttcccagctttgcactgttagcttattttttccaatgtccctataataacaatccactcctttctctgcactcctggcccctcgtgatgttttatcatgctcatgctgaaagaaaaggtgtctgtccatactgtatctcttcatttggcctcagggatttccctttgatttggaaagaataatctttcaaattccgctataaactatacaggagaaagagaaaaataagataaagctcctggaatgtgcactggtattgacatttcgttcaaataatgggctgaaggtgaactatctttactattgctcatgtgaatgatcaattattatcaatccaaactatcaacagtgctgcttattattgatttatactgcatggtttaattttgtctccatccttccagacattaaaacatagccaatatttagcagttcccgccattcaccatgagcacctccacagcccccaactcctctctcccagttctgcccaggatatttatggtgagtagcgagttatctcctctttggcagtcatccctgctttcctgtgtggaggaattgcccacattcgcatttgcaaacagaggctcactcaagtgtcactaaaggaaaggaggtggagcctgaagagctttaaaaagcaaagctgagtcattccacttttcaaaaagagaaactgttgggagaggaatcgtatctccatatttcttctttcagccccaatccaagggttgtagctggaactttccatcagttcttcctttctttttcctctctaagcctttgccttgctctgtcacagtgaagtcagccagagcagggctgttaaactctgtgaaatttgtcataagggtgtcaggtatttcttactggcttccaaagaaacatagataaagaaatctttcctgtggcttcccttggcaggctgcattcagaaggtctctcagttgaagaaagagcttggaggacaacagcacaacaggagagtaaaagatgccccagggctgaggcctccgctcaggcagccgcatctggggtcaatcatactcaccttgcccgggccatgctccagcaaaatcaagctgttttcttttgaaagttcaaactcatcaagattatgctgctcactcttatcattctgttgccagtagtttcaaaatttagttttgttagtctctcagcaccgcagcactggagctgtcctgaaggtactctcgcaggaaatgggaattctacttgtgtgggtaagtactccaatgaaaaggtgctccaggtctccgggaaactgcccccacatccctgttggttcaatctggtatacttgggcatttaacaaagtttgtctttgggtatgtatagttgcttaatttttgttttctgatgcatgtttattttcttactggccattagagctaatctgctaccaactataaaacttcataactctcaaactgtacttctgtgtataagtgaatgaatatgcctcattttaaactagcagaacatttcatggaagcttcagcttttactctgacaagaggagtaattaacacctggctaattgcttggaaattagggaaacagatggttgattttttgtttgtctgtttgaaactcttaagccacaaagaaaaaaatccttccttctgataacttgtaagaattcagaagttctaaaaattagtgaaaaatggaaagggaactgtgaacaaaggtagttgtgaaaattaacctaaatttcaatttcaacctccttcactttctccccactcttactgtttctgaggctctgacacaactccggagttttagtaacaggtgcattgcaactttaagaactgccaaatatgataatgggtaaataagccacactgtcctctcatattaaatgaattttttgccaaggggaaatgggagcttgactgaatgcgaattacaatcctgccaaaggatattgcctgaaaaacattctctctctaactgttaattcatttatttaatccttgggtgagcctccaacctgctgcttagacacggcagccgcctttgttgatgagaggttatagctgccccgacattccatttttatcagcttgcccttttgagatggcgtctggcttttaaaaagaggtagattgagggggaaaacacagtacagtttccagaagagacacctatggaagacagtacacaataggcaatagtttgaataaagagagcagaatggagccaaactgccaaagctaggctgctgtcctggctctcccattaaggaagttcccgatgaggaaatcaggtgcttttgctcagaatctctggactctgttctcaggtagcactccttgtaacaggtgagcagaactctagggtatttgaaataaagacttaatcctagtgatctctatgttcccagcacctaggacattcctgcttccacagtgtgtactcagcaaattcttgtgtatgaatgaggcgtctttctctgatctgctaatgacatagtcctagagaacagcaacaaaaagagggtgacaaatgacaaaaatggccccatgaacctcagactcagctgttggagacagaagtaaaacttctgtatacagttatgtcaaatggactggactctctttggggtgggagaattttccgtggagtagttggcaaatatctagagttgggcactgtcatttgcatgggatgtgaggggtgatggttgggccgatctatcaggcagccagaagctaggaaagaagaacccaggttgctgaagcagaacccaagaaattacaaaaatgagcttttatggatggctctaggatctcagaatagtctgattcctgctggcaagcaagtctatgccttgttttccttgccacctctggtggctcagaagtgccttcattgaggtaggttgtacccaataaacatgaaacccaggatagaaacaataagttggggagactgtgtcacagagtggaaggaaccacaggttttagaaacaaacaagcctcatttcatatccatgctaccaacttaatagctgagttactttagagtatctctgggaaataataccctcgcccactgcttttaggatttttttgtggggaatcacatgagataacctagcatgtaccaaagcatggtgcttagcagagtatgctcaataaatgtcctcctgggctccacgtcttggctaaatctctgatcaagtcatacgatgagatgccgtatttgaacagtgcagtgacacggcacagatccatggagtgtggaatgtgtggatggcactttgggattccctgcctctctgctacctcatttcttgcaagtcactggtttaaatcccgtactttacgctcctggtctcatgttagctgataactgcctgggtcaccctttgtcagtcactgtgtgcatttcagaggatagtatttctttctcctctctaaatagatatggtgccatcatctatttttccctcatttaaattctacttgccttatttcttgcccttggcattgagacagatcacctctgcagccacctgacccagcaggaagaatgctttatggtctaacagtattcaggtaaacttatgcaagattgttactcatgtgactgctagccggataaaccaagtgatagcaacacaattaggtttctttctattcccctccctctccctccttttaactgagtattctgttagcgtctacttgagctacagcaggtgaggacagcaggaaagaaaactgctggcaagtggtttctgaaccttcaagtctatttaccctggaggacaaataacagttgaaaaagaaattgttcctgtttggcttctgtacctgcattatttatatgaacttttttggtaataaagggtaaggaagaagtacagcctcccagctgcgggagggatcctggggtggcactaagttatcacttttagtagtaaacagtgaaatcagtgatttcagtaccggctaaggcgtggtcagcatcccagtcatgtgcaaaccagagtaattctgagaccagaagcttgtctgttttttcagccagggttatgcgattttttttctttttttctaacagcagtgaaactaacctccaaatattcagtggtgtttggtcattgagcttagtggtaaagaagcataaattttggagacagatttcttgcctggattcaaatcccatttctgctgcttgtgaactgtttgtctcattttccttaccctaaaatgaagataattgtaccctcttccgaggactcttgtcagtattgcgttaatgtattcattttcagtgctggctgtgcattagaatcactaatgtctgggtggccaccccgggcagtctggatcagagtctcttctgggagtggaatctaggccttatttttttttaatgtggtgattctaaccaacagcctgggttagaaccactgagttaatatatgtaaagtgcacaaaacagagcttggcatacaataaacactcgataagcccgagattctattaatgttttgttgttttaaaaattatttttatgaatgtaatggtattttctaaatgtggcttggtttcgcctataatcatcgaacattttttatacatgacaaaatgccatagtgaaaaacccaataatagttctacaacattaaaaattatagtcaaaataatttaaaaatacataactcatatttttgtaatcagaagaaatgtttattaaaaatacaagaacatgtcaacttgatttgagtaagtacctttgtgaaactgtggctctggtgtttgtctttttcttataccaactgataaaaaatttcattcattgcaaattaactctgttcgtcgggtttcttaccggtaataatcttattttaacagcagcaaaaacaagccacttgaaagtgatagcgattatttcagttttttgcatatttttgcccatgtgtggaacccttcccttgtggatttttaaagctattaaaagcatataaaaatggtaaattagttttctcagttaatttacattttggggctaatttgagcttgtcaaaatatttgacattcaatttagaagttgcttgtgttcatggtagagcaagtaattgattgtttctatcaaaagtaaacagactaataatttggctcaagcaaattaaaaaccttactttataatttacaaatctgcctttatgaaaatccatttcaaattattccttgggtagtatggttggttggaggttttttagcttttagtttttgtcttttttttttaatttcaatttttactttacattcaggtgtacatgtggaggtttgttacaaggggatattgtgtgatggtgaggtttgggcttctattgatcccatgtgatcagttggttttttatttttatttttattttttgagacaggttttgctctgtcgcccaggctggagtacagtggcatgatcttggctcactgcaacctccgcctcccaggttcaagcaattctcctgtctcagcctcctgagtagttgggattacaggcatatgccaccacacctgctaatttttgtatttttagtagagatggggtttcatcatgttggccaggctggtctcgaactcctgacctcaagtgatcagcccacctcagcctcccaaagtgctgggattacaggcatgagccaccacgactggcctcagttggtttattaaatcagtactctccagactccgttccatcagtaaaataattaaaatgtaagcatatgcttctaataaacacatttacttatcaattacatacatgtaatatgtacactgtacacatgaacatgtgtatgtaatgaacattacacaacaaataacgtatctaatattttctttctacacaatagcaaaccatcttacatagcctctatgtgatatacaccctccttggaagatagttttagaaaataagtgaaatggtagaataaacgtttaccttttcttcactataagctctgttcctttctcttgattgctaggtgtggttttttttttttttttaaatttcaagtaaaggtgggttattcatagcgaatgacttttctcagagtgtgtaatggtagaaacagaaatgcgtgtggttgtgctgagattcttccggaaggagtggaaggccagatgatgttcctgagggggacctggagtttgagaaatgcccaagtcctgtggcttgctgggctcagcatctatttaaattaaagtgacctgcacctctatcatatgttccaggaaacccaatgtctctctcctctgtcttggaagatgctggaggtgggggctgtgatgaggaaggcaaggctatgtgtcccttctgggcctcctactgaatgattcatctactgtgtgtctcactgccctcatgtactgtccctttcccatacttcaccacctcacaccagccaccaccctgtctcacttacttcttgaaagaacgaggaaacaattgttatgagctgtgaggggacagactttacctgaaggtttgctgttgggagggttggggcaagggcaggggctgcttacatcccagcgcttccaacaacaaagtaaaacatttttcattcctgttcctaaaagtgacacaaggtcatctgtggaagggacttgccagacatctctttttcttgggccttagtcttccaccacatgagcgaaaccctctttctcccacagtgatactgacctgcaccttggccgctttcctgggcctccttaatctacttcagaccatccatatccttctgcagaacattttagatttcttcttcctccaattttgcttttctgatcatatccgagacttgcctttttaaatgaaaataacttcaaaaactattaaatagtgagctgatgtgttttgctaaacaaaaacagttgtgtactcctttgagaatttctggctcctgatttcaaagtaatcatttttcttttccttctacaatgggagatgttaattttgagacagaagtgaagattcttgtaggcagtcccaggtattaggaatgcatgcttctctgtctctctctctctctctctctctctctctctctctctctctctctctctctctcatctctctctctctctcatctctctctccctctgtctgtatctctctctgtcctgtattctgagtctgggaagggactactgcactttggggctggggagtgcctttactttggcttgatggacataagtcataagtaaggcagggcactgacttgaaaagagactttaacaggtctggtcatggccagtgattgtgagttatactataggttgtcctcctcccctctccacaattcttaaagaggacttcagtaaaagttagacattgatctcacttgtgctcaggtgaaatggtacatgagtgacaggtaggggggaactacttccaggagcactgtggcctcacattggtgtggccagagatcaaggagatcagaggagagctcttgatggggtaaggatgagagaggtaggccccggaatctctcagaaaggtctaggatggaaagattttaaagaaggctaatttccagcaatttgcttgtggtggcatggtccaaaaaatttcactataaaaaagaaatgtgcccttatttagtagttactgactggacaggtcaagtgtaaacgatacacatctgtaaatagagaagtatgctcagaatattccctagtcagtcagtggtctgctattgggagcatcaaatagtttggcttgtgaatcagtacaatgtcttttatttttatcgttgatgcataggtttcatttaacaaattcatatagatgaatttataagttgttttttaatccatacagagttaaaaagtcaaacattgaacctcagatgaaaggtaacaaagatttcttacctggaaaataagtcttctaaaatctgttcgaagtccttaaactttttgtcactttgattacaatagaggaaactcggagaacctagcaactttccaatgtaaattgcctgatctaagctattttagcaattattgtacagaagtagtttttataaacttattgcaaacaaaacaattaaagactcaataactatcctcaatagctggaaatgactgcattggagagcgttttcaaaatagtcagtttttaagaaacaaatcactttatctcactggtgtggccagaggtcgaggagaacaggggagagcacttgatggggcgaggagaagagaggcaggccctggaatctctcagaaaggtctaggtcagttttaaagaaagaaatcacgttcttttaaaggattcctaaatctttttcaagaaattttaaattccaggaagcagtttagtgcttagtttaattattactccaaatttgggccatcctagagctagtaaacaaaatattagtcttattatgttatagtttctcatgtgagaattagaattaactttaagaaagaaccagaaacaacaacagcaactacagagatcctgaccattggaatgtaattgtccccattgtctatttacttcttgcctacaggccagcgctttcctccagaatgctaatattgttcaccatgaaggaagtattgcctagatattaggtgaactaagaactagattcactttgtagagattctttattaccactgaggtggttgtgcacacggccatcccaggcccttcccagatgtcctgtttgctggggctcatgacaagatgactgagagtcaggtctggaaggatgaatactattattgccaggtgtagacgaagaaaaaatttcactgaacagaagggatctttacacttcttgaaagatcttactatctctgaaaatgttttactctcttgttttatatggccaaagttaataacttccaaaggcaattgtggaataatgcttgtcaatatgtctttctttaggagatgttctatttcttaagagcatcttccagagctttcttctcaattctgggaattagcaaatgtatagaaacttcagttgttttagccaaatacaaggcagaaacttctactctcatcacctgttgacctccttgctaagtctggaatctgaattggtgtgagcatctgtttttttttttattctgacttgattttctgattctcccaagttgaccaaacatactaatgcctctcactgtctgggtttcccaagtatttcccaggacattcagtacactggaatttgtgtgtgtgtgtgaaggtatttgagagccagccaactgctgtgacagtgattcatggtaggcactaatttatttgcaaagcttcttcccagtgatgtaagagtccttttggagaaaagcactgcctccttcctccattcagactaacttcccagggtgctatggaccagctttgtgtgcagtaagggaattacatccatgaggtggttctttctgtgggtaggtggttgctaggatacagatagtcacaacagcatcacggcagctgccttgttcttcagcacatggtgtatcagttgagaaatagtgttttatttcattcactccaacacttttctggttaaaattttaaaagcttgaaggaggatctttctttttcacacacaccattcttgtataaacaggtcaaaaacagattagtcaaactgaacattgtcataatacatgccggttgacaccaatcctctgctcttccagcccaggccttcccttacgaggtttaaaaacatgctgaagggttgaagctaccaagggtcttctggtgtttttctcccttcctctgaagtgcataattattctgtttactggaagattttcaacacaaaggaaattaacttctccttggtgtgcaaggaaattgcaaaggttattgtcattaatgttaatttacccactatatcttttagattcaagcaacattgtttagaatggtcaatgctctaagtggatcaaaaggcttattattttttggaagacaaatttgaaaaacctgctggaacttttatctctcctggttactctaatgaatcatggcaaagatttcatgtaagtgggaaaaaatgaggtatttgaagaaaaatgttcatctaggatttcaatccattaaaaagcacacaatcatggacacctacctacaagaggataagtgactgtctttcaatactgacatgttgtcttctgagacaggagctaatagaaatatatagcgcatgacatcctctttaacatgagctatgttgacacatatgaagttactgggtttattacttccaagagaggcagtgccattttcaaacaaaggatacattttaagcagagtgaattctggttggttctttatacagtgggttgatcttgtcacacaggcaaaaatggagcagttttgggcagatggttctagtgttacgcttgcttgttgccttactttgcaagaagaagttctctcatctttggtcaacgccctatgtctggcatgtcatgttaggcctcagcttttgaaattgatagggtctaattctggagctgatataagctgttaatacctacctcttagattgctatgagtactaaatggattaattcttgtaaaatgcttagaatcttagctgacgcagtgagttatcagcaaatattggctattactctctaccaaaaaccataaatgagacatattagaaacattttctataatttttataatacctgtttcttcaaattttcaacaatgcttagagaagtcggtttcctgggatgagctaagtcctaaaaactatcttaaccagcaggttctttgtgatttttaaaaattatcctttttattatcctaacatgtgacaaaactccccattaattattttttttaaatagttaatcttgctatttgttacatatgtcttcaagagaattatataaaatattttttatgtatatttatatagctgtacctataggtatatatgtatataggtaaggcccagaacttaatgaccagtgtaggattaatgagaacagtgaaactgggctcaggaaatagcaatacgccaacacttcttaattttacctcatttttgtctatttgtctagaacactcaggatatagtatctataggcaaatatttatgtgtttatccttgcaatttgagaaactaaatttaaagctggttaaaaaagagagaagataattgtattcagtataaatgagacttacaccaaattttgtacctccaataaatttgttatagatttaatcagtagattaatttttagaattcctttagaaagttgagtgtttagtgtcacttagggggaagttatttaagttattgttttacttcatttagtaggactcatgatgacatattttaaaattatttttattattttttgagacagggtctcactcttgtcacccaggctggagggcaatggcacaatcaaagcacactgcagccttgacttcctgagctcaggtgatgcttccacatcagcttcctaagtagctggaactacaggtgtacgccagcacacccaactagtttctgtatttttagtagagacaggatttcgccatgttgcccaggctggtcttgaactcctgggcccaagagagccacccaccttggcctcccaaagtgctgggattataggtgtgagccaccacgcctggcctatgacactttattgatttcatatttgaagttccaagaaacaaagaaggaaacaattcacagaaagtagaggttaaggtgaataatatttatgtaggaatttactacaagtttaagcctccttgccaaagtgccacaaaaaagaaagttattgaattttttagtgcatatagaatatgaattaaattgataaatgtcagattacgaaggaccttcaagatcatttagcccaactgcttcttattatggatgagaggctgagatctagacagatgaagtagcttctcaggtcctatgagaatatagctcaggaccctagactcttattctgtgaaatttacaatgcacatgacacctcccaagactgattgttgaaagtccatcaatgtaatgattttattagttctttctaccaaaaaaaattaatagttttaagtcggtttaggaaaacttccttaatatatctagttctctatgttgaaagcactttgaaagtaggattgaataaatgaaatttccttttatataaattacatccatgaattaactcaaatcaagtcagcaagtatttattggatgctaggtgcttgggctgacagtggagacatcactgatccacatacacagggattcctgacagggcaatggggctccagagctcagtcagcagtttacctgatgacttacagatcctcttatttggttttatcaaaactaacccttacaaaattcaacaagtggctcagacgccttcctacaaagaaactaaagattgcagacaacactaatattgcaaacctaagagaataatgaggaaagggcagtcttgacacctttcttattcctaggatgagctttttgttggctacgtaagagctgaaagcaacgtaaatctccatagatctgaccaaaaaaagttaaaaagagaaattaacaagaagacagcctgaaaaatggatttacaattgttattattagcgacgaacctcacaaaaactgtaaagtgtacctgggaagatgttagctagtggtaacatgaagccatcaggacaagcaagatatttgtaaatgagtatccaggatctgaaaatgattttttataatttttacagttgtgttcaaagttatgatagttaagaagactctatttactaagcttaatgaaaaaagtcagaagcctctcttgaggtttcttacattacggcaaaagaggaaaagcctgatattattggtgaaacacttgttcttcctgcttcctgttgtggtaaaatattgctaaaataatacatgaaaaaccacatgacaacaaattaaaatgtgttcctttgtaaacaaatactgctgaaaactgtacagaaagaatcaatgaaaatgtgatgaagtaagtactaagcaattatactgttgaatggaagtaaaggtgtttctaatatatcacagcgtatggttgttttctagaaagtaatagccaaaatttactgggaactcactatgtgtcagacaagattctaagcactttacatgaattactttacttattctttttaacaatctctgaggtaagtattactattattcccattttatttttgcagatgaagaaaccaagacacggagaggttaagtcatgtgctgaaggccacactgtcaatagtattggagccaataaagagtcaacatgagtactccgtctccaatgccagtaatcttagccactatcataattacctcaacaatgaaatgctcagagaactgtaattcttttctatgagagagtaagggaaaaatgcaacagaaaagaaattttctcagtgaaagttctcagaagtcagaaatgacttttttatatatcagaaaatgttctatgaaaaaaatggtataagtgtattcagcagtggtacacccactgcatttactaggacatcaaccaaaaagcattcttggtgagatcacagagaacaccacagccttcacagcaagacgtgtggcaaagaagttgaaactggaattgcatcaagcattatggaacatcattgatgtagttattcctataaaacaagactagtctctttataatactttgtactggatggggagtaatcataaaaatctttgtcttacatacttcccacaaagtatcttgaagcaaagcacttaatagaacagtcaaatgtcacatgtcacaaaacgtcaaatgtcacaagcaggaggattgcttgaggccagagtttgtgaccagcctaggcaacataggagaccctatctctacaaataacttaaaaacttagctgggcatggtggtatgtgactgtagtcttggcttttcggaaggctgaggcgggaggatctcttgagcccaggagttcaaggctgcagtgagctaggattgtgctactgcactccagcctgggcaacagagtgagacactgtcttttttttttttttttttttccgagacggagtctctctctgtcgcccaagctggagtgcagtggcgcgatctcgtctcactgcaagctccacctctcgggttcacgccattctcctgcctcagcctcccgagtagctgggactacaggcgcccgccaccacacccggctaatttttttttgtatttttagtagagacggggtttcaccgagttagccaggatggtctcgatctcctgacctcgtggtccgcctgcctcggactcccaaagtgctgggattactggcgtgagccactgcactcggccgtgacaccgtctttaaaagaagaaaaagaaaaggacaagtgtttaacaatttttggctttttaaaaatttttgtgattacagatagatgtcagtagtatgctacccaaaaagtaactaaaacaacaaaactttatccaagttataggtgatgttttaacaagtgagaaagtgaccactaattataagaaatttgtgtaggaagagagcagtttgaagatagatgttggagatgtttccattgttatgtgattttattgttgaatcaatgccaatatgtcacctgttaaaaattcttgtgtctgcgcttttaaaacatttacaaacagctttctaagctattttaaaaaaatcttccaaatacagagtttttgtctttttaaatccacttgttaaaaacgtaaaatgcaataccttctggttagttttcatttactgtttaaaatctagaaagatagaaatttgctggtctaattcaacaaaatttgtgaataatcgagggatgtaattaaaaagtaaattttgtgattttgtaaatacagccaatgatgcatttatttcatctgatgtagacataattgtgaaaaattatttttgtttaaaaaagctgtcaaaaaccaaatatcaaaacatgttgatctttaaactagattttttatcaaattcaagcttttcagtaaatgcaaactaatcagaaggtgttatgtaatctcaatttttaacatgcggggggacttttgggactgtggggcattcctaactggagatgtccaccaaagacatgtccaggccgggcgcagtggctcatgcctgtaatcctagcactttgagaggccgaggcaggcggatcacgaggtcaggagattgagaccatcctggctaacacagtgaaaccccgtctctactaaaaacacaaaaaattagttgggcgtggtggcgggcgcttgtggtcccagctactcgggaggctgaggcaggagaatagcgcgaacccgggaggcagagtttgcagtgagaggagattgtgccactgcactccagcctgggcgacagagagagacaccgtctcaaaaaaaaaaaaaaaaaagacatgtccaaaagtagatgcaaaactcagtagacagatcaggatagtgatttctgaattttgccgtgtgtgtgtgtgtgtgtgtgtgtgtgtgtgtgtgtgtgtgtgaaacatttggaaaaacttttctaatgctttaatgttggtaaattcattttagtctagtaatggtagactttaaataaaattgagcataatttgtgttgaaaagctgaggggtgtttaaacttacttaaggtgaaggattacctatagcataggaacattataacggttcactgttctgcaaaactgaattattatgagttttaaaagttataatgagctgtagtattggataagggatagacacataaattaatagaacagaagagaaagttcagaaacggactcacacaagtacactcatttgatatttaacaaagatgttaaagcaatttaatggtgaaaggccagtctttttcaacaaagggtgttggaccaattagacatctataagcaaaataataaacatcaatcaatacatgcaagatatacattagtttgatcaggaaacgagggacaactcaaagagtagggtaaggtggggttaggttccaggtcacagaaagtttttcaaagattttctgattggcaattaattaaaagacttatcatctaaggacctggaatcagtagaaaggaatgtctgggttaagataaggggttgtggagaccaaggttttattatgcagatgaaacctccagacagcaggcttcagagctcttataagatctaaaaaggtgccagactcttagttaattctctcctgggtcgggggaaaggcctagaaatgaatggggattacctgcagaatgtagattttcccaacgagagacagctttgcaggaccatttcaaaacatgtcaaagaaatatattttgggataaaatattttgatttctttcagggtctgctatttgtcgtgtgatgctatactagagtcagtctggaatttggttgtcctattgctacaaaaagtctgttttgtcaatcttaagatctttcttttaatgttaatgctggtcagctgtgcctgaattccaacgggaggagggtgtaataaggcatgtcccaccctcacttcccatcatggcctgaactagtttttcaggttgactttgaaatgcccttggctgagaggaggggtctattcagttggttgggaggcttagaattttattttttgtttacaaatgcaatatattatagaagtagatataaaattattcaggtgatgtaattataggaatctatttaaagggacctgctttataattaattatggaagatggatgtagggaatccagccttatggtgaatatgcctagaacagtgtttcctggtgtgggttccttgacacaactgaactaaaacacactgaacaatttctagtacattcagataagcagtatagcttggtctttaaaagctagggtctgtgttgagaaaggcatagctttgtacccctaccccgctatttattggccttgtgacttgtggcaagttaactgcttgaaactttcctttcttcttctgtaaaatagagatgttgagagcatttacctcctagtgttctccaattgaatgaaataatgcattcaatatgctcccccagagataacacacaatatgttgactgtaattattctgatgaaattcaccacccaccctgttagagtgttagagtgtggaatagcacattaaagactgagaagtcctgttgaaaacaaaacgaaacaagtttcatgttgcagaacttgctagtctcaattaatatcctgaggacctggaaagtaagcctcttcagtttacatgtaaatgtggctgggggtaggtaggggctgttttctgctctggatgacacatttctatcactactctaggcaatcttcattcacaattttggtgaagcaaaatgagttccagagcatttttttaatggaattaagacttaaattcaaatctcctggctcttctttctgggtgcattatttttaaatcatctggcttctctctctcacttgacctgaattttgacatagatgaataaactgagaagaaagctgtgaaaagaaatttgtgcttgatatggttggctgtgtgtccccactcaaattccatcttgaattgtaatccccaggtgttgagggagagacctggtgggaagtgattggatcatgggggcggtttccccagtggtgttctcctaatagtgagtgagttctcacgagatctgatggttttataaggggcttcaccgctttgctgtctcttctcgctcctgccgcatgtggagaaggtgcttgcttccactttgccttccgccatgattgtaattttcctgaggcctcaccagctgtgtggagctgtcagtcaattaaacctctttcctttgtaagttacccagtcttgggtatttctttatagcagtgtgaaaatggactaatacagtgctcttttaagtaccgtaactgaagaggagatgagatagttttttggagtgaataaaacgttctgtacttcataaaacccaagctgtcatttaagtcagcacctggggagtagtaataaatgactcttcttaggggctttctgtgggagcagtgtgaggaggcctcagccttccttatgtaggtccattagtttagagccacattcttttctcatggtgtcactgaagtttttgaggtccagaagctccctttgcactctcttcatcttgtgagctttcagtctgtctctagatttagggcaagaaacctgtggtggtgagggcaggtggcaatgttcacctgatagacagctaggatttcttgttaatctggttgtggttatcatttatgtgttaactagctctcatgagtgtttgcccccaaggcctgcagaagacaggtaatgtctcttctcacttacctgtgtggggcactccctcagactcacagaggatgaaggggtgtgtgttataaaatgttctgtttctgcttcctacttcaagcaaagcttgcttttcatcactgacctctgtgttatgtagtcatagttctttgtagtcactgatgaacatcttcaatgtgctccaaacattctgaactcctttctaattcctgaagatcccctactaatccctaggttgagaagtcagaggttctaattgatttgctgtttgctgccttaaggtttgtgttccctagaaatgatgtttcattttgtatgtacttccccccttactgaactgcacccaaaacaaatgttgtaggttttgacatgggaaagctttagctgttcaaacatgcacaccttgctgacattcaaatccacagactgtaccacacatcagtgtttacagagttcttgacaggtctgaaaaaacattaccatatttatcatttccattggtagaacagaataatggcaaatgatatacatgtagtcctccataattaataaaatactttcacatctgtaattattattcacaaagcctaattctcaaagtgtttcattttctttaaaattatattttattacattcttacaaatatagcctgggctctggtttacataaaatgatgttgacagtgtaggaaaaataaacggtgctttgagggaatggaattacaattggctacgcaaagaaaatgaagattgtaatatcttgacatgtgacaacccagaccaaggcagggtggagttggaagtgtactagattgcgagtgcactagattgcgattgcagtacctggattctaattccaagtctaccacctactagtggtgggactttgggaaacatcattgaatttcctcttaattagatccatgttttcctggttcaccaagacctgagaatcacctggagtgcctggtcaaaaaaaagaaaaaagaaaaaagcatagccctcagcccagccctgctggattaactggaatctcaagagtagagtagggatctgcaaaaaataggaacattcactcacagagaggcaccctgggtgattattttaaacaaacaattttgggaaacaatttgaaaatgtcaagagtcttcctagttgctaggatctgtatgctatgattagcccttagatgggcaaaatctgaagataaaatgtattaattatttatactttgattttgtagttttataactactctatttttttgaaaagttacagaagttagtgctataatttgtgctttatgaatttacaaattcttgagatttctcttttccctttgacttattggtttattggttcatggtgttatgttgaggataaatgaggtcaggatgtaaaaatttgttattattattgctgttagtaagataactaccattgactagacccatcttttattaatttgatatatctgtttctatggctttgttctattagtaaaagcgcaaataaacagaacacaattatttcttcattagtttattgatttattcaaaatttttgagtgcctattatgtacagaggattgtactgcattatgtggtaaggaatattaaaatgtttaaagagccttttctttctctttttttttttttacatgaaaacctcccatttagtcatatatatatatatataaatttttttttttttttttgagacggagtctcgctctgttgcccaggctggagtgtagtggcatgatcttggctcactgcaagctccaccacccgggttcacaccattctcctgcctcagcctcccgagtatctgggactacaggcgctcgccaccatgcctggctaattttttgtatttttagtagagacggggtttcaccgtgttagccaggaaggtctcgatctcctgacctcatgatccgcctgcctgcctcggcctcccaaagtgctgggattacaggcatgagccaccgcgcctggcccaatattttttaataaataaaatattttattgatctcaccaatatgtcaatgcattaggaaattaacaatatatattggatacatttattcagcatagactatagagcatgcatgatacacatagcagagaactcttagaaataaatctagatgtccatggtaatctttgccccacgaattagtagctatgagtttaaggtgtctcttcctagtgtcttctttttctccatgatgaattgctgtattagagacaagttattagagacaagttataccaatgttccagtccctgggttcaaatccaagcagttgcacaacctatgtagtgaaaacttgtttctggcaaaaagcaatggcaaacgatatacatgtagtcctccacaattaataaaatactttcacatctataatttcatttttttcccataataatcctctgatacaggcaggggagatcctgtgagatgtccagagaagcgaagctggtggggtcaggactggaaaccaggcctctggctttctgtctagtgccctttccctttttcccaagatgtctacgtgattctacaactgcagtggagcatgggccctcgctatgtgtctgcatagcggggcttgtattgtagcaaagatctgggaataataatttgagtgaattctcttagacatttatgctggcacctatttcaaactctcataatcttacagttctcccagcctcttgtagcatttcttttttttcttttttttttttttatactttaagttctacagtacatgtgcacaacgtgcaggtttgttacataggtatatatgtgccatgtttgtttgctgcacccatcaactcgtcgtttacattaggtatttctcccaacgctatccctccaccagccccccacctcccaacaggccccggtgtgtgatgttcccttccatgtgtccatgtgttctcattgttcaacacccacttatgagtgagaacatgcggtgtttggttttctgtccttatgatagtttgctgagaatgatggtttccagcttcaaccatgtccctgcaaaggacatgaactcatccttttttatggcggcatagtattccatggtgtatatgtgccacattttctttatgcagtctattatcgatagacatttgggttggttccaagtctttgctattgtgaatagtgccacaataaacatatgtgtgcatatgtctgtatagtagcatgatttgtaatcctttgggtatatatccagtaatgggattgctgggtcaaatggtatttgtagttctagatccttgaggaattgccccactgtcttccacaatggttgaactaatttacactcccaccaacagtgtaaaagtgttcctatttctccacatcctctccaacatctgttgtttcctgactttttaatgatcgccattctaactggcgtaagatggtatctcactgtggttttgatttgcatttctctgatgaccagtgatgatgagcattttttcatgtgtctgttggcttgtgatttttgcacattgattttgtatcctgagagtttgctgaagttgcctatcagcttaaggagattttgggctaagacgatggggttttctaaatatgcagttatgtcatctgcaaacagagacaatttgacacatacataaatgtggtctcttaggaagtgtctgttcatatccttcgtccacttttttatggggttgtttggttttttcttgtaaatttgtttaagttctttgtatattctagatattagtcctttgtcagatgggtagattgcaaatattttctcccattctgtaggttgcccgttcactctgatgatagtttcttttgctgtgcagaagctctttagtttaattagatcccatttgtctattttggcttttgttgccattgcttttggtattttagtcatgaagtctttgcccatgcctatgtcctgaatggtattgcctaggttttcttctagggtttttatggttttaggtcttacatttaagtctttaatcaatcttgagtaaatttttgtgtaaggtgtaaggaagggatccagtttcagctttctccatatgtctagccagttttcccagcaccgtttattaaaaagggaatcctttccctattgctcgtttttgtcaagcttgtcaaagatcagatggttgtagatgtgtggtgttatttctgaggcctctgttctgttccatgggtctatatatttgttttggtaccggtaccatgctgttttggttactgtagccttgtagtgtattttgaagtaaggtagtgtgatgcctccagctttgttctttttgcttaggattttcttgggtataggggctcttttttggttagatatgaactttaaagtagttttttccaattctgtgaagaaagtcaggggtagcttgatggggatagcattgaatttataaattactttggcagtatggccattttcacgatattgattcttcctatccatgagcatggaatgttcttccatttgtttgtgtcctcttttacttccttgagcagtggtttgtagttctccttgaagaggttcttcacatcccttataagttggattcctaggtattttattatctttgtagtaattgtgaatgggagttcactcatgatttggctgtctgttattggtatataggaatgcttgtgatttttgcacattgattttgtatcctgagagtttgctgaagttgcctatcagcttaaggagattttgggctgagacgatggggttttctaggtatacaatcatgtcatctgcaaacagagacaatttgacgtccctttttcctaattgaataccctttatttcttcctcttgcctgattgccctggccagaacttccaatactatgttgaataggagtggtgagagagggcatccttgtcttataccagtgttcaaagggaatgcttcctgttttcgcccattcagtatgatattgattgtgggtttgtcataagtagcttttattattttgagatacgttccatcaataccaagagtttttagcatgtaagggtgttgaattttatcgaaggcgttttctgcatctattgagataatcgtgtggtttttgtcgttggttctgtttatgtgatggattatgtttattgatttgcgtatgttgaaccagtcttgcatcccaggggtgaagccaactcggtcgtggtggataagctttttgatgtgttgctggatccggtttgccagtgttttattgaggattttcatgtcaatgttcatcagggatattggcctaaaattctcttttttttgttgtgtctctgccaggctttgatatcaggatgatgctggcctcataaaatgagttagggaagattctctctttttctattgattggaatagtttcagaaggaatgataccagctcctctttgtacctctggtagaattcgactgtgaatccgtctggtcctggaatttttatggttggtaagctattaattattgcctcaatttcagagcctgttattggtctattcagagattcaacttcttcctggtttagtcttgggagggggtatgtgtccaggaatttatccctttcttccagattttgtagtttatttgcatagaggtgtttatagtattctctaacggtagtttgtatttctgtgggatcggtggtgatatcccctttattattttttattgtgtctatttgattcttctctcttttcttccttattagtctggctagcagtctattttgttaatcttttcaaaaaaacgagttcctggattcattaattttttgaagagtttttcatatctctatctccttcagttctgctctgatcttagttatttcttgtcttctaacttttgaatttgtttgctcttgcttcactagttcttttaattgttatgttaaggtgtcgattttggatatttcttgctttctcctgtgggcatttagtgtatacatttccgtataaacactgctttagctgtgtctcagagattctggtacattgtgtctttgttctcattggtttccaataacttatttatttctcccttaatttcgttatttacccagtagtcattcaggagaaggttgctcagtttccatgtagttgtggggttttgagtgagtttcttaatcctgagttccaatttgattggactgtggtctgagagactgttacaatttctgttcttttgcatttgctgaggagtgttttacttccaattacgtgttcaattttagaataagtgtgatgtgatgctgagaagaatgtgtattctgttgatttggggtggagagttctgtagatgtctattaggtctgcttggtccagagctgagttcaagtcttgaatatccttgttaattttctttctcgttggtctaatattgacagtggggtgttattgtctcccacttttattgtgtgggagtctaagtctctttgtaggtctctaagaacttgctttatgaatctgggtgctcctgtattgggtgtacatataattaggctacttagttcttcttgctgcattgatccctttaccattatgtaatggtcttctttgtctcttttgatctttgtttctctaaagtctgtttatcaaagaccaggattgcaatccctgctttttttttttttttgctttccattagcttggtagatcttcctccatccctttattttgagcctatgtgagtctttgcacatgagatgggcctcctgaaaccagcacactgatggtcttgactctttatccaatttgccagtctgtgtcttttaattggggcatttagcccatttacatttaaggttaatattgttatatgtgaatttgatcctgtcattatggtgctagctggtttcttcatagcgtccatggtctttaccatttgacatgtttttgcagtggctggtaccggttcttcctttccatatttagtgcttctttcgggagctcttgtaaggcaggcctggtggtgacaaaatctctcagcatttgcttgtctttaaaggattttatttctccttcacttatgaagcttagtttgtctggatatgaaattttgggttgaaaattcttttctttaagaatgttgaatattggcccccactctcttctggctgtaggatttctgcagagagatctgctgttagtctgatgggcttccctttgtgggtaactcgacctttctctctggctgcccttaacattttttccttcatttcaaccttggtgaatctgaaaattatgtgtcttggggttgctcttctcga

SEQ ID NO: 12036 - DNA, 289 bp, Homo sapiens
ttttttttgttttccatttgcttggtagatcttcctccatccctttattttgagcctatgtgtgtctctgcatgtgagaggggtctcctgaatacagcacactgatgggtcttgattctttatccaatttgccagtctgtgtcttttaactggagcatttagcccatatacatttaagattaatattgttatgtgtgaatttgatcctgtcattatgatgttagctggttattttgctcattacttgatgcagtttcttcctagcatcgatggtctttacaatttggca

SEQ ID NO: 12037 - DNA, 2387 bp, Homo sapiens
ttttgcccattcagtatgatattggctgtgggtttgtcataggtagctcttaatattttgagatacatcccatcaatacctaatttattgagagtttttagcatgaagggttgttgaattttgtcaaaggccttttctgcatctattgagataatcatgtggtttttgtcgttggttgtgtttatatgctggattacgtttactgatttgcgtatgttgaaccagccttgcatctcagggatgaagcccattttatcatggtggataagctttttgatgtgctgctggatttggtttgccagtattttattgaggatatttgcattgatgttcatcagggatattggtctaaaattctctttttttgttgtgtctctgccaggctttggtatcaggatgatgctggcttcataaaatgagttagggaggattccctctttttctattgattggaatagtttcagaaggaatggtaccagctcctccttgtacctctggtagaattcagctgtgaatccatctggtcctggactttttttgggtggtaagctattaattattgcctcaatttcagagcctgttattggtctattcagagatttaacttcctcctggtttagtcttgggagggtgtacgtgtcaaggaatttatccatttcttctagattttctagtttatttgcatagaggtgtttatagtattctctgatggtagtttgtattctgtgggatcagtggtgatatcccctttatcattttttattgcgtctatttcattcttctctcttttctgtttattagtcttgctagcagtctatcaattttgttgatcttttcaaaaaaccagctcctggattcattggttttttgaaggtttttttgtgtctccatttccttcagttctgctctgatcttagttatttcttgccttctgctagcttttgaatgtgtttgctcttgcttctctaattcttttaattgtgatgttagggtgtgaattttagatctttcctgctttctcttgtgggcatttagtgctataaatttccctctacacactgctttaaatgtgtcccagatattctgatatgttgtgtctttgttctcgttggtttcaaagaacatctttatttctgtcttcattttgttatgtacccagtagtcattcaggagcaggttgttcagtttccatgtagttgagcggttttgagtgagtttcttaaacctgagttctagtttgattgcactgtggtctgagagacagtttgttaaaatttctgttcttttacatttgctgaggggtgctttacttccaactatgtggtcaattttggaataggtgtgatgtggtgctgaaaagaatgtatattctgtttatttggttgggagagctctgtagatgtctattaggtccacttggtgcagagctgagttcagttcctggatatccttgttaactttccgtcttgttgatctgtctaatgttgacagtggggtgttaaagtctcccattattattgtgtgggagtctaagtctctttgtaggtctctaaggacttgctttatgaatctgggtgctcctgtattgggtgcgtatatatttaggatagttagctcttcttgttgaattgatccctttaccattatgtaatggccttcttttgatctctgttggtttaaagtctgttttatcagagactaggattgcaacccctgcctttttttgttttccatttgcttggtagatcttcctccatccctttattttgagcctatgtgtgtctctgcacatgagatgggtttcctgaatacagcacactgatgggtcttgactctttatccaatttgccaggctgtgtcttttaattggagcatttagtccatttacatttaaggttaatattgttatgtgtgaatttgatcctgtcattatgatgttagctggttattttgctcgttagttgatgcagtttcttcgcagccttgatggtctttacattttggcatgattttgcagtggctggtactggttgttcctttccatgtttagtgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctctaagaatattgaatattggcccccactctcttctggcttgtagagtttctgccgagagatcagctgttagtctgatgggcttccctttgtgggtaacccaacctttctctctggctgcccttaacattttttccttcatttcaactttggtgaatctgacaattatgtgtcttggagttgctcttctcgag

SEQ ID NO: 12038 - DNA, 5485 bp, Homo sapiens
tttctttcttttttaattttattattattatactttaagttttagggtacatgtgcacaatgtgcaggtttgttacatatgtatacatgtgccatgttggtgtgctgcacccattaactcgtcatttagcattacatatatctcctaatgctatccctccccgctccccccaccccacaacagtccccactgtgtgatgttccccttcctgtgtccatgtgttctcattgttcaattcccacctatgagtgagaacatgtggtgtttggttttttgttcttgcaatagtttgctgagaatgatggtttccagtttcatccatgtccctacaaaggacatgaactcatcattttttatggctgcatagtattccatggtgtatatgtgccacattttcttaacctagtctatcattgttggacatttgggttggttccaagtctttgctattgtgaatagtgccacaatatatatgtgtgtgtgcctttacagcagcatgatttacaatcctttgggtatatacccagcaatgggatggctgggtcaaatggtatttctagttctagatccctgaggaatcaccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatatcctttgcccactttttgatggggttgtttgttttttttcttgtaaatttgtttgagttctttgtagattctggatattagccctttgtcagatgagtaggttgcgaaaattttttcccattttgtaggttgcctgttgactctgatggtagtttcttttgctgtgcagaagctctttagtttaattagatcccatttgtcagttttggcttttgttgccattgcttttggtgttttagacatgaagtccttgcccatgcctatgtcctgaatggtattgcctaggttttcttctagggtttttatggttttaggtctaacatgtaagtctttaatccatcttgaattaatttttgtataaggtgtaaggaagggatccagtttcagctttctacacatggctagccagttttcccagcaccatttattaaataggaaatcctttccccattgcttgtttttgtcaggtttgtcaaagatcagatggttgtagatatgcggcattatttctgagggctctgttctgttccattaatctatatctctgttttggtaccagtaccatgctgttttggttactgtagccttgtagtatagtttgaagtcaggtagcatgatgcctccagctttgttcttttggcttaggattgacttggtgatgcaggctcttttttggttccatatgaactttaaagtagttttttccaattctgtgaagaaagtcattggtagcttgatggggatggcattgaatctataaattaccttgggcagtatggccattttcacgatattgattcttcctacccatgagcatggaatgcccttccatttgtttatatcctcttttatttcattgagcagtggtttgtagttctccttgaagaggtctttcacatcccttgtaagttggattcctaggtattttattctctttgaagcaattgtgaatggtagttcactcatgatttggctctctgtttgtctgttattggtgtataagaatgcttgtgatttttgtgcattgattttgtatcctgagactttgctgaagttgcttatcagcttaaggagattttgggctgagacaatagggttttctagatatacaatcatgtcatctgcaaacagggacaatttgacttcctcttttcctaattgaataccctttatttccttctcctgcctgattgcactggccagaatttccaacactatgttgaataggagtggtgagagagggcatccctgtcttgtgccagttttcaaagggaatgcttccagtttttgtccattcagtatgatattggctgtgggtttgtcatagatagctcttattattttgagatacgtcccatcaatatctaatttattgagagtttttagcatgaagggttgttgaattttgtcaaaggccttttctgcatctattgagataatcatgtggtttttgtctttggttctgtttatatgctggattacatttattgatttgtgtatgttgaactagcctttcatcccagggatgaagcccacttgatcatggtggaaaagctttttgatgtgctgctggatttggtttgccagtattttattgaggatttttgcatcaatgttcatcaaggatattggtctaaaattctctttttttgttgtgtctctgccaggctttggtatcaggatgatgctggcctcctaaaatgagttagggaggattccctctttttctattgattggaatagtttcagaaggaatggtaccagctcctccttgtacctctggtagaattcggctgtgaatccatctggtcctggactttttttggttggtaagctattgattattgccacaatttcagagcctcttattgttctattcagagattcagcttcttcctggtttagtcttgggagggtgtatgtgttgaggaatttatccatttcttctagattttctagttatttgcgtagaggtgtttgtagtattctctgatggtagtttgtatttctgtgggatcggttgtgatatcccctttatcattttttattgtgtctatttgattcttctctctttttttctttattagtcttgctagcagtctatcgattttgttgatcttttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctgcacactgctttgaatgtgtcccagagattctggtatgttgtgtctttgttctcgttggtttcaaagaacatctttatttctgccttcatttcgttatgtacccagtagtcattcaggagcaggttgttcagtttccatgtagttgagtggttttgagtgagtttcttaatcctgagttctagtttgattgcactgtggtctgagagatagtttgttataatttctgttttttacatttgctgaggagtgctttacttccaactatgtggtcaattttggaataggtgtggtgtggtgctgaaaaaaaatgtatattctgttgatttggggtggagagttctgtagatgtctattaggtatgcttggggcagaggtgagttcaattcctggatatccttgttaactttctgtctcgttgatctgtctaatgttgacagcggggtgttaaagtctcccattattattgtgtgggagtctaagtctctttgtaggtcactaaggacttgctttatgaacctgggtgctcctgtattgggtgcatatatatttaggatagttagctcttcttgttgaattgatccctttaccattatgtaatggccttctttgtctcttttgatctttgttggtttaaagtctgttttgtcagagactaggattgcaatccctgcctttttttgttttccatttgcttggtagatcttcctccatccctttattttgagcctatgtgtgtctctgcacgtgagatgggtttcctgaatacagcacactgatgtatgactctttatccaatttgccagtctgtgtcttttaattggagcatttagcccatttacatttaaagttaatattgttatgtgtgaatttggtcctgtcattatgatgttagctggttattttgctcattagttgatgcagtttcttcctagccttgatggtctttacattttggcatgttttgcagtggctggtaccggttgttcctttctatgtttagtgcttccttcaggagctcttttagggcaggcctggtggtgacagaatctctcagcatgtgcatctctgtaaagtattttatttctccttcacttatgaagcttagtttggctggatatgaaattctgggttgaaaattcttttctttaagaatgttgaatattggcccccactctcttctggcttgtagagtttctgctgagagatccgctgtttgtctgatgggcttccctttgtgggtaacccgacctttctctctggctgcccttaacattttttccttcatttcaactttggtgaatgtgacagttatgtgtcttggagttgctcttctcgaggagtatctttgtggcgttctctgtatttcctgaatttgaatgttggcctgccttgctagactggggaagttctcctggataatatcctgcagagtgttttccaagttggttccattctccccgtcactttcaggtacaccaatcagacgtagatttggtcttttcacatagtcccatatttcttggaggctttgtttgtttctttttattcttttttctctaaacttcccttctcgcttcatttcattcatttcgtcttccatcactgataccctttcttccagttgatcgcatcggctcctgaggcttctgcattcttcacgtagttctcgagccttggctttcagctccatcagctcctttaaggacttctctgcattggttattctaggtatccattcgtctaattttttttcaaagtttttaacttctttgccattggtttgaatttcctcctgtagctcggagtagtttgatcgtctgaagccttcttctctcaactcgtcaaagtcattctccgtccagctttgttccgttgctggtgaggagctgcgttcctttggaggaggagaggcactctgctttttagagtttccagtttttctgctctgtttttcccccatctttgtggttttatctacttttggtctttgatgatggtgacgtacagatgggtttttggtgtggatgtcctttctgtttgttagttttccttctaacagacaggaccctcagctgcaggtctgttggagtttgctagatgtccactccagaccctgtatgcctgggtatcagcagcggtggctgcagaacagcggtggctgtagaaaagtggatgttggtgatccgcaaatgctcctgcctgattgttcctctggaagttttgtctcagaggagtacccggccatgtgaggtgtcagtctgcccgtactggcggatgcctcccatttaggctgcttgggagtcagggacccact

SEQ ID NO: 12039 - DNA, 18858 bp, Homo sapiens
taattattttttttattatactttaagttttagggtacatgtgcacaacatgcaggtttgttacatatgtatacatgtgccatgttggtgtgctgcacccattaactcgtcatttaacattaggtatatctcctaatgctatccctccccttccccccaccccacaacaggccccggtgtgtgatgttccccgtcctgtgtccatgtgttctcattgttcaattcccacctatgagtgagaacatgtggtgtttggtttttttcccttgcgatagtttgctgagaatgatggtttccagcttcatccatgtccctacaaaggacatgaactcatccttttttatggctgcatagtattccatggtgtatatgtgccacattttcttaatccagtctatcattgttggacatttggcttggttccaagtctttgctattgtgaatagtgccgcaataaacatacgtgagcatgtgtctttatggcagcatgatttataatcctttgggtatatacccagtaatgggatggctgggtcaaatgatatttccagttctagatccctgaggaatcgccacaccaacttccacaatggttgaactagtttacagtcccaccaacagtgtaaaagcattcctatttctccacatcctctccagcacctgttgtttcctgactttttaatgattttcattctaactggtgtgagatggatggtatctcattgtggttttgatttgcatttctctgatggccagtgatgatgagcatttttcccatgtgttttttggctgcataaatgtcttcttttgagaagtgtctgttcatatccttcacccactttttgatggggttgtttgtttttttcctgtaaatttgttggagttcattgtagattctggatattagccctagccctttgtcagatgagtaggttgcaaaaattttcttccattctgtaggttgcctgttcactctgatggtggtttcttttgctgtgcagaagctctttagtctgattagatcccatttgtcaattttggcttttgttgccattgcttttggtgttttagacatgaagtccttgcccacgcctatgtcctgaatggtattgcctaggttttcttgtagggtttttatggttttaggtctaacatgtaagtctttaatccatcttgaattaatttttgtataaggtgtaaggaagggatccagtttcagctttctacatatgtctagccagttttcccaacaccatttattaaatagggaatcctttccccatttcttctttttgtcaggtttgtcaaagatcagatagttgtagatgtgcggcattatttctaagagctctgtccttttccattggtctatatctctgttttggtaccagtaccatgctgttttggttactgtggccttgtagtatagttagaagtcaggtagcatgatgcctccagctttgttcttttggcttaggattgacttggcaatgcgggctctttttttggttccatatgaaccttaaagtagttttttccaattctgtgaagaaagtcattggtagcttgatggggatggcattgaatctataaattaccttgggcataaattaccttggccattttcacgatatcgattcttcctagccttgagcatggaatgttcttccatttgtatcctcttttatttcatttagtagtggtttgtagttctccttggagaggtccttcacatcccttgtaagttggattcctaggtattttattctctttgaagcaattgtgaatgggagttcactcatgatttggctctctgtttgtctgttattggtgtataagaatgcttgtgatttttgcacattgattttgtatcctgagactttgctgaagttgcttatcagcttaaggagattttgggctgagacgatggggttttctagatatacaatcatgtcatctgcaaacagggacaatttgacttcctcttttcctaattgaataccctttatttccttctcctgcctgattgccctggccagaacttccaacactatgttgaataggagtggtgagagagggcatccctgtcttgtgcccgtttccaaagggaatgcttccagtttttgtccattcagtatgatattggctgtgggtttgtcatacatagctcttattattttgagatacatcccatcaatacctaatttattgagagttttttagcatgaagcgttgttgaattttgtcaaaggccttttctacatcttttgagataatcatgtggtttttgtctttggttctgtttatatgctggattacgtttattgattttcgtatgttgaaccagccttgcatcccagggatgaagcccacttgattatggtggataagctttttgatgtgctgctggattcggtttgccagtattttaccgagaatttttgcatcggtgttcatcaaggatattggtctaatattctctttttatgtggtgtctctgccaggctttggtatcaggatgacgctggcctcataaaatgagttagggaggattccctctttttctattgattggaatagtttcagaaggaatggtaccagctcctccttgtacctctggtagaattcggctgtgaatccatctggtcctggactttttttggttggtaagctattaattattgcctcaatttgagagcctgttattggtctattcagagattcaacttcttcctggtttagtcttgggagagtgtatgtgttgaggaatttatccatttcttcttgattttctagtttatttgcatagaggtgtttatagtattctctgatggtagtttgtatttctgtgggatcagtggtgatatcccctttatcattttttattacatctatttgattcttctctcttttcttctttattagtcttgctagtggtctatcaattttgttgatcttttcaaaaaaccagctcctggattcattgattttttgaagagttttttgtgtctctatttccttcagttctgttctgatcttagtcatttcttgccttctgctagcttttgaatgtgtttgctcttgcttctctagttcttttaattgtgatgttagggtgtcaattttagacctttcatgctttctcttgtgggcatttagtgctataaatttccctctacacactgctttgaatgtgtcccagagattctggtatgttgtgtttttgttcttgttggtttcaaaaaacatctttatttctcccttcatttcgttatgtacccagtagccattcagcagcaggttgttcagtttccatgtagttgagcggttttgagtgaatttcttaatcctgagttctagtttgattgcactgtggtgtgagagacagtttgttataatttctattcttttacatttgctgaggagtgctttacttccaactatgtggtcaattttggaataggtgtggtgtggtgctgaaaagaatgtatattctgttgatttggggtggagagttctgtagatgtctattaggtccgcttggtgcagacctgagttcaattcctggatatccttgttaactttctgtctcgttgatctgtctaatgttgacagtggggtgttaaagtctcccaagtctctttgtaggtcactaagggcttgctttatgaatctgggtgctcctgtattgggtgcatatatatttaggatagttagttcttcttgttgtattgatcccctttaccattatgtaatggccttctttgtctcttttgatctttgttgatttaaagtctgttttatctgagactaggattgcaacccctgcctttttttgttttccatttgcttggtagatcttcctccatccctttattttgagcctatgtgtgtctctgcacgtgagatgggtttcctgaatacagcacactgctgggtcttgactctatccaatttgccagtctgtgtcttttaattagagcatttggcccatttacatttaaggttagtattgttatgtgtgaatttgatcctgtccttatgatgttagctggttattttgctcgttagttgatgcagtttcttcctagcatcaatggtctttacaatttggcatgtttttgcagtggctggtaccagttgttcctttccatgtttagtgcttccttcaggagctcttttagggcaggcctggtggtgacaaaatctctcagcatttgcttgtctgtaaagtattttatttctccttcacttatgaagcttagtttgaaatgaatgaaatgaagcatgaagagaagtttagagaaaaaagaataaaaagaaacaaacaaagcctccaagaaatatgggactatgtgtaaagcccaaatctacatctaattgatgtacctgaaagtgactgggagaatggaaccaagttggaaaacactctgcaggatattatccaagagaacttccccaatctagcaaggcaggccaacattcaaattcaggcaatacagagaatgccacaaagatactcctcaagaagagcaactccaagacacatcattgtctgattcaccgaagttgaaatgaaggaaaaaatgttaaggcagccagagagaaaggtcgggttacccacaaagggaagcccatcagactaacagctgatctcttggcagaaactctctaagccagaagagagtgggggccaatattcaacattcttaaagaaaagaattttcaacatactgattttttacagatgccttatcaaaagagattatgaaagctattggaattgtaatacttttattaattaatggttcacttttatatagtatcagtgaacttcgagcaatgaaagaagatgattttaatgcttccttcatttctctatcacccacctcctgatttttatagatcattatcattcattcattcaaccagtgtttatttagagaatactttgtgtaaggcaccttcaaggtgctgagcctagagctataagctatcgatggaacagacaagattctcacacataatggggcttgcattttaatagaaagaaaaaataaatcactattttgacattgcgctgattctgttcagtaaccataagcctcataattgttcagtattgtttctatatttgaattctttctatgcatatacataagtagaagtctggcagactagagagatagccagactcacttttataaaaatgggatgatactataaattcacttccgtcgctgacagcccatcctccacctaccttcttatctctgatcctccctagcagccctatccaggtttccctggttagaaggagaagctcggtcttttccagattcacagggaaaggttcccaagcaggaggagtgaggaggagccaggtggcagggccaggccaggccaagcctttctccactgcttctctgcagaatttccttggctgctggttttggaagtgtgtgacattaggttatgtccatttccttggttggtggctgctgataaaaattttgactggtttcactattttgatgctataattcttcatttttttttaggcattgctaagttagataaatcttatgttcagtcttttctatcttatctttaccccaagtctacctccttaaaatacttttatgagcacaaatccctgatgtaaaatcaagccataatgtgtttcctggagtaggggcggacaaatatgttaactaaattctttttgcgtgcttcatgttggatcaattcttaaggaataattttgactgagcctcttttaagcttttccaggcctggcttgttttcctgaaaagcttcaaagcagagaggagaatctttgtcagttagctgggtgagtggttcacaagcctcactgttgtgacacactccgtcatttgtgagggcatcacagccattttgttaatagaaatacagagccaaaagtcaaacatgattttatatgtgtgagatgttgcccgagggaaagggcaaagaatgagaagagctggactgggcaactctcatgtgaccccaggtccctttcaaagttgagtttctctagcaagtttgggatttccaaatgtttctactgagaaaaaaaaaaaaaggaaacgtgcaattaaattagaaaactacacagctcttactgaagagctgaaattttaaaaagatgcttaaaataaagcaaggaagataaggagaaagaaacataaagcatccaaacctgaaagaataacattcagataggctaacactcagaaaagattggagtcttgccaaacatcctgaggtcagccgccaccacagcaaaaagactgtttgatttggagtgacaagaaagatgatgtgatctcagaggaaacagatggctcactaaagatatttgaggatattttaataaaaagaagattttaaaaggtgtgagtaggatacagggaaagtgacaaaagatggagcaagttggaacctgatgggagtaatctggggggaaggaacccatagcagaagtggtggctctcaatggtggagcccagccaatccgtgggatcgggcaggaagggagctgacccactgtctgctccacgacctcctggtgctgcctccccttggctgaacccagccagaaggcaaagagagacccattggtccattccgtccaagatctctctcagggctcagagcagcgtacagaaaggtagtgtttctggaggaacaaatagaagatatccagcagtaagggcaaggaggcacagaagtacttcctgcttcaaggggttgagtggctatggtagttgatgttgagaaggcagatgaagtaaaagcaacttcgcatatatctttcctatcaaagacaatggtctaactggaaagaaaacaataaacagggttgtgactaaaaactgggcaaatgatctaaacagacatttctcaaaagtaaacatacaaatggccaagaggtatatgaaaaaaatgttcaacatcaccatcatcagggaaatgcaaataaaaaccacagtgagatattatctcaccccagttagaacggctatgatcaaaaagacaaaaaataacaaatgctgacaaggatgcaaaaaaaacccacttatactgtgttggtaggaacgtaagttagtacagccactatggagaatagtatggcggttcctccaaaaaactaaaatagaactaccatacaacccagcaatcctactactaggtttctgtattgttttgttttatattttttgtttttttggttttttttttttttttttttttttgagaaggagtcttgctctgttgcctagtctagagtgcaatggcatgatcttggctcactgcaacctccatctcctgggttcaagtgattctcctgcctcaacctccccagtagctgggattacaggtgtgtgccaccacacccagctaatctttttagttgagatggggtttcgccatgttagccaggctggtcttgaacccctgatctcaagtcatctgcccactttggcctcccaaagtgctaggattacagataagagctaccatgcccagccccattactaggcatttatccaaaggaaaggaaaccagcatatcagaggaatacctgcaccccatgtttatcacagcactattcacaatcgctaagatattgaatcaacctaagtgtccatcgacagatgaatggataaagaaagtgtggtatatttatacaatggaatactattcagccatttaaaaataaaactctgtcattcatggcaacatggatgagcctggaggacattacgttaagtgaagtaacccaggcacagaaagacaaataccatatgatctcattcacatacagaagctgaaaaacagttgatctcatagaagtagagagtacaattgtagttattagaaactgagaagggtaggaggggaggagatggagaggttggttcaaggttacaaaattatagccagatcagaggaatatgttctagtgttctatagcactgttgggtgactacagttaaaaatttttgtatattttcaaatagctagaatagaagattttgaatgttcccaacgtaaagaattgaaaactctttgaggtgatggatgtgttaattaccgtgatttatcattacacattgtatctatcaaaataccactctataccctataaagatgtataattattatgttcaattaaaaataatgtaaggaataaacaatattgaaagcaaaagaaaaaatcccaaagtggtcaaagcaataagccaatacttaactcctttaagcccatctgcaggcctaaatgaatcttacctgagagtgctgaaagaaaattatgtttaatttccagaaagggtcaaaagagtacattattgaacctgtaataaagttactgaaattaaaaggaatgttaaagatctcaggtttcttgatttcaggaagctatttgatggagcctttcaaagtttggttggtaatgaatatgctggagaaacaccggccatacaagaaggtttccctgacctgggatggacagtcatgcacagtgtttactagtgttgctcgcatggcatgaggaggaaagggcacaggacccttctttttgacccactcctattcaagtttctatgaaggtcttgaatgaagataggaggtgtaggtcaaagtcgtggttatgactgtttcaaagtcagaaaggagaatcggttctgtggatcttacaagctcctttaagatgcctcaggctatgaagctgtgggagagctggaaattctggatggatgggataatatttcctgaagcttgagggaaggtgtttgctgaagtttgtccaatgtgctctgtatgaagccagaacccaatgtcccatctgccttgttccagcactgcctcggattccagatcctgagaaccaccctttaccccagggaaacccctgatgccaccttctctgctgccaaccattatgtggtgtgagctgtccccaggttgcaagtctctgccagcagccctgcatgcttcaagactctctgtgtggccccacagggcaagcacaacaaagaggtcaaatgacagaatttcaaaagatttcaactgatgaaccaaattaaaggacatgttaggtattggaattttccaatttacagagctagtttgtcctagcattggccagaatgaaggctgaaagagtggcagggctgccaccatggttactgcagcaggtggaattcgagtgcctgaattgagggaagtgggggtcctcctgcatcccgagatagcgagagcacctcagaagtgctggcttaggtggtggcacccactgtaagagaacgatgacaaatctcagtttctccctaggagagtgcccagcagggtgatgagccaggaagatctgtcaggatgaagagtagtgagaggaagggggaaccctggagaagagaagaacttaaagggattcacaagaagttgaggagggcagagctgaatgagacaaggttgcagggaaacagactttttaagatcagtgtaagggaaaaaaaaatccttgacaatcagaattgtttcaaaacagagtcagcagcttcttgagactgggtcgctgtgctaagaacgtaaagggggagctgggtggcaccagcaaagtggcaggaatgtgtccctgcagggtctttgctgccttccgaatcctctcctttgtgatcctgtaatttgtgagagagcctggagggtagcatggaaaagagagaggagaggacctgacagcagtatttccatcttgtcccctaacaattgcctaggcagtctcctctcagcagggaagcaaactggtcaccaaataataataattatccccctacatttccttaattatttaaacttctgaaaggacatcaaacacagcaaagagtcaatgacttgctttcagaagtgattcagactgtagctccacccataacagtgtcaccttgagcagtcacatatgccttaacatccttctttctaaagcaattccatcttcccaggttgattgttgagcgtttagacatgatgacatatataatctttatatatgtatatttacaagtatatgtttatggataaattttgactgcctgtaacccatgtggccttgtgtcatcacacataagttcactgaagctcccaacaaccagacttttggggaagtacaaacctccacattagcactaggtctccttgcctgcccctctgctggaagaatccctggcaggggccttctttggtgatgggattgaattttctatttcctgaaatgtaatcagctttcagtttcaatggtggtcacccccttgtaccttcttttaaagattggaacgctgtattggtttctcagggctgctgtggtcttcatagaagatgacccgcgtatttccaaggtttcctccaggattgctggggctgtctgcgtccagatgttaaggttactgtagacaataaatgggagagggtgaaggaaggaggatgtttagagaaaattatccagtcacctggaggaaaggctcttagctgcaaaagaggaaataagggccaggcacagtggctcatgcctgtaatcccagcactttgggaggccgaggcaggcagatcatgaggtcaggagatcaagaccatcctggccaacatagtgaaacccatctctactaaaaatacaaaaatcagccgggcgcagtggcacacgcctgtagtcccagctacttgggaggctgaggcaggagaattgcttgaacccgggaggcagaggttgcagtgagatgagatcgtgccactgcactgcagcctggtgacagagtgagactccatctcaaaaaaaaaaataagaaactgctatttagcacaacatcaaataagcagtttgttgcttatgtctgaacacttctgtgaaaacaggcaaaggcagtcgtgtgtaggttctggtgaccaggaactggagctgcacagaggtgtagaggctcccaaagctcgtcaattgtttatgaagggagtaaaggctggaagtcagggggtgggtgtcagtttctgccactagctaccagatttctcctaaagatgggaaagctccctttatagagctggagtgcaattttgtgttttctttgtgtttggcaatgtctgttactgacttgcaatagatatgcaacagtataggtatgttcatcttagtattttggggacaaaactcccaaaccagccaccacacaaatgtatttataggtaccagtaggcacctttggactcggagggaagtcagcctccttaaagccgtattcagtaaggagaatgaagggtaggcatggctgcagcttgggttgtgcccaccatgtggatatccagccatgatctcaatagtcaggttggtccacattgtccagatatctccatgtaacattaactcagactttatgaaaataaccggtgagaataaccaaagccacattgggtaatgaaaactgtatgtacaattttctttagttacattgatgttgttacatactgttcataattaattacattggtttgtaatgtatcatgtcctattgtattgtaggttctaataccaagaccctaggtgttcctctcttaaaagctggtgaccacctttaactcatgtggtaaaagaatgatagttctgggaggatctgcattctctctgtgtccatgcagcattgccccacactgcctgtgctgagctgcatgatcctcatagctacatcatagtctttgcttgtaggcttgtcgtttggagaaccgtcttggagtctttattggttgatgtcaatggaaagctctgcttccctctggatgtcctatggtattgctgttcctaatgtctttctaatgagtgctacgtgtctgtatgtgtgtataaagagatttatgtaaagaattggctcatgtgattacggaggctgagaaaccccaagatctgcatttgccactaagtactcagatatttggtcaaacatgattgtgagtgctgttgagtgctgtattttttaactgccacgtaatcccctcaaggtccgtgttattctagacagtaaaccgggagaggcttctaaagccccctttgtcaggaaatgttactttagaatctgaccttgtgtgaaacacagatgacagaacctctctagtgcaatgacattaaaatcctcccccagtacttgaagtgcaagggaaatagctcattgctattatggctggatcatctcatggcctctcaacagatcaagagcaccattactactgttgctttcttgacttgtgttttacttttattctaacatttgttgcagtctgtgttaaatagggaggtagaccaaactatgagaaggagccctatattggaaactgtatagccaactatgaaacctccaggcttactttgctttctcattacaggcggccttcccctctgctccactggagagagtcagagtaattggctcttgctttatatgaaggatatgctcccaaaaaagttgtatttaaatcaagttttaacaaaccgactcatgcttgtttatccacttataacacttactatttaaaggaaatgataaagagtccttttctgttgttacagcgtagttggcaaagctgtatcttctgaagactgacttgcactcagcagttttagatcaactcgagtctgtttatactaagatccacagacccctggtggttctcagatgacttgcaaattctactagtttttccaattgtgtgttttttgatgataacttaaaaattttttatgataatcttttcattgtttagtataataatgtacagataaaccctagatgatcaccttataactgagtgctgtcatgagatttcagtgcctttgttctcagtcctgtaggtaaccaagacttcatctaaaatcacatcacttgactttaaatgtttgcaagacacatctgactgtcattgggttgataaaatctgtcttgtcctcattttgtgttgtgtgggactctatcatcaggtacaaaagcaaaactcctttgccatgagcgttcacagttgaatgacttttttatagaccaagagtttagtttcttagagtatatattgaatcaatttggcatcatggaaatggcatagtacattagaggcacatactatgttaactgtcacaatctaatgataaagaacagaaaaggacatattacataatcggtgcatttctgttaaagtcatggcaagcttattgaactagttttatagcaatttggcaggataaaaatgatgggaggatggagtcatcatagggtgcctgccctgtagcatggacacctgggacacaccttgctggatgatgtcttctttgggttccatcttaatacatgacaactggaaataattctgtagcagaaagtagagtgtaaaatagaaaatgactcttattctgatgaatcaaagtttttaagccatatatgtcggagtacacttgaattacttctgtaaaaactagcacattatataaaaatcataataaaaacagagattccagtgaggggtccctcttgttcagagtcgaaagattcaagtcaacaaaaatggaacctgtaagttagtctttttgccactgttaaaagaaaaacactggacacaatacttttaacagagtttatgtgagcattagaggattcatgaattgggcagcacccagaaccagaaaaggttcagagagctctacccagcagcatgggtagtgagctttaataggcggaacgtggaagtaagacaaagaaaacatatttgatttgttagagtagaaagtccctagttagaggttagttggaggtttctgatggtaacttctctagtttcattttactgttcacattgggctttggtttgcttacctaggaacttaaagtgctgggaatgcttcggcttaatgacctcccaattaaaatttttttaacatcacttttatttatgatctacaaagtggcaactgcctatttttttttaattttattattattatactttaagttttagggtacatgtgcacaatgtgcaggtttgttacatatgtatacatggccatgttggtgtgctgcacccattaactcatcatttagcattaggtatatctctcagtgctatccctcccctctcccccaaccccacaacagtcctcggtgtgtgatgttccccttcctgtgtccatgtgttctcattgttcagttcccacctgtgagtgagaacatgcagcgtttggttttttgttcttgcaatagtttgctgagaatgatggtttccagcttcatccatgtccctacaaagcacatgaactcatccttttttatggctgcatagtattccatgttgtatatgtgccacattttcttaatccagtctatcattgttggacatttggcttggttccaagtctttgctattgtgaatagtgccgcaataaacatacatgtgcatgtgtctttatagcagcatgatttataatcctttgagtatatacccagtaatgggatggctgggtcaaatggtatttctagttctacatccctgaggaatcgccacaccaacttccacaatggttgaactagtttacagtcccaccaacagtgtaaaagtgttcctatttctccacatcctctccagcacctgttgtttcctgactttttaatgattgccattctaactggtgtgggatggatggtatctcattgtggttttgatttgcatttctctgatggccagtgatgatgagcattttttcatgtgttctttggctgcataaatgtcttcttttgagaagtgtctgttcatatcctttgcccacttgttgatggggttgtttgtttttttcttgtaaatttgttggagttcattgtagattctggatattagccctttgtcagatgaataggttgcaaacattttctcccattctgtaggttgcctgttcactctgatggtggtttcttttgctgtgcagaagctctttagtttaattagatcccatttgtcaattttggcttttgttgccattgcttttggtgttttagacatgaagtccttgcccacgcctatgtcctgaatggtattgcctaggttttcttgtagggtttttatggttttaggtctaacatgtaagtctttaatccatcttgaattaatttttgtataaggtgtaaaggagggatccagtttcagctttctacatatggctagccagttttcccagcaccatttattaaatagggaatcctttccccatttcttctttttgtcaggtttgtcaaagatcagatagttgtagatatgcagcattatttctgagggctctgttctgttccattggtctatatctctgttttggtaccagtaccatgctgttttggttactgtagccttgtagtatagtttgaagtcaggtagcgtgatgcctccagctttgttcttttggcttaggattgacttggtaatgcgggctcttttttggttccatatgaactttaaagtagtttttttccaattctgtgaagaaagtcattggtagcttgatggggttggcattgaatctataaatcaccttgggcggtatggccattttcacgatattgattcttcctacccatgagcatggaatgttcttgcatttgtttgtatcctcttttatttcattgagtagtggtttgtagttctccttgaagaggtcattcatatcccttgtcagttggattcctaggtattttattctctttgaagcaattgtgaatgggagttcactcatgatttggctgtttgtctgttattggtgtataagaatgcttgtgatttttgcacattgagtttgtatcctgagactttgctgaagttgcttatcagcttaaggagatttggagctgagatgatggggttttctagatatacaatcatgtcatctgcaaacagggacaatttgacttcctcttttcctaaatgaataccctttatttccttctcctgcctgattgccctggccagaacttccaacactatgttgaataggagtggtgagagagggcatccctgtcttgtgccagttttcaaaggtaatgcttccagtttttgtccattcagtatgatattggctgtgggtttgtcatagatagctcttattattttgagatacatcccatcaatacctaatttattgaaagtttttagcatgaagcgttgttgaattttgtcaaaggccttttctgcatctattgagattatcatgcggtttttgtctttggttctgtttatatgctggattacgtttattgattttcgtatgttgaaccagccttgcctcccagggatgaagcccacctgatcatggtggataagctttttgatgtgttgctggattcggtttgccagtattttaccgagaatttttgcatcagtgttcatcaaggatattggtctaaaattctctttttatgtggtgtctctgccaggctttggtatcaggatgacgctggcctcataaaatgagttaggaaggattccgtctttttctattgactggaatggtttcagaaggaatggtaccagctcctccttgtacctctggtagaattcggctgtgaatccatctggtcctggactttttttggttggtaagctattaattattgcctcaatttgagagcctgttattggtctattcagagattcaacttcttcctggtttagtcttgggagggtgtatgtgtccaggaatttatccatttcttctagattttctatttatttgcatagaggcgtttatagtattctctgatggtagtttgtatttctgtgggatcagtggtgatatcccctttgtcattttttattgcgtctatttgattcttctctcttttcttctttattagtcttggtagcagtctatccattttgttgatcttttcaaaaaaccagctcctggattcatttatttttttgaagggttttttgtgtctctatctccttcagttctcctctgatcttagttatttcttgccttctgctagcttttgaatgtgtttgctcttgcttctctagttcttttaattgtgatgttagggtgtcaattttagacctttcgtgctttctcttgtgggcatttagtgctataaatttccctctacacactgctttgaatgtgtcccagagattctggtatgttgtgtctttgttctctttggtttcaaagaacatctttatgtctgccttcattttgttatgtacccagtagtcattcaggagcaggttgttcagtttccatgtagttgagcagttttgagtgagtttcttaatcctgagttctagtttgattgcactgtggtgtgagagacagtttgttataatttctattcttttacatttgctgaggagtgctttacttccaactatgtggtcaattttgaaataggtgtggtgtggtgctgaaaagaatgtatattctgttgatttggggtggagagttctgtagatgtctattaggtccgcttggtgcagacctgagttcaattcctggatatccttgttaactttctgtctcgttgatctgtctaatgttgacagtggggtgttaaagtctcccattattattgtgtgggagtctaagtctctttgtaggtcactaagggcttgctttatgaatctgggtgctcctgtattaggtgcatatatatttaggatagttagttcttcttgttgaattgatccctttagcattatgtaatagccttctttgtctcttttgatctttgttggtttaaagtctgttttatcagagactaggattgcaacccctgcctttttttgttttccatttgcttggtagatcttcctccatccctttattttgagcctatgtgtgtctctgcacgtgagatgggtttcctgaatacagcacactgctgggtcttgactctatccaatttgccagtctgtgtcttttaattggagcatttagcccatttacatttaaggttaatattgttatgtgtgaatttgatcctgttattatgatgttagctggttgttttgctcattggttgatgcagtttcttcctagccttgatggtctttacaatttggcatgtttttgcagtggctggtactgcggttgttcctttccatgtttagtgcttccttcaggagctcttttagggcaggcctggtggtgacaaaatctctcagcatttgcttgtctgtaaagtattttatttctccttcacttatgaagcttagtttggctggatatgaaattctggattgaaaattcttttctttaagaatgttgaatattggtccccactctcttctggcttgtagagtttctgctgagagatcagctgttagtctgatgggctttcctttgtgggtaacccgacctttctctctggctgctcttaacattttttccttcatttcaactttggtgaatctgacaattatgtgtcttggagttgctcttctcaaggagtatctttgtggcgttctctgtatttcctgaatttgaatgttggcctgccttgctagattggggaagttctcctggataatatcctgcagagtgttttccaacttggttccattctccctgtcactttcaggtacaccaatcagacgtagatttgggcttttcacatactcccgtatttcttggagactttgtttgtttttattcttttttctctaaacttctcttctcgcttcatttcattcatttcgtctttcattgatgatatcctttcttccagttgatcacatcgactactgaggcttgtgcattcgtcacatagt

SEQ ID NO: 12040 - DNA, 5781 bp, Homo sapiens
gcttttttctttttttttttttattgtactttaagttctagggtacatgtgcacaacatgcaggtttgttacatatgtatacatgtgccatgttggtgtgctgcacccattaactcgtcatttaatattcggtatatctcctaatgctatccctcccccctccccccaccccacaacaggccccggtgtgtgatgttccccttcctgtgtccatgtgttctcattgttcaattcccacctatgagtgagaatatgcggtgtttggtttttggccttgtgatagtttgctgagaatgatggtttccagctttatccatgtccctacaaaggacgtgaactcatcattttttatggctgcatagtattccatggtgtatatgtgccacgttttcttaatccagtctatcattgttggacatttgggttggttccaagtctttgctattgtgaatagtgccacaataaacatacgtgtgcatgtatctttatagcagcatgacttacaatcctttgtgtatacacccagtaatgggatggctgggtcaaatggtatttctagttctagatccctgaggaatcgccacactgtcttccacaatggttgaactagtttacagtctcaccaacagtgtaaaactgttcctatttctccacatcctctccagcacctgttgtttcctgactttttaatgatcgccattctaactggtgtgagatggtatctcgttgtggttttaatttgcatttctctgatggccagtgatgatgagcattttttcatgtgtcttttggctgcataaatgtcttctttcaagaagtgtctgttcatatcctttgcccactttttgatgggttgtttttttcttgtaaatttgtttgagttcattgtagattctggatattagccctttgtcagatgagtagattgcaaaaattttctcccattctgtaggttgcctgttcactctgatggtagtttcttttgctgtgcagaagctctttagtttaattagatcccatttgtcaattttggctttcgttgccattgcttttggtgttttagacatgaagtccttgaccatgcctatgtcctgaatggtattgcctggttttcttctagggtttttatggttttaggtctaacatttaagtctttaatccatcttgaattaatttttatataaggcgtaaggaagggatccagtttcagctttctacatatggcaagccagttttcccagcaccatttattaaatagggaatcctttccccatttcttgtttttgtcaggtttgtcaaagatcagatagttgtagataacaggactctgttctgttccattggtctatatctctgttttggtaccagtaccatgctgttttgattactgtagccttgtagtatagtttgaagtcaggtagcatgatgcctccagctttgttcttttggcttaggattgacttggcaatgcaagctcttttttggttccatatgaactttaaagtagttttttccaattctgtgaagaaagtcattagtagcttgatggggatggcattgaatctataaattaccttgggcagtatggccattttcacgatattgattcttcctacccatgagcatggaatgttcttccatttgtttgtatcctcttttatttcattgagcagtggtttgtagttctgcttgaagaggtccttcacatcccttgtaagttggattcctaggtattttattctctttgaagcaattctgaatgggagttcactcatgatttggctctctgtttgtctgttattagtgtataagaatgcttgtgatttttgcacattgattttgtatcctgagactttgctgaagttgcctatcagcttaaggagatttggggctgagacgatggcgttttctaaatatacagtcatgtcatctgcaaacagggacaatttgacttcctcttttcctaattgaataccctttatttccttctcctgcctgattgccctggccagaacttccaacactatattgaataggagtggtgagagagggcatccctgtcttgtgccagttttcaaagggaatgcttccagtttttgcccattcagtatgatattggctgtgggtctgtcatagatagctcttattattttgagatacatcccatcaatacctaatttattgagagtttttagcatgaagggctgttgaattttgtcaaaggccttttctgcatctattgagataatcatgtggtttttgtcattggttctgtttatatgctggattacgtttagtgatttgcgtaagttgaaccagccttgcatcccagggatgaagcccacttgatcatggtggataagctttttgatgtgctgctggattcggtttgccagtattttattgaggatttttgcatcgatgttcatcagggatattggtctaaaattctctttttttgttgtgtctctgccaggctttggtatcagcatgatgctggcctcataaaatgagttagggaggattccctctttttctattgattggaacagtttcagaaggaatggtaccagctcctccttgtccctctggtagaattcggccatgaatccatctggtcctggactttttttggttggtaagctattaattattgcctcaatttcagagcctgttattggtctattcagagattcaacttcttcctggtttagtcttgggagggtgtaggtgtcgaggaatttatccatttcttctagattttccagtttatttgcgtagaggtgtttatagtattcgctgatggcagtttgtatttctgtgggatcagtggtgatatcccctttatcattttttattgcgtctatttgattctcctctcttttattctttattagtcttgctagcggtctatcaattttgttgatcttttcaaaaaaccagctcctggattcgttgattttttgaagggttttttgtgtctctatttccttcagttctgctctgatcttagttatttcttgccttctgctagcttttgaatgtgtttgctcttgcttctcaagtccttttaattgtgatgttagggtgtcaattttagatctttcctgctttctcttgtgggcatttagtgctataaatttccctctacacactgttttgaatgtgtcccagagattctggtatgttttgtctttgttctcgttggtttcaaagaacatctttatttctgccttcatttcattatgtacccagtagtcattcagaagcaggttgttcagtttccatgtagttgagtggtctcgagtgagtttcttaatcctgagttctagtttgattgcgctgtggtccgagagacagtttgttataatttctgttcttttacatttgctgaggagtgctttacttccaactatgtggtcaattttggaataggtgtggtgtggtgctgaaaagaatgtatattctgttgatttggggtggagagttctgtagatgtctattaggtccgcttggtgcagagctgagttcaattcctgggtatccttgttaactttctgtctcgttgatctgtctaatgttgacagtggggtgttaaagtcttggagtctaagtctctttgtcggtctctaaggacttgctttatgaatctgggtgctcccgtattgggtgcatatatatttaggatagttagctctcttgttgaattgatccctttaccattatgtaatggccttctttgtctcttttgatctttgttggtttaaagtctgttttatcagagaatagggttgcaacccctgcctttttttgttttccatttgcttggtagatcttcctccatccctttattttgagcctatgtgtgtctctgcacgtgagatgggtttcctgaatacagcacactgatgggtgtgctctttatccaatttgccagtctgtgtcttttaattggagcatttagcccatttacatttaaggttaatattgttatgtgtgaatttgatcctgtcattatgatgttagctggttattttgctcattagttgatgcagtttcttcctagcctcgatggtctttacaatttggcatgtttttgcagtggctggtactggttgttcctttccatgtttagtgcttccttcaggagctcttttagggcaggcctggtggtgacaaaatctctcagcattttgcttgtctgtaaaggattttatttctccttcacctatgaagcttagtttggctggatatgaaattctgggttgaaaattcttttctttaagaatgttgaatattggcccccactctcttctggcttgtagagtttctgccaagagatcagctgttagtctgatgggcttccctttgtgggtaacccgacctttctctctggctgcccttaacattttttccttcatttcaactttggtgaatctgacaattatgtgtcttggagttgctcttctcgaggagtatctttgtggcgttctctgtatttcctgaatttgaatgttggcctgccttactagattggggaagttctcttggataatatcctgcagagtgttttccaacttggttccattctccccgtcactttcaggtacaccaatcaggtgtagatttggtcttttcacatagtcccatatttcttggaggctttgttcatttctttttattcttttttctctaaacttctcttctcgcttcatttcattcatttgatcttccgtcactgataccctttcttccagttgatggaatcagctactgaggcttgtgcattcatcatgtagttctcgggctgtggttttcagctccatcaggtcctttaaggacttctctgcattggttattctagttagccattcgtctaattttttttcaaggtttttaacttctttgccatgggttcgaacttcctcctttagctcagagtagtttgattgtctgaagccttcttctctcaagtcgtcaaagtcattctccatccagctttgttccattgctggtgaggagctgcgttcctttggaggaggagaggcgctctgatttttagagtttccagtttttctgctctgttttttccccatctttgtggttttatctacctttggtctttgatgatggtgacgtacagatggggttttggtgtggatgtcctttctgtttgttggttttccttctaacagtcaggaccctcagctgcaggtcttttggagtttgctggatgtccactccagaccctgtttgcctgggtatcagcagcagaggctccagaacagcggatattggtgaacagaaaatgttgctgcctgataattcctctggaagtttcatctcagaggagtacccggccgtgtgaggtgtcagtctgcccctactggggggtgcctcccagttaggctactcgggggtcagggacccacttgaggaggcagtctgtccgttctccgatctcaagctgcatgctgggagaaccactactctcttcaaagctgtcagacagcgacatttaagtctgcagaggtttctgctgccttctgtttggctatgccctgcccccagaggtggagtctacagaggcaggtgggcctccttgagctgcggtgggatccacccagttcgagcttcccggccgctttgtttacctactcgagcctcagcaatggcaggcgcccctcccccagcctcgctgccgccttgcagtttgatctcagactgctgtgctagcaatgagcgaggctccgtgggcgtaggaccctccgagtcaggcgt

SEQ ID NO: 12041 - DNA, 4943 bp, Homo sapiens
tttattattattattattattattattattattattattatactttaagttttagggtacatgtgcacaacgtgcaggttggttacatatgtatacatgtgccatgttggtgtgctgcacccattaactcgtcatttagcattagttatatctcctaatgctatccctcccccctccccccatcccacaacaggccccagtgtgtgatgttccccttcctgtgtccatgtgttctcattgttcaattcccacctatgagtgagaacatgcagtggttggttttttgtccttgcgatagtttgctcagaatgatggtttccagcttcatccacgtccctacaaaggacatgaactcatcactttttatggctgcatagtattccatagtgtatatgagccacattttcttaatccagtctatcattgttggacatttgggttggttccaagtctttgctgttgtgaatagtgctgcaataaacatatgtgtgcatgtgtctttatagcagcatgatttgtaatcctttgggtatatacccagtaatgggatggctggatcaaatggtatttctagttctagatccctgaggaattgccacactgacttccacaatggttgaactagtttacgttatggtaccaccaacagtgtaaaagtgttcctatttctccacatcctctccagcacctgttgtttcctgactttttaatgattgccattctaactggtgtgagatggtatctcattgtggttttgatttgcatttctctgatggccagtgatagtgagcattttttcatgtgttttttggctgcataaatgtcttcttttgagaagtgtctgttcatatcctttgcccaattttgatggggttgtttttttcttgtaaatttgttggagttcattgtagattctggatattagccctttgtcagatgagtaggttgcaaaaattttctcccattctgtaggttgcctgttcacactgaaggtggtttcctttgctgtgcagaagctctttagcgtaattagatcccatttgtcaattttggcttttgttgccattgcttttggtgttttagacatgaagtccttgcccatgcctatgtcctgaatggtattgcctaggttttcttctagggtttttatggttttagatctaatatttaagtctttaatccatcctgaattaatttttgtataaggtgtaaggaagggatccagtttcagctttctacatatggctagccaatcttcccagcaccatttattaaatagggaattgtttccccatttcttatttttgtcagattcgtcaaagatcagatagttgtagatatgcagcatcatttctgagggctctgttctgttccattggtctatatctctgttttggtaccagtaccaaaacagagttactgtagccttgtagtatagtttgaagtcaggtagtgtgatgcctccagctttgttcttttggcttaggattgacttggcaatgagggctcttttttggttccatatgaactttaaagtagttttttccaattctgtgaagaaagtcattggtagcttggtggggatggcattgaatctataaattaccttgggtagtatggccattttcacaatattgattcttcctacccatgagcatggaatgttcttccaattgtttgtatcctcttttatttcattgagcagtggtttgtagttctccttgaagaggtccttcacatcccttgtaagttggattcccagatattttattctctttgaagcaattgtgaatgggagttcactcatgatttggctctctgtttgtctgttattggtgtataagaatgctttgtgatttttgcacattgattttgtatcctgagactttgctgaagttgcttatcagcttaaggagattttgggctgagacagtggggttttctagatatacaatcatgttatctgcaaacagggacaatttgacttcctcttttcctaattgaatgctctttatttctttctcctgcctgattgccccggccagaactcccaacactatgtagaataggagtggtaagagagggcatccctgtcttgtgccagtttttgaagggaatgcttccagtttttgcccattcagtatgatattggctgtgggtttgtcataaatagctcttattattttgagatacgtcccatcaatacctaatttattgagagtttttagcatgaacggctgctgaattttgtcaaaggccttttctgcatctattgagataatcatgttgtttttgtctttggttctgtttatatactggattacgcttattgatttgtgtatgttgaaccagccttgcatgccagggatgaagcccacttgatcatggtggataagctttttgatgtgctaatggattcggtttgccagtattttatcgaggatttttgcatcgatgttcatcagggatattagtctaaaattctcttttttgcgtgtgtctctgccaggctttggtatcaggatgatgctggcctcataaaatgagttaggaaggattccctctttttctattgattggaatagtttcagaaggaatggtaccagcttctccttgtacctctggtagaaattagctgtgaatccgtctggtcctggactttttttgtttggtagcctattaattattgcctcaatttcagagcctggtattggtctattcagagattcagcttcttcctggtttagtcttgggagggtgtatgtgtccaggaatttatccatttcttctagattttctggtttatttgtgtagaggtgtttatagtattctctgatggtagtttgtatttctgtgggattggtggtgatatcccctttatcattttttattgcgtctatttgattcttctctcttttcttctttattagtcttgctagcagtctatcaattttgttgatcttttcaaaaaaccagctcctggattcattgattttttgaagggtttttggtgtctctatctccttcagttctgctctgatcttagttactatttcttgccttctgctagcttttcaatgtgtttgctcttgcttctctagttcttttaattgtgatgttagggtgtcaattttggatctttcctgctttctcttgtgggcatttagtgctataaatttctctctacacactgctttaaatgtgtcccagagattctggtatgttgtgtctttattctcactggtttcaaagaacacctttatttctgccttcatttcattatgtaccccatagtcattcagaagcaggttgttcggtttccatgtagttgagcggttttgagtgagtttcttaatcctgagttctagtttgattgcactgtggtctgagagacagtttgctataatttctgttctgttacatttgctgaggagtgctttacttccaattatgtgttcaattttggaataagtgtgatgtgctgagaagaatgtatattctgttgattttggggtggagagttctgtagatgtctattaggtctgcttggtgcagagctgagttcagttcctggatatcctagttaactttctgtctcattgatctgtctaatgttgacagtggggtgttaaagtctcccattattattgtgtgggagtctaagtctctttgtaggtctctaaggacttgctttatgaatctgggtgctcctgtattgggtgcatatatatttaggatagttagctcttcttgttgaattgatccctttaccattatgtaatggccttctttgtctcttttgatctttgttggtttaaagtctattttatcagagacgaggattgcaacccctacctttttttgttttccatttgcttggtagatcttcctccatccctttatttggagcctatgtgtgtctctgcatgtgagatgtatttcctgaatacagcacactgagtcttgactctttatccaatttgccagtctgtgtcttttaattggagcatttagcccatttacatttaaagttaatattgttatgtgtgaatctgatactgtcattatgatgttagctggttattttgctcgttagttgatgcagtttcttcctagcatcaatggtcttttcaatttggcatgtttttgcagtgactgtaccagttgttcctttccacatttagtgcttccttcaggagctcttgtagggcaggtctggtggtggcaaaatctctcagcatttgcttgtctgtaaaggattttatttctccttcacttatgaagattagtttcacaggatatgaaattctgggttgaaaattcttttcttcaagaatggtgaatattggcccccactctcttctggcttgtagagtttctgctgagagatcagctgttagtctgatgggcttccctttgtgggtaacctgacttttctctctggatgcccttaacattttttccttcatttcaactttggtgaatctgacaattatgtgtcttggagtagctcttctcaaggagtatctttgtggtgttctctgtatttcctgaatttgaatgctggcctgccttgctaggttggggaagttctcctggataatatcctgcagagtgttttccaacttggtttcattctccccctcactttcaggtacaccaatcagacgtggatttggtcttttcacatagtcccatatttcttggaggctttgtttgtttctttttattcttttttctctaagcttctcttctcccttcatttcattcatttgatcttcaatcactgataccctttcttccagttgatcgaatcagctactgaagcttctgtattcgtcacgcagttcttgtgccatggttttcacctccatcaggtcatttaaggacttctctgcactggttattctagttagctattcgtctaatcttttttcaaggtt

SEQ ID NO: 12042 - DNA, 12637 bp, Homo sapiens
ccttttttttttttttttttttttttaagctgtaactattttttttttattattatactttaagttttagggtacatgtgcacattgtgcaggttagttacatatgtatacatgtgccatgctggtgcgctgcacccactaactcgtcatctagcattaggtatatctcccgatgctatccctcccccctccccccaccccaccacagtccccagagtgtgatattccccttcctgtgtccatgtgatctcattgttcaattcccacctatgagtgagaatatgcggtgtttggtttttgttcttgcgatagtttactgagaatgatgatttccaatttcatccatgtcgctacaaaggacatgaactcatccttttttatggctgcatagtattccatggtgtatatgtgccaaattttcttaatccagtctatcattgttggacatttgggttggttccgagtctttgctattgtgaataatgccgcaataaacatacgtgtgcatgtgggggacagcctttttaacagccttggttttaagagtcagaatttagcacaaccgccagattcaataaacctgcacttctgctcttaaaaatggctacaagaggcctccccaccagaggccctctccaggccatcatttcattatgtattcagtgtttttgtaactgatccatcagtcaattggtaaaaatgccaaggagaaaactttgtttaatgatcatgcatctctttgactttgttaccataatttctgggggagcgacaattaccttgtgtctggctgttcttcctctgagtgcagcatccttccagctggtttagagggaacatcagtctccctccctccttctgcgggactgtcacttactgcatgctgatgtccagcctctgtgtgggctttgggaccacagccggaatgtcagatttaggaatccgctcattcgtgtgtttgttcattcaacaaatctctgtcagtgccttctatgttctggacactgcaccaggtgttaaagtgtaaaagctgccattctagagatacgcctaaaacactaaaggagaacagagaagtgaggaattaattctgggatgtgcgtgagtgtcttgggaagtcttctccaaggagtgacatttgtcctgggtcttgaagggtgaataggagccatgctgaaaagggatcataactctcaaggcagcgtttctcagccttgccggatgagtagaagcacctggtgggggggcccaggccacagtccagaccatccaataaggacctctgggggtgagacccaggcatcagtgttttttaaagcttcccggatgattccaaagagcagccatggttggaaaccatgcattaggggaatggaagtagaggttgcctaaatgtgcacacacacacacacacacaattagggtaggcttgaaggtaaacttccaaagactgtcagtccatagccttctccccagcccctcctgtgtgttccagaggaataaaaggacatgggttttggaggcagacggatcatgtgctgactgctgtaagatagcatgtgaccatcgaggcagtcgataatttgataagtgtttattgagtgcttactatgtgctaggtgctgggaacccagcagggaatatcatcaagtccttgctctcagggagctcactgcctatggcagaagatggatagacatacatttctcaggcagtgttagaaggagggacacagagttacgggagcccccaggaggggtatctggtgcagtcttgtggggttagggagacttcctctcagaggaagtggccgcaaggagataccacaaaggagtggaggaaagagatggaaacataagtagaggaaactacatgtgcaaaagcctagaggcaagagtgagtatggagaactcagaaatagcaagtattgactctatgtgaaatgtgacgttggggagggataaaagagaactggaaaaaacaggcagggccagatcataaaaggccttaaaagccgaagtggggagtctgtactttatcccgatgacaatggggagctcccggaagtagagcagtgccttcagggatgagtttatctgtgcagtgtgactagatggaagggatgctgcaggcatcctcatgagagatgatggtggtctgggatcaggtagtgacagtggggatggagagaagtggacagagtcaagagactgagcatttctggagctctctctgcacagttctctcctctctggtactctgtcctgtgagatccagctgcctttcctttgctgcgttgtggcctgaaaacccgagctgtaactggacaactggggggcttgcctggtctgtttccccctactcaggaatcactgtcctttgttaaccatgtccaatgccctgaaaactcttgtttcatatattttgtctgttttttggttgcttcagtcaggagtataaatctggtctctattatttcaccttgattggaagtgaaagtccttctatttcatttttctatataagaattatttaagaaagtttggctgggcacagtggctcacgcctgtaatcccaacactttgagaggctgaagcgggtggatcacttgaggccaggagtttgagatcagcctggccaagatgacgaaacctggtctctactaaaaatacaaaaattagccaagcatggtggcatacacttgtagtcccagctacttgggaggctgggcaggagaatcacttgaacccaggaagcggacgttgcagtgagccgagatcactcccactgcactccagcttgggcaatagagcaagactctgtctaaaaataaaaataaataaaaaaaaaatagggaaagaattctagatggtaggaacagggtgatcaaaggctcagaatcagagacgggaaaatgcaggccttttcagaggggcatatgctgtctgatattgcgttggcttggcattctcagtggggctaggcagagaacagtggaaagctacactgggatggaatgtggcaggtcttaaaggagaggcaaaaaatattgtattgtgaaggcaatggggagccatggaaggttcttgagtagagagggggaatagcatggtttttttttttgcctgccaggcaagtagttttgacagaagagctagcctcagtatagttcaaaggtccagttttagggctggtttcagaagttgagatctagtggataccttaaaagaactggtataaaaactttttattataggccaggtgcagtggctcatgcttataattccaacacttgggaaggcagaggtgggaggactacctgaggcaggagtttgagaccagtatgggcaacatagcaagaccctgtctctacaaaaaacaagaacaaaactaatcaggcatggtggcgcacacttgtagtcctaactattcaggaggctgaggagggaggattgcgtgcgctcgggaggttgaggcttcagtgagctatgatcgcgctggagtgcagcctggacaacagagtgagaccttgtctcaaagaaacaaacaaaaccaaacaaaaccacaataccattttcacacctacaaaaaatgaacatattctctaatatcatgaaatctctattaagatgttcatattctaattgtattataattttgatgacttttacacataaaatttgttttaaaacactttaagtttccttcttccatctaagaagatgtcacactcatctagagaccagctcaagttcggctcagggaacatttaggtcttcctactgtgttgcggttcactgactttggaagtttcactgacgatggtggaagtaacgagttacagcactggtcccatctcgcactgagttgggttcaagcacatctggtgaactagtggggcatctctgcacagtgaacccgttaaaggaagtgtcaggaaccagccttgacagcttggcctagcaagcggagcaaggagtgatgctgggtactgtgtggccactgtccctctgatttgtcccttggctttgtctcattttgagtgaaaactgtgaggacaaattctaaaactgtttaagatgttgggggcatgagcggagtagagttggtacccccataagagaaaggcggggagtggtgtggtgctctccaccagacccccttggtcagagactggtaaggtgggcagaggagggggcaggatttctgtaggtgcagtgtcatcacaggggaatccctggagccagaggaggggaaatcccttcaaacaccacccagacactaccccgcttgtttgtgagcacattggagatggcccctggggaatgcaagctacttgatgaaggtagggaagtactgaacacgactctgtgaaggttcttattaccccaccttccatgtgtgagaactgagttcaaatggagggaagagtcacgcaaccaggaagcaaggtgtcttttcatttttatttatttacttatttattttttgagacagagtctcactctgttgcccaggctgcagtgcattggcatgatctgggctcactgcaacctctgcctgtgggttcagcctcccaagtagctgggattacaggtgtgcaccaccacacccagctaatttttgtatttttatttattatttgtttatttatttattgagatggggtcttgctctgttgcccaggctggagtgcagtggtataatctcagctcactgcaacttctgcctccccggctcaagtgatcctcctacctcggcctccttagtagctgggactacaggcctactccaacatgcctgctaattttttgtattttcagtagcgacggggttttaccatgttgcccaagctggtcttgtgaactcaagtgatctgcccgcctcggcctctcaaagtgttgggattacaggcgtgagccactgtgtctggtcatgagatgtgtttaaattcaaagccatccttctctcactctaataatggttgccacacagaaggggaatgctttaggagaagaatgctgatgggctgagtctgtatcagggaccatctggagaccataagctgttgctcatcttaaccttcaaaaccattctatgaggtcacttttatccttattctacagatagggaaatgaggctcagttttactaacttcaaagctcacagtcatggtcaaaatagttcattggatatttcttgggaacatttggctttggttcgtggttcaggaaaaaaattgtctttagattttcatttcagggttcagagaggctggttctttctcatttggggttcaagatttagtttgaatattaggccctaggagcctctggttcttcataagtgttaaatagattaaatgccataaaggtgacattgagatacttgggcatgttggggcagtgagctttggctctggcccgtggctctaggaggatggtagctggtatccatcgagatggatggtggctgtggggtgtgaatgctgagtgatgacttgtattaaagtggatgtgggcaaataaaaatgaattttgcttggaaccactttttatcaggtggctttccatgcaggatgatgtttcacatgcataggcaacctggacctgagctggggtggagttggggcagacgagctgtgtcttctctgccctttctgattccagggcgagggctgtgccaggaagtgcttctcagccacttctccttaggcacctttaaaggagcctttccccaccccagtctgactcagaaagtggggagaaatgccagaggcagatggagccaggcacaggcccgggcaaaacgtgtgaggctgagtgtttccaacagcaagacactggaagtgatgcaagtgctcagcagtcaaaaaggagaggatgaaagcattccagtgcccagcctgcacctcagttgttgtaatcacgattccctgcctccagtctggcaactcccccagccatcatttaatcactcagcaagtatctatcaagcacttatcctgtactgggaagggcatgttgactgctacttgctcagccccctgtttcattcccctgtgaccctcgaagattcctttaagtgaccaggcaagccctccatgccaccactccctaaaagtaggctccatctgggcggcttcagtgtgcaacctacacaactgtacacaggagccctgcctcaggcacccatggtgtcaatcacagtcttactgcacatataagtactctgtaaactgcatgaaggttaggctattcctcttactactattgtatgagacgtctgggatcctgttctagaaatgttcctgtcatatctcaatagaccccaagaattgtctccttgtctgaaatttcctgcagtcagcaagcttcctctctagggttccaggaccttagaatccccctcttccccagcctctgccttcacttcctgcatccacacaggggaagggaagggaacccatgcccttttatgtgtcaggcccatgctgagaaatttacagagtattctatttaattttcaacaacttctagagaagtaggtattgccacccccattttaggataaactgagatttttttcttttttttttctttagggagaaactgaagctcaaagacatgaaatcattttctttagatcatgcgtatgtgaagtggcagacccggatttgaacttgaattccgtaagacttcaaaccctgaaactgtgtagcttcatatcctggctcttctgcctactattgtgtgtaccttgggaaattactaaatctcttgatgcttctctttcaatcttggtaaaatgagggcgataataattcttgcctctccaggcagttaggaggatcaaaggagttgaaacaagtaaaacactgtgagaccggcacactcaatgaatattggctcttatcatcatcatcatcatcatcatcatcatcatcatcatcatcatcatcatcattactattacttctccaagacacttacatgacttgggataattgttacatttatagaagcagccccaggattaaatgcttcttcgtcttggaagccttgggccaatttgataacaacgggctttgtattttcaaatatgagaaatatctagaataaactcccaaatgtcacagtggagactctgtccaggccggtgatgactcttccagagcagcacaggggagatgagggtgttttccagtgatgtgattgggtcacacaggcctcaagtcatctctgaaagaaataaaagggaacttggatttgaaaggacatggtgggtcttaagagatctctgcttatggtttaaaaattgtgtccaattttcattgctccattgatttgcgcttcttggagttggttggatgaagtcctccttagaggcaggggaatggattggatgttcggtccctatgacttctctcctgtattttcttcatgctttgaaataataatccatttcatagtatagtgggttcagatggcagatcatagactcaggtattgtggacagaccaatcattgtgtccacagcttgaccctggtggaaggctgtaaccctgatggcaaagccctggagtctcccaaaccagtcaggggtccctgcctcttcccaacttctttttttattattatttttttatttttttattgtccttcacttcctttttttaaattatactttaagtttcagggtacatgtgcacaacgtgcaggtttgttacatatgtatacatgtgccatgttggtgtgctgcacccattaactcgtcatttacattaggtatatctcctaatgatatccctcctccctccccccaccccacaacaggccccagtgtgtgatgttccccttcctgtgtccatgtgttctcattgttcaattcccacctatgagtgagaatatgcggtgtttggttttttgtccatttctcagtttgctgagaatgacggtttccagcttcattcatgtccctacaaaggacatgaactcatcattttttatggctgcatagtattccatggtgtatatgtgccacattttcttaatcgagtctatcattgttggacatttgggttggttccaagtctttgctattgtgaatagtgccacaataaacatacgtgtgcatgtgtctttatagcggcatggtttataatcctttgggtatatgcccagtaatgggatggctgggccaaatggtatttctagttctagatccctgaggagtcgccacactgtcttccacaatggttgaactagtttacagtcccaccaacgtgtaaaagtgttcctatttctccacatcctctccagcacgtgttgtttcctgactttttaatgatcgccattctaagtggtgtgagatggtatctcattgtggttttgatttgcatttctctgatggccagtgatgatgagcatattttcatgtgtcttttggctgcataaatgtcttcttttgagaagtgtctgttcatatccttcacccacttggtgatgggttgtttttttcttgtacctttgtttgagttcattgtagattctggatattagccctttgtcagataagtagattgcaaaaattttctcccattctgtaggttgcctgttcactctgatggtagtttcttttgctgtgcagaagctctttagtttaattagatcccatgtgtcaattttggcttttgttgccattgcttttggtgttttagacatgaagtccttgtacatgcctatgtcctgaatggtattgcctaggttttcttctagggtttttacggttttaggtctaacatttaagtctttaatctatcttgaattaatttttgtataagatgtaaggaagggatccagtttcagctttctacatatggctagccagttttcccagcaccattgattaaatagggaatcctttccccatttcttgtttttgtcaggtttgtcaaagatcagatagttgtagatatgtggaattatttctgagggctctgttctgttccattggtctatatctctgttttggtacaagtaccatgctgttttggttactgtagccttgtagtatagtttgaagtcagatagcgtgatgcctccagctttgttcttttggcttaggattgacttggcaatgcaggctcttttttggttccatatgaactttaaagtagctttttccaattctgtgaagaaagtcattggtagcttgatggggatggcattgaatctataaattaccttgggcagtatggtcattttcaccatattgattcttcctacctatgagcatggaatgttcttgcatttgtttgtatcctcttttatttcgttgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgcacgttgattttgtatcctgagactttgctgaagttgcttatcagcttaaggagatttggggctgagacgacggggttttccagatatacaatcatgtcatctgcaaacaggggcaatttaacttcctcttttcctaattgaatacaatttatttccttctcctgcctgattgccctggccagaacttccaacactatgttgaataggagaagtgagagagggcatccctgtcttgtgccagttttcaaagggaatgcttccagttttagcccattcagtatgatattggctgtgggtttgtcatagatagctcttattattttgagatacgtcccatcaatacctaatttattgagagtttttagcatgaagtgttgttgaactttgtcaaaggccttttctgcatctactgagataatcatgtggtttttgtctttggttctgtttatatgctggattacatttattgatttgtgtatgttgaaccagccttgcatcccagggatgaagcccacttgatcatggtggataagctttttgatgtgctgctggatttggtttgccagtattttattgaggatttttgcatcgatgttcatcagggatagtggtctaaaattctctttttttgttgtgtctctgccaggctttggtatcaggataatgctggcctcttaaaatgagttagggaggattccctctttttctattgattggaatattttcagaaggaatggtaccagctcctccttgtacctttggtagaatacggctgtgaatccatctggtcctggacttttttttgttggtagcctattaattattgctttaatttcagagcctgttattggtctattaagagattcatcttcttcctggtttagtcttggaagggtctatgtgtcgaggaatttatccatttcttctagattttctaatttatttgcatagaggtgtttatagtattctctgatggtagtttgtatttctgtgggatcggtggtgatatcccctttatcattttttattgcgtctatttgatacttctctcttttcttctttattagtcttgctagcagtctaacaattttgttgacctttcgaaaaaccagctcctggattcactgattttttgaagggttttttgtgtctctatttccttcagttctgctctgatcttagttatttcttgccttctgctagcttttgaatgtgtttgctcttgcttctctagtgcttttaattatgatgttagggtgtcaattttagatcttttctgctttctcttgtgggcatttagtgctataaatttccccctacacactgctttgaatgtgtcccagagattctggtatgttgtgtgtttgatctcattggtttcaaagaatatctttatttctgccttcatttcgttatgtacccagtagtcattcaggagcaggttgctcagtttccatgtagttgagtggttttgagtgagcttcttaatcctgagttctagtttgattgcactgtggtctgagagatggtttgttataatttctgttgttttacatttgctgaggagtgctttacttccaactatgtggtcaattttggaatagatgtggtgtggtgctgaaaagaatgtatattctgttgatttggggtggagagttctgtagatgcctattaggtcctcttggtgctgagctgagttcaattcccggatatccttgttaactttctgtcgcattgatctgtctaatgttgatagtggggtgttaaaatctcccattattattgtgtgggagtctaagtctcttcataggtctctaaggacttgctttatgaatctgggtgctcctgtattgggtgcatatatatttaggatagttagctcttcttgttacattgatccctttaccattatgtaatggccttctttgtctcttttgatctttgttgtttaaagtctgttttaacagagagtaggatttcaactcctgcctttttttgttttccatttgcttggtagatcttcctccatccccttattttgagcctatgtgtgtctctgcatgtgagatgatttcctgaataccgcacactgatgggtcttgactctttatccaatttgccagtctgtgtcttttaattggagcatttagcccatttacctttaaggttaatattgttatgtgtgaatttgatcctgtcattatgatgttagctggttattttgctcgttagttgatgcagtttcttccaagcatcgatggtctttacaatttggcatgtttttgcagtggctggtactggttgtttctttccatgtttagtgcttccttcaggagctcttgcaaggcaggcctggtgttgacaaaatctcttagcatttgcttgtctgtaaaggattttatttctccttcacttatgaagcttagtttggctggatatgaaattctgggttgaaaatacttttctttaagaatgttgaatattggccccactctcttctggcttgtagagtttctgccaagagatcagctgttagtctgatgggcttccttttgtgggtaacccgacctttctctctggaagccgttaacattttttccttcatttcaactttggcgaatctgacaattatgtatcttggagttgctcttctcgaggaatatctttgtggcgttctctgtatttcctgaatttgaatgttggcctaccttgctaggttggggaagttctcctggataatatcctgcagagtgttttccaacttggttccattctccccgtcactttcatgtacaacaatcagaagtagatttggtcttttcacatagtcccatatttcttggaggctttgttcatttctttctactcttttttctctaaacttctcttcttgcttcatttcattcatttaatcttcaatcactgatacctttcttccacttgatcgaattggctactgaagcttgtgcatgtgtcacgtggttctcgtgccatggttttcagcgccatcaggtcatttaaggtcttctctctgctgtttattctagttagccatttgtctaatcttttttcaaagtttttagcttctttgcgatgggttcaaacatcctcctttagctcggagaagtttgttatt

SEQ ID NO: 12043 - DNA, 5334 bp, Homo sapiens
taatttttttttttatactttaagttctagggtacatgtgcacaacgtggaggtttgttacaaaggtatacatgtgtcatgttggtgtgctgcacccgttaactcgtcatttacattaggtatatctcctaatgctatccctcctccctccccccaccccacgacaggccctggtgtgtgatgttccccaccctgtgtccaagtgttctcattgttcaattcccacctatgagtgagaacatgcagtgtttggttttctgtccttgcgatagtttgctcagaatgatggtttccagcttcatccatttccctacaaaggatatgaactcatccttttttacggctgcatagtattccatggtgtaaatgtgtcacattttcttaatccagtctatcattgatggacatttgggttgttccaagtctttgctactgtgaatagtgccgcaataaacatatgtgtgcatgtgtctttataccagcatgatttataatcctttgggtacatgcccagtgatgggatggctgggtaaaatggtatttctagttctagatccttgaggaatcgccacactgtcttccacaatggtggaactagtttacagtcccaccaacagtgtaaaagtgttcctatttctccacatcctctccagcacctgttgttttctgactttttaatgatcgccattctaactggtgtgagatggtatctcatagtggttttgatgtgcatttctctgatggccagtgatggtgagcattttttcatgtgtctgttggctgcataaatgtcttcttctgagaagtgtctgtttatatcctttgcccactttttgatggggctgtttgatttttgcttgtaaatttaagttctttgtagattttggatattagcccattgtcagatgagtagattgcaaaaattttctcccattctgtaggttgcctgttcactctgacggtagtttcttttgctgtgcagaagctctttagtttaattagatcccatttgtcaattttggcttttgttgccattgcttttggtgttttagtcatgaagtcctcgcccgtgcctatggcctgaatggtattgcctaggttttcttctggggtttttatcgttttaagtctaacatttaagtctttaatccatcttcaattaatttttgtgtaagatataaggaagggatccagtttcagctttctacatatggctagccagttttcccagcaccatttattaaatagggaatcatttccccatttcttgtttttgtcaggtttctcaaagatcagatggttttaggtgtgtgatattatttccgggggctctattctgttccattggtctatatctctgttttggtaccagtaccattttgttttggttactgtaggcttgtagtatagtttgaagtcaggtagcatgatgcctccagttttgttcttttggcttaggattgtcttggcaatgcgggctcttttttggttccatatgaactttaaagtagttttttccaattctgtgaagaaagtcattggtagcttgatggggatggcattgaatctataaattaccttgggcagtatggccattttcacaatattgattcttcctatccatgagcatggaatgttcttccatttgtttgtgtcctcttttatttcgttgagcagtggtttgtagttctccttgaagaggtccttcacatcccttgtaagttggattcctaggtattttattctctttgaagcaattgtgaatgggagttcactcatgatttggctctttgtttgtctgttattggtgtataggaatgcttgcgatttttgcacattgattttgtatcctgagactttgctgaagttgcttatcagcttaaggagattttgggctgagatgatggggttttctacatatacaatcatgttatctgcaaacagggacaatttgacttcgtcttttcctaattgaataccctctatttctttctcttgcctgactgccctggccagaacttccaacactacgttgaataggaatagtgagagagagcatccctgtcttgtgccagttttcaaagggaatgcttccagtttttgcccattcagtatgatactggctgtgggtttatcatatatagctcttattattttgagatacgtcccatcaatacctagtttattgagagtttttagcatgaagggctgttgaattttgtcgaaggccttttctgcatctattgagataatcatgtggtttttgtctttggttctgtttatatgatggattacgtttattgatttgcataggttgaaccagccttgcatcccagagatgaagccaacttgatcatgataggtaagctttttgatgtgctgctggatttggtttgccggtattttattgaggatttttgcatcaatgttcatcagggatattggtctaaaattctctttttttgtcgtgtctctgtcaggctttgatatcaggatgttggcctcataaaatgaattagggaggattctctctttttctattgattggaatagtttcagaaggaacggtaccagctcctctttgtacctctggtagaattcggctgtgaatctgtctggtcctggactttttttggttggtaggctattaattattgcctcaatttcagaacttgttattggtctattcagggattcaacttcttcctgttttagtcttgggagggtgtatgtgtccaggaatttatccatttcttctaggtcttctagtttatttgcatagaggtgtttatagtattctctgatggtagtttgtatttctgtgggatcagtggtgatatcccctttatcattttttattgcgtctatttgattcttctctcttttcttcattagtcttgctagcggtctatcaattttgttgatcttttcaaaaaaccagctcctggattcattgattttttgaagggttttttgtgtctctatctccttcaattctgctctgatcttagttatctcttgccttctgctagcttttgaatgtgtttgctcttgcttctctagttcttttaattgtgatgttagggtgtcaattttagatctttcctgctttctcttgtgggcatttagtgctataaatttccctctacacactgctttaaatgtgtcccagagattctggtatgttgtgtctttgttctcattggtttcaaagaacatctttatttctgccttcatttcgttatgtacccagtagtcattcaggatcaggttgttcagtttccatgtagttgagcagttttgagagagtttcttaatcctgagttctagtttgattgcactgtggtctgagagacagtttgttataatttctgttcttttacatttgctgaggagtgctttacttccaactatgtggtcaattttggaataggtgtgatgtgctgctgagaagaatgtatattctgttgatttagggtgcagagttctgtagatgtctattaggtccgcttggtgcagagctgagttcaattcctggatatccttgttaacttttttgtctcattgatctgtctaatgttgacagtggggggttaaagtctcccattattattgtgtgggagtctaagtctctttgtaggtctctaaggacttgctttatgaatctgggtgctcctgtactgggagcatatatatttaggatagttagctcttcttgttgatcactttaccattacgtaatggccttttttgtctcttttgatctttgttggtttaaagtctattttatcagagactagaattgcaacccccgctttttttttgttttccatttgcttggtagatcttcctccatccctttattttgagcctatgtgtgtctctgcacgtgagatgggtctcctgaatacagcacactgatgggttttgactctatccaatttgccagtctgtgtcttttaattggagcatttagcccatttacttttaaggttaatattgttatgtgtgaatttgatcctgtcatcatgatgttagctggttattttgctcgttagttgatgcagtttcttcctagcattgatggtctttacaatttggcatgtttttgcagtggctggtaccagttgttcctttccaggtttagtgcttccttcaggagctcttgtaaggcaggcctggtgatgacaaaatctcttagcatttgtttgtctgtaaaggattttatttctccttcacttatgaagtttagtttggctggatatgaaattctgggttgaaaattctttcctttaagaatgttgaatattggctcccactctcttctggcttgtagagtttctgccaagagatccgctgttagtctgatgggcttccctttgtgggtaacccaacctttctctctggctgcccttaacattttctccttcatttcaactttggtgaatctgataattatgtgtcttggggttgctcttctcgaggagtatctttgtggcattctctgtatttcctgaatttgaatgttggcctgccttgctcgattggggaagttctcccgcataatatcctgaagagtgttttccaacttggttccattctccccatcactttcgggtacaccaatcagacgtaggtttggtcttttcacatagtcccatatttcttggaggctttgttcatttctttttactcttttttctctaaacttcttttctcgcttcatttccttcatttgatcttcaatcactgataccctttctcccacttgatcaaatcagctactgaagcttgtgcatgcgtcatgtagttctcatgccatggttttcagctccatcaggtcatttaaggacttctctacactgtttattctagttacccattcgtctaatcttttttcaaggtttttagctgctttgcgatgggtttgaacatcctcctttagctcggagaagtctgttattaccgatcatctgaagccttcttctctcaactcatcgaagtcattctctgtccagctttgttccattgctggcgaggagctgcattcctttggaggagaagaggcgctctgatttttagaattttcagcttttctgctctggtttctccccatctttgtggttttatctacctttggtctttgatgatggtgacgtacaggtggggttttggtgtggatgtcctttctgtttcttagttttccttctaacagtcaggaccctcagctgcaggtctgttggagtttgctggaggtccactccagaccctgtttgcctgggtatcaccagcggaggctgcagaacagcaaatattgcagaacagcaaatgatg

SEQ ID NO: 12044 - DNA, 2318 bp, Homo sapiens
ttttgcccattcagtatgatattggctgtgggtttgtcatagatagctcttattattttgagatacatcccatcaatacctaatttattgagagtttttagcatgaagggttgttgaattttgtcaaaggccttttctgcatctattgagataatcatgtggtttttgtctttggttctgtttatatgctggattacatttattgatttgtgtatgttgaaccagccttgcatcccagggatgaagcccactcgatcatggtggataagctttttgatgtgctgctggattcggtttgccaatattttattgaggatttttgcatcaatgttcatcaaggatattggtctaaaattctcttttttggttgtgtctctgccagcctttggtatcaggatgatgctggcctcataaaatgagttagggaggattccgactttttctattgattggaatcgtttcagaaggattggtaccagctcctctttgtacctctggtagaattcggctgtgaatccatctggtcctggactttttttggttggtaagctattgattattgcctcaatttcagctcctgttattggtctattccgagattcaacttcttcctggtttagccttgggaggatgtatgtgtcgaggaatttatccatttcttctagattttctagtttatttgcgtagaggtgtttgtagtattctctgatggtagtttgtatttctgtgggattggtggtgatatcccctttatcattttttattgtgtctatttgattcttctctcttttcttctttattagtcttgctagcggtctatcaatttcgttgatcttttcaaaaaaccagctcctggattcattaattttttgaagggttttttgtgtctctatttccttcagttctgctctgatcttagttatttcttgccttctgctagcttttgaatgtgtttgctcttgcttttctagttcttttaattgtgatgttagggtgtcaattttagatctttcctgctttctcttgtgggcatttagtgctataaatttccctctacacactgctttgaatgtgtcccagagattctggtatgttgtgtatttgttctcgttggtttcaaagaacatctttatttctgccttcatttcattatttacccagtagtcattcaggagcaggttgttcagtttccatgtagctgagcaattttgagtgagtgtcttaatcctgagttccagtttgattgcactgtggtctgagagacagtttcttacattttctgttcttttacatttgctgaggagtgctttacttccaactatgtggtcaattttggagtaggtgtggtgtggtgctgaaaagaatgtatattctgttgatttagggtggagagttctgtagatgtctattaggtctgcttggtgcagagctgaattcaattcctgggtatccttgttgactttctgtctcgttgatctgtctaatgttgacagtggggtgttaaagtctcccattactattgtgtgggagtctaagtctctttgtaggtcactaaggacttgctttatgaatctgggtgctcctgtattgggtgcatatatatttaggacagttatctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccctttattttgagcctatgtgtgtctctgcacgtgagctgggtttcctgaatacagcacactgatgggtcttgactctttacccaatttgccagtctgtgtcttttaattggagcatttagcccatttacatttaaagttaatattgttatgtgtgaatttgatcctgtcattatgacgttagctggttattttgctcattagttgatgcagtttcttcctagcctcgatggtctttacaatttggcatgtttttgcagtggctggtactggttgttcctttccatgtttagtgcttccttcaggagctctttcagggcaggcctggtggtgacaaaatctctcagcatttgcttgtctgtaaagtattttatttctccttcacttatgaagcttagtttggctggatatgaaattctgggttgaaaattcttttctttaagaatgttgaatattggtccccactctcttctggcttgtagagtttctgccgagagatcagctgttagtctgatgggcttccctttgtgggtaacccgacctttctctat

SEQ ID NO: 12045 - DNA, 4811 bp, Homo sapiens
cccctccccccccaccccacaacaggccctggtgggtgatgttccccttcctacgtccaagtgttctcattgttcagttcccacctacgagtgagaacatgcggtgtttggtttttcattcttgctatagtttgctgagaatgatggtttccagcttcatccatgtccctacaaaggacgtgaactcatcctttttttatggctgcatagtattccatggtgtgtatgtgccacattttcttaatccagtctatcattgatggacatttgggttggttccaagtctttgctatcgtgaatagtgctgcaataaacatacgtgtgcatgtgtctttatagcagcatgacttatagtcctttgggtatatacccagtaaggggatggctggatcaaatggtatttctagttctagatccttgaggaatcaccacactgtcttctacaatggttgaactagtttacagtcccaccaacagtgtaaaagcgttcctatttctccacatcttctccagcacctgttgtttcctgaatttttaatgattgccattctaactggtgtgagatggtatctcattgtggttttttgatttgcctttctctgatggccagtgatgatgagcattttttcatgtgtcttttggctgcataaatgtcttcttttgagaagtgtctgttcataacctttgcccactttttgatagggttgtttgttttttcttgtaaatttgtttgagttctttgtagattctggatattagccttttatcagatgagtagattgcaaaaaatttctcccattctgtaggttgcctattcactctgacggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttacggttttaggtctaacatgtaagtctttaatccatcttgaattaatttttgtataaggtgtaaggaagggatccagtttcagctttctacatatggctagccagttttcccagcaccatttattaaatagggaatcctttccccatttcttgtttctgtcagctttgtcaaagatcagatgattgtagatgtgtggtattatttctgagggctctgttctgttccattggtctatatctctgttttggtaccagtaccatgctgttttggtgactgtagccttgtagtatagtttgaagtcaggtagcgtgatgcctccagctttgttcttttggcttaggattgtcttggcaatgcgggctcttttttggttccatatgaactttaaagtagtttttttccaattctgtgaagaaagtcattggtagcttgatggggatggcattgaatttataaattaccttgggcagtatggccattttcatgatactgattctccctatccatgagcatggaatgttcttccatttgtttgtatcctcttttattttgttcagcagtggtttgtacttctccttgaagaggtccttcacatcccttgtaagttggattcctaggtattttattctctttgaagcaattgtgaatgggagttcactcatgatttggctctctgtttgtctgttattggtgtataagaatgcttgtgatgttttgcacattgattttgtatcctgagactttgttgaagttgcttatcagcttaaggagattttgggctgagatgatggggttttctaaatatacaatcatgtcatctgcaaacagggacaatttgacttcctcttttcctaattgaatatcctttctttctttctcccgcctgattgccttggccagaacttccaacactatgttgaataggagtggtgagagagggcatccctgtcttgtgccagttttcaaagggaatgcttccagtttttgctcattcagtatgatattggctgtgggtttgtcataaatagctcttattattttgagatacatcccatcaatacctaatttattgagagtttttagcatgaagggctgttgaattttgtcaaaggccttttctgcatctattgagataatcatgtggtttttgtctttggttctgtttatatgctggataatgtttattgatttgcatatgttgaaccagccttgcatcccagggatgaagcccacttgatcatggtggataagctttttgatgtgctgctggattcggtttgccagtattttattgaggatttttgcatcaatgttcatcagggatattggtctaaaattctctttttttgttgtgtctctgccaggctttggtatcaggatgatgctggcctcataaaatgagttagggaggattccctctttttctattgtttggaatagtttcagaaggcatagtaccagctcctccttgtacctctggtagaattcggctgtgaatccgtctggtcctggactttttttggttggtagactattaattattgcctaaatttcagagcctgttattggtcttttcagggattcaacttcttcctggtttagtcttggaagggtgtatgtctccaggaatttatccatttcttctagattttctagtttatttgcatagaggtgtttatagtattctctgatggtagtttgtatttctgtgggatcggtggtgatatcccctttatcattttttattgcatctatttgattcttctctcttctttattagtcttgctagaggcctatcaattttgttgatcttttcaaaaaaaccacctcctggattcattgattttttgaagggttttttgtgtctctatctccttcaattcttctctgatcttagttatttcttgccttctgctagcttttgaatgtgtttgctcttgcttctctagttcttttaattgtgatgttagggcatcaattttagatttttcctgctttctcttgtgggcatttagtgctataaatttccctctacacactgctttaaatgtgtcccagagattctggtatgttgtgtctttgttctcattggtttcaaagaacatctttatttctctgccttcatttcgttatgtacccagtagtcattcaggagcaggtggttcagtttccatgtcgttgagcggttttgagtgagtttcttaatcctgagttctagtttgattgcactgtggtctgagagacagtttgttatagtttctgttcttttacatttgctgaggagtgctttacttccaattatgtggtcaattttggaataagtgcgatgtgatgctgagaagaatgtatattctgttgatttgggttggaatgttctgtagatgtctattaggtccacttggtgcagagctgagttcaattcctggatatccttgttaacttccggtcttgttgatttgtctaatgttaacagtggggtgttaaagtctcccattattattgtgtgggagtctgtctctttgtagatctctaaggacttgctttatgaatctgggtgctcctgtattgggtgcatatatatttaagatagttagctcttcttgttgaattgatccctttaccattatgtaatgaccttgtctcttttgatctttattggtttaaagtctgttttatcagagactaggattgcaacccctgcctttttttattttccatttgcttggtagatcttcctccatccctttattttgagcctatgtgtgtctctgcacgtgagatgggtctcctgaatacagcacactgatgggtcttgactctttatccaatttgccagtctgtgtcttttaattggagcctttagcctatttacatttaaggttaatattgttatgtgtgaatttgatccattatgatgttagctggttattttgctcgttagttgatgcagtttcttcctagcatctatggtctttacaatttgtcatgtttttgcagtggctggtaccaattgttcctttccatgtttagtgcttccttcaggagctcttgtagggcaggcctggtggttataacatctctcagcatttgcttgtctataaaggattttatttctccttcacttatgaagcttagtttggctggatatgaaattctgggttgaaaattcttttctttaagaatgttgaatattggcccccactctcttctggcttgtagagtttctgctgagagatccgccgttagtctgatgggtttccctttgtgggtaacccaacctttctctctggctgcccttaacattttttccttcatttcaactttggtgaatctgacaattatgtgtcttggagttgctcttcttgaggagtatctttgtggcattctctgtatttcctgaatttgaatgttggcctgccttgctaggttggggaagttctcctggataatatcctgccttgctaggttggggaagttctcctggataatatcctgaagagtgttttccaacttggttccattctccctgtcattttcatgtacaccagtcagatgtagatttggtcttttcacatagtcccatatttcttggaggctttgttcgtttgtttttactcttttttctctgaacttctcttctcacttcatttcattcatttgatcttcaatcaccgatatcctttcttccagttgatcaaatcggctactgaagcttgtgcatttgtcacgtagttcttgtgccatggttttctgctccatcatgtcatttaaggacttctctacactggttattctagttagccattcgtctaatcttttttcaaggtt

SEQ ID NO: 12046 - DNA, 5621 bp, Homo sapiens
cttttttctttttttttttttattgtactttaagttctagggtacatgtgcacaacatgcaggtttgttacatatgtatacatgtgccatgttggtgtgctgcacccattaactcgtcatttaatattcggtatatctcctaatgctatccctcccccctccccccaccccacaacaggccccggtgtgtgatgttccccttcctgtgtccatgtgttctcattgttcaattcccacctatgagtgagaatatgcggtgtttggtttttggccttgtgatagtttgctgagaatgatggtttccagctttatccatgtccctacaaaggacgtgaactcatcattttttatggctgcatagtattccatggtgtatatgtgccacgttttcttaatccagtctatcattgttggacatttgggttggttccaagtctttgctattgtgaatagtgccacaataaacatacgtgtgcatgtatctttatagcagcatgacttacaatcctttgtgtatacacccagtaatgggatggctgggtcaaatggtatttctagttctagatccctgaggaatcgccacactgtcttccacactggttgaactagtttacagtctcaccaacagtgtaaaactgttcctatttctccacatcctctccagcacctgttgtttcctgactttttaatgatcgccattctaactggtgtgagatggtatctcgttgtggttttcatttgcatttctctgatggccagggatgatgagcattttttcatgtgtcttttggctgcataaatgtcttctttcaagaagtgtctgttcatatcctttgcccactttttgatgggttgtttttttcttgtaaatttgtttgagttcattgtagattctggatattagccctttgtcagatgagtagattgcaaaaattttctcccattctgtaggttgcctgttcactctgatggtagtttcttttgctgtgcagaagctctttagtttaattagatcccatttgtcaattttggctttcgttgccattgcttttggtgttttagacatgaagtccttgaccatgcctatgtcctgaatggtattgcctggttttcttctagggtttttatggttttaggtctaacatttaagtctttaatccatcttgaattaatttttatataaggcgtaaggaagggatccagtttcagctttctacatatggcaagccagttttcccagcaccatttattaaatagggaatcctttccccatttcttgtttttgtcaggtttgtcaaagatcagatagttgtagataagcggcattatttctgaggactctgttctgttccattggtctatatctctgttttggtaccagtaccatgctgttttgattactgtagccttgtagtatagtttgaagtcaggtagcatgatgcctccagctttgttcttttggcttaggattgacttggcaatgcaagctcttttttggttccatatgaactttaaagtagttttttccaattctgtgaagaaagtcattagtagcttgatggggatggcattgaatctataaattaccttgggcagtatggccattttcacgatattgattcttcctacccatgagcatggaatgttcttccatttgtttgtatcctcttttatttcattgagcagtggtttgtagttctgcttgaagaggtccttcacatcccttgtaagttggattcctaggtattttattctctttgaagcaattctgaatgggagttcactcatgatttggctctctgtttgtctgttattagtgtataagaatgcttgtgatttttgcacattgattttgtatcctgagactttgctgaagttgcctatcagcttaaggagatttggggctgagacgatggcgttttctaaatatacagtcatgtcatctgcaaacagggacaatttgacttcctcttttcctaattgaataccctttatttccttctcctgcctgattgccctggccagaacttccaacactatattgaataggagtggtgagagagggcatccctgtcttgtgccagttttcaaagggaatgcttccagtttttgcccattcagtatgatattggctgtgggtctgtcatagatagctcttattattttgagatacatcccatcaatacctaatttattgagagtttttagcatgaagggctgttgaattttgtcaaaggccttttctgcatctattgagataatcatgtggtttttgtcattggttctgtttatatgctggattacgtttagtgatttgcgtaagttgaaccagccttgcatcccagggatgaagcccacttgatcatggtggataagctttttgatgtgctgctggattcggtttgccagtattttattgaggatttttgcatcgatgttcatcagggatattggtctaaaattctctttttttgttgtgtctctgccaggctttggtatcagcatgatgctggcctcataaaatgagttagggaggattccctctttttctattgattggaacagtttcagaaggaatggtaccagctcctccttgtccctctggtagaattcggccatgaatccatctggtcctggactttttttggttggtaagctattaattattgcctcaatttcagagcctgttattggtctattcagagattcaacttcttcctggtttagtcttgggagggtgtaggtgtcgaggaatttatccatttcttctagattttccagtttatttgcgtagaggtgtttatagtattcgctgatggcagtttgtatttctgtgggatcagtggtgatatcccctttatcattttttattgcgtctatttgattctcctctcttttattctttattagtcttgctagcggtctatcaattttgttgatcttttcaaaaaaccagctcctggattcgttgattttttgaagggttttttgtgtctctatttccttcagttctgctctgatcttagttatttcttgccttctgctagcttttgaatgtgtttgctcttgcttctcaagtccttttaattgtgatgttagggtgtcaattttagatctttcctgctttctcttgtgggcatttagtgctataaatttccctctacacactgttttgaatgtgtcccagagattctggtatgttttgtctttgttctcgttggtttcaaagaacatctttatttctgccttcatttcattatgtacccagtagtcattcagaagcaggttgttcagtttccatgtagttgagtggtttcgagtgagtttcttaatcctgagttctagtttgattgcgctgtggtctgagagacagtttgttataatttctgttcttttacatttgctgaggagtgctttacttccaactatgtggtcaattttggaataggtgtggtgtggtgctgaaaagaatgtatattctgttgatttggggtggagagttctgtagatgtctattaggtccgcttggtgcagagctgagttcaattcctgggtatccttgttaactttctgtctcgttgatctgtctaatgttgacagtggggtgttaaagtcttggagtctaagtctctttgtcggtctctaaggacttgctttatgaatctgggtgctcccgtattgggtgcatatatatttaggatagttagctctcttgttgaattgatccctttaccattatgtaatggccttctttgtctcttttgatctttgttggtttaaagtctgttttatcagagaatagggttgcaacccctgcctttttttgttttccatttgcttggtagatcttcctccatccctttattttgagcctatgtgtgtctctgcacgtgagatgggtttcctgaatacagcacactgatgggtgtgctctttatccaatttgccagtctgtgtcttttaattggagcatttagcccatttacatttaaggttaatattgttatgtgtgaatttgatcctgtcattatgatgttagctggttattttgctcattagttgatgcagtttcttcctagcctcgatggtctttacaatttggcatgtttttgcagtggctggtactggtttttcctttccatgtttagtgcttccttcaggagctcttttagggcaggcctggtggtgacaaaatctctcagcattttgcttgtctgtaaaggattttatttctccttcacctatgaagcttagtttggctggatatgaaattctgggttgaaaattcttttctttaagaatgttgaatattggcccccactctcttctggcttgtagagtttctgccaagagatcagctgttagtctgatgggcttccctttgtgggtaacccgacctttctctctggctgcccttaacattttttccttcatttcaactttggtgaatctgacaattatgtgtcttggagttgctcttctcgaggagtatctttgtggcgttctctgtatttcctgaatttgaatgttggcctgccttactagattggggaagttctcttggataatatcctgcagagtgttttccaacttggttccattctccctgtcactttcaggtacaccaatcaggtgtagatttggtcttttcacatagtcccatatttcttggaggctttgttcatttctttttattcttttttctctaaacttctcttctcgcttcatttcattcatttgatcttccgtcactgataccctttcttccagttgatggaatcagctactgaggcttgtgcattcatcatgtagttctcgggctgtggttttcagctccatcaggtcctttaaggacttctctgcattggttattctagttagccattcgtctaattttttttcaaggtttttaacttctttgccatgggttcgaacttcctcctttagctcagagtagtttgattgtctgaagccttcttctctcaagtcatcaaagtcattctccatccagctttgttccattgctggtgaggagctgcgttcctttggaggaggagaggcgctctgatttttagagtttccagtttttctgctctgttttttccccatctttgtggttttatctacctttggtctttgatgatggtgacgtacagatggggttttggtgtggatgtcctttctgtttgttggttttccttctaacagtcaggaccctcagctgcaggtcttttggagtttgctggatgtccactccagaccctgtttgcctgggtatcagcagcagaggctccagaacagcggatattggtgaacagaaaatgttgctgcctgataattcctctggaagtttcatctcagaggagtacccggccgtgtgaggtgtcagtctgcccctactggggggtgcctcccagttaggctactcggaggtcagggacccacttgaggaggcagtctgtccgttctccgatctcaagctgcatgctgggagaaccactactctcttcaaagctgtcagacagcgacatttaagtctgcagaggtttctgctgccttctgtttggctatgccctgcccccagaggtggagtctacagaggcaggtgggcctccttgagc

SEQ ID NO: 12047 - DNA, 4906 bp, Homo sapiens
ctggtcagatgagtaggttgcaaaaattttctcccattttgtaggttgcctgttcactctgatggtagtttcttttgctgtgcagaagctctttagtttaattagatcccctttgtcaattttggcttttgttcccatttcttttggtgttttagacatgaagtccttgcccaggcctatgtcctgaatggtattgcctaggttttcttctagggtttttatgattttaggtctaacatgtaagtctttgatccaacttgaattaatttttgtataaggtgtaaggaagggatccagtttcagctttctacatatggatagccagttttcccagcaccatttattaaatagggaatcctttccccattgcttgtttttgtcaggtttgtcaaagatcagacagttgtagctatgcggcattatttctgagggctctgtcctgttccattgatctatgtctgtgttttggtaacagtaccatgctgttttggttactgtagccttgtagtatagtttgaagtcaggtagcgtgatgcctccagctttgttcttttggcttaggattgacttggcgatgcgggctcttttttggttccatatgtactttaaagtcgttttttccaattctgtgaagaaagtcattggtagcttgatggggatggcattgaatctataaattaccttgggcagtatggccattttcacgatattgatacttccaacccaagagcgtggaatgttcttccatttgtttgtatcctcttttatttcattgagcagtggtttgcagttctccttgaagatgtccttcatgtcccttgtaagttgggttcctaggtattttattctctttgaagcaattgtgaatgggagttccctcatgattgggcactctgtttgtctgttattggtgtacaagaatgcttgtgaattttgtacattgattttgtatcctgagactttgcttaagttgcttatcagcttaaggagattttgggctgagacaatggggttttctagatatacaaccatgtcatctgcaaacggggacaatttgacttcctcttttcctaattgaataccgtttgtttccttctcctgcctgattgccctggccagaactcccaacactatgttgaataggagtggtgagacaggacatccctgtcgtgtgccagttttcaaaaggaatgcctccagtttttgcccattcagtatgatattggctgtgggtttgtcatagatagctcttattattttgagatacgtcccatcaatacctaatttattgagaatttttagcatgaagggctgttgaattttgtcaaaggccttttcttcatctattgagataatcatgtggtttttgtccttggttaggtttatatgctggattatgtttattgatttgcatatgttgaaccagccttgcatcccagggatgaagcccacttgatcatggtggataagctttttgatgtgctgctggattcggtttgccagtattttattgaggatttttgcatcaatgttcatcaaggatattggtctaaaattctctttttttgttgtgtctctgcccggctttggtatcaggatgatgctggcctcataaaattagttagagaggaatccctctttttctattgatgggaatagtttcagaaggaatggtaccagttcctccttgtacctctggtagaattctgctgtgaatccatctggtcctggactctttttggttggtaagctattgattattgccataattttggagcctgttattggtctattcagagattcaacttcttcctggtttagtcttgggagagtgtatgtgtcgaggaatttatccatttcttctagattttctagtttatttgcatagaggtgtttgtagttttctgtgatggtagattgtatttctgtgggatcggtggtgattacccctttatcattttttgttgcatctatttgattcttctctcttttcttctttattagtcttgctagtggtctatcaattttgttgatctgttcaaaaaaccagctgctggattcattaattttttgaaaggttttttgtgtctctatttccttcagttctcctctgattttagttatttcttgccttctgctagcttttgaatgtgtttgctcttgcttttcaagttcttttaattgtgatgttagggtgtcaattttggatctttcctgctttctcttgtgggcatttagtgctataaatttccctctacacactgctttgactgtgtcccagagattctggtatgttttgtctttgttctcgttggtttcaaagaacatctttatttctgcctttattttattatgtacccagtggtcattccggagcaggttgttcattttccatgtagttgagcggttttcagtgagtttcttaatcctgagttctagtttgattgcactgtggtctcagagacagtttgttataatttctgttcttttacatttgctgaggagagctttacttccaactatgtgatcaagtttggaatgggtgtggtgtggtgctgaaaaaaatgtatattctgttgatttggggtggagagttccgtagatgtctattaggtgtgcttggtgcagagctgagttcaattcctgggtgtgcttgctaactttctgtctcattgatctgtctaatgttgacagtggcatgctaaaatctcccattatgattgtgggggagtctaagtctctttgtaggtcactaaggacttgctttatgaatctgggtgctcctgtattgggtgcatatatatttaggatagttagctcttcttgttgaattgatccctttaccattatgtaaaggccttctttgtctcttttgatctttgttggtttaaagtctattttatcacagactaggattgcaacccctgcctttttttgttttccatttgcttggtagaccttcctccatccctttattttgagtctatgtgtgtctctacacgtgagatgggtttcctgaatacagcacactgatgggtcttgtctccttctccaatttgccagtctgtgtcttttaattggagcatttagcccatttacatttaaagttaatattgttatgtgtgaatttgatcctgtcattatgatgttagctggttattttgctcgttagttgatgcagtttcttcctagtctcaatggtctttacaatttggcatgtttttgcagtggctggtaccggttgttcctttccatgtttactgcttccttcaggagctcttttagggcaggcctggtggtgacaaaatctctcagcatttgtttgtctgtaaagtattttatttctccttcacttatgaagcttagtttggctggatatgaaattctgggttgaaaattattttctttaagcatgttgaatattgacccccactctcttctggcttgtagagtttctgctgagagatcagctgttagtctgatgggcttccctttgtgggtaacccgacctttctctctggctgcccttaacattttttccttcatttcaactttggtgaatctgacaattatgcgtcttggagttgctcttcttgaggagtatctttgtggcgttctctgtatttcctaaatctgaatgttggcctgccttgctagattggggaagttctcctggataatatcttgcagagtgttttccaacttggttccattctccccgtcactttcaggtacactaatcagacgtagatttggtcttttcacatagtcccatatttcttggaggctttgttcatttctttttattcttttttctctaaacttcccttcttgcttcatttcattcatttcatcttccatccctggtactctttcttccagttgattgcatccgctcctgaggcttctgcattcttcatgtagttcttgagccttggctttcagctccatcagctcctttaagcacttctctgcattgattattccagttatacattcatctaattgtttttcaaagtttataacttctttgctattggtttgaatttcctcctgtagctcggagtagtttgatcgtctgaagccttcttctctcaactcgtcaaagtcattctccgtccagctttgttccattgctggtgaggaactgcgttccttaggagaaggaggggcgcgctgctttttagagtttccagtttttctgctctgttatctccctatctttgtggttttatcaacttttggtctttgatgatggtgatgtacagatgggcttttggtgtgggtgtccttctgtttgttagttttccttctaaaagacaggaccctcagctgcagatctgtgggagtttcctagaggtccactccagaccctgtttgcctgggtatcagtagcggtggctgcagaacagcagattttcgtgaaccacaaattcagctgtctgatcgttcctctggaagtttggtctcagaggactacccggccgagtgaggtgtcagtctgtccctactgaggggtgcctcccagttaggctgctcgggggtcagtgacccactttaggaggcagtctgcccgttctcagatctccagctgcgtgctgggagaaccactactctcttcaaagctgtcagacagggacatttaagtctgcagaggtttctgctgactttttgtttgtctgtgccctgcccccagaggtggagcctacagaggcaggcaggcctcctggagctgtggtgggctccacccagttccagctgcctggctgctttgtttacctaagcaagcctgggcaatggtgcgtacccctcccccagcctcactgccgccttgcagtttgatctcagactgctgtgctagcaatctgcgagactctgtgggcgtaggaccctccaagccaggtgc

SEQ ID NO: 12048 - DNA, 4733 bp, Homo sapiens
tgtgctgcatccattaactcgtcatttaacattaggtatatctcctaatgctatccctccccccttcccccaccccacgacaggcccccggtgtgtgatgttccccttactgtgtccatgtgttctcattgttcaattcccacctatgagtgagaacatgcggtctttggttttttgtctttccgatagtttgctgggaatgatgattttcagtttcatccatatctctacaaaggacatgaactcatcattttttatggctgcatagtattccatggtgtatatgtgccacgttttcttaatccagtctatcactgatggacatttgggttggttccaagtctttgctattgtgaatagtgccacaataaacatatgtgtgcatgtgtctttatagcagcacgatttataatcctttgggtatatagcaagtaatgggatggcttggtgaaatggtatttctagttctagatccttgaggaatcgccacactgacttccacaatggttgaactagtttatggtcccaccaaccatgtaaaagtattcctatttctccacatcctctgcagcacctgtactttcttgacattttgatgattgccattctaactggtgtgagatggtatctctttgtggttttgatttgcatttctctgatggccaatgatgatgagcattttttcatgtgtctgttggctacataaagatcttcttttgagaagtgtctgttcatatccttcgcccactttttgatggggttgtttgtttttttcttgtaaatttgtttgagttcattgtcgattctggatattagccctttgtcagatgagtagattgcaaaaattttctcccattctgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaacatgtaagtctttagtccatcttgaattgatttttgtataaggtgtaaggaagggatccagtttcagctttctacatatggctagacagttttcccagagccatttattaaatagagaatcctttccccatttcttgtttttgtcagctttgtcaaaggtcagatggttgtagatgtgtggtattatttctgagggctctgttctgttccattggtctatgtctttgttttggtgccagtaccatgctgttttggttattgtagccttgtagcatactttgaagtaaggtagcatgatgcctccagcttttttctattggcttaggattgtcttggcaatgcgggctcttctttagttccatatgaactttaaagtagttctttccaattctgtgaagaaagtcactcgtagtttgatgaggatggcattgaatctataaattaccttgggcagtatggccattttcatgatattgattcttcctacccatgagcatgaaatgttcttccatttgtttgtgtcctcttttatttcattgagcagtgttttgaagttcttcttgaagaggtccttcacatcctttgtaagttgaattcctaggtattttattctctttgaagcaattgtgaatgggagttcactcatgaattgactctctgtttgtctgttattggtgtataggaatgcttgtgatttttgcacattgattttgtatcctgagactttgctgaatgtccttatcagcttaaggatattttgggctgagaagatggggttttctaaatatacgatcatgtcatctgcaaacaggaacaatttgacttcctcttttcctaatggaataccctttgtttctttctcctgcctgattgccctggccagaacttccaatactatgttgaataggagtggtgaaagagggcatccctgtcttgtgacagttttcaaagggaatgcttccaatttttgcccattcaatatgatgttggctgtgggtttgtcataaatagcttttattattttgagatacatcccataaatacctagtttattgagagtttttagcatgaagggctgttgaattttgtcaaaggccttttctgcatctattgagataatcatgtggtttttttctttagttctgtttatatgctggattacaattattaatttgcatatgttgaaccagccttgcaccccggggaagaagcccacttgatcgtggtggataaactttttggtgtgctgctggatttggtttgccagtattttattgaggatttttgcatcgatgttcatcaaaggtattggtctaaaattctcttttttggttgtgtctctgccaggttttggtatctggatgatgctggcctcataaaatgagttagagaggattccctctttttctattgattggaatagtttcagaaggaatggtagcagctccgctttgtacctctggtacaactcggctgtgaatccgtcaggtcctggactttctttggtcagtaagctattaattattgcctcaatttcagagcctgttattggtaggttcagagattcaacttcttcctgatttagtcttgggaggttgtatgtgtccaggaatttatccatttcttctagattttctagtttatttgcgtagaggtgtttatagtattctctgatggcagtttatatttctgtgggattggtggtgatatcccctttttcattttttattgcatctatttgattcttctctattttcctctttattagtcttgctagcgttctatcaattttgttgatcttttccaaaaacaagctcctggattcattgattttttgaaggtttttttgtgtctccatctccttcagttctgctccgatcttagttatttcttgccttctgctagcttttgaatgtgtttgctcttgcttctctagttcttttaattgtgaaattaggatgtcaattttagatctttcttgctttctcttgtgggcatttagtgctataaatttccctctacaggctgctttaaatgtttcccagagattctggtatgttgtgtgtttgttctcattggtttcaaagaacatctttatttctgccttcatttcattaggtacccagtagtcactcaggagccagttgttcaatttccatgtagttgagtggttttgagtgagtttcttaacactgagttctagtttgattgcactgtgatctgagagacagtttgtaacaatttctgttcttttacatttgctgaggagacctttacttccaactatgtggtcaattttggaataagtgtgatgtggtgctgagaagaatgtatattctgttggtttggggcagatagttctgtagatgccgattaggtccacttggtgcagagctgagttcaattcctggatatctttgttaactttctctcttgttaatctgtctaatgtctacagtggggtgttaaagtctcccattattattgtgtgggagtctaagtctctttgtaggtctctaaggacttgctttatgaatctgggtgctcctgtattgggtgcatatatatttaggataattagctgttcttgttaaattgacccctttaccattatgtaatggccttctttgtctcttttgatctttcttggcttaaagtctgttttatccgagactaggattgcaacccctgccttttttttgttttccatttgcttggtagatcttcccccatccctttattttgagcccatgtgtgtctctgtatgtgagatgggtctcctgaatacagcacactgatgggtcttgactctttatccaatttccagtctgtgtcttttaattggagcatttagcccatttacatttaaggttaatattgttatgtgtgaatttgatcctgtcattatgatgttagctggttattttactcgttagttgatgcagtttcttcctagcatcgatggtctttacaatttggcatgtttttgcgtggctggtaccagttgttcctttccatgtttagtgcttccttcaggagctcatgtagggcaggcctggtggtgacaaaatctctcagcatttgcttgtctataaaggattttatttctccttcacttatgaaccttagtttggctggatatgaaattctgggttgaaaattattttctttaagaatgttgaatattggcccccactctcttctggcttgcagagtttctgccaacagatcagctgttagtctgatgggcttccctttgtgggtaacctgacctttctctctggctgcccttaacattttttccttcatttcaactttggtgaatctgaaaattatgtgtcttggggttgctcttctcaaggagtatctttgtggcattatctgtatttcctgaatgtgaatgttggcctgccttgctaggttggggaagttctcctggataatatcttgcagattgttttccaacttggttccactgtccccatcactttcaggtacaccagttagacatagatttggtcttttcacatcatcccatatttcttggaggcttcattcatttctttttattcttttttctctaaatttctcttcttgctttgtttcattcattggatcttccatcactgatatcctttcttccagttgatcaaatcagctactgaagcttgtgcattc

SEQ ID NO: 12049 - DNA, 4565 bp, Homo sapiens
gtctaacgtttaagtctttaatccatcttggattgatttttgtataaggtgtaaggaagggatccagtttcagctttctacatatggctagccagttttcccagcaccacttattaaatagggaatcctttccccattgcttgtttttgtcaggtttgtcaaagatcagatagttgtagatatgtggtgttatttctgagggctctgttctgttccgttgatctatatctctgttttgataccagtaccatgctgttttggttactgtagccttgtagtatagtttgaagtcaggtagtgtgatgcctccagctttgttcttttggcttaggattgacttggcgatgtgggctcttttttgtttccatatgaactttaaagtagttttttccaattctgtgaagaaagtcattggtagcttgatggggatggcattgaatctataaattaccttgggcagtattgccattttcacaatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattatgcatgggagttcactcatgatttggctctctgtttgtctgttgttggtgtataagaatgcttgtgatttttgtatattgattttgtatcctgagactttgctgaagttgcttatcagcttaaggagattttgggctgagacaatggggttttctagatatacaatcatgtcctctgcaaacagggacaatttgacttcctcttttcctaatagaataacctttatttccttcttctgcctaattgccctggccagaacatccaacactatgttgaataggagtggtgaaagagggcatccctgtcttgtgccagttttcaaagggaatgcttccagtttttgcccattcagtatgatattggctgtgggtttgtcatagatagctcttattattttgaaatacgtcccatcaatacttaatttattgagagtttttagcatgaagggttgttgaatttcgtcaaaggctttttctgcatctattgagataatcatgtggtttttgtctttggctccgtttatatgctggattccatttattgatttgcgtatattgaaccagccttgcatcccagggatgaagcccacttgatcatggtggataagctttttgatgtgctgctggattctgtttgccagtattttattgaggattttttgcatcaatgttcatcaaggatattggtctaaaattctctttttttgttgtgtctctgcctggctttggtatcagaatgatgctggcctcataaaatgagttagggaggattccctctttttctattgattggaatagtttcagaaggaatggtaccagttcctccttgtacctctggtagaattcggctgtgaatccatctggtcctgggctctttttggttggtaagctattgattattgccacaatttcagctcctgttattggtctattcaaagattcaacttcttcctggttttgtcttgggagagtgtatgtgtccaggaatttatccatttcttctagattttctagtttatttgcatagaggtgtttgtagtattctctgatggtagtttgtatttctgtgggatcagtggtgatatcccctttatcaatttttattgtatctatttgattcttctctctttttttctttattagtcttgctagtggtccatcaattttgttgatcctttccaaaaaccagctcctggattcattaattttttgaagggttttttgtgtctctatttccttcagttctgttctgattttagttatttcttgccttctgctagcttttgaatgtgtttgttcttgcttttctagttcttttaattgtgatgttagggtgtcaattttggatctttcctgctttctcttgtgggcatttagtgctataaatttccctctacacagtgctttgaatgcatcccagagattctggtatgttgtgtctttgttctcgttggtttcaaagaacatctttatttctgccttcatttccttatgtacccagtagtcattcaggagcagcttgttcagtttccatgtagttgagcggttttgagtgagattcttaatcctgagttctagtttgattgcactgtggtctgagagatagtttgttataatttctgttcttttacatttgctgaggagagctttacttcccagtatgtggtcaattttggaataggtgtagtgtggtgctgaaaaaaatgtatattctgttaatttggggtggagagttctgtagatgtctattaggtccgcttggtgcagagctgagttcaattcctgggtatccttgttgactttctgtcttgttgatctgtctaatgttgacagtggggtgttaaagtctcccattattaatatgtgggagtctaagtctctttgtaggtcactcaggacttgctttatgaatctgggtcctcccgtattgggtgcatatatatttaggatagctagctcttcttgttgaattgatccctttaccattatgtaatggccttctttgtctcttttaatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacaccacactgatgggtcttgactctttatccaatttgccagtctgtgtcttttaattggagcatttagtccatttacatttaaagttaatattgttatgtgtgaatttgatcctgtcattatgatgttagctggttattttgctcgttagttgatgcagtttcttcctagtctcgatggtctttacattttggcatgattttgcagcggctggtactagttgttcctttccatgtttagtgcttccttcaggagctcttttagggcaggcctggtggtgacaaaatctctcagcatttgcttgtctgtaaaggattttatttctccttcacttatgaagcttagtttgtctggatatgaaattctgggttgaaaattcttttctttaagaatgttgaatattggcccccactctcttctggcttgtagggtttctgccgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgatagattggggaagttctcctggataatatcctgcagagtgttttcccacttggttccattctccccatcactttcaggtacaccaatcagacgtagatttggtcttttcacatagtcccatatttcttggaggctttgctcatttctttttattcttttttctctaaccttcccttctcgcttcatttcattcatttcatcttccattgctgataccctttcttccagttgatcgcattggctcctgtggcttctgcattcttcacatagttctcgagccttggttttcagctccatcccagctcctttaagcacttcgctgtattggttattctagttatacattcttccaaatttttttcaaagttttcaacttctttgcctttggtttgaatgtcctcccatagctcagagtaatttgatcatctgaagccttcttctctcagcttgtcaaagtcattctccatccagctttgttccgttgctggtgaggagctgcattcctttggaggaggagaggtgctctgctttttagagtttccagtttttctgttctgttttctccccatctttgtggttttatctacttttggtctttgatgatggtgatgtacagatgggtttttggtgtggatgtcctttctgtttgttagttttccttctaacagagaggacctcagctgcaggtctgttggaatgccctgccgtgtgaggtgtcagtgtgcccctgctggggggtgcctcccagttaggctgctcgggggtcaggggtcagggacccacttgaggaggcagtctgcccgttctcagatctccagctgcgtgctgggagaactactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttggagcttcctggctgctttgtttacctaagcaagcctgggcaatggcgggcgcccctcccccagcctcgctgccgccttacagtttgatctcagactgctgtgctagcaatcagtgagactccctaggcgtaggaccctccgagccaggtgcgagatat

SEQ ID NO: 12050 - DNA, 3277 bp, Homo sapiens
gaaagtcattggtagcttgatggggatggcattgaatctataaattaccttgggcagtgtggccattttcacgatatggattattcctatccatgaacgtggaatgttcttccatttgtttgtatcctcttttatttcattgaacaggtttgtagttctccttgaagaggtccttcacatcccttgtaagttggattcctaggtattttattctctttgtagcaattttgaataggagttcactcatgatttggctgtctgtctgttattggtgtgtaagaatgcttgtgatttttgcacattgattttgtatcctgagactttgctgaagttgcttatcagcttaaggagattttgggctgagttgatggggttttctagacatacaatcgtgtcatctgcaaacagggacaattttacttcctcttttcctaattgaataccctttatttccttctcctgcctaattgccctggccagaacttccaacactatgttgaataggagtgatgagagagggcatccctgtcttgtgccagttttcaaagggaatgcttccagtttttgcccattcagtatgatattggctgtgggtttgtcatagatagctcttattattttgagatacgtcccatcaatacttaatttattgagagtttttagcatgaaggttgttgaattttgtcaaaggccttttttgcatctattgagataatcatgtggtttttgtcgttggttctgtttaaatgctggattatgtttattgattttcgtatgttgaaccagccttgcatcccagggatgaagcccacttgatcatggtggataagctttttgatgtgctgctggattcggtttgccagtattttattgaggatttttgcatctatgttcatcagggatattggtctaaaattctctttttttgttgtgtctctgcccggctttggtatcaggatgctgctggcctcataaaatgagttagggaggattctctctttttctattgattggaatagtttcagaaggaatggtaccagctcctccttgtacctctggtagaattcggctgtgaatccatctggtcctggactattcttggttggtaagctattaattattgcctcaatttcagatcctgttattggtctattcagagattcaacttcttcctggtttagtcttgggagggtgtatgcgtcgaggaatttatccatttcttctagattttctagtttatttgcatagaggtgtttatagtattctctgatggtagtttgtatttctgtgggattggtggtgatatcccctttatcatttttattgcatctatttgattcttctctctttattagtcttgctagtggtctatcaattttgttggtcttttcaaaaaatcagctcctggattcattgattttttgaagggttttttgtgtctctatctccttcagttctgctctgatcttagttatttcttgccttctgctagcttttgaatgtgattgctcttgcttctctagttcttttaattgtgatgttagggtgtcgattttagatctttcctgctttctgttgtgggcatttagtgctataaatttccctttacacactgctttgaatgcatcccagagattctggtatgttgtgtctttgttctcgttagtttcaaagaacctctttatttctgccttcctttcgttttgtacccagtagtcattcaggagcaggttgttcagtttccatgtggttgagcagttttgagtgagtttcttaatcctgagttctagtttgattgcactgtggtctgagagacagtttgttataatttctgttcttttacatttgctgaggagtgctttacttccaactatgtggtcagttttggaataagtgcggtgtggtgctgagaagaatgtatattctgttgatttggggtggagagttctgtagaagtctattaggtctgcttggtgcagagctgagttcaattcctggatatctttgttaactttctgtctcattgatctgtccgatgttgacagtggggtgttaaagtttcccattactattgtgtgggagtctaagtctctttatatgtctctacggacttgctttatgaatctgggtgctcctgtattgggtgcatatctatttaggatagttagctcttctcattgaattgatccctttaccattatgtattggccttctttgtctcttttgatctttgttggtttaaagtctgttttatcagagactaggattgcaacccctgcctttttttgttttccatttgcttggtagatcttcctccatccctttattttgagcctatgtgtgtctctgcacgtgagatgggtttcctgaatacagcacactgatgggtcttgactctttatccaatttgccagtctgtgtcttttaattggagcatttagcccatttacatttaaggttaatattgttatgtgtgaatttgatcctgtcattatgatgttagctggttattttgctcattagttgatgcagtttcttcctagcctcaatggtctttactatttggcatgtttttgcagtggctggtaccagttgttcctttccatgtttagtgcttccttcaggagctcttgtaaggcaggcctggtggtgacaaaatctctcaggatttgcttgtctgtaaaggattttatttctccttcacttacaaagcttagtttggctggatttgaaattctgggctgaaaattcttttctttaagaaagttgaatattggcccctactctcttctgccttgtagagtttctgctgagagatcagctgttagtctgatgggtttccctttgtgggtagcccgacctttctctctgtcttcccttaacattttttccttaatttcaactttggtgaatctgacaattatgtgtcttggagttgctcttcttgaggagtatctttgttgtgttctctctatttcctgaatttgaatgttggcctgccttgctagattggggaagttctcctggataatatcctgcagagtgttttccaacttggttccattctctccgtcacttgcaggtacaccaatcagatgcagatttggtcttttcacatagtcccatatttcttggaggctttgttcatttctttttattcttttttctctaaacttctcttctcacttcatttcattcatttgatcttccatcactgataacctttcttccagttgatcgaatcagctactgaagcttgtgcattcatcacttagtt

SEQ ID NO: 12051 - DNA, 4744 bp, Homo sapiens
tctcctaatgctatccctctcccagccccctctccatgactgtccccggtgtgtgatgttcgccgccctgtgtccaagtgttctcattgttcagtttccacctatgagtgagaacatgcagtgtttggttttctgtccttgtgatagtttcctcagaatgatggtttccaacttcatccatgtccctgcaaaggacatgaactcatccttttttatggctgcttagtattccatggtgtatatgtgccacattttcttaatccagtctatcattgatggacatttgggttggtgtcaagtctttgctattgtgaatagtgccacaataaacatatgtgtgcatgtgtctttatagtagcctgatttataatcctttgggtatatacccagtaatgggatcactgggtcaaatggtatttctagttctagatccttgaggaattgccacactgacttgtacaatggttgaactagtttacactcccactgacagtgtaaaagtgatcctatttctccacaccctctccagtatctgttgtttcctgactttttaatatcaccattctaactggcatgaatgctatctcattgtggttttgatttgcatttctctgatgaccagtgatgatgagcattttttcatgtgtctattggctgcataaatgtcttcttttgagaagtgtctgtttatatccttggcccactttttgatggggttgtttgtttctttcttgtaaatttgtttaagttctttgtagattctggatattagccctttgtcagatgggtagattgcaaaaattttctcccattctataggttgcttgttcactctgatattagtttcttttactgtgcagaagctctttagtttaattagatcccatttgtctattttggcttttgttgccgttgcttttggtgttttagtcatgaagttcttgcccatgcctatgtcctgaatggtattgcctaggttttcttctagggtttttatggttttaggtctaacatttaattctttaatccatcttgaattaatttttgtataaggtgtaaggaagggatcctgtttcagctttctacatatggctagccagttttcccagcaccatttattaaatacggaatcatttccccatttcttgtttttgtcaggtttgtcaaagatcagatggctgtagatgtggggtgtcatttctgaggcctctgttctgttccattggtctatatctctgttttggtaccagtaccatgctgttgtggttactgtagccttgtagtatagtttgaagtcaagtagcgtgatgcctccagctttgttcttttggcttaggattgtattggcaatgcaggctttttttttggttccatatgaactttaaagtagctttttccaattctgtgaagaaagtcattggtagcttgatggggatggcattgaaagtgtaaattaccttgggcaatatggccattttcacgatattgatttttcctatccatgagcatggaatattcttccatttgtttgtgtcctcttttattttgttgagcagtggtttgtagttctccttgaagaggtccttcatatcctttgtaagttggattcctaggtattttattctctttgcagcaatcgtgaatgggagttcactcatgatttggctctctgtttgtctgttattggtgtacagaaatgcttgtgattcttgcacattgattttatatcctgagactttgctgaagttgcttatcagcttaaggagattttgggctgagatgatggggttttctagatatacaatcatgtcatctgcaaacagggacaatttgacttcctcttttcctaattgaataccctttatttctttctcttgcctgattgccctggccagaacttccaacattatgttgaataggagtggcgagagacggcatccctgtcttgtgccagttttcaaagggaatacttccagtttttgcccattcagtatgatattgactgtgggtttgtcataaatagctcttattattttgagatacgtttcatcaatatctagtgtattgagagtttttagcatgaagggctgttgaattttgtcaaaggccttttctgcatctattgagataatcatgtggtttttgtcattggttcagtttatgtgatggattatgtttattgatttgcatatgttgaaccagccttgcatcccagggacaaagccaacttgattgcaatggataaactttttgatgtgctgctggattcagtttgccagtattttattgaggattttcgcattgatgttcatcagggatattggtctaaaattcttttttttgttgttgtgtctctgccaggctttggtatcagaatgatgctggcctcataaaatgagttagggaggattcccttttttctattgattggaatagtttcagaaggaatggtaccagctcctccttgtacctctggtagaatttggctgtgaatccgtctggtcctggactttttttggttggtaagctattaattattgactcaatttcagagcctgttattggtctattcagagattcaacttcttcctggtttagtcttgggagggtgtatgtgttgaggaatttatccatttcttctagattttctagtttatttgcgtagaggtgtttatagtattctctgatggtagtctgtatatctgtgggatcggtggtgatatcccctttatcattttttattgtgtctatttgattcttctctcttttcttctttattagtcttgctagcggtctatcaattttgttgatcttttcaaaaaaccacctcctggattcattgattttttgaagggttttttatgtctctatctccttaagttctgctctgatcttacttatttcttgccttctgctgtcttttgaatgtaaagtttgctcttgcttctctagttcttttaatcgtgatgttagggtgtcaattttagatctttcctgctttctcttgtgggcatttagtgctataaatttccctctacacattgctttaaatgtgtcccagagattctggtatgctgtgtctttgttctcattggtttcaaagaacatctttatttgtgccttcatttcattatgtacccagtagtcattcaggagcaggttgttcagtttccatgtagttgagcggttttgagtgagtttgttaatcctgagttctagtttggttgcactgtggtctgagcaacagtttgttataatttctgttcttttatatttgctgaggagtgctttacttccaactatgtggtcaattttggaataagtgcggtgtggtgctgagaagaatgtacattctgttgatttggggtggagagttctgtagatgtctattaggtccgcttggtgcagaactgagttcaattcctggatatccttgctaactttctgtctcgttgatctgtctaatgttgacagtggggtgttaaagtctcccattattattgtgtgggagtctaagtctctttgtaggtcactcaggacttgctttatggatctgggtgctcctgtattgggtgcatatctatttaggatagttagctcttcttgttgaattgatccctttaccattatgtaatggccttctttgtctcttttgatctttgttggtttaaagtctgttttatcagagactgggattgcaacccctgcctttttttgttttccatttgcttggtagatcttcctccatccctttattttgagcctatgtgtgtctctgcacatgagatgggtttcctgaatacagcacactgatgggtcttgactctttatccaatttgccagtctgtgtcttttaattggagcatttagcccatttacatttaaggttaatattgttatgtgtgaatttgatcctgtcattatgatgttagctggttattttgcttgttagttgatgcagtttcttcctagcatcgatggtctttacaatttggcatgtttttgcagtggctggtaccagttgttcctttccatgtttagtgcttccttcaggagctctcgtagggcaggcctggaggtgacaaaatttctgagcatttgcttgtctgtaaagtattttatttctccttcacttatgaagcttagtttggctggatatgaaattctgggttgaaaattcttttctttaagaatgttgaatattggcccccagtctcttctggcttgtagagtttctgctgagagatccgctgttagtctgatgggcttccctttgtgggtaacccaacctttctctctggctgcccttaacattttttccttcatttcaactttggtgaatctgacaattaatgtgtcttggagttgctcttctcacggagtatctttatggcattctctgcatttcctgaatttgaatgttggtctgccttgctaggttggggaagttctcctggataatatcctgcagagtgttttccaacttggttccattctccctgtcactttcaggtacaccaagccaatgtagatttggtcttttcacatagtcccatatttcttggaggctttgttcatttctttttattcttttttctctaaacttctcttcttgcttcatttcattcatttgatcttcaatctctgttaccctttcttccagttgattgaatcggctactgaatcttgtgcacgcatcacgtagttctcctgccatggttttcagctccatcaggtcctttaa

SEQ ID NO: 12052 - DNA, 2380 bp, Homo sapiens
cagtatgatattggctgtgggtttgtcataaatagctcttattattttgagatatgtcccatcaatacctagtttattgagagtttttagcatgaagacctgctgaattttgtcaaagcccttttctgcatctattgagataatcatgtggtttttgtctttggttctgtttatatgatggattccatttattgatttgcttatgttgaaccaggcttgcatcccagggatgaagccaacttgatcatggttgataagctttttgatgtgctgctggatttggtatgccagtattttattgaggatttttgcattgatgttcatcagggacattggtctaaaattctctttttttgttgtgtctcggccaggcatggtatcaggataatgttggcctcacaaaatgagttatggaggagtccctctttttctattgattggagtaatttccgaaggaatggtaccagctcctccttgtacctctggtagaattccgttgtgattccgtctggtcctggacttttttgggttggtaggctgttaattattgcctcaatttcagaacctgttattggtctattcagggattcaacttcttcctggtttagtcttgggagggtgtatgtgtcaaggaatttatccatttcttctagattttctagtttatttgcatagatgtgtttatagtattctctgatggtagtgtgtatttccatgggatcggtggtgatatcccctttatcattttttattgtgtctatttgattcttctctcttttcttctttgttagtcttgctagcggtctatcaattttgttgatcttttcaaaaaaccagctcctggattcgttgattttttgaggagttttttgtgtctctatctccttcagttctgctctgatcttagttatttcttgccttctgctagcttttgaatatgtttgctcttgcttctctagttcttttaattgtgttgttagggtgtcaattttagatctttcctgctttctcttgtgggcatttggtgctataaatttccctctacatactgctttaaatgtgtcccagagattctggtttgttgtgtctttgttctcattggtttcaaagaacatctttatttctgccttcatttcgttatgtacccagtagtcattcaggagcaggttgttcagtttccatgtagttgagcggttttgactgagttttttaatcctgtgttctggtttgattgcactgtggtctgagagacagtttgtaataatttctgttcttttacatttgctgaggagtgctttacttccaactatgtggtcagttttggaataagtgcgatgtggtgctgagaagaatgtacattctgttgatttggggttgagagttctgtaaatgtctattaggtcctcttggtgcagagctgagttcaattcctggatatccttgttaactttctgtgtcatggatctgtctaatattgacagtggggtgttaaagtctcccattattatggtgtgggagtctaagtctctttaggtgtctaagggcttgctttatgaatctgggtgctcctgtattgggtgcatatattaggatagttagcttttcctgttgaattgatccctttaacattatataatggccttctttgtctcttttgatctttgttgatttaaagtcttgtttatcagagactagaattgcaacccctgctttttttttgttttccatttgcttggtagatcttccttcatcccattattttgagcctatgtgtgtctctgcatgtgagatgggtctcctgaatacagcacactggtgggtcttgactctttatccaatttgctagtctgtgtcttttaattggagcatttagcccatttacatttaaggttaatattgttatgtgtgaatttgatcctgtcattatgatgttagctggttattttgctcgttagttgatgcagtttcttcctagccttgatggtctttacaatttggcatgattttgcagcggctggtactggttgttcctttccatgtttagtgcttccttcaggagctcttttagggcaggcctggtggtgacaaaaatctctcagcatttgcttgtctgtaaagtattttatttctccttcacttatgaagcttagtttggctggatatgaaattctgggttgaacattcttttccttaagaatgttgaatattggcccccactctcttctggcttgtagagtttctgctgagtgatctgctgttattctgatgggcttccctttgtaggtaacctgacctttctctctggccgcccttaatgtttttttccttcatttcaactttggtgaatctgacaattacgtgtcttggagttgcacttctc

SEQ ID NO: 12053 - DNA, 1642 bp, Homo sapiens
ctggtatgttgtgtctttgttctcgttggtttcaaagaacatctttatttctgccttcatttcgttatgtacccagtagtcattcaggagcagggttgttcagtttccatgtagttgagcagttttgagtgagtttcttaatcctgagttctagtttgattgcactgtggtctgagagacagtttgttataatttctgttcttttacatttgctgaggagtgctttacgtccaactatgtggtcaattttggaataggtgtggtgtggtactgaaaagaatgtatattctgttgatttggggtggagattcctgtagatgtctattaggtccgcttggtgcagagctgagttcaattcctgggtatccttgttaactttctgtctcgttgatctgtctaatgttgacagtggggtgttaaagtctcccatcattattgtgtgggagtctaagtctctttgtaggtctctaaggacttgctttatgaatgtgggtgctcctgtattgggtgcatatatatttaggatagttagctcttcttgttgaattgatccctttaccattatgtaatggccttctttgtcccttttgatctttgttggtttaaagtctgttttatccgagactaggattgcaacacctgcctttttctgttttccatttgcttggtagatcttcctccatccctttattttgagcctatatgtgtgtctgcacgtgagatgggtttcctgaatacagcacactgatgggtcttgactctttatccaatttgccagtctgtgtcttttaattggagcatttagcccatttacatttaaagttaatattgttatgtgtgaatttgatcctgtcattatgatgttagctggttattttgctcgttagttgatgcagtttcttcctagcctcgatggtctttacaatttggcatgattttgcagtggctggtaccggttgttcctttccatgtttagtgcttccttcaggagctcttttagggcaggcctggtggtgacaaaatctctcagcatttgcttgtgtgtaaagtattttatttctccttcacttatgacgcttagtttggctggatatgaaattctggattgaaaattcttttctttaagaatgttgaatattggcccccactctcttctggcttgtagagtttctgccgagagatccgttgttagtcttatgggcttccctttgtgggtaacctgacctttctctctggctgcccttaacattttttccttcatttcaagtttggtgaatctgacaattatgtgtcttggagttgctcttctcaaggagtatctttgtggcggttctctgtatttcctgaatttgaatgttggcctgccttgctagattggggaagttcttctggataatatcttgcagagtgttttcctatttggttccattctccccgtcagtttcaggtacaccaatcagacgtaaatttggtcttttcacatagtcccatatttcttggaggctttgttcgtttctttttattcttttttctctatacttctcttcccacttcatttcattcatttccttttccattgctgataccctttcttccagttgatcacatcggctactgaggcttgtgcatttgtcacgtagtt

SEQ ID NO: 12054 - DNA, 3778 bp, Homo sapiens
ccttgtgatagtttactgagaatgatgatttccagcttcatccatgtccctacaaaggacatgaactcatcattttttatggctgcatagtattccatcggtgtatatgtgccacattttcttaatccagtctatcattgttagacatttcgggttggttccaaatagcaaaagacaatagtctttgctattgtgaatagtgctgcaataaacatacgtgtgcatgtgtctttatagtagcatgatttataatcctttgggtatatacccagtaatgggatggctgggtcaaatggtatttctagttctagatccctgaggaatcgccacactgacttccacaatggttaaactagtttacagtcccaccaacagtgtaaaagtgttcctatttctccacatcctctccagcacctgttgtttcctgactttttaatgatggccattctaactggtgtgagatggtatctcattgtggttttgatttgtatttctctgatggccagtgatgatgagcattttttcatgtattttttggctgcataaatgtcttcttttgagaagtgtctgttcatatcctttgcccactttttgatggggttgtttgtttttttcttgtgaattgtttgagttcattgtagattctggatattagccctttgtcagatgagtaggttgcgaaaattttctcccattttgcaggttgcctgttcactctgatggtagtttcttttgctgtgcagaagctctttagtttaattagatcccatttgtcaattttgtcttttgttgccattgcttttggtgttttagacatgaagtccttgcccatgcctatgtcctggatagtattgcctaggttttcttctaggatttttatggttttaggtctaacatgttaagtctttaatccatcttgaattaatttttgtataaggtgtaaggaagggatccggtttcagctttctacaaatggctagccagttttcccagcaccatttattaaatagggaatcctttccccattgcttgtttttctcaggtttgtcaaagatcagatagttgtagatatgaggcgttatttctgagggctctgttctgttccattgatctatatctctgttttggtaccagtaccatgctgttttggttactgtagccttgtagtatagtttgaagtcaggtagcgtgatgcctccagctttgttcttttggcttaggattgccttggcgatgcgggctcttttttggttccatatgaactttaaagtagttttttccaattctgtgaagaaagtcattggtagcttgatggggatggcattgaatctataaattactttaggcagtatggccattttcacgatattgattcttcctacccatgagcatggaatgttcttccatttgtttatatcctcttttatttcactgagcagtggtttgtagttctccttgaagaggtacttcacgtcccttgtaagttggattcctaggtattttattctctttgaagcaattgtgaatgggagttcactcatgatttggctctctgtttgtctgttattggtgtataagaatgcttgtgattttggtacattgattttgtatcctgagacttcgctgaagttgcttatcagcttaaggagattttgagctgagacaatggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgccagttttcaagggaatgcttccagtttttgcccattcagtatgatattggctgtgggtttgtcatagacagctcttattattttgagatatgtcccatcaatacctaatttattgagagtttttagcatgaagggttgttgaattttgtcaaaggccttttctgcatctattgagataatcatgtggtttttgtcattggttctgtttatgtgatggattgcgtttattgatttgtgtatgttgaaccagccttgcatcccagggatgaagccaacttgatcatggtggataagctttttgatgtgctgctggattcggtttgccagtattttattgaggatttttgcatcaatgttcatcaaggatattggtctaaaattctcttttttggttgtgtctctgccaggctttggtatcaggatgatgctggcctcataaaatgagttggggaggattccctctttttctattaattggaatagtttcaggaagaatggtaccatctcctccttgtacctctggtagaattcggctgtgaatccatctggtcctggactttttttggttggtaagctattgattattgccacaatttcagctcctgttattggtctattcagagattcaacttcttcctggtttagtcttgggagagtgtatgtgtcaaggaatttttccatttcttctagattttctagtttatttgcatagagatgtttgtagtattctccaatggtagtttgtatttctgtgggatcggtggtgatatcccctttatcattttttattgcatctatttgattcttctctcttttcttctttattagtcttcgtagcgctctatcaatttcgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttcttttgtggccatttagtgctataaatttccctctacacactgctttgaatgtgtcccagagattctggtatgttgtgtctttgttctcgttggtttcaaagaacatctttatatctgccttcatttcgttatgtacccagtagtcattcaggagcaggttgttcagtttccatgtagttgagcagttttgagtgagtttcttaatcctgagttctagtttgattgcactgtggtctgagagacagtttgttatcatttctgttctttcacatttgctgaggagtgctttccttccaactatgtggtcaattttggaataggtgtggtgtggtgctgaaaaaaaatgtatattctgttgatttggggtggagagttctgtagatgtcttttaggtccacttggtgcagagctgagttcaattcctgggtatcctttttaactttctgtatcattgatctgtctaatgttgacagtgggatgttaaagtctcccattattattgtgtgggagtctaagtctctttgtaggtcactaaggacttgctttatgaatctgggtgctcctgtattgggtgcatatatatttaggatagttagctcttcttgttgaattgatccctttaccattatgtagtggccttctttgtctcttttgatctttgttgatttaaagtctgttttatccgagactaggattgcaacccctgcctttttttgttttccatttgcttggtagatcttcctccatccctttattttgagcctatgtgtgtctctgcacgtgagatgggtttcctaaatacagcacactgatgggtcttgactctttatccaatttgccagtctgtgtcttttaattggagcatttagcccatttacatttaaagttattattgtta

SEQ ID NO: 12055 - DNA, 3693 bp, Homo sapiens
gtctaacatttaaatctttaatccatcttgaattaatttttgtataaggtgtaaggaagggatccagtttcagctttctacatatggctagccagttttcccagcaccatttattaaatagggaatcctttccccattgcttgtttttgtcaggtttgtcaaagatcagatagttgtagataacgtggcattatttctgagggctctgttctgttccattggtctagatctctgttttggtaccagtaccatgctgtttgggttactgttgccttgtagtatagtttgaagtcaggtagtgtgatgcctccagctttgttcttttggcttaggattgacttggcgatgcgggctcttttttggttccatatgaactttaaagtagttttctccaattctgtgaagaaagtcattggtagcttgatggggatggcattgaatctataaattaccttgggcagtatggccattttcacgatattgattgttcctacccatgagcatggaatgttcttccatttgtttgtatcctcttttattttcattgagcagtggtttgtagttctccttaaagaggtccttcacatcccttgtaagttggatcctaggtattttattctctgaagcaattgtgaatgggagttcactcatgatttggctctctgtttgtctgctaatggtataagaatgcttgtgatttttgcacattgattttgtatcctgagactttgctgaagttgcctatcagcttaaggagattttgggctgagacgatgggttttctagatatactatcacatcatctgcaaacaggaacaatttgatttcctcttttcctaactgaataccctttatttccttctcctgcctgattgccctggccagaacttccaacactatgttgaataggagtggtgagagagggcatccctatcatgtgccagttttcaaagggaatgcttccagtttttgcccattcagtatgatattggctgtgggtttgtcatagatagctcttattattttgagatatgtcccatcaatacctaatttattgagagtttttagcatgaagtgctgttgaattttgtcaaaggccttttctgcatctattgagataatcatgtggtttttgtcattggttctgtttatatactggattatgtttaatgatttgcatatgttgaaccagccttgcatcccagggatgaagcccacttgatcatggtggataagctttttgatgtgctgctggattcggtttgccagtattatattgaggatttttgcattgatgttcatcagggatcttggtctaaaattctctttttttgttgtgtctctgccaggctttggtatcaggatgatgctggcctcataaaatgagttagggaggattccctctttttctattgattggaatagtttcagaaggaatggtaccagctcctccttgtacctctggtagaattcagctgtgaatctgtctggtcccggactttttttggttggtaagctattaattattgcctcaatttcagagcctgttatcggtctattcagagattcaacttcttcctggtttagtcttgggagggtgtatgtgtcaaggaatttatccatttcttctagattttctagtttatttgcgtagaggtgtttatactattctctgatggtagtttgtatttctgtaggatcagtggtgatatcccctttatcattttttaattgcatctatttgattcttctctgttttcttctttattagtcttgctagtggtctatcaattttgttgatcttttcacaaaaccagctcctggattcattgattttttgaagggttttttgtgtctctatttccttcagttctgctctgatcttagttatttcttgccttctgctagcttttaaatgtgtttgctcttgcttctctagttcttttaattgtgatgttagggtgtcaattttagatctttcctgctttctcttgtgggcatttagtgctataaatttccctctacacactgctttgaatgtgtcccagagattctggtatgttgtgtctttgttctcattggtttcaaagaacatctttatttctgccttcatttcattatgtacccagtagtcactcaggagcaggttgttcagtttccgtgtagttgagtggttttgagtgagtttcttaatcctgagttctagtttgattgcactgtggtctgagagacagtttgttataatttctgttcttttacatttgctgaggagtgctttacttccaactatgtggtcaattttggaataggtgtggtgtggtgctgaaaagaatgtctattctgttgatttggggtggagagttctgtagatgtctattaggtctgcttggtgcagaactgaattcaatttctggatatccttgttaactttctgtctcgttgatctgtctaatgttgacagtggggtgttaaagtctcccattattattgtgtgggagtctaagtctctttgtaggtctctaaggacttgctttatgaatctgggtgctcctgtattgggtgcatatatatttaggatagttagctcttcttgttgcattgatccctttaccatcatgtaatggccttctttgtcacttttgatctttgttggtttaaagtctgttttatcagagactaggattgcaacccctgcctttttttgttttccatttgcttggtagatcttcctccatccctttattttgagcctatgtgtgtctctgcatgtgagatgggtttcctgaatacagcacactgatgggtcttgactctttatccaatttgccagtctgtgtcttttaattggagcatttagcccatttacatttaaggttaatattgttatgtgtgaatttgatcctgtcattatgatgttagctggttattttgctcgttagttgatgcactttcttcctagcctcgctggtctttacaatttggcatgtttttgcagtgggtggtaccagttgttcctttccatgtttagtgcttccttcaggagctcttttagggcaggcctggtggtgagaaaatctctcagcatttgcttatctataaagtattttatttctccttcacttatgaagcttagtttcactggataagaaattctgggttgaaaattcttttctttaagaatgttgaatattggcccccactctcttctgccttctagagtttctgccgagagatccattgttagtctgataggcttccctttatgggtaacccgacctttctctctggctgcccttaacattttttcctgcatttcaactttggtgaatctgacaattctgtgtcttggagttgctcttcttgaggagtatctttgtggcgttctctgtatttcctgaatctgaatgttggcctgccttgctagattagggaagttctcctggataatatcctgcagagtgttttccaacttggtcccattctccctgtcactttcaggtacaccaatcagacatagatttggtcttttcacaaagtcccatatttcttggaggctttgttcatttctttttattcttttttctctaaacttctcttctcacttcatttcattcgtttgatcttccatcactgataccctttcttccagttgatcgaattggctactgaggcttgtgcattcgtcacgtagtt

SEQ ID NO: 12056 - DNA, 3694 bp, Homo sapiens
gtctaacattcaagtctttaatccatcttgaattaatttttgtataaggtgtaaggaagggatccagtttcagctttctacatatggctagccagttttcccagtaccatttgttaaatagggaatcctttccccattgcttgtttttgtcaggtttgtcaaagatcagatagctgtagatatgtggcattgtttctgagggctctgttctgttctattgatctatatatctgttttggtaccagtaccatgctattttggttactgtagccttgtagtatagtttgaaggcaggtagcatgttgcctccagctttgttcttttgacttaggattgacttggcaatgtgggctcttttttggttccatatgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaacttggattcctaggtattttattctctttgaagcaattgtgaatgggagttcactcatgatttggctctctgtttgtctattattggtgtgtaagaatgcttgtgatttttgtacattgattttgtatcctgagactttgctgaagttgcttatcagcttaaggagattttgggctgagacaatggggttttctagatatacaatcatgtcatctgcaaacaaggacaatttgacttcctgttttcctaattgaataccccttatttccttctcctgcctgcttgccctggccagaacttccaacactatgttgaataggagtggtgagagagggcatccctgtcttgtgccagttttcaaagggaatgcttccagtttttgtccattcagtatgatattggctgtgggtttgtcatagatagctcttattattttgagatatgtcccatcaatacctaatttattgagagtttttagcatgaagggttgttgaattttgtcaaaggccttttctgcatctattgagataatcatgtaatttttgtctttggttctgtttatatgctggattgcatatattgatttgcgtatgttgaaccagccttgcatcccagggatgaagcccacttgatcatggtggataagctttttgatgtgttgctggattcagtttgccagtattttactgaggatttttgcatcaatgttcatcaaggatattggtctaaaattctctttttttgttgtgtctctgccaggctttggtatcaggatgatgctggcctcataaaatgagttagggaggattccctctttttctattgattggaatagtttcggaaggaatggtaccagctcctccttgtacctctggtagaattcggctgtgaatccatctggtcctggactttttttggttggtaagctattaattattgcctcaatgtcagagcctgttattggtctattcagagattcaacttcttcctggtttagacttgggagagtgtatgtgtcgaggaatttatccatttcttctagattttctagtttgtttgtgtagaggtatttatagtattatctgatggtagtttgtatttcagtgggatcgggtggtgatatcccctttgtaatttttttattgtgtcaattggattcttctctcgtttcttctttattagtcttgctagcagtctatcaattttgttgatcttttcaagaaaccagctcctggattcattaattttttgaagggttttttgtgtctctatttccttcagttctgctctgatcttagttatttcttgccttctgctagcttttgaatgtgtttgctcttgcttctctagttcttttaattgtgatgttagggtgtcaattttagaactctcctgctttctcttgtgggcatttagtgctataaatttccctctacacactgctttgaatgtgtcccagagattctggtatgttgtgtctttgttctcgttggtttcaaagaacatctttatttctgccttcatttcgttatgtacccagtagtcattcaggagcaggttgttcagtttccatgtagttgagcagttttcagtgagtttcttaatcctgagttctagtttgattgcactgtggtctgagagacagtttgttataatttctgttcttttacatttgctgaggtgtgctttacttccaactatgtggtaaattttggaataggtgtgatgtggtgttgaaaagaatgtatattctgttgatttggggtggagagttctgtagatgtcttttagatctgtttggtgcagagctgggttcaatttctggatatccttgttaactttctgtcttgttgatctgtctgatgttgacagtggggtgttaaagtctcccattattattgtgtggaagtctaagtctctttgtaggtcactaaggtcttgctttatgaatctgggtgctcctgtattgggtgcatatatatttaggatagttcttcttgttgaattgatccctttaccattatgtaatggccttctttgtctcttttgatctttgttggtttaaagtctgttttatccgagactaggattgcaacccctgcctttttttgttttccatttgcttggtagatcttcctccatccctttattttgagcctatgtgtgtctctgcatgtgagatgggtttcctgaatacagcacactgatgggtcttgactctttatccaatttgccagtctgtgtcttttaattggagcatttagcccatttacatttaaggttagtattgttatgtgtgaatttgatcctgtcattatgatgttagctggttattttgctcgttagttgatgcagtttcttcctagcctcgatggtctttacaatttggcatgattttgcagtggctggtaccggttgttcctttccatttttagtgcttccttcaggagctcttttagggcaggcctggtggtgacaaaatctctcagcatttacttgtctgtaaaggattttatttctccttcacttatgaagcttagtttggctggatatgaaattctgggttgaaaattcttttctttaagaatgttgaatattggcccccactctcttctggcttgtagggtttctgccaagagatcagctgttactctgatgggtttccctttgtgggtaacccgacctttctctctggctgcccttaacattttttccttgatttcaactttggtgaatctgacaattatgtgtgttggagttgctcttcttgaggagtatctttgtggtgttctctgtatttcctgaatttgaatgttggcctgccttgctagattggggaagttctcctggataatatcctgcagagtattttccaacttggttcaattctccacgtcactttcaggtacaccaatcagaggtagatttggtcttttcacatagtcccatatttcttggaggctttgttcgtttctttttattcttttttctctaaacttctcttcacacttcatttcattcatttcgtgttccattgctgataccctttcttccagttgatcgcatcggttactgaggcttgtgcgttcgtcacgtagtt

SEQ ID NO: 12057 - DNA, 3356 bp, Homo sapiens
gactgacttggcgatgtgggctctttttttggttccatatgaactttaaagtagtttttttccaattctgtgaagaaagtcattggtagcttgatggggatggcattggatctataaattaccttgggcagtatggccattttcatgatattgattcttcctacccatgagcatggaatgttcttccatttgtttgtatcctcttttatttcattgagcagtggtttgtagttctccttgaagaggtccttcacgtcccttgtaagttggattcctaggtattttattctctttgaagcaattgtgaatgggagttcactaatgatttggctctctgtttgtctgttattggtgtataagaatgtttgtgatttttgtacattgattttgtatcctgagactttgctgaagttgcttatcagcttaaggagattttgggctgagacaatggagttttctagatatacaatcatgtcatctgcaaacacggacaatttgacttcctcttttcctaattgaataccctttatttccttctcctgcctaattgccctggccagaacttccaacactatgttgaataggagtggtgagagagggcatccctgtcttgtgccagttttccaagggaatgcttccagtttttgcccattcagtatgatattggctgtgggtttgtcatagatagctcttattattttgagatacatcccatcaataccaaatttattgagagtttttagcatgaagggttgttgaatgttgtcaaaggccttttctgcatctattgagataatcatgtggtttttgtctttggctctgtttatatgatggattacataaattgatttgcgtatattgaaccagccttgcatcccagggatgaagcccacttgatcatggtggataagctttttgatgtgctgctggattcagtttgccagtattttattgaggatttttgcatcaatgttcatcaaggatattggtctaaaattctctttttggttgtgtctctccctggctttggtatcaggatgatgctggcctcataaaatgagttagggaggattccctctttttctattgattggagtagtttcagaaggaatggtaccagttcctccttgtacctctggtagaatttggctctgaatccatctggtcctggactctttttggttggtaagctattgattattgccacaatttcagagcctgttattggtctattcagagattcaacttcttcctgatttagtcttgggagggtgtatgtgtcgagaaatttatccatttcttctagattttctagtttatttgcgtagaggtgtttgtagtattctctgatggtagtttgtatttctgtgggattggtggtggcatcccctttatcatttttattgcacctatttgagtcttctctcttttcttctttattagtcttgctagcagtctatcaattttgttgatccttcaaaaaaccagctcctagattcatgaattttttgaagggttttttgtgtctctatttccttcagttctgctctgattttagttatttcttgccttctgctagcttttgaatgtgtttgctcttgcttttctagttattttaattgtgatgttagggtgtcaattttggatctttcctgctttctcttctgggcatttattgctataaatttccctctacacactgctttgaatgtgtcccagagattctggaatgttgtgtctttgttctctttggtttcaaagaacatctttatttctgccttcatttcgttttatgtacccagtagtcattcaggagcaggttgttcagtttccatgtagttgagcagttttgagtgagtttcttaatcctgagttctagtttgattgcactgtggtctgagagacagtttcttataatttctgttcttttacatttgctgaggagagctttacttccaactatgtggtcaattttggaataggcatgctgcagtgctgaaaaaaatgtatattctgttgatttggggtggagagttctgtagatgtctattaggtctgcatgatgcagagctgagttcaattcctgggtatccttgttaactttctgtcttgttgatatgtctaatgttgatagtggggtgttaaagtctcccattattattgtgtgggagtctaagtctctttgtaggtctctaaggacttgctttatgaatctgggtgctcctgtattgggtgcatatatatttaggatagttagctcttcttgttgaattgatccctgtaccattatgtaatgagccttctctggctcttttgatcttagttggtttaaagtctgttttatcagagactaggattgcaacccctgcctttttttgttttccattggcttggtagatcttcctccatccttttattttgagcctatgtgtgtctctgcatgtgagatgggtttcctgaatacagcacactgatgggtcttgactctttatccaatttgccagtctgtgtcttttaattggagcatttagcccatttgcatttaaagttaatattgttatgtgtgaatttgatcctgtcattatgatgttagctggttattttgctcgttagttgatgcagtttcttcctagccttgatggtctttacaatttggcatgattttgcagtggctggtactggttgttcctttccatgtttagtgcttccttcaggagctcttttagggcaggcctggtggtgacaaaatctctcagcatttgcttctctgtaaagtattttatttctccttcacttatgaagcttagtttggctggatattaaattctgggttgaaaattcttttctttaagaatgttgaatattggaaaggacatgcacaccaagaacccatctgtacatcaccatcatcaaagaccaaaagtagataaaaccacaaagatggggaaaaaacagagcagaaaaactggaaactctaaaaagcagagcacctctcctccttcaaaggaacgcagttcctcaccagtaacggaacaaagctggacagagaatgactttgatgagttgagagaagaaggcttcagatgatcaaactactacgagctacaggaggaaattcaaaccaaagacaaagaagttaaaaactttgaaaaaaatttagctgaatgtataactagaataaccaatacagagtacaagccactctcttctggcttgtagggtttctgccaagagatccgctgttagtctgatgggcttccctttgtgggtaacccgacctttctctctggctgcccttaacattatttccttcaactttggtgaatctgataattatgtgtcttggagttgctctt

SEQ ID NO: 12058 - DNA, 4556 bp, Homo sapiens
gtctaacatttaagtctttaatccatcttgaattgatttttgtataaggtgtaaggaagggatccagtttcagctttctacatatggctagccagttttcccagcaccatttatgaaatagggaatcctttccccattgcttgtttttctcaggtttgtcaaagatcagatagttgtagatatgcggcgttatttctgagggctctgttctgttccattgatctatatctctgttttggtatcagtaccatgctgttttggttactgtagccttgtagtatagtttgaagtcaggtagcgttatgcctccagctttgttcttttggcttaggattgccttggtgacgtgggctcttttttggttccatacgaactttaaagtagttttttccacttctctgaagaaagtcattggtagctttatggggatggcattgaatctgtaaattaccttgggcagtatggccattttcacgatattgattcttcctacccatgagcatggaatgttcttctgtttgtttgtatcctcttttatttccttgagcagtggtttgtagttctccttgaagaggtccttcacatcccttgtaagttggattcctaggtattttcttctctttgaagcaattgtgaatgggagttcactcatgatttggctctctgtttgtctgttattggtgtataagaatccttgtgatttttgtacattgattttgtatcctgagactttgctgaagttgcttatcagcttaaggagatttggggctgagacaatggggttttctatatatacaatcatgtcatctgctaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatactggctgtgggtttgtcatagatagctcttattattttgaaatacgtcccatcagtacctaatttcttgagagtttttagcatgaagggttgttgaatttttgtcaaaggctttttctgcatctattgagataatcatgtggtttttgtctttggctctgtttatatgctggattacatttattgatttgcgtatattgaaccagccttgcatcccagggatgaagcccacttgatcatggtggataagcttttggatgtgctgctggattcgttttgccagtatttgattgaggatttttgcatcaatgttcatcaaggatattggtctaaaattctcttttttggttgtgtctctgccaggctttggtgtcagaataatgctggcctcataaaatgagctagggaggactccctctttttctattgattggaatagtttcagaaggaatggtaccagttcctccttgtacctctgatagaattcggctgtgaatccatctggtcctggactctttttggttggtaaactattgattattgccacaatttcagctcctgttattggtctattcagagattcaacttcttcctggtttagtcttgagagagtgtatgtgtcgaggaatttatccatttcttctggattttctagtttatttgcgtagaggtgtttgtagtattctctgatggtagtttgtatttctgtgggattgctggtgatatcccctttatcattttttattgcatctatttgattcttctctctttttttctttattagtcttgctagcggtctatcagttttgttgatcctttcaaaaaaccagctcctggattcattgattttttgaagggttttttgtgtctctatttccttcagttctgctctgattttagttatttcttgccttctgctagcttttaaatgtgtttgctcttgcttttctagtttttttaattgtgatgttagggtgtcaattttggatctttcctgctttctcttgtgggcatttagtgctataaatttccctctacacactgctttgaatgcgtcccagagattctggtatgttgtgtccttgttctcgttggtttcaaagaacatctttatttctgccttcatttcgttatgtacccagtagtcattcaggagcaggttgttcagtttccatgtagttgagcggttttgagtgagattcttaatcctgagttctagtttgattgcactgtggtctgagagatagtttgttataatctctgttcttttacatttgctgaggagagctttacttcccagtatgtggtcaattttggaataggtgtggtgtggtgctgaaaaaaatgtatattctgttgatctggggtggagagttctgtagatatctattaggtccacttggtgcagagctgagttcaattcctgggtatccttgctgactttctgtctcgttgatctgtctaatgttgacagtggggtgttaaagtctcccattattaatgtgtgggagtctaagtctctttgtaggtcactgaggacttgctttatgaatctgggtgctcctgtattgggtgcatatatatttaggttagttagctcttcttgttgaattgatccctttaccattatgtaatggccttctttgtctcttttgatctttgttggtttaaagtctgttttatcagagactaggattgcaaccctgccttttttttgttttccatttgcttggtagatcttcctccatccctttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggtgattttgctcgttagttgatgcagtttcttcctagtctccatggtctttacattttggcatgattttgcagcggctggtaccagttgttcctttccatgtttagcgcttccttcaggagctcttttaaggcaggcctggtggtgacaaaatctctcagcatttgcttgtctgtaaagtattttatttctccttcgcttatgaagtttggtttggctggatatgaaattctgggttgaaaattcttttctttaagaatgttgaatattggcccccactctcttctggcttgtagggtttctgccgagagatccgctgttagtctgatgggcttccctttgagggtaacccgacctttctctctggctgcccttaacattttttccttcatttccactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccccatcactttcaggtataccaatcagacgtagatttggtcttttcacatagtcccatatttcttggaggctttgctcatttctttttattcttaaacttcccttctcgcttcatttcattcatttcatcttgcattgctgataccctttcttccagttgatcacatgggctcctgaggcttctgcattcttcacgtagttctcaagccttggttttcagctccatcagctcctttaagcacttctctgtattgattattctagttatacattcttctaaatttttttcaaagttttcaacttctttgcctctggtttgaatgtcctcccgtagctcagagtaatttgatcgtctgaagccttcttctctcagctcgtcaaagtcattctccgtccagttttgttccattgctggtgaggaactgcgttcctttggaggaggagaggtgctctgcgttttagagtttccagtttttctgctctgttttttccccatctttgtggttttatctacttttggtctttgatgatggtgatgtacagatgggtttttggtgtggatgtcctttctgtttgttagttttccttctaacacacaggaccctcagctgcaggtctgttggaataccctaccgtgtgaggtgtcagtgtgcccctgctgggggttgcctcccagttaggctgctctggggtcaggtgtcagggacccacttgaggaggcagtctgccccttctcagatctccagctgcgtgctgggagaaccactgctctcttcaaagctgtcagacagggacatttaagactgcagaggttactgctgtctttttgtttgtctgtgccctgcccccagaggtggagcctacagaggcaggcaggcctccttgagctgtggtgggctccacccagttcgagcttaagggctgctttgtttacctaagcaagcctgggcaatggcgggcgcccctcccccagcctcgctgccaccttgcagtttgatctcagactgctgtgctagcaatcagcgagactccgtgggcataggaccctccgagccaggtgcgggatat

SEQ ID NO: 12059 - DNA, 1671 bp, Homo sapiens
tacacactgctttgaatgtgtcccacagattctggtatgttgtgtctttgttctcgtttgtttcaaagaacgtctttatttctgccttcatttcgttatgtacccagtagtcattcaggagcaggttgttcagtttccatgtagttgagcgcctttgagtgagtttcttaatcctgagttctagtttgattgcattgtggtctgagagacagtttgttataatttctgttcttttacatttgctgaggagtgctttacatccaactatgtggtcaattttggaataggtgtggtgtggtgctgaaaaaaatgtctattctgttgattttgggtggagagttctgtagatgtctattaggtccacttggtgcagagctgagttcaattcctggatatccttgttaactttctgtctcgttgatctgtctaatgttgacagtggggtgttaaagtctcccattattattgtgtgggagtctaagtctctttgtaggtcactaaggacttgctttatgaatctgggtgctcctgtattgggtgcatatatatttaggatagttagtagttctccttgttgaattgatccctttaccgttatgtaatggccttcttttctcttttgaactgtgttggtttaaagtctgttttatccaagactaggattgcaacccctgccttttttgttttccatttgcctggtagatcttcctccatccctttattttgagcctatgtgtgtctctgcacgtgagatgggtttcctgaatacagcacactgatgggtcttgactctatatccaatttgccagtctgtgccttttaattggagcatttagcccatttacatttaaggttagtattgttatgtgtgaatttgatcctgtcattatgatgttagctggttattttgcttgttagttgatgcagtttcttcctagccttgatggtctttacaatttggcatgtttttgcagtggctggtaccagttgttcctttccatgtttagtgcttccttcaggagctcttttagggcaggcctggtggtgacaaaatctctcagcatttgcttgtctgtaaagtattttatttctccttcacttatgaagcttagtttggctggatatgaaattctgtattgaaaattcttttctttaagaatgttgaatattggcccccactctcttctggcttgtagagtttctgccaagagatcagctgttagtctgatgggcttccctttgtgggtaaccccacctttctctctggctgcccttaacattttttccttcatttcaactttggtgaatctgacaattatgtgtcttggagttgctcttctcgaggagtatctttgtggtgttctctgtatttcctgaatttgaatgttggcctgccttcctagattggagaacttctcctggataatatcctgcagaatgttttccaacttggttccagcctccccgtcactttcaggtacaccaatgagacgtagatttggtcttttcacatagtcccacatttcttggaggctttgtttgtttctttttattcttttttctctaaacttctcttcacgcttcatttcattcatttcgtcttccatcgctgataccctttcttccagttgattgcatcggttactgaggcttgtgcattcatcatgtagt

SEQ ID NO: 12060 - DNA, 1631 bp, Homo sapiens
tgcgtctatttgattcttctctcttttcttctttattagtcttgctagcagtctatcaattttgttgatcttttccaaaaaccagctcctggattcattgattttttgaagggttttttgtgtctctatttccttcagttctgctctgatcttagttatttcttgccttctgctagcttttgaatgtgtttactcttgcttctctagttcttttcattgtgatgttaggatgtcaactttagatctttcctggtttctcctgtgggcatttagtgatataaatttccctctacacactgctttgaacgtgcctcagagattctggtatgttgtgtctttgttctcattggtttcaaagaacatctttatttctgccttcatttcgttatgtacccagtagtcattcaggagcaggttgttcagtgtccatgtagttgagtggttttaagtgagtttcttaatcctgagttctagtttgattgcactgtggtctgagagatagtttgttataatttctgttcttttacatttgctgaggagtgctttacttccaaccatgtggtcaattttggaataggtgtggtgtggtgctgaaaagaatgtatattctgttgatttggggtggagagttctgtagatgtctgttagatccgcttggtccagagctgagttcaattcctgaatatccttgttaactttctgtctcgttgatctgtctaatgttgacagtggggtgttaaagtctcccattattattgtgtgggagtctaagtctctttgtaggtctctaaggacttgctttatgaatctgggtgctcctgtattgggtgcatatatatttaggatcgttagctcttcttgttgaattgatccctttaccattatgtaatggccttctttgtctcttttgatctttgttggtttaaagtcggtttcatcaaagaccaggattgcaacccctgcctttttttgttttccatttgcttggtagatcgtcctccatccctttattttcagcctatgtgtgtctctgcacgtgagatgggtttcctgaatacagcacactgatgggtcttgactctttatccaatttgccactctgtgtcttttaattggagcatttagcccatttacatttaaggttaatattgttatgtgtgaatttgatcctgtcattatgatgttagctggttattttgcttgttagttgatacagtttcttcctagcctcgatggtctttacaatttggcatgtttttgcagtggctggtaccagttgttcctttccatgtttagtgcttccttcaggagctcttatagggcaggcctggtggtgacaaaatctctcagcatttgcttgtctgtaaaggatcttatttctccttcacttatgaagcttagtttggctggatatgaaattctgggttgaaaattcttttctttaagaatgttgaatattggcccccaatctcttctggcttgtagagtttctgctgagagatcagctgttagtctgatgggcttcctttgtgggtcccctgactttctctctggctgcgcttaacattttttccttcgtttcaactttggtgaatctgacaattatgtgtcttagacttgctcttcttggg

SEQ ID NO: 12061 - DNA, 998 bp, Homo sapiens
aaatctctattaggtcttcttggtgcagagctgagttcaattcctgggtatccttgttaactttctgtctcgttgatctgtctaatgttgacagtggggtgttaaagtctcccattattattgtgtgggagtctaagtctccttgtaggtcactcaggacttgctttatgaatctgggtgctcctgtattgggtgcatatatatttaggatagttagctcttcttgttgaattgatccccttaccattatgtaatggccatctttgtatcttttgatctttgttggtttaaagtctgttttatcagagactaggattgcaacccctgcctttttttgttttacatttgcttggtagatcttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttgctcgttagttgatgcagtttcttcctagcctcgatggtctttacaatttggcatgattttgcagtggctggtacctgttgttcctttccatgtttagtgcttccttcaagagctcttttagggcaggcctggtggtgacaaaatctctcagcatttgcttgtctgtaaaggattttatttctccttcacttttgaagcttagtttggctggatatgaaattctgggttgaaaatatttttctttaagaatgttgaatattggcccccactctcttctggcttgtagagtttctgctgagagatccgctgttagtctgatgggcttccctttgtgggtaacccgacctttctctctggctgcccttaacattttttccttcatttcaactttggtgaatctgacaattatgtgtcttggagttgctcttctcgag

SEQ ID NO: 12062 - DNA, 3321 bp, Homo sapiens
gtctaacatttaagtctttaatccatcttgcattaatttttatataagatgtaaggaagggatccagtttcagctttctacatatggctagccagttttcccagcaccatttattaaatagggaatcctttccccatttcttgtttttgtcaggtatgtcaaagatcagatggttgtagatatgcggcattattcctgagggctctgttctgttccattggtctatatctctgttttggtaccagtaccatgctgttttggttactgtagccttgtagtatagtttgaagtcaggtagcgtgatgcctccagctttgttcttttggcttagtattgtcttatcaatgagggctcttctttggttccagatgaactttaaagtagttttttccaattctgtgaagaaagtcattggtagcttgatggggatggcattgaatctataaattaccttgggcagtatggccattttcacaatattgattcttcttatccatgagcatggaatgttcttccatttgtttgtgtcctcttttatttggttgagcagtggtttgtagttctccttgaagaggtccttcacatcccttgtaagttggattcctaggtattttatcctctttgaagcaattgtgaatgggagttcactcatgatttggctctctgtttgtctgttattggtgtataagaatgcttgtgatttttgtacattgattttgtatcctgagactttgctgaagttgtttatcagcttaaggagattttgggctgagacaatggggttttctaaatatacaatcatgtcgtctgcaaacagggacaatttgacttcctcttttcctaactgaatactctttatttctttctcctgcctgattgccctggccagaacttccaacactatgttgaataggagtggtgagagagggcatccctgtcttatgccagttttcaaagggaatgcttccagtttttgcccatccagtatgatattggctgtgtgtttgtcataaatagctcttattattttgagataggtcccatcaatacgtaatttattgagcgttttagcatgaaggttgttgaattttgtcaaaggccttttctgcatctattgagagaatcatgaggtttttgtcattggttctgtttatatgctggattatgtttattgatttgtgtatgttgaatcagccttgcatcccagggatgaggcccacttgatcatgatgtataagctttttgatgtgttgctggatttggtttgccagtattttattgaggatatttgcagcgatgttcatcacggttattggtctaaaattctctttttttgttgtgtctctgccaggcattggtatcagaatgatgctggcctcatgaaatgagttagggaggattccctctttttctgttgattggaatagtttcagaaggaatggtatcagctcctccttatacctctggaagaatttggctgtgaatctgtctggtcctggacttgttttggttggtaggctattaattattgcctcaattttagagcctgttattagtctattcagggattcaacttcttcctggtttagtcttgggaggatgtatgtgttgaggaatttatccatttcttctagattttctagtttattggcatagaggtgtttatagtattctctgatggtagtttgtatctctgtgggattggcggtgataccccctttatcatttttattgcatctatttgattcttctctcttttcttctttattagttttgctaccggtctgtcaattttgttgatcttttccaaaaaccagttcttggattcattgattttttgaaggatttttttgtgtctccatctccttcagttctgctctgatcttagttatttcttgccttctgctagcttttgaatgtgtttgctcttgcttctctggttgtttcaattgtgatgttagggtgtcaattttagatctttcctgctttcttttgtgggcatttagtgctgtaaatttccctctacacactgctttaaatgtgtcccagagattctggtattttgtgtctttgttctcattggtgtcaaagaacatctttattccttcatttctcaatgtacccagtagtcattcaggagcagattgttcagtttccatgcagttgagcggttttcagtgagtttcttaatcctgagttctagtttgattgcacttttacatttgctgaggagtactttacttcaaactatctggtcagttttggaataagtgcgatgtggtgctgagaacaatatattctattgatttggggtggagagttctgtagatgtctattaggtctgcttggtgcagagctgagttcaattcctggatatcctttttaactttctgtcttgttgatctgtctaatgttgacagtggtgtgttaaagtctcccattattattgtgtgggagtctaagtctctgtaagtctctaaggacttgctttatgaatctgggtgctcctgtattgggtgcatatatgtttaggatagttagctgttcttgttgaattgatccctttaccgttatgtaatggccttctttgtctcttttgatctttgttggtttaaagtctgttttatccgagactaggattgcaacccctgctttttttttattttccattgcttggcagatcttcctccatccctttattttgagcctatgtgtgtctctgcaggtgagatgggtttcctgaatacagcacactgatgagtcttgactctttatccaatttgccagtctgtgtcttttaattggagcatttagcccatttacatttatggttaatattgttatgtgtgaatttgatcctatcattatgatgttagctggttattttgctcgttagttgatgcagtttcttcctggcatcaatggtcttaaaaatttggcatatttttgcagtggctggtaccggttgttcctttccatgtttagtgcttccttcaggagctcttgtaaggcaggtctggtggtgacaaaatctctcagcatttgcttgtctgtaaaggattttatttctccctcacttatgaagcttagtttggctggttatgaaattctgggttgaaaattcttttctttcagaatgttgaatattggcccccacctcttctggcttgtagagtttctgccaagagatccgctgttagtctgatgggcttccctttgtgggtaacccgacctttctctctggctgcccttaatattttttccttcatttcaaatttggtgaatctgacaattatgtgtcttggatttggtcttctcgag

SEQ ID NO: 12063 - DNA, 2423 bp, Homo sapiens
ttcacgatattgattcttcctacccatgagcatggaatgttcttccacttgtttgtatcctcttttatttccttgagcagtggtttgtagttctccttgaagaggtccttcacatcccttgtaagttggattcctaggtattttattctctttgaagcaattgtggatgtgagttcactcatgatttggctctctgtttgtctgttgtttgtgtataagaatgcttgtgatttttgtacattgattttgtatcctgagcgtttgctgaagttgcttatcagcttaaggagattttcggctgagacaatggggttttctagatatacaatcatgtcgtctgcaaacagggacaatttgacttcctcttttcctaattgaataccctttatttccttctcctgcctaattgccctggccagaacttccaacactatgttgaacaggagtggtgagagagggcatccctgtcttgtgccagttttcaaagggaatgcttccagtttttgcccattcagtatgatattggctgtgggtttgtcatagatagctcgtattattttgaaatacatcccatcagtacctaatttattgagagtttttagcatgaagggttgttgaattttgtcaaaggccttttctgcatctattgagataatcatgtggtttttgtctttggctctgtttatatgctggattacatttattgatttgcgtatatcgaaccagccttgcatcccagggatgaagcccacttgatcatggtggataagctttttgatgtgctgctgtattcgttttgccagtattttattgaggatttttgcatcaatgttcatcaaggatattggtctaaaattctcttttttggttgtgtctctgcctggctttggtatcagaatgatgctggcctcataaaaagagttagggaggattccctctttttctattgattggaatagtttcagaaggaatggtaccagttcctccttgtacctctggtagaattcggctgtgaatccatctggtcctggactctttttggttggtaagctattgattattgccacaatttcggatcctgttattggtctattcagagattcaacttcttcctggtttagtcttgggagagtgtatgtgtggaggaatttatccatttcttctagattttctagtttatttgcgtagaggtgtttgtagtattctctgatggtagtttgtatttctgtgggatcagtggtgatatcccctctatcattttttattgcgtctatttgattcttctctctttttttctttattagtcttgctagtggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttctttcaatgttgatgttagggtgtcaattttggatctttcttgctttctcttgtgggcatttagtgctataagtttccctctacacacagctttgaatgcaccccagagattctggtatgttgtgtatttgttctcattggtttcaaagaacatctttatttctgccttcattttgttatgtacccagtagtcattcaggagcaggtttttcagtttccatgtagttgagcagttttgagtgagattcttaatcctgagttctagtttgatttcactgtggtctgagagacagttttttgtaatttctgttcttttacatttgctgaggaaagctttacttccaagtatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcgttgatctgtctaatattgacagtggggtgttaaagtctcccattattaatgtgtgggagtctaaatctctttgtaggttactcaggacttgctttatgaatcttggtgctcctgtattgggtgcatatatgtttaggatagttagctcttcttgttgaattgatccctttaccattatgtaatggccttctttgtctcttttgatctttgttggtttaaagtctgttttatcagagactagaattgcaacccctgccttttttttgttttccatttgcttggtagatcttcctccatctttttattttgagcctatgtgtgtctctgcacgtgagatgtgtttcctgaatacagcacactgatgggtcttgaccctttatccaatttgccagtctgtgtcttttaattggagcatttaatgcatttacatttaaagttaatattgttatgt

SEQ ID NO: 12064 - DNA, 2942 bp, Homo sapiens
gtttcagctttctacatatggctagccagttttcccagcaccatttgttaaacagggaatcctttccccatttcttgtttttgtcaggtttgtcaaagatcagatagttgtagatatgtggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggttcttttttggttccatatgaactttaaagtagttttttccaattctgtgaagaaagtcattggtagcttgatggggatggcattgaatctgtaaattaccttaaacagtatggccattttcacgatattgattcttcctacccatgagcatggaatgttcttccatttgtttgtatcctcttttatttccttgagcagtggtttgtagttctccttgaagaggtccttcacatcccttgtaaattggattcctatgtattttattctctttgaagcaattgtgaatgggagttcactcgtgatttggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctgattgccctggccagaacttccaacactatgttgaataggagtggtgagagagggcatccctgtcttgaaacagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcgtggtttttgtctttggctctgtttatatgctggaatacatttattgatttgcgtatattgaaccagcctcgcatcccagggatgaagcccacttgatcatggtggataagctttttgatgtgctgctggattcgttttgccaggattttattgaggatttttgcatcaatgttcatcaaggatattggtctaaaattctctttttttgttgtgtctctgcctggctttggtatcagaatgatgctggcctcataaaatgagttagggaggattccctctttttctattgattggaatagtttcagaaggaatggtaccagttcctccttgaacctctggtagaattcggctgtgaatccatctggtcctggactctttttgattggtaagctattgattattgccacaatttcagctcctgttattggtctattcagagattcaacttcttcctggtttagtcttggtagagtgtatgtgtccaggaatttatccatttcttctagattttctagtttatttgcatagaggtgtttgtagtattccctgatggtagtttgtatttctgtgggatcggtggtgatatctcctttatcattttttattgcgtctatttaattcttctctctttttttctttattagtcttgctagcggtctatcaattttgttgatcctttcaaaacaccagctcctggattcattaattttttgaagggttttttctgtctctatttccttcagttctgctctgatcttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcattccagagattctggtatgttgtgtctttgttctcgttggtttcaaagaacatctttatttctgccttcattttgttatgtacccagtagtcattcaggagcaggttgttcagtttccatgtagttgagtggttttgagtgagattcttaatcctgagttctagtttgattgcactgtggtctgagagatagtttgttataatttctgttcttttacatttgctgaggagagctttacttcccagtatgtggtcaattttggaataggtgtggtgtggtgctgaaaagaatgtatattctgttgatttggggtggagagttctgtagatgtctattaggtccgcttggtgcagagctgagttcaattcctgggtatccttgttgactttccgtctcgttgatctgtctaatgttgacagtggggtgttaaagtctcccattattaatgtgtgggagtctaagtctctttgtaggtcactcaggacttgctttatgaatcttggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacatgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttgcttgttagttgatgcagtttcttcctagtctcgatggtctttacattttggcatgattttgcagtggctggtaccg

SEQ ID NO: 12065 - DNA, 27386 bp, Homo sapiens
gtctaacgtttaaatctttaatccatcttgaattgatttttgtataaggtgtaaggaagggatccagtttcagcttcctacatatggctagccagttttcccagcaccatttattaaatagggaatcctttccccattgcttgtttttctcaggtttgtcaaagatcagatagttgtaggtatgcagcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggtgatgcgggctcttttttggttccatatgaacttgaaagtagttttttccaattctgtgaagaaagtcattggtagcttgatggggatggcattgaatctgtaaattaccttgggcagtatggccattttcatgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatagaatcatgtcatctgcaaacagggacaatttgacttcctcttttcctaattggataccctttatttccttctcttgcctaattgccctggccagaacttccaacactatgttgaataggagtggtgagagagggcatccctgtcttgtgcccgttttcaaagggaatgcttccagtttttgcccattcagtatgatattggctgtgggtttgtcatagatagctcttattattttgaaatacgtcccatcaatacctaatttcttagtaaaaaaaaataaatattccgagatataaactagaaacaagctatcagtgaaaatactttgcaatgtgtgggttcatctcacaggttaaacttttttttttttttttagcaggttggaaaccctctttttgtagaatctacaaagggacatttcggagcccattgagttgtatagtgaaaaactgaatatccttcaatagaaactagaaacaagctaacagtgaaaatgctttgtgatgtgtggattcacatcatagagttaaacctatgttttgattaaacaggttgaaaacacttatattgtagattctaagtagggacatttcgaaggccatttaggacaatagtgaaaaatcaattatcctgtgataaaaactagaaaaaaactatttgtggaaatgctttgtgatgtgtggattcgtctcacagagtgaaacctttattttgattcagcaggttggaaacatgtttttttgtagaatctaagaaaagatattctgaagcccactgaggcctatagtgaaaactcaaatatcccacaataaaaactacaaacaagctttctgtgaaaatgctttgtgatgtgtggattcatctcacagatttaaaccttttttttaattcagcagttgaaaacactctttttgtagaatctgtgaagggacatttcagggccaatggagaaaggtacggaaaaagcgaatctacttttatgaaaagcagaaataagctatctgtgaaaatgctttgggttgggtggatcatctcacaaagtgaaaccttgttttaattcagcaggctgaaaacactctttttatagattctacaaaaggacgttacggatctcattgaggcctacagtgaaaagttgaatatcatgtgatgaaaactagaaacaagctatttgtgaaaaggtcttgtgatgtgtagaattgtctcacagatttaaagctttgtttgtattcagcaggttggaaacattctttttgtagaacatacgaagagacgtttagaagcccatggatgagtatattgaaacacaaaatatcctgccataaaaagtacaaacaagctatctgtgaaaatgctttgcattctgtggattgatctcacagagttaaacatttgtttccattcagcaggttggaaacacttgttttgtagaatctactaagagccatttaaaccccattgaagactacaatgaaaggccgaatatcccatgatgaaaacaagaaacaagctatctgtgaaaatgcgttgggatatgtgcattcatttcatagagttaaacctttgctttaattcagcaggttggaaaaactctttgtagaatctacgaagaaacatttcaaagctcattgaagtctatagtgaaaaccaaaatatgtagagatagaaactagaaacaaactatctgtgaaaatgctttgggacgtctggattcatataacagagttaaaccttcgttttgattaagcaggttggaaacagtcagtttatagaatctatgagaagacattttggtgcccattgaggcctatagtgaaaaactgaatatcctgtgataaaaatgagaaataagctatctgtgaaaatgtttcgtgatgtgtggattcatctcactgagttaaacctttgttttgattcagcacattaaaaaccatcttttttttacaatctatgagggggcatatgggagcctattgaggcctatagtgaaaaaccaaatatcctgtgataaaaactacaaacaagctatctgtgaaaatacttcacaacgtgtggatacatctcacagatttaaacctttatttagattcagcaggttggaaacactttttttgtagaatctattaaggcacatttcagagtccatgaaagccattagtaaaaacaatatcccatgacaaaaattagaataaagctatctgtgaaaatgctttgcaatgtgtcgattcatctcacagagttaaacctttgttttgattcagccagttgaaaacactctttttgtagaatctaagaaggcacatttcagagaacattcaaacctacagttaaaaaccttatatctcaagataaaaactagaaacaagctatatatgagaatgctttatgatgtgtggattcaactcacagagttaaaccttgttttgattcagcaggttgaaaacactctgtttgtagaatctataaagaaacattttgaagcccatgaagaagtatatgaaaaaaacaaatatcctgtgatgaatactagaaacaatctatttgtgaaaattccctgtgatgtgtggattcatctcacagagttaaacctgtgtttttattcagcaggtttaaatcactgttttgtagaacctaagaagggatattttggagcccactgtggcctgtactaaaaaactgaatatcccacgataaaaactagaaccaagctatctgtgaaaatgctttatggtgtgtcatttcatgtcacagagttaaaactttgtttttattcagcaacttaaaagtactttttttgtagaatttaccaaagcacatttcagagcctattgaggtctacaatgaaaaactaaatatcccacgataaaaactagaaacatgctatcagtgaaaatgctttgcaatgtgtggattcatctcacagagttaaacatttgttttgatttagcaggtctgaacaactctatttgtagaatctacgatgagacatgtaaaagcccaatgaggcctctaatgaaaaacagagtattccgcgataaaacctaggaatgatttatctgtgaaaatactttgtgatgtgtggagtcatctcacagagttaaacctttgtttttatgcaataaattagaaactttttttgtagaaactatggagggacatttaggagcccatttagacctctactaaaaaagagaatatcccactataaaaactagaaacaagttatctgtgaaaatgtttgtgatgtgtggatttgtctcacagagtaaaacctatatttatatacagtaggttggaaacactcttttagtgggatctaaaagaaggcctttctaagctctttgtggattacagtaaaaattctttttttttactgtaatatataaatatatatatatatatatatatataaatataggggatagaatatcccctataaaaactagaaacaaacaatctctgaaaattctttgtgatgtgtcaatttatctcacagagttaaacctttgctttaattaagcactctttttgtagattctacgaagggacattctgaaacagcttgaagcctatagtcaaaaaccgattataccatgattaaaactagaaacaagctgtcagtcaaaatgcattgtgatgtgtagatttctctcacagagttatacctttttttaattcagccagctggaagcactattttcgtagaacctacgaagggacatttcagagctcataaagaagtatattgaaaaactgaatatctcgctatgaaaattaaaaacaagctatttgtgaaaatgttttgaaatgtgtggattaatctcacagaattaaacctttgttttgattaagcaggttaaaaacactctttttgtagaatctactaagaaacaattcatagcccattgaggcctctagtgaaaaactgaatattccataataaaaactagaaacaagctatctgttaaaaagctttgcaatatgtggactcttcttacagagttaaacatttgtttttattcagcaggttggaaacactctttttgtagaatctaagaaggcacatttcagagccaactgaggcctataataaaaaaccaaatatcctgggataaaaaatagaaataagctatatgagagaatgctttgtgatgtgtggattcatctcacagaattaaccctctgctttggttaagcagatttgaagcacctttttgtagaatctatgaagagacattttaaagcccattgaggcctatagtcaaaaaccaattatcccatgacagaaactagaaacaagctatcagtgaaagtatcacagagttaaacatttgttttgattaagcacattggaaacctgtgaaaatgctttgcaatgtgtagattcttcacacagagttaaacctttgttttgattcagtaggttggaaaaactctctttgtaaaatctacaaagaaacatttcagagcccactgaggcctatatttaaaaaacctgagtattccacaataaaaactagaaaaaacttatctttaaaagtgtcttgcaatgtgtgaaatgatctctcagaattaaacttttgctttgattcagcaggctggaaacattcattttgtagactctatgtagggatctttcagagcctaatgaggcctctaatgaaaagcagagtattcaggccaggcacggtggctcatgcctgcaatcccagtactttgggaggctgaggcaggtggatcatgaggtcgggagatcgagaccatcctggctaacatggtgaaaacccgtctctactaaaaatacaaaaaatttactgggtgtggtggtgggcacctgtagtcccagctactcgggaggctgagacaggagaatggcatgaacctgggaggtggagcttgcagtgagccaagattgcacgactgcacttcagccttgggggacagagcaagactctgactcaaaataaaaacaagaacaacaacaacaataacaaaaaagagtatccagcaataaaactagaaataatctatctgtgaaaatgctttgcaatgtgtggattcatctcacagagtaaaacctttgtttttacacagcaaattaaaagctttttcttgtggaatctacaaagggacatttaggagcccattgaggcctctcatgaaaaaccaaatatcatgtgataaaaactagaaacaagctatctgtgaaaatgtttgcaatgtatggatttatctcacagagttaaacctacagttttatacaacaggttggaaacactctttaaggagaatattttaaaaagacatttctgagctctttgtagactatagtaaaatccaaacatcccctataaaaactagaaagaaataatcggtgaaaatgccttgcaatgtgtggattcatctcacagagttaaaaaccttgttttgattcaggaggttggaaacactctctttgtggaatctatgaagggacattttgaagccctttgaggcctatagtgaaaaaccaaacaccctgtgataaaaattagatgcaagctatatatgaaaatgctttgtaatgtgtagatttatctcacagaattaaacctttgtgtttacacagaattttggaaacactctattaatagaatctaaaaggaaataattctgagcccattgaggcctatagcgaaaaaccgaatatcttgcgataaaaacttgaaacaagctgtctataaaaatactttgtgatatgtggactcacctcaaagagttaaacttttcttttgattaagcaggttagaaacattcttttgtagaatctacaaggggcatttctgaacccactgaggcctatagtgaaaaacagaatattacaggataaaatctagaaaaaacatatctgtgaaaatgctttgcaatatgtggcttcttctcacaatgtaaaacctttgttttgatttagcaagttggaaactctctttttgtacaatttgtgaggagacatttcgaagaccattgaggcatgtagtgaaaaactaaatatcccatgataaaaactagaaacaagctatctgtgaaaatgctttgtgatgtgtggatttagctcacagagttaaacctttgttttttataccacagttttcaaacactcttttagtagaaagtaaaggaagacatttctgatcccatcaaggcctatagtgaaaaaccgaatatccagcgataaaaactagaaacaagctatctgtgaaaatgctttgcaatgtgcagattcatctgacagggttaaatctttgttttgattcaacaggttagaaacagtttttgtacaatctacaaagggacattttggagcacattgacgcctacagtgtgaatccaaatattttgcgataaaaactaaaaataagctattctttgaaaatgctttgtgatgtgtacaatcatctcacagagttaaaccatatttacatacagcagtttagaaacactctttttgtagaatttaagaaggtacaattaagattccattgaagcttatagttaaaaaccaaatattcagcaataaaaactagaaacaagctatctgaaaaatgctttgcaatgtgtgatttgatatcacagagttaaacctttattttgattcagaaaaaaataaacttttttttctggaatctacgaagagacattttggagcccattgaggccaatagtgaaaaattgaatgtctcatgataaaagccagaaacaaactatctgtgaaaatgccttgcaacatgtggattcgtctcacagagttaaacctttgtttttattgagcaggttggaaacactctctttacggaatctgcaaatggacatttcagagcctattgaggcctacactgaaaaaccaaatatcctgcaataaaaactacaaataagctacctgtgaaaatgttttgtgaggtttggattcatctcacagatttaaccctttgttttgattcagcaggtaggaaactctttttctaagatctactctgagacatttctgagcccaatgaggcctatagtgaaaaactgaatatcccactttaaaaaccagaaacaagctatttgaaaatatgctttgcaatatgtggatttctctcacagagttatacctgtgttttgattctgtaggttgaaaaaattcttgttatagaatctatgaggggatatttcaaagtgcactgaggcctatagtgaaaaacagaatatgccatgatgaaaactagaaagaagctatttgtgaaaatgctttgtgatgtgtggatttatctcacagagttaagcctttgtttttattttgcaggttggaaatactcttgttgtagaatctatgaagggacatttcagagctcattgaggcctatagagaaaaatcaaatatcctgcgataaaaactgtaaagaagctacctctgaaaatactttgtgatgtgtgattttatctcagaagttgaacttttcatttgattctgcaggttggaaactctttttttgtagaatctacaaggagacatttcatagcccattgaggcctatagtgaaaaatcgaatatcccttgataaagactagaaacaacctatctgtaaaaatgctttgtgatgtgtagattcattttacaaatttaaacctttgttttgcttcatcaggttggaaactctttgaatctacaaagggacaattcagggcccattgaggcctttagtgaaaaaccaattaccctcagtaaaaactagatataagctatgggtgaaaatgctttgtgatgtgtggattcatctcacaagttaaacctttgttttgattcagcaggttggaaacactcttttaatagagtttatgagggaaaatttcagagcccattgaagcctcttaataaaaactgataagaaatagaaacaagctatctgtgaaaatgctttgtgatgtgtgggttcatctcacagagttaaacctttgttttgattcagcaggttgtaaagattctttttgtaaaatctatgaaggaacactgaaggcctacagagaaacatcgaatattctgcaataaaaactagaaacaagctatttgtgaaaaagctttgctataaatggatctttttcacagagttaaatatttgttattatacacaggttggaaacacatatttagtagaatctaagaggagtcttttttgagtccattaaggcctgtggtgaaaaactcaatatcccacaattaaaactagaaacaggctatctgtaaatatgctttgcaatatatgtttgcatctcacagagttaaattttgggttttattcagcaggctggagacacttattttttacagtctacttcgtgacagtctacttcgtgaggcctaaagtgaaaaaccgagtatcttgtgataaaactacaatcaatctgtgaaaatgctttgcaatgtgtggattcatctcaatgagttaaatgtttgttttgattcagcaggttagaaatactctcttcgtagaatctatgaaggaacatttcggagccctttgaggcttatagtgaaaagctgaatatcctgtgataaaaactagaaacaaactgtctgtgaaaatgctttgtgatgtgtggattcatctcacagagttaaacctttgcttttatagagcagtttggaaacaattttttagtacaatctaaggggacattattgagcccattcattcctatagtgaaaaacaaaatatcctgtcataaaaactaaaacaaactatctgtaaaaatgttttgcaatgtgtggattcatctcaaagagttaaacctctgttttgattcagcaggttggaaacactctttttgtagaatctgcaaagcaacatttcagaccccattcaggcctatagtgaaaaatcaaatatcccgcaataaaaactagaagcaagctatccatgaaaatgctttgtgatgtgtggatttatctcactgagttaaacgtttgttttgattcagcagcaaatgtcctgcaataaaaactacaaagaagctatgactaaaaatgctttgtgatgtgtgactttatctcacagagtttaacctttcttgtcattcagcaggttggaaacactctttttctacaatctacaaaggtacattttggagcaaattgagggttatactgaaaaatcgattatctcacaatacaaactaggaaaaagttatccgtgaaaatgcttcgcaatgtgtgaatccatctcacaaatttaaacctttgtgttcattcagcaggttaggaatactttttttgtagaatatacaaagggacatttgacacctttggaagcctatagtaaaaaagcaattatttctcaataaaaaatttgtctctgaaaatgctttgtgatatgtggattcttttcacagagtaaaacgtatgtttttatcccacaggttggaaacactgttgttgttgaatatgcgaagggacatttcagagctaattgaggcctatagtgaaaaaccgaatatcccatgataaaaactataaagaagctatctctgaaaatattttgtgatgtgtgattttcatctcacaagttgaacttttgtttttattcagcaggttagaaactccttttgtagaatctacgacgggacatttcatagcccattgaggcctacagtgaacaaacaaatatgccttgataaaaactagaaacaacttatctgtgaaaatgctttgcaatgtgtatattcatcttacaaatttaaacctttgttttgcttagccggttggaacctctttgtttgtagaatctacaagggaatattttgggactcattgaggcctatagtgaaaataacatatctcacggtaaaaactagaaaaaagctatgagtgaaaatgctttgcgatgtatgggtttatctcacaatattaaacctttgttttgattcagcaggttgaaaacactgttttcgtagaatctatgaagggacattttggagcctattgatgcctatggtgaaaaactgaataccccacaataaaaactataaacaacctatctgtgaaaatgctttgcaatatgtggattcatctcacagagttgaacctttgtcttgattcagcatgtttgaaatactgtttttgtagaatctacaagggataatttcagagcaaattgaggcctatagtataaaatctaatatcctgcaataaaaactagaaaaaatctatctgtaaaaatgctttgtgatatgtgggttcatctcacaaaggtaaatctttattttgattcagcaagttggaaacacttttctttgtagaatctacaaggggacatttcatagcccatggaggcctatagtgaaaaactgaatattccatgatagaaactaaagaagctatatgtgaaaatactttgcaatgtgtggtttcatctcacatagtttaaactttattttgattcagctaggttggaagcattctttttgtagaatatatgaagggacattttggagtccatggaggcctatagtgaaaaactgaatattccatgatagaaactaaagaagctatatgtgaaaatactttgcaatgtgtggtttcatctcacatagtttaaactttattttgattcagctaggttggaagcattctttttgtagaatatatgaagggacattttggagtccattgaggcctatagtgaaaaaccaaatatcccatcattaaaaactagaactaagctatctgtgaaatagctttgcaatgtgtggattcatgtcacagagctaaacttttgtttctatacagcatattggaaacacactattagtagaatctaagatgggacaattcagagccttttgaagcttatagtaaaaaattcaaaatgtggcaaaatttacatacaaactatctgtaaaaatgctttgtgatgcgaagattcatctcacagtgttaaacatttgttttgattcagcatgttggaaaaaattttttgtagaatctacaaagggacttttcggagcccattgagaccaatattgaaaaaatgaatatccagctataaaaactagaaacaagctctcggtgaaaatgctttgcaatgtgtggattcatctctcagagttaaacttttattttgattcacccagttggagacacttaattggtagaatctattaggggacatttcatagcccattgaggcatgtggtgaaaaactgaatatcccgcaataaaaacctgaaacaagcgacctgtgaaaatgctttgtgatgtgtggattcatctcacagagttaaacctttgtgttgattcagtagggttggaaagactttttttagaaactacaaaggaacattttgtagcccattgaggcctatagtgaaaaaccgaatatccggtgataaaaactagaaacaagctatttgtgaaaatgctttgcattgtatagatttatctctaatagtcaaacctttgtttttatactgcagttttgaaacgttattttagtagaacgtaaaggaagacatttctgatccctttgaggcctatagtgaaaaaccgaatatcccacaataaaaactagaaacaagctgtgaaaacgctttgggatgtgtagattcatctgacactgtgaaaatgctttgtgatgtgtagattcgtctcacagagttaaactttgattatatacagcaggttggaaacatttattttgtagcatttaagaaggtacaattaagagtccattgaagcctacagtgaaaaacccaatatccagtgataaaaactagaaacaagctgtgaaaattctttgcaacatgtggattcatctcacagagttaaacctttgttttgattcagtaggttggaagcaactctttttttgaatctacagattgacattaaagagcccattgaggcccatactgaaaaactgaatatcctgtgataaaaactagaaacaagctgtctgtgaaaatgctttgcaaggtttagattcaactcacagagttaaacctttgttttgattcagcaggagggaaacaattttgtaaaatctactatgagacatttcagagcaaattgaggctgatagtaaaagtccaaatatccctcgatataaacctgaaacaagcaatctgtgaaaataatttttgatgtgtagattcctctcaaaaagttatacctttgttttgaatcagcaggttgaaaacactttttttgtgtgtaatctatgaagggacaagctatctgacaaggatttcagagcccattgaggcgtatagtgaaaaacaaaaaattccaaactatctgtgaaaatgctttgcaatatgtggattcatctcacaaagataaaagtttgttttgattcagcaggttggcaacactgtttttgtagaatctataagaggacatatttacaagaggtccactgatgcctatggtgaaaaactgaatatcccactttaaaaactagaaacaagctatctgaaaatatgctttgtgatgtgtgcattcctttcacatagttatacctttgttttgattcagaagtttgaaaacactcttgttatagaattttcgaagggacatttcagagtgcaatgaggcctgtagtgaaaaaccaaatatctcacaataaaaactagaaacaagatatttgtgaaaatgctttgccatgtgtgaatttatctctcatatttaaacctttattttgattcagcctgttggaaacactctttttatagaatctaaaaaagaatatttcaaagccgctagatggctatactgaacaaccgaatactccacgataaaaactagaaacaggctatctttgaaaatgctttgtgatgtgtggattcatctcacagagttaaagctttcttgtgattcagcaggttggaagtactctttttgtagaatctacaaggggaagttttggagcaaattgaggcctacattatacaatcgaatattctgtgataaaaacgaaaaaaaaaatctagctgtaaaaatgccttgtgatgtgtggttttacctcacaaagttaaatatttttttttttgattcaacaagttggaaacaccttttctgtagacctacgaggggatatttcatagctcatggaagcatatagtgaaaaactgaatatcccgtgatggaaactaaggaagttatatgtgaaaatgctttgcaatgtgtggttgtatctcacagagtttaactttcttttgattcagctaggttagaaacactctttatgtagaatgtacaaagggacatttcagagccgattgaggcccatttcaaaaaaccatatatcctgtgacaaaaacaagaagcaagctatctgtgaaatagctttccaatgtggggatatttcagagacctttgagaccaatattgaaaaaatgaatatcctgcaatgaaaactagaaacaacctcttgaagcccattgaagcctatagcaaaaaactgaatatcccatgataaaaaatagaaacaagctatttgtgaaaatgctttgtgatgtgtgagttcatctcacagagttaaaccattgttttgattcagctggtagaagacacttaactggtactactagaggacattttgtagcccactgaggcctgtggtgaaaatccaaatatcccatgataaaactagaaacaagctatctgtgaaaatgctttgtgatatgtgggttcatctcacagagttaaaccttgttttgattcaccaggttggaaagactctttttgtagaatatatgaagaaacatttcacagcccattgaggcctataatgaaaaactgaatatccggtgatacaaactagaaacaagctatttgtgaaaaagctttgtgatgtgtggatttctttcacagggttaaatatttgttattatacatcaagttggaaacacatatttaatagaatctaagaggagtctttttgagcctattaaaatctgtagtgaaaaaccaaatatcccatgattaaaactagaaacaggctctctgtaaatatgtttgtgatatatggatgcatctcacatagttaaattttggtttttattcagaaggttggagacacttatttttttcaatctacttggtgacaatacagttctcattaatgccaatagtgaaaattcaaatatcctgtgataaaattacaaacaatctgtgaaaatgttttgcaatgtgtggatttatctcaatgagttaaatgtttgttttgattcagcagtttggaaacactctgtgcgatgtgtggattcatctcacacagttaaacatttgttgccattcagcaggatggaaacaatctttttgtagaatctacaagggtcattttgacacccgttaaggcttatagtgaaaacctggatatcctgagataaaaactagaaagaagctatgtgtgaaaatgctttgcaatgtgtaaattcacctcatagagttaaaccttcattttaattcagaaggttggaaacactttttttgtagaaaggacattttggagccttttgaagcctatggtgaaaccagaatatcccacaataaatattagaagcaaggtatctgtgaaaatgctttgtgacatgtggattcatcttacagaattaaacctttctcctgattctgcaggttggaaattctccttttgtagaatctacaaagaaatattttggagcccattgaggctcaaatatcctgcaataaacactagaaactagctatctgtgaaaatgattggcgatgtgtggattaatttcacaaaattaaaactttgttttgattcagcacttttgaaccactttttttgtagcatctacgaaggaacacttcagagtcctttgacagaaagggttatagagggttatagagaaaaacggaatattccatgataaaaactagaagcaagttctctgtgaaaattctttgcaatgtgtaaattcatctcacagagttaaacctttgcattgattcagcaagttggaaacactctcttgtacaatctatgaggggatatttgggagcccgttgaggcctatagtaaaaatttgagtgtcccataagaaaaactaggaagaatttatgtctgaagatgctctgtaatgtgtgatttcatctcacagctttaaacctttcttttgattctgtaggttggaatcactatttttcttagaatctatgaaaagacattttggagcaaaatgaggactataatgaaaaattgaatatcccacaataaaaattagaaacaagctgtctgtgaaaatgcttggcaatgtgtggattcatctcacacatctcacagagttaaacctttgttttgattcagcaggccaaaattactcttttggtaaaatctacgaaggaacattttggagcccattgatgcctgaggtaaaaaactgaaaactgaatatcttgtgataaaaactagaaacaagctttctgtgaaaatgctttacaatgcatcattttatgtcacagagttaaatctttgttttgattcagctggttaaaaacactcttgtagaaactatgagaggacatttcagaacatgttgaagtctatagtgaataacaaaatatcccgcaataaaaactagaagcaagctatctatgaaaatgctttgtgatgtgtgcatttatcttgcagatctaaacattgttttgattcatcaggtgagaaacacccttttgatgcaatgtacaaacggacgtttcagagcccactgagccccatagtcataaaaccaaatatcctgctataaaactggaaacgagctatctgtgaaaatgttttgtgatgtgtggattcatctcatatagttaaccctttattttgattcagcaggatgaaaacactctttgtgtaaaacctacaaaagggaggttggaaacactcttattgtgaaatttacgaagggacattttggagcccactgaagcctatgtgaaaaaccaaatatctcaccattaaaactagctaaacaaactacccatgaaaatgcttggccatatgtggaataattttacagagttaaatctttgtttttattcagcaagttggaaatgctctcttgtacaatctacgaggggacattttggagcccattgaggcctatagtaaaaaatcaagtgtcccgtaataaaaactacaaagaatctatgtctgaaaatgttctgtaatgtatgattttatctcacagagttaaactgttgttttgtttcagcaggttggaaactctcttttggtagaatcttcaaagagacatttgagagcccattgaggcttggagtgaaaaaccaaatatccagcaataaaaactagaaacaagcaatctgcaaaaatgctttgtgatgtgttcatttattttgcagagttaaaacttcattttgattcaacaggttaaaaacactcttgtagaatataggaagtgacatttctaagcccattgaggcctatactgaaaaactgaatatctcacaacaaaaactagaaaaaaatctatctgtgaaaatactttgcaatgtgaggatttatctcacagaggtaagcctttgtattaatacagcaggctggaaacactctttttgtaaaatctacaaagggacatttcatagaccattgaggcctacagtgaaagatcaaatattttgtgattaaaactagaaaaaagctatctgttaaaatgctttgcaatgtttggattcattttacagagttaagcctttgtttggattcagcaggttgaaaacactctttttgtagaatcaacatagggacatttcagagcacattgaggcctacggtgaaaaacccaacatcccatgataaaaactagattcaagctatctgtaaacatgctatgcaatgtctggattagcccaaaaaagttaaacctttaatttgattcagcaagtaggaaacactgttcttgtagaatctaagaagggacacttcagagcccatttaggcctagagtgaaaacccacttatcctgcgataaaaactagaaacaagctatctgtgaaaatcttttctgatgtgggcattcatctcaaagagttaaacctttcttttgattcagcaggttggaaacactcttttagtagaatctacagagggacagtttggaacctatttagacccatagtcaaaaaagcaaatatcccacaataaaaactagtaacaagctatctgtgaaaatgctttgcaatgtggggattcatctcacagagtcaaacctttgtttggattcagcaggatgaaaacacactttttgtaaatctacaaagaggactttggaaaaactctttttatgaatctacaaagggacattttggagcccattcaggtctacagtagaaaaccaaatattccaggataaaaactaaaaacaagctatctgtgaaaatgcttcttgatgtgtgcattcaccaaatataggtaaactttttttttgattcagcaggttggaaaccctctttttatagaatctacaaaggggcatttcgaagcccattgaggcctatagtgaaaaattgaacattcaacaataaaaactagtaacaagctatatttgaaattgctttgtgatgtgtgggttcatctcactgttacatcatcattttgatttagcaggttggaaatgctcttttgtagaatctatgaaggaacatttggaatcgcattaaagcctatagagaaaaactgaatattctgcaataaaaactaggaacgaggtatctgtgaaaatgctcttcgatgtgtgcattcatctcacagagataaacatttcttttgagtcatcagattggaaactctttttgtagaatgtacaaaggaacatttcagagcccattggggcctatagagaaaaacctaatatctcatgataaaaactagaaacaaaatatctgtgaaaatgctttgcgatgtgtggattcatttcacaaagttaaatctttagttttattcagtaggttgaaaacattctttttgcagaagcaaaaaaaaaagggacgtttcaaagtccattggggcctacagtgaaaaacctaatacccagcgataaaaactagaaaaaagctatctgtgaaaatgctttgtgatgtgttcactcatttcacagagtttaacatttgctttgattcagcaggttggaaacactcttttgtagaatctacgaagaaacatttcatagcccatataggcctattctgaaaaaccaaatatactgtgataaaaactagaaactacctatctgcaaaaatttgttgcaatatatgaattcgtctcaaagggttaaacctccattttgattcgacacattgaaaatactcttttctagatcctatgaagtgacatttcagagcccattgaggcctatagtgaaaaatctaatatcccaccataaaaactagaaaacagctaattgagaaaatcctttgcaatgtgtgaattcatctcacagagttaaacctttattttgattcagcaagttggaaaccctcgttttctagaatctatgaagggacatttcaaagcccactgaggcctacagtgaaaaaccaaatatcccacaataaaaactagaaaaaactctttgagaaaatcctttgcgatgcggggattcatcccacagagttaaacttttgttttgattgatcaggttgaaaatgttctatcagtaaaatctatgaagggcaggttgaaaacactctttttgaagaatctacaaagggacattttggaacccattgaggcctgtagtgaaaaaatgaactttctgtggtaaagactagaagcaagtattgcgggatgtggccagcagcctgcaatgcaacagggctctctctttgttcccaggtggattggcaggtggagaaataatagacacacaaaagatagagaaagctggatccaggggggtcactgccttctggtcccatgatgccaacaatgcactggatataccagcacttattattaagtttagtgagggtggtgataggttagtgagggatttagggtcatttgattatgaggtgagatggtcacatggggatgaagtaattctttaacataacatctgtgtgcagaaatacagtatacagagataagaatttataatatagtgtgtgcatcagtaatttctaacagagccttaaaacagaaacacagtctttccataacctatgattagcaagatattaatcagcagtaacagttgcagcaaaagctggttacaaataatctgtagaaacaggaagtgaagctagacaacctgttagaccagaaattctcagaaggaagtatgccttaaccttaaagaggcctagaaaagccatggcaagaaaagggcgtttatagctctatcttatccatatggacaggtgccccccaagcgtctgtttataggctctccacaagggtcacattccattcccagagctatgaacatctgcttttctgggataggaatcttggtgatgtgaaacctccctgactgcacatccattcataggctctctgcaggaggaagcacatcatgcgttgttggctcattctggcagtccaacctggcattgtctttctacaatcctgcatgcaattttgcatttacaataatcaggagcatttcatcttttattccatagcaatagtttcagggggtctccctacaagcaagtatctgtgaaaatgcttcgtgatgtgtacagtcatctcacatatttaaaccttagttttaatttaacctttggaatcactcttactgtagaatctacaaagggatatgtcaaatcccatttattcctatggagaaaaattgaatatcccatgataaaaactagaaacaagctatctgtgaaactgctttgcgatgtatggattcatctcacagagttaaaactttgttttgattctgcagtttggaaacactctttttgtagaaactgcaaagggacatttcagagcccactgaggcctacagtggaaaacaaaatatcctatgataaaaactagaaacaagctatctgtgacaatgttttttgatttttgcattcatctcacagagttaaactttgttttgattcagcaatttggaaacactctttttctagaatctacaaagggacattttggagccaactgaggcctgtagtgaaaaaccaaaagtccagagacaaaaaggagacacaaattatctgtgaaaatgctttgcaatgtgcagattcatctcacagagttaaacctttgttttcaatcagcaggttgaaaatactctttttgtagaatctaagaagtcacatttgagagccaagtgaggcctatagtaaatgaacacatatcccatgataaaaagtagaaacaagatacatgtgaaaatgctttataatgtgtggattcatctcacagaatcaaccctttgctttgattaagcagatttgaagcactgttattgtggaatctacaaagccatattttgaagcccattgtagcctatagtcaaaaactgattattctgtgagaaaaactagaaacaagctatctgtaaaaatgctttgcaatgtgtggattcatctcacagagttgaacctttattttttattttattttattattattatattttaagttttagggtacatgtacacaatgttcaggttagttacatatgtatacatgtgccatgctggtatgctgcacccattaactcgtcatttagcattaggtatatctcctaatgctacccctcccccctccccccaccccacaacagtccccagagtgtgatattccccttcctgtgtccatgtgttctcattgttcagtacccacatatgagtgagaatatgcggtgtttggttttttgttcttgtgacagtttactgagaatgatgatttccaatttcagccatgtccctacaaaggacatgaactcatcattttttatggctacatagtattccatgatgtatatgtgctacattttcttaatccagtctatcattgttggatatttgggttggttccgagtctttgctattgtgaatagagccacaataaacatatgtgtgtgtgtgactttgtagcagcatgatttatagtccttcgggtatatacccagtaatgggatggctgggtcaaatggcatttgtagttctagatccctgaagaatcgccacactgacttccacaatggttgaactagtttacagtcccaccaacagtgtaaaagtgttcctatttctccacatcctctccagcacctgttgtttcctgactttttaatgatggccattctaactggtgtgagatggtatctcattgtggttttgatttgcatttctctgatggccagtgatggtgagcattttttcatgtgttttttggctgcataaatgtcttcttttgagaagtgtctgttcatgtccttcacccactttttgatggggttgtttgtttttttcttgtaaatttgtttgagttctttgtagattctggatatcagccctttgtcagatgagtaggttgcaaaaattttcttcccttctgtaggttgcctgttcactctgatggtggtttcttttgctgtgcagaagctctttagtttaattagatcccatttgtcaattttggcttttgttgccattgcttttggtgttttagacatgaagtccttgcccatgcctatgtcctgaatggtcatgcctaggttttcttctagggtttttatagttttacatctaacatttaagtctttaatccatcttgaattaatttttaaataaggtgtaaagaatggatccagtttcagctttctacatatggctaggcagttttcccagcaccattcattaaatatggaatcctttccccattgcttgtttttctcaggtttgtcaaagatcagatagttgtagatatgcggcataatttctgagggctctgttctgttccactgatctatatctccgttttggtaccagtaccatgctgtttttggttactgtagccttgtagtatagtttgaagtcaggtagcatgatgcctccagctttgttcttttggcttaggattgacatggcaatgtgggctcttttttggctccatatgaactttaaagtagttttttccaattatgtgaagaaagtcattggtagcttgatggggatggcattgaatctgtaaattactttgggcagtatggccattttcacgatattgattcttcctacccatgagcatggaatgttcttccatttctttgtatcctcttttatttccttgaggagtggtttgtagttctccttgaagaggtccttcacgtcccttgtaatttggattcctaggtatttcattctctttgaagcaattgtgaatgggagttcactcatgatttggctctctgtttgtctgttattggtgtataagaatgcttgtgatttttgtacattgattttgtatcctcagactttgctgaagttgcttatcagcttaaggagattttgggctgagacaatggggttttctagatatacaatcatgtcgtctgcacaaggggacaatttgacttcctcttttcctaattgaataccctttatttccttcccctgcctgattgccctggccagaatttccaacactatgttgaataggagtggtgagagagggcatccctgtcttgtgccagttttcaaagggaatgcttccagtttttgcccattcagtatgatattggccgtgggtttgtcatagatagctcttattgttttgagacacgttccatcaatacctaatttattgagagtttttagcatgaagggttgttgaattttgtcaaaggccttttctgcatctattgagataatcatgtggtttttgtctttggttctgtttatatgctggattacatttattgatttgcatatattgaaccagccttacatcccagggatgaagcccactcgatcatggtggataagctttttgatgtgctgctggattcggtttgccagtattttattgaggattttttcatcaatgttcatcaaggatattggtctaaattctcttttttggttgtgtctctgcctggctttggcatcaggatgatgctggcctcataaaatgagttagggaggattccctctttttctattgattggaatagtttcagaaggaatggtaccagttcctccttgtacctctggtagaattcggctgtgaaaccatctggtcctggactcttttggttggtaagctattgattattgccacaatttcagatcctgttattggtctattcagagattcaacttcttcctggtttagtcttgggagagtgtatgtgtcgaggaatttatccatttcttctagattttctagtttatttgcacagagatgtttgtagtattctctgatggtagtttgtatttctgtgggatcggtagtgatatcccctttatcatttttttgtgtctatttgattctgctctctttttgtcattagtcttgctagtggtctatcaattttgttgatcttttcaaaaaaccagttcctggattcattaattttttgaagggttttttgtgtctgtatttccttcagttatgctctgattttagttatttcttgccttctgctagcttttgaatgtgtttgttcttgcttttctagttcctttaattgtgatgttaggcttgtgtctttgttctcgttggtttcaaagaacatctttatttctgccttcatttcgttatgtacccagtagtcattcaggagcaggttgttcagtttcaatgtagttgagcggttttgagtcagtttcttaatcctgaattctagtttgattgcactgtggtctgagagacagtttgttagaatttctgttctttacatttgctgaggagagctttacttccaagtatgtggtcaattttggaataggtgtggtgtggtgctgaaaaaaatgtatattctgttgatttggggtggagagctctgtagatgtctattaggtctgcttggtgcagagctgagttcaattcctgggtatccttgttaactttctgtgtcattgatctgtctaatgttgacagtggggtgttaaattctcccattattattatgtgggagtcttaagtctctttgtaggtcactcaggacttgctttatgaatctgggtgctcctgtattgggttcatgtatatctaggatagttagctcttcttgttgaattgatccctttaccattatgtaatggccttctttgtctcttttgatctttgttggattaaagtctgttttatcagagactaggattgcaacccctgcctttttttgctttccatttgcttggtagatcttcctccatccttttattttgagcctatgtgtgtctctgcacgtgagatgggtttcctgaatacagcacactgatgggtcttgactctttatccaatttgccagtctgtgtcttttaattggagcatttagcccatttacatttaaagttaatattgttatgtgtgaatttgatcctgtcattaagatgttagctggttattttgctcgttagttgatgcagtttcttcctagccttgatggtctttacattttggcatgattttgcagtggctggtactggttgttcctttccatgtttagtgcttccttcaggagctcttttagggcaggcctggtggtgacaaagtctctcagcatttgcttgtctgtaaagtattttatttctcctttacttatgaagcttagtttggctggatatgaaattctgggttgaaaattcttttctttaagaatgttgaatattggcccccactctcttctggcttgtagagtttctgccgagagatctgctgttagtctgatgggcttccctttgtgggtaacccgacctttctctctggcttcccttaacattttttctttcatttcaaccttggtgaatctgacaattatgtgtcttggagttgctcttcttgaggagtatctttgtggcgttctctgtatttcctgaatctgaatgttggcctgccttgctagactggggaagttctcctggataatatcttgcagagtgttttccaacttggttccattctccctgtcactttcagtacaccaatcagacgtacatttggtcttttcacatagtcccatatttcttggaggctttgttcatttctttttattcttttttctctaaacttcccttctcacttcatttcattcatttcatcttccatcactgataccctttcttccagttgatcgcatcggctcctgaggcttctgcattcttcacgtagttcttgaaacttggctttcagctccatcagctcctttaagcacttctctgtattggttattctcgttatacattcatctaaatttttttcaaagtttttaacttctttgcctttggtttgaatttcctcctgtagctcggagtagtttgatcatctgaagccttcttctctcaactcgtcaaagtcattctccatccagctttgttccattgcaggtgaggaactgcgttcctttggaggaggagaggcgctctgctttttagagtttccagtttttctgctctgttttttccccatctttgtggttttatctacttttggtctttgatgatggtgatgtacagatgggtttttggtgtggatgtcccttctgtttgttagttttccttctaacagacaggaccctcagctgcaggtctgttggagtttgctagaggtccactccagaccctgtttgcctgggtatccacagcggtggctgcagaacagcggattttcgtgaaccgcgaatgctgctgtctgatcgttcctctgcaagttttgtctcagaggagtacctggctgtgtgaggtgtcagtctgcccctactggggggtgcctcccagttaggctgctcaggggtcaggggtcagggacccacttgaggaggcagtctgcccattctcagatctccaactgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcaagcttcccagctgctttgtttacctaagcaagcctgggcaatggcggatgcccctccccgagcctcgctgccaccttgcagtttgacctcagactgctgtgctagcaatcagcaagactccgtgggcgtaggaccctccgagccatgtgtgggatataatctcctggtgcatcgttttttaagcccgtcagaaaagcgcagtattcgggtgggagtgacccgattttccaggtgccgtctgtcacccctttctttgactaggaaagggaactctctgatcccttgtgcttcctgagtgaggcaatgcctcgctctgcctcgggtcatgcacggtgcactgcaccactgtcgtgcacccactgtctggcactccctagtgatatgaacctggta

SEQ ID NO: 12066 - DNA, 3643 bp, Homo sapiens
tttaagttctttgtagattctggatattagccctttgtcagatgagtagattgtaaaaattttctcccattctgtaggttgcctgttcactctgatggtagtttcttttgctgtgcagaagctctttagtttaattagatcccatttgtcaattttggcttttgttgccattgcttttggtattttagtcatgaagtccttgcccatgtctatggcctgaatggtattgcctaggttttcctctagggtttttatggttttaggcctaacatttaagtctttaatccatcttgaattaatttttgtataaggtgtaaggaagggatctactttcagctttctacatatggctagccagttttcccagtaccatttattaaatagggaatcctttccccatttcttgtttttgtcagatttgtcaaagatcagattgctgcagatgtgtggtattatttctgagggctctgctctgttccattggtctccatctctgttttggtaccagtaccatgctgttttggttactgttgccttgtagtatagtttgaagtcaggtggtgtgatgcctccagctttgttctttgggcttaggattgtcttggcaatgcaggctcttttttggttccatatgaactttaaagtagttttttccaattctgtgaagaaagtcattggtagctcgatggggaaggcattgaatctataaattaccttgggcactatggccattttcacgatattgattattcctacccatgagcatggaatgttcttccatttgtttgtgtcctcttttattttgttgaacagtggtttgtagttctccttgaagaggtccttcacatcccttgtaagttggattcctaggtattctattctctttgaagcaattgtgaatgggagttcactcatgatttggctctctgtttgtctgttattggtgtataggaatgcttgtgatttttggacattgattttgtatcctgagactttgctgaagttgcttatcagcttaaggagatttggggctgagatgatggggtattctaaatatacaatcatgtcatctgcagacagggaaaattggacttcctcttttcctaattgaataccctttatttctttctcctgcctgattgccctggccagaacttccaacactatgttgaataggagtggtgagagagggcatccctgtcttgtgccagtttttgcccattcagtatgatattggctgtgtgtttgtcataaatagctcttattattttgagatacatcccatcaatcctagtttattgagagtttttagcatgaagggctgttgaattttgtcgaaggccttttctgcatctattgagataatcatgtggtttttgtctttggttctgtttatatgatgaattaaatttattgatttgtatatgttgaaccagccttgcatcccagggttgaagcccacttgatcatggtggataagctttttgatgtgctgctggatttggtttgccagtattttattgaggatttttgcaatgatgttcatcagggatattggtctaaaattctctttttttgttacgtctctgcgaggctttggtgtcaggatgatgctggcctcataaaatgagttagggaggattccctctttttctattgattagaatagtttctgaaggaatggtaccagctcctctttgtacctctggtagaatttggctgtgaatccatctggtcctggactttttttggttggtaggctattaattattgcctcaattttagagcctgttattggtctattcagggatccaacttcttcctggttcagtcttgggagggtgtatgtgtccaggaatttatccatttcttctagattttctagtttatttgcatagaggtgtttatagtattctctgatggtagtttgtatttctgtgggatcagtggtgatatcccctttatcattttttattgcatctattggattcttctctcttttcttctttattagtcttgctagcggtctattttgttaatcttttcaaaaaaccagctcttggattctttgattttttgaagggttttttgtgtgtctatttccttcagttctgctctgatcttagttatttcttgccttctgctagcttttgaatgtgtttcttgttgcttttctagttttttttaattgtggtgttagggtatcaattttagatctttactgctttctcttgtgggcacttaatgctataaatttccctctccacactgctttaaatgtgtcccagagattctggtatgttgtatctttgttctcactggtttcaaggaacatctttatttctgccttcattttgttatgtacccagtagtcattcaggagcaggttgttcagtttccatgtagttgagcagttttgactgagtttcttaatcctgagttctagtttgattgcactatggtctgaaagacagtttgttataacttctgttcttttacatttgctgaggagtgcttcacttccaagtatgtggtcaattttgtaataagtgtgatgtggtgctgagaagaatgtatattctattgatttggggtggagagttctgtagatgtctattatgtctgcttggtgcagagctgagttcaattcctggatatctttattaactttcagtctcgttgacagaaagtttctgtcaattcctggatatccttgttaactttctgtctcgttgacagtgggttgttaaagtgtcccattattattgtgtgggagtctaagtctctttctaggtctctaaggacttgctttatgaatctgggtgctcctgtattgggtgcatatatatttaggttaattagctcttcttgttgaattgatccctttacattatgtaatggccttctctgtctcttttgatctttgttgatttaaaatctgttttttcagcgactaggattgcaacccctgcttttttttgttttccatttgcttggtagatcttcctccatccctttattttgagcctatgtgtatctctgcacatgagatgggtctcctgaatacagcacactaatgggtcttgactctttatccaatttgcccctctgtgtcttttaattggagcatttagcccatttacatttaaggttaatattgttatgtgtgaatttgatcatgtcattatgatgttagctggttattttgctcattagttgatgcagtttcttcctagcctcgatggtctttacaatttggcatgtttttgcagtggctgatactggttgttcctttccatgtttagtgcttccttcaggagctctttgtaaggcaaacctggtggtgtcaaaatctctcagcatttgtttgtctgtaaaggattttatttctccttcagttatgaagcttagtttggctggacatgaaattctgggttgaaaattcttttctttaagaatgttgaatattggcccccattctcttctgccttgtagagtttctgctgggagatctgctgttagtctgatgggcttccctttttgcataacccgacctttctctctggctgcccttcacattttttccttcatttcaactttggtgaatctgacaattacatgtcttggagttgctcttctcgag

SEQ ID NO: 12067 - DNA, 4121 bp, Homo sapiens
gtctaacgtttaagtctttaattcatcttgaattaatttttgtataaggtgtaaggaagggatccagtttcagctttctacatatggctagtcagttttcccagcaccatttattaaatagggaatcctttccccatttcttgtttctgtcaggtttgtcaaagatcagacagttgtagatatgcgacgttatttctgagggctctgttctgttccattggtctatatctctgttttggtacaagtaccatgctgttttggttactgtagccttgtagtatagtttgaagtcaggtagcctgatgcctccagctttgttcttttggcttaggattgacttggcaatgcgggctcttttttggttccatatgaactttaaagtagttttttccaattctgtgaaaaaagtcattggtagcttgatggggatggcattgaatctataaattaccttgggcagtatggccattttcacgatattgattcttcctaaccatgagcatggaatgttcttccatttgtttgtatccttttttatttcattgagcagtgttttgtagttcttcttgaagaggtccttcacatcccttgtaagttggatttctaggtattttattctctttgaagcaattttgaatgggagttccctcatgatttggctctctgtttgtctgctattggtgtataagaatgcttgtgatttttgcacatcaattttgtatcctgagcctttgctgaagttgcttatcagcttaaggagattttgggctgagacaatggggttttctagataatacaatcatgtcatctgcaaacagggacaatttgacttcctcttttcctaattgaataccctttatttccttctcctgcctaatggccctggccagaacttccaacactatgttgaataggagtggtgagagagggcatccctgtcttgtgcccgttttcaaagggaatgcttccagtttttgcccattcagtatgatattggctgtgtgtttgtcatagatagctcctattattttgagatatgtcccatcaatacctaatttattgagagtttttagcatgaagagttgttgaattttgtcaaaggccttttctgcatctattgagataatcatgtggtttttgtctttggttctgtttatatgctggattatatttattgatttgcatatattgaaccagccttgcatgccagggatgaagtccacttgatcatggtggataagtttttgatgtgctgctggatttggtttgccagtattttattgaggatttttgcattaatgttcatcaaggatattggtctaaaattctcttttttggttgtgtctctgcccagctttggtatcaggatgatgctgggctcataaaatgagttagggaggattccctctttttctattgattggaatagtttcagaaggaatggtaacaattcctccttgtacctctggtagaatttggctgtgaatccgtctggtcctggactctttttggttggtaagctattgattattgccacaatttcagagcctgttattggtctattcagagagtcaaattcttcctggtttagtcttggaaatgtgtatgtgtcgaggaatgtatccatttcttctagattttctagtttatttgcatagaggtgtttgtaatattctctgatggtagtttgtatttctgtgggatcagtggtgatatcccctttatcattttttattgcgtctatttgattcttctctcttttcttctttattagttttgctagcggtctatcaattttgttgatcctttcaaaaaaccagctcctggattcattaattttttgaagggttttttgtgtctctatttccttcagttctgctctgtttttaattagttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtcttagttctcgtggtttcaaagaacatctttatttctgcttcatttcgttacgtacccagtagtcattcaggagcaggttgttcagtttccatgtaactgagcggttttgagtgagtttcttaatcctgagttctagtttgattgcatggtcgtctgagagacagtttgttataatttctgttcttttccatttgctgaggagagctttacttccaagtatgtggtcaattttggaataggtgtggtgtggtgctgaaaaaaatgtatattctgttgatttggggtggagagttctgtagatgtctattaggtccacttggtacagagctgagttcaattcctgggtatccttattaactttctgtctcgttgatctgtttaatgttgacagtggggtgttaaagtctcccattattattgtgtgggagtctaagtctctttgtaggtcactcaggacttgctttatgaaactgggtgctcctgtattgtgtgcatatatatttaggatagttagctcttcttgttgaattgatccctttaccattatgtaatggccttctttgtctcttttgatctttgttggtttaaagtctgtttaatcagagactaggattgcaacctctgcctttttttgttttccatttgcttggtagatcttcctccatccctttatttcgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttgctcattagttgatgcagtttcttcctagccttgatggtctttacaatttggcatgattttgcagtggctggtaccagttgttcctttccatgtttagcgcttccttcagaagctcttttagggcaggcctggtggtgacaaaatctctcagcatttgcttgtctgtaaaggattttatttctccttcacttatgaagcttagtttggctggaaatgaaattctgagttgaaaattcttttctttaagaatgttgaatattggcccccactctcttctggcttgcagggtttttgccgagagatctgctgttagtctgatgggcttccctttgtgggtaacccgacctttctctctggctgcccttaacattttttccttcatttcaactttggtgaatctgacaattatgtgtcttggagttgcttttctcgaggagtatctttgtggcgttctctgtatttcctgaatctgaatgttggcctgccttgctagactggggaagttctcctggataatatcctgcagagtgttttccaacttggttccattctccccgtcactttcaggtacaccaatcagacgtagatttgatcttttcacatagtcccatatttcttggaggctttgttcatttctttgtattcttttttctctaaacttcccttctcacttcatttcattcatttcatcttccatcactgataccctttcttccagttgatcgcatcggctcctgaggcttctgcattcttcacgtagttctcgagccttggctttcagctctatcagctcctttaagcacttctctgtattggttattctagttatacattcgtctaaatttttttcaaagttttcaacttctttgcctttggtttgaatttcctcctgtagctcggagtagtttgatcgtctgaagacttcttctctcaactcatcaaagtcattctccatccagctttgttccgttgctggtgaggaactgcgttcctttggaggaggagagccactctgctttttagagtttccagtttttctgctctgtttttttccctgtctttgtggttttatctacttttggtctttgatgatggtgatgtacagatgggtttttggtgtggatgtcctttctgtttgttagttttccttctaacagacagcaccctcagctgcaggtctgttggagtt

SEQ ID NO: 12068 - DNA, 1607 bp, Homo sapiens
tattgtgtctctgccaggctttggtatcaggatgacgctggcctcataaaatgagttagggaggattccctctttttctattgattggaatagtttcagaaggaatggtaccagctcctccttgtacctctggtagaatttggctgtgaatccatctggtcctggatttttttttttggttggtaagctattaattattgcctcaatttcagagcctgttattgttctattcagagattcaacttcttcctggtttagtcttgggaggatgtatatgtcgaggaatttatccatttcttctagattttctagtttctttgcgtagaggtgtttatagtattctctgatggtagtttgtatttctgtgggataggtggtgatatcccctttatcatttttcattgtgtccttttgattcttctctcttttcttctttattatttgctagaagtctatcaattttgttgatgttttcaaaaaaccagctcctggattcattgattttttgaaggtttttttgtgtctctatttcctttggttatgctctgatcttagttatttattgccttctgccagcttttgaatgtgtttgcgcttgcttctctagttcttttaattgtgatgttagggtgtcaattttggatctttcctgctttcttttgtgggcatttagtgctataaatttgcctctacacactgctttgaatgtgtcccagagattctggtatgttgtgtctttgttcttgttggtttcaaagaacatctttctttctgccttcatttcgttatgtacccagtagtcattcaggagcaggttgttcagtttccacgtagttgagcgcttttgagtgagtttcttaatactgagttctagtttgattgcactgtggtctgagagacagtttgttataatttctgttcttttacatttgctgaggactgctttacttccaactatatggtcagttttggaataggtgtggtgtggtgctgaaaagaatgtatattctgttgatttggggtggagagttctgtagatgtttattaggtcctcttggtgcagagctgagttcaattcctgggtatccttgttgactttctgtctcattgatctgtctaatgttgacagtggggtgttaaagtctcccattattattctgtgggagtctaagtctctttgtaggtctctaagaacttgctttgtgaatctgggtggtcctgtattaggtgcatatatatttaggataggtagctcttcttgttgaattgatccctttaccattatatagtggccttctttgtctcttttgatctttgatttaaagtctgttttatcagagactgggattgcaacccctgcctttttttgttttccacttgcttggtagatcttcctccatccctttattttgagcctatgtgtgtctctgcaggtgagatgggtttcctgaatacagcgcactgatgggtcttgacactttatccaatttgccagtctgtgtcttttaattggagcatttagcccatttacatttaaggttaatattgttatgtgtgaatttgatcctgtcattatgatgctagctggttattttgctcgttagttg

SEQ ID NO: 12069 - DNA, 3515 bp, Homo sapiens
gtttcagctttctacatatggctagccagttttcccagcaccatttattaaatagggaatcctttccccatttcttgtttttgtcaggtttgccaaagatcagatggttgtagatgtgtagtattatttctgagggctctgttctattccattggtctatatatttgttttggtacaagtaccatgctgttttggtcactgtagccttgtagtatagtttgaagtcaggtagcatgatgcctccaggtttgttcttttggcttaggattgtcttggcaatgtgggctcttttttggttccacatgaactttaaagtagttttttccaattctctgaagaaagtaattggtagcttgatgggtatggcattgaatctataaattaccctgggcagtatggccattttcacgatattgatttttcctctccatgaacatggaatgttcttccatttatttgtgtcctcttttatttcattgagcagtggtttgtagttctccttgaagaggtccttcacatcccttgtaagttggattcctaggtattttattctctttgtagcaattgtgaatgggagttcactgatgatttggctctctgtttgtctgttattagcgtgtaggaatgcttgagatttttgcacattgattttatatcctgagactttgctgaatttgcttatcagcttaaggaaattttgggctgagacgatggggttttctaaatatacaatcatgtcatctgcaaacagggacaatttgacttcctcttttcctaattgaatgccctttatttctttctcctgcctgattgccctggccagaacttccaacactatgttgaataggagtggtgagagagggcatccctgtcttgtgccagttttcaaagggaatgcttccagtttttgcccattgagtatgatactggctgtgggtttgtcataaacagctctgattattttgaggtatgtcccatcaatacctagtttattgagagtttttagcatgaagtgctgttgaattttgtcaaaggccttttctgcatctattgagataatcatgtggtttttatctttggttctgtttatatgatggattatgtttattgatttgcatatgtagaatcagccttgcatcccagggatgaaaccaacttgatcatggttggcttttgttgtgctgctggatttggtttgccagtattttattgatgatttttgcattgatattcatcagggatattggtctaaaattctctttttttgttgtgtctctgccaggctttggtatcaggttgatgctggcctcataaaatgagttagggaggattcactctttttctgttgattggaatagtttcagaaggagtggtaccagctcctctttgtacctctggtagaattgggctatgaatccatctggtcctggactttttttggttgataggctattaattattgcctcaatttcggagcctgttattggtctattcagggattcaacttcttcctggtttagtcttgggagggtgtatgtgtccaggaatttatccatttcttctagattttctagtttatttgcatggggttgtttatagtattctctgatgatagtttttatttctgtgggatcagtgatgatatcccctttatcattttttattgagtctatttgattcttctctcttttcttctttattagtcttgctagtggtctatcaattttgttgatctttataaaaaaccagctcctgggtttattgattttttgaagtgttttttgattctctatctccttgagttctactctgctcttagttatttcttgccttctgctagcttttgaatgtgtttgctcttgcttctctagttcttttaactgtgatgttagggtgtcaattttagatctttcctgctttctcttgtgggcatttagtgctataagtttccttctacacactgctttaaatgtgtctcagagattctggtatgttgtgtctttgttctcattggcttcaaagaacatctttatttctgcctttattttgttatgtagccagtagtcgttcaggagcagattgttcagttaccatgtagttgagtggttttgagtgagtttcttaatcctgagttctagtttgattgcactgtggtctgagagacagtttgttataatttctgttcttttacatttctgagaactgctttacttccaactatgtggtcagatttggaataagtgtgatatggtgctgagaagaatgtatattctgttgatttgggatggagagttctgtagatgtctattaggtctgcttggtgcagagctgagttcaattcctggatagccttgttaactttctgtctcaatgatctgtctactgttgacagtgggatgttaaagtctcccgttattgttgtgtgggagtctaagtctctttgtaggtcactaaggacttgctttatgaacctgggtgctcctgtattgggtgcatatatatttaggatagttagctcttcttgttgaattgatccctttaccattatgtaagggcattctttgtctcttttgatctttgttggtttaaagtcggttttatcagagactaggattgcaacccctgctttttttgttttccatttgcttggtagatcttcctccatccctttattttgagcctatatgtgtctctgcaagtgagatgggtctcctcaatacagcacactgatgggtcttgactctttatccaatttaccagtctgtgtcttttaattggagcatttagcccatttacatttaaggttaatattgttatgtgtgaatttgatgctgttattatgatgttagctggttattttgcccattagttgatgcagtttcttcctagcatcaatggtctttacaatttggcatgtttttgcagtggctggtaccagttgttcctttccatgtttactgcttccttcaggagctcttgtaaggcaggcctggtggtgacaaaatctctcagcattagtgtgtctgtaaaggattttatttctccttcacttatgaagcttagtttggctggatatgaaattctgggttgaaaattcttttctttaagaaggttgaatattggcccccattctcttttggttgtagagtttctcccaagagatccactgttagtctgatggacttccctttgtgggtaacctgacctttctctctggctgcccttaacattttttccttcatttcaaccttggtgaatctgacaattatgtgtcttggagttgctcttctcgaggagtatctttgtggcattctctgtatttcctgaatttgaatgttggcctgccttgctaggttggggaagttctcctggataatatcctgcagagtgttttccaacttggttccattctccctgtcactttcaggtacaccaatcagatgtagatttggtcttttcacatagtcccatatttcttggagtctttgttcatttctttttactcttttttctct

SEQ ID NO: 12070 - DNA, 4833 bp, Homo sapiens
ttttattttattattattattatactttaagttttagggtacatgtgcacaacgtgcaggttagttacatatgtatacatgtgccatgttgctgtgctgcacccattaactcgtcatttagcattaggtatatctcctaatgctatccctccccactcctcccaccccaaaacagtccccggtgtgtgatgttccccttcctgtgtccatgtgttctcattgttcagttcccacctatgagtgagagcatgcagtgtttggttttttgtccttgcaatagtttgctgagaatgatggtttccagcttcatccatgtccctacaaaggacatgaactcatcattctttatggctgcatagtattccatggtgtatatctgccacattttcttaatccagtctatcattgttggacatttgggttggttccaagtctctgctattgtgaatagtgctgcaataaacatacgtgtgcatgtgtctttatagcagcatgatttataatcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatgaccagtgatgatgagcattttttcatgtgtctgttggctgcataaatgtcttcttttgagaagtgtctgttcatatcctttgcccactttttgatggggttgtttgtttttttcttgtaaatttgtttgagttcattgtagattctggatattagccctttgtcagatgagtaggttgcaaaaattttctcccattctgtaggttgccttttcactctgatggtggtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacattcaagtctttaatccatcttgaattaatttttgtataaggtgtaaggaagggatccagtttcagctttctacatatggctagccagttttcccagtaccatttgttaaatagggaatcctttccccattgcttgtttttgtcaggtttgtcaaagatcagatagctgtagatatgtggcattgtttctgagggctctgttctgttctattgatctatatatctgttttggtaccagtaccatgctattttggttactgtagccttgtagtatagtttgaaggcaggtagcatgttgcctccagctttgttcttttgacttaggattgacttggcaatgtgggctcttttttggttccatatgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaacttggattcctaggtattttattctctttgaagcaattgtgaatgggagttcactcatgatttggctctctgtttgtctattattggtgtgtaagaatgcttgtgatttttgtacattgattttgtatcctgagactttgctgaagttgcttatcagcttaaggagattttgggctgagacaatggggttttctagatatacaatcatgtcatctgcaaacaaggacaatttgacttcctgttttcctaattgaataccccttatttccttctcctgcctgcttgccctggccagaacttccaacactatgttgaataggagtggtgagagagggcatccctgtcttgtgccagttttcaaagggaatgcttccagtttttgtccattcagtatgatattggctgtgggtttgtcatagatagctcttattattttgagatatgtcccatcaatacctaatttattgagagtttttagcatgaagggttgttgaattttgtcaaaggccttttctgcatctattgagataatcatgtaatttttgtctttggttctgtttatatgctggattgcatatattgatttgcgtatgttgaaccagccttgcatcccagggatgaagcccacttgatcatggtggataagctttttgatgtgttgctggattcagtttgccagtattttactgaggatttttgcatcaatgttcatcaaggatattggtctaaaattctctttttttgttgtgtctctgccaggctttggtatcaggatgatgctggcctcataaaatgagttagggaggattccctctttttctattgattggaatagtttcggaaggaatggtaccagctcctccttgtacctctggtagaattcggctgtgaatccatctggtcctggactttttttggttggtaagctattaattattgcctcaatgtcagagcctgttattggtctattcagagattcaacttcttcctggtttagacttgggagagtgtatgtgtcgaggaatttatccatttcttctagattttctagtttgtttgtgtagaggtatttatagtattatctgatggtagtttgtatttcagtgggatcggtggtgatatcccctttgtcatttttttattgtgtctatttgattcttctctcgtttcttctttattagtcttgctagcagtctatcaattttgttgatcttttcaagaaaccagctcctggattcattaattttttgaagggttttttgtgtctctatttccttcagttctgctctgatcttagttatttcttgccttctgctagcttttgaatgtgtttgctcttgcttctctagttcttttaattgtgatgttagggtgtcaattttagaactctcctgctttctcttgtgggcatttagtgctataaatttccctctacacactgctttgaatgtgtcccagagattctggtatgttgtgtctttgttctcgttggtttcaaagaacatctttatttctgccttcatttcgttatgtacccagtagtcattcaggagcaggttgttcagtttccatgtagttgagcagttttcagtgagtttcttaatcctgagttctagtttgattgcactgtggtctgagagacagtttgttataatttctgttcttttacatttgctgaggtgtgctttacttccaactatgtggtaaattttggaataggtgtgatgtggtgttgaaaagaatgtatattctgttgatttggggtggagagttctgtagatgtcttttagatctgtttggtgcagagctgggttcaatttctggatatccttgttaactttctgtcttgttgatctgtctgatgttgacagtggggtgttaaagtctcccattattattgtgtggaagtctaagtctctttgtaggtcactaaggtcttgctttatgaatctgggtgctcctgtattgggtgcatatatatttaggatagttcttcttgttgaattgatccctttaccattatgtaatggccttctttgtctcttttgatctttgttggtttaaagtctgttttatccgagactaggattgcaacccctgcctttttttgttttccatttgcttggtagatcttcctccatccctttattttgagcctatgtgtgtctctgcatgtgagatgggtttcctgaatacagcacactgatgggtcttgactctttatccaatttgccagtctgtgtcttttaattggagcatttagcccatttacatttaaggttagtattgttatgtgtgaatttgatcctgtcattatgatgttagctggttattttgctcgttagttgatgcagtttcttcctagcctcgatggtctttacaatttggcatgattttgcagtggctggtaccggttgttcctttccatttttagtgcttccttcaggagctcttttagggcaggcctggtggtgacaaaatctctcagcatttacttgtctgtaaaggattttatttctccttcacttatgaagcttagtttggctggatatgaaattctgggttgaaaattcttttctttaagaatgttgaatattggcccccactctcttctggcttgtagggtttctgccaagagatcagctgttactctgatgggtttccctttgtgggtaacccgacctttctctctggctgcccttaacattttttccttgatttcaactttggtgaatctgacaattatgtgtgttggagttgctcttcttgaggagtatctttgtggtgttctctgtatttcctgaatttgaatgttggcctgccttgctagattggggaagttctcctggataatatcctgcagagtattttccaacttggttcaattctccacgtcactttcaggtacaccaatcagaggtagatttggtcttttcacatagtcccatatttcttggaggctttgttcgtttctttttattcttttttctctaaacttctcttcacacttcatttcattcatttcgtgttccattgctgataccctttcttccagttgatcgcatcggttactgaggcttgtgcgttcgtcacgtagtt

SEQ ID NO: 12071 - DNA, 4269 bp, Homo sapiens
gtttcagctttctacatatggctagccagttttcccagcaccatttattaaatagggaatcctttccccattcttgtttttgtcaggtttgtcaaagatcagatgatggtagatatgcagcattatttctgagggctctgttctgttccattgatctatatctctgttttggtaccagtaccattttgttttggttactgtagccttgtagtatagtttgaagtcaggtagtgtgatgcctccagcttggttcttttggcttcggattgacttggcaatgtgggctctttttttggttccatatgaactttaaagtagtttttccaattctgtgaagaaagtcattggtagcttgatggggatggcattgaatctataaattaccttgggcagcatggccattttcatggtattgattcttcctacccacgagcatggaatgttcttccatttgtttgtatcctcttttatttcattgagcagcggtttgtagttctccttgaaggggtccttcacatcccttgtaagttggagtcctaggtattttattctctttgaagcaattgtgaatgggagttcactcatgatttggctctctgtctgttattggtatataagaatgcttgtgatttttgcacattgattttgtatcctgagactttgctgaagttgcttatcggcttaaggagattttgggctgagacgatggggttttctagatatacaatcatgtcatctgcaaacagggacaatttgacttcctctgttcctaattgaatgccctttatttccttcttctgcctgattgccctggccagaacttccaacactatgttgaataggagtggtgagagagggcatccgtgtcttgtgccagttttcaaagggaatgcttccagtttttgcccattcagtatgatattggctgtgggtttgtcatagatagctcttattattttgagatacatcccatcaatacctaatttattgagagtttttagcatgaagcattgttgaattttgtcaaaggccttttctgcatctgttgagataatcatatggtttttgtcattggttctgtttatatgctggattatgtttattgatttgcatatgttgaaccagccttgcatcccagggatgaagcccacttgatcatggtggacaagctttttgatgtgctgctggattcggtttgccagtattttattgaggatttttgcatcgatgttcatcagggatattggtctaaaattctctttttttgttgtgtctctgccaggctttggtatcaggatgctgctggcctcataaaatgagttagggaggattccctctttttctactgattggaatagtttcagaaggaatggtaccagctcctccttgtacctctggtagaatttggctgtgaatccatctggtcctggacttttttggttggtaagctattaattagtgcctcaatttcagagcctgttattggtctattcagagattcaacttcttcctggtttagtcttgggagggtgtatgggttgaggaatgtatccatttcttctagattttctagtttatttgcgtaaaggtgtttatagtattctctgatggtagtttgtatttctgtgggatggtggtgatatcccctttatcattttttattgcatctatttgattcttctctcttttcttctttattagtcttgctagcggtctatcaattttgttgatcttttcaaaaaaccagctcctggattcattgattttttgaagggatttttgtgtctctgtttccttcatttctgctctgatcttagttatttcttgccttttgctagctttggaatgtgtttgctcttgcttctctagttcttttttttttatactttaagttttagggtacatgtgcacattagggtgtcaattttagatctttcctgctttctctagtgggcatttagtgctataaatttccctctacacactgctttgaatgtgtcccagagattctggtatgttgtgtcttttttctcgttggtttcaaagaacatctttatttctgccttcatttcgttatgtacccagtagtcattcaggagcaggttgttcagtttccatgtagttgagcggttttgagtgagtttcttaatcctgagttccagtttgattgcactgtggtctaagagacagtttgttataatttctgttcttttacatttgctgaggagtgctttacttccaactatgtggtcagttttgaaataagtgtggtgtggtgctgagaagaatgtatattctgttgatttggggtggagagttccgtagatatctattaggtccgcttggtgcagagctgagttcaattcctggatatccttgttaactttctgtcccattcatctgtctaatgttgacagtggggtgttaaagtctcacattattattgtgtgggagtctaagtctctttgtaggtcactaaggatgtgctttatgaatctgggtgctcctgtattgggtgcatatatatttaggatagttagttcttcttgttgaattgatccctttaccattatgtaatggccttctttgtctcttttgatctctgttggtttaaagtctgctttatcagagactaggattgcaacccctgcctttttttgttttccatttgcttggtagatcttcctccatccctttattttgagcctatgtgtgtctctgcacctgagatgggtttcctgaatatagcacactgatgggtcttgactctttatccaatttgccagtctgtgtcttttaattggagcatttagcccatttacatttaaggttaatattgttatgcatgaatttgatcctgtcattatgatgttagctggttattttgctcgttatttgatgcagtttcttcctagcctcaatggtctttacaatttggcatgtttttgcagtggctggtactggttattcctttccatgtttagtgcttccttcaggagctcttttagggcaggcctggtggtgacaaaatctctcagtatctgcttgtctgtaaaggattttatttctccttcaattatgaagcttagtttggctggatatgtaattctgtgttgaaaattcttttctttaagaatgttgaatattggcccccactctcttctggcttgtagagtttctgccaagagatcagctgttagtctgatgggcttccctttgtgagtaacccgacctttctctctgcctgcccttaacatttttccttcatttcaactttggtgaatctgacaattatgtgtcttggagttgctcttcttgaggagtatctttgtggtgttctctgtatttcctgaatttgaatgttggcctgccttgctagattggggaagttctcctggataataccctgcagagtgttttccaacttggttccattctccctgtcactttcaggtacaccaatcagacgtagatttggtcttttcacatagtcccatatttcttggaggctttgttcatttctttttattcttttttctctaaacttctcttctcgcttcatttcattcatttgagcttccatcactgataccctttcttccagttgatcaaatcggctactgaggcttgtgcatttgtcacgtagttctcgtgccttggttttcagctccatcaggtcttttaaggacttctctgcattggttattctagttagccattcatctaattttttttcaaggtttttaacttctttgccatgtgttcgaacttcctcctttagctcggagtagtttgatcacctgaagccttcttctctcaactcgtcaaagtcattctccgtccagctttgttccattgctagtgaggagctgcattcctctggaggaggagaggcactctgatttttagagtttccagtgtttctgttctgttttttccccatctttgtggttttatctacctttggtctttgatgatggtgacgtacagatggggtttggtgtggatgtcctttctgtttgttcgttttccttctaacagtcaggaccctcagctgctgcaggtctgttggagtttactggaggtccactccagaccatgtttgcctgggtatcagcagcggaagctacagaacagcggatattggtgaacagcaaatgttgctgcctgatcgttcctctgaaagttttgtctcagaggagtacccggccatgtgaggtgtcagtctgcccctactggggggtgcctcccagttaggttactcggggg

SEQ ID NO: 12072 - DNA, 1323 bp, Homo sapiens
gttattggtctattcagagattcaacttcttcctggttcagtgttgggagggtgtaggtgtcgaggaatttatccatttcttctagattttctagtttatttgagtagaggtgtttgtagtattctgatagtagtttgtatttctgtaggatcggtggtgatatcccctttatcattttttactgtgtctacttgattcttctcccttttcttctttattagtcttgctagtggtctgtcaattttgttgatcctctcaaaaaaacagctcctggattcattaattttttgaagggtttttttgtgtctctatttccttcagttctgctctgatttaagttatttcttgccttctgctggcttttgaatgtgtttgctcttgcttttctagttctcttaattgtgatgttagggtgtcaattttggatctttcctgctttctcttgtgagcatttagtgctataaatttccctctacacactgctttgaatgtgtctcagagattctggtatgttgtgtctttgttatcattggtttcaaagaacatctttatttctgccttcatttcgttatgtacccagtagtcattcaggagcaggttgttcagtttccatgtagttgagtggttttgagtgagtttcttaatcctgagttctagtttgattgcactgtggtctgagagatagtttgttataatttctgttctttcctatttgctgaggagagttttatttccacctatgtggtgaattttggaataggtgtggtgtggtgctgaaaaaaatgtatattctgttgatttggggtggagagttctctagatgtctatttggtccacttggtgcagagctgagttcattttctgggtatccttgttaactttctgtctcgttgatctgtctaatgttgacagtggggtgttaaagtctcccattattattgtgtgggtgtcttagtctctttgtaggtcactcaggacttgctttatgaatctgggtactcatgtattgggtgcatatatatttaggatagttagctcttcttgttgaattgatccctttaccattatgtaatggccttctttgtctcttttgatctttgttggtttaaagtctgttttatccgagactaggattgcaacccctcttttttttgttttccgtttgtttggtagatcttcctccatccttttattttgagcctatgtgtgtctctgcacatgagatgggtttcctgaatacagcacactgatgggtcttgactctttatccaatttgccagtctgtgtcttttaattggagcatttagtccatttacatttaa

SEQ ID NO: 12073 - DNA, 2320 bp, Homo sapiens
ctcataaaatgagttagggaggattccctctttttctattgattggaatagtttcaaaagcaatggtaccagttcctccttgtacctctggtagaattcggctgtgaatccatctggtcctggactctttttggttggtaagctattgattattgccacaatttcagagcctgttattggtctattcagagattcaacttcttcctggcttagtcttgggagggtgtatgtgtcgaggaatttatccatttcttctagattttctagtttatttgcatagaggtgtttgtagtattctctgatggtagtttgtatttctgtgggatcggtggtgatatcccctttatcattttctatttcgtctatttgattcttctctcttttcttcttgattagtcttgctagcagtctatcaattttggtgatcctttcaaaaaaccagctcctggattcattaattttttgaagggttttttgtgtctctatttccttcagttctgctctgattttagttatttcttgccttctagcagcttttgaatgtgtttgctcttgcttttctagttcttttaattgtgatgttagggtgtcaattttttatctttcctgctttctcttgtgggcatttagtgctataaatttccctctacacactgctttgaatgtgtcccagagactctggtatgttgtgtctttggtctcgttggtttcaaagaacatctttatttctgccttcatttcgttatgtacccagtagtcattcaggagcaggttgttcagtttccatgtagttgagcagttttgagtgagtttcttaatcctgagttctagtttgattgcactgtggtctgagagacagtttgttataatttctgttcttttacatttgctgaggagagctttacttccaactatgtggtcaattttggaataggtgtggtgtggtgctgaaaaaaaatgtatattctgttgatttggggtggagagttctgtagatgtctattaggtccgcttggtgcagagctgagttcaattcctgggtatccttgttaactttctgtctcgttgatctgtctaatattgactgtggggtgttaaagtctcccattgttattgtgtgggagtctaagtctctttgtaggtcactcaggacttgctttatgaatctgggtgctcctgtattgggtgcatatatatttaggatagttagctcttcttgttgaattgatcactttaccattatgtaatggccttctttgtttcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaattttatcatgtcattataatgttaactggttattttgcttgttagttgatgcagtttcttcctagcctctgtggtctttacagtttggcatgattttgcagtggctggtactggttgttcctttccatgtttagtgcttccttcaggagctcttttagggcaggcctggtggtgacaaaatctctcagcatttgcttatgtgtaaagtattttatttctccttcacttatgaagcttagtttggctggatatgaaattctgggttgaaaattcttttctttaagaatgttgaatattggcccccactctcttctggcttttagagtttctgccgagagtcctgcttgttagtgtgatgggcttccctttgtgggtaacccgacctttctctctggctgcccttaacattttttccttcatttcaactttggtgaatctgacaattatgtgtcttggagttgctcttctcgaggagtatctttgtggcgttctctgtatttcctgaatctgaatgttggcctgccttgctagattggggaagttctcctggataatatcctgcagagtgttttccaacttggttccattctccccgtcactttcaggtacaacaatccgacatagatttggtcttttcacatagtcccatatttcttggaggctttgttcatttctttttattctttttgctctaaacttcccttctcacttcatttcattcatttcatcttccatcactggtaccctttcttccagttgattgcattggctcctgaggcttctgcattcttcatgtagtt

SEQ ID NO: 12074 - DNA, 3692 bp, Homo sapiens
gtctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcagcattatttctgagggctctgttctgttccattgatctatatctctgttttggtaccagtaccatgctgttttggttactgtagccttgtagtatagtttgaagtcaggtagtgtgatgcctccagctttgttcttttggcttaggattcacttggcgaagcgggctcttctttggttccatatgaactttgaagtagttttttcaattctgtgaagaaagtcattggtagcttgatggggatggcattgaatctgtaaattaccttgggcagtgtggccattttcacgatattgattcttcctgcccatgagcatggaatattcttccatttgtttgtatcttcttttatttccttgagcagtggtttgtagttctccttgaagaggtccttcacatcccttgtaagttggactcctaggtattttattctctttgaagcaattgtgaatgggaattcactcatgatttggctctctgtttgtctgttattggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctattgaataccctttatttccttctcctacctaattgccctggccagaacttccaacactatgttgaataggagtggtgagcgagggcctccctgtcttatgccagttttcaaagggaatgcttccagtttttgcccattcagtatgatattggctgtgggtttgtcatagatacctcttattattttgaaatacgtcccatcaatacctaatttattgagagtttttagcatgaagggttgttgaattttgtcaaaggccttttctgcatctattgagataatcatgtggtttttgtctttggttctgcttatatgctggattacatttattgatttgcatatattgaaccagccttgcatcccagggatgaagccctcttgatcatggtggataagctttttgatgtgctgctggattcgttttgccagtattttattgaggatttttgcatcaatgttcatcaaggatattggtctgaaattctcttttttggttgtgtctctgcccggctttggtatcaggatgatgctggcctcataaaatgagttagggaggattccctctttttctgttgattggaatagtttcagaaggaatggtaccagttcctccttgtacctctggtagaattccgctgtgaatccttctggtcctggactctttttggttggtaagctattgattattgccacaatttcagatcctgttattggtctattcagagattcaatttcttcctggtttagtcttgggagagtgtatgtgttgaggaatttatccatttcttctagattttctagtttatttgcatagaggtggttgtagtattctctgatggtagtttgtatttctgtgggatcagtggtgatatcccctttatcattttttattgcatctatttgattcttctctctttttttctttattagtcttgctagtggtctatcaattttgttgatcctttcagaaaaccagctcctggattcattaattttttgaagggttttttgtgtctctatttccttcagttctgttgattttagttatttcttgccttcttctagcttttgaatgtgttttctcttgcttttctagttcttttaattgtgatgttagggtgtcaattttggatctttcctgctttctcttgtgggcatttagtgctataagtttccctctacacactgctttgaatgcgtcccagagattctggtatgttttgtctttgttctcaatggtttcaaagaacatctttatttctgccttcatttcgttatgtacccagtagtcattcaggagcaggttgttcagtttccatgtagttgagcggttttgagtgagattcttaatcctgagttctagtttgattgcactgtggtctgagagatagtttgttataatttctgttcttttacatttgctgaggagagctttacttccaagtatgtggtcaatttttgaataggtgtggtgtggtgctgaaaaaaatgtatattctgttgatttggagtggagagttctgtagatgtctattaggtccgcttggtgcagagctgagttcaattcctgggtatccttgttgactttctgtctcattgatctgtctaatgttgacagtgcggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccattacgtaatggccttctttgtctcttttgatctttgttggtttaaagcctgttttatcagagactaggattgcaacccctgcctttttttgttttctatttgcttggtagatcttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttgctcgttagttgatgcagtttcttcctagtctcgatggtctttacattttggcatgattttgcagcagctggtaccagttgttcctttccatgtttagtgcttccttcaggagctcttttagggcaggcctggtggtgacaaaatctctcagcatttgcttgtttgtaaagtattttatttctctttcacttatgaagcttagcttggctggatatgaaattctgggtttaaaattcttttctttaagaacgttgaatattggcccccactctcttctggcttgtagagtttctgccgatagatctgctgttagtctgatgggcttccctttgagggtaacctgacctttctctcttgctgcctttaacattttttccttcatttcaactttgatgaatctgacaattgtgtgtcttggagttgctcttctcaaggagtatctttgtggcattctctgtatttcctgaatctcaatgttggcctgccttgctagattggggaagttctcctggataatatcctgcagagtgttctccaacttggttccattctccctgtcactttcaggtacaccaatcagacgtagatttggtcttttcacatagtcccatatttcttggaggctttgctcgtttctttttattcttttttctctaaacttcccttctgtcttcatttcattcatttcaccttccatcgctgataccctttcttccagttgatctcatcagctccggaggcttctgcattcttcacgtagtt

SEQ ID NO: 12075 - DNA, 2900 bp, Homo sapiens
ggccattttcatgatattgattcttcctacccaggaccatggaatattcttccatttctttgtatcctcctttatttcattcagcagtggtatgtagttctccttgaagaggtccttcacatcccttgtaagttggattcctaggtattttattctctttgaagcaattgtgaatgggagttcactcatgatttgactctctgtttgtctgttattggtgtacaagaatgcttgtgatttttgtacattgattttgtatcctgagactttgctgaagttgcctatcagcttaaggagattttgggctgagacaatggggttttctagatatacaatcatgtcatctgcaaacagggacaatttgacttcctcttttcctaattgaataccctttatttccttctcctgcctaatggccctggccagaacctccaacactatgttgaataggagtggtgagagagggcatccctgtcttgtgccagttttcaaagggaatgcttccagtttttgcacatttagtatgatattgactgtgggtttgtcatagatagctcttattattttgagatacttcccatcaatacctaatttattgagagtttttagcaggaagtgatgttgaattttgtcaaaggccttttctgcatctattgagataatcatgtggtttttgtctttggctctgtttataccctggattacatttattgatttgcgtatattgaaccagacttgcatcccagggatgaagcccacttgatcatggtggataagctttttgatgtgctgctggattcggtttgccagtattttactgaggatttttgcatcaatgttcatcaaggatattggtctaaaattctcttttttggttgtgtctctgcccggctttgggatcaggatgatgctggcctcataaaatgagttagggaggattccctctttttctattgattggaatagtttcagaaggaatggtaccagttcctccttgtacctctggtagaattcggctgtgaatccatctggtcctggactgtttttggttggtaagctattgattattgccacaatttcagagcctgttattggtctattcagagattcaccttcttcctggtttagtcttgggagggtgtatgtgtcaaggaatttatccatttcttctagattttctagtttatttgcgtagaggtgtttgtagtattctctgatggtagtttgtatttctgtgggatcggtggtgatatcccctttatcattttttattgcgtctatttgattcttctctcttttcttctttattagtcttgctagcggtctatcaattttgttgatcctttcaaaaaaccagctcctggattcattaatttttgaagggttttttgtgtctctatttccttcagttctgctctgattttagttatttcttgccttctgctagcttttgaatgtgtttgcccttgcttttctagttcttttaattgtgatgttagggggtcaattttggatctttcctgctttctcttgtgggcatttagtgctataaatttccctttacacactgctttgaatgtgtcccagagattctggtatgttgtgtctttgttctctttggtttcaaagaacatctttatttctgccttcatttcgttatgtacccagtagtcattcaggagcaggttgttcagtttccatgtagttgagcggttttgagtgagtttcttaatcctgagttctagtttgattgcactgtggtctgagagacagtttgttataatgtctgaccttttatatttgctgaggagagctttacttccaactatgtggtcaattttggaataggtgtggtgtggtgctgaaaaaaatgtatattctgttgatttggggtggagagttctgtagatgtctattgggtccacttggtgcagagctgagttcaattcctgggtatccttgttaactttctgtctcgttgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagttcttcttgttgaattgatccctttaccattatgtaatggccttgtctctgttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggtgattttgctcgttagttgatgcagtttcttcttagccttgatggtctttacaatttggcatgattttgcagtggctggtagcggttgttcctttccatgtttagtgcttccttcaggagctcttttagggcaggcctggtggtgacaaaatctctcagcatttgcttgtctgtgaagtattttatttctccttcacttatgaagcttagtttggctggatatgaaattctgggttgaaaattcttttctttaagaatgttgaatattggcccccactctcttctggcttgtagagtttctgctgagagatcagctgttaatctgatgggcttccctttgtgggtaacccgacctttctctccgggtccccttaacattttttccttcatttcaactttggtgaatctgacaattatgtgtcttggagttgctcttctcgag

SEQ ID NO: 12076 - DNA, 1328 bp, Homo sapiens
tgctttaaatgtgtcccagagattctggtatgttgtgtctttgttctcattcgtttcaaagaacatctttatttctgccttcatttctttatatacccagtagtcattcaggagcagattgttaagtttccatgtagttgagcggttttgagtgagtttcttaatcctgagttctaatttgattgcactatggtctgagagacagtttgttataatttctgttcttttacatttgctgaggagtgctttacttccaactatgtggtcaattttagaataagtgggatgtggtgctgagaagaatgtatattctgttgatttggggtggagagttctgtagatgtctattaggtctgcttggtgcagagctgagttaaattcctggatatccttgttaactttctgtctcatttatttgtctaatgttgacagtggggtgttaaagtctcccattgttattgtgtaggagtctaagtctctttgtagaacttgctttatgaatctgggtgctcctgtattgggtgcgtatatatttaggacagttagctcttcttgtggaattgatccttttaccattatgtaatggccttctttgtctcttttgatctttgttggtttaaagtctgttttatcagagactagcattgcaacccctgcttttttgttgttttccatttgcttggtagatcttcctccatccctttattttgagcctatgtgtgtctctgcatgtgagatgggtctcctaaatacagcacactgatgggtcttgactctttatgcaatttgccagtctgtgtcttttaattggagcatttagcccatttacatttaaggttaatattgttatgtgtgaatttgatcctgtcattatgatgttagctggttattttgctcgttagttgatgcagtttcttcctagcattgatggtctttacaatttggcatgtttttgcagtggctggtactggttgttcctttccatgtttagtgcttccttcaggagctcttgtaaggcaggcctggtggtgacaaaatctctcagcatttgcttgtctgtaaatgattttatttctccttcacttatgaagcttggtttggctggatatgaaattctgggttgaaaattcttttctttaagaatgttgaatattggcccccactctcttctggcttgtagagtttctgccaagagatctgctgttagtctgatgggcttccctttgtgggtaacccaacctttctctctgtctgcccttaatattttttccttcatttcaactttggtgaatctgataattatgtgtcttggagttgctcttctcaag

SEQ ID NO: 12077 - DNA, 1176 bp, Homo sapiens
tcacccaggacttactttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttgctcgttagttgatgcagtttcttcctagtcttgatggtctttacattttggcatgattttgcagtggctggtaccggttgttcctttccatgtttagtgcttccttcaggagctcttttagggcaggcctggtggtgacaaaatctctcagcatttgcttgtctgtaaaggattttatttctccttcacttatgaagcttagtttgactggatatgaaattctgggttgaaaattcttttctttaagaatgttgaatattggcccccactctcttctggcttgtagagtttctgccgagagatctgctgttagtctgatgggcttccctttgtgggtaacctgacctttctctctggctgcccttagcattttttccttcatttcaactttggtgaatctgacaattatgtgtcttggagttgctcttctcgaggagtatgtttgtggcgttctctgtatttcctgaatctgcatgttggcctgccttgctagattggggaatttctcctggataatatcctgcagagtgttttccaacttggttccattctccccgtcactttcaggtacaccaatcagacgtagatttggtcttttcatatagtcccatatttcttggaggctttgtttgtttctttttattcttttttctctaaacttcccttctcacttcatttcattcatttcatcttccatcactgataccttttcttccagttgatcgcatcagatcctgaggcttctgcattcttcacgtagt

SEQ ID NO: 12078 - DNA, 1816 bp, Homo sapiens
cctgagttctagtttgattgcactgtggtctgagagacagtttgttataatttctgttcttttacgtttgctaaggagtgctttacttccaactatgtggtcaattttggaataggtgtggtgtggtgctgaaaagaatgtatattctgttgatttgagatggacagttctgtaaatgtctattaggtccgcgtggtgcagagctgagttcaattcctggatatccttgttaactttctgtcttgttgatctgtctaacgttgacagtggggtgttaaagtctcccattattatcgtgtggaagtctaagtctctttgtaggtcactcaggacttgctttatgaatctgggtgctcctgtattgggtgcatatatatttaggatagttagttcttcttgttgaattgatccctttaccattatgtaatggccttctttgtctcttttgatcttgttggtttaaagtctgttttatccgagactaggattgcaaaccctgcctttttttgttttccatttgcttggtagatcttcctccatccctttattttgagcctatgtgtgtctctgcatgtgagatgggtttcctgaatacagcacactaatgggtcttgactctttatccaatttgccagtctgtgccttttaattggagcatttagcccatttacatttaaggttagtattgttatgtgtgaatttgatcctgtcattatgatgttagctggttattttgctcgttagttgatgcagtttcttcctagcctcgatggtctttacaatttggcatgtttttgcagtggctggtaccggttgttcctttccatgtttagtgcttccttcaggagctcttttagcgcaggcctggtggtgacaaaatctctcagcatttgcttgtctgtaaagtattttatttctccttcacttatgaagcttagtttggctggatatgaaattctaggttaaaaattcttttctttaagaatgttgaatattggccgggcgcggtggctcacgcctgtaatcccagcactttgggaggccgaggcgggcggatcacgaggtcaggagatcgagaccatcctggctaaaacggtgaaaccccgtctctactaaaaatacaaaaaattagccgggtgtagtggtgggcgcctgtagtcccagctacttgggaggctgaggcaggagaatggcgtgaacccgggaggcggagcttgcagtgagccgagatcccgccactgcactccagcctgggtgacagagcgagactccgtctcaaaaaaaaaaaaaaaaaaaaaaaaagaatgttgaatattggcccctactgtcttctggcttgccgtttctgctgagatatcagctgttcatctgatgggcttccctttgtgggtaacccaacctttctctctggctgcccctaatattttttcctgcatttgaactttggtgaatctgacaattatgtgtcttggagttgctcttctcgaggagtatctttgtggcattctctgtgtttcctgaatttgaatgttggcctgccttgctagattggggaagttctcctggataatatcctgcagagtgttttccaacttggttccattatccccaccactttcaggtacaccaatcagacgtagatttggtcttttcacatagtcccatatttcttggaggctttgtttgtttctttttattcttttttctctaaacttctcttcacacttcatttcattcatttcgtcttccatcactgttaccctgtcttccagttgatgacatcagttactgaggcttgtgcattcatcacatagtt

SEQ ID NO: 12079 - DNA, 3036 bp, Homo sapiens
gattgacttggcgatgcgggctcttttttggttccatatgaactttaaagtagttttttccaattctgtgaagaaagtcattggtagcttgatggggatggcattgaatctataaattaccttgggcagtatggccattttcatgatattgactcttcctacccatgagcatggaatgttcttccatttgtttgtattctcttttatttcattgagcagtggtttgtagttctccacttgaagaggtccttcacatcccttgtaagttggattcctaagtattttattatctttgaagcaattgtgcatgggagttcactcatgatttggctctctgtttgtctgttattggtgtataagaatgcttgtgatttttgtacattgattttgtatcctgagactttgctgaagttgcttatcagcttaaggagattttgggctgagacgatggggttttctagatatacaatcatgtcatctgcaaacagggacaatttgacttcctcttttcctaattgaataaccctttatttccttctcctgcctaattgccctggccagaacttccaacactatgttgaataggagtggtgagagagggcatccctgtcttgtgcccgttttcaaagggaatgcttccagtttttgcccattcagtatgatattggctgtgggtttgtcatagatagctgttattattttgagatacgtcccaccaatacctaatttattgagagtttttagcatgaagggttgttgaattttgtcaaaggccttttctgcatctattgagataatcatgtggtttttgtctttggttctgtttatatgctggattacatttattgatttgtgtatattgaaccagccttacatcccagggatgaagcccacttgatcatggtggttaagtttttgatgtgctgctgggttcggtttgccagtattttactgaggatttttgcatcaatgttcatcaaggagattggtctaaaattctcttttttggttgtgtctctgtcaggctttggtatcaggatgatgctgacctcataaaatgagttagggaggattccctctttttctattgattggaatagtttcagaaggaatggtgccagttcctccttgtacctctggtagaattcggctgtgaatccatctggtcctggactctttttggttggtaagctattgattattgccacaatttcagctcctgttattggtctgttcagagagtcaacttcttcctggtttagtcttgggagggtgtatgtgtcgaggaatttatccatttcttctagattatccagtttatttgcgtagaggtgtttgtcgtattctctgatggtagtttgtatttctgtgggatcggtggtgatatcccctttattattttttattgcgtctatttgattcttctctcttttcttgtttattagtcttgctagtggtctatcaattttgttgatcttttcaaaaaaccagctcctggattcattgattttttgaagggttttttgtgtctctatttccttcagttctgctctgattttagttatttcttgccctctgctagcttttgaatgtgtttgctcttgcttttctagttcttttaattgtgatattagggtgtcacttttggatctttcctgctttctcttgtgggcatttagtgctataaatttccctctacacactgctttgaatgtgtcccagagattctggtatgttgtgtctttgttctcgttggtttcaaagaacatctttatttctgccttcatttcgttatgtacccagtagtcattcaggagcaggttgttcagtttccatgtagctgagcagttttgagtgagttttttaatcctgagttctagtttgattgcactgtggtctgagagacagttcgttataatttctgatcttttacatttgctgaggagagctttacttccaactatgtggtcaatttgggaataggtgtggtgtggtgctgaaaaaaatgtatattctgttgatctggggtggagagttctgtagatgtctattaagtccgcttggtgcagagctgagttcaattcctgggtatccttgttaactttctgtctcgttgatctgtctaatgttgacagtggggtgttaaagtctcccattattattgtgtgggagtcttaagtctttttgtaggtcactcaggacttgctttatgaatctgggtgctcctgtattgggtgcatatatatttaggatagttagctcttcttgttgaattgatccctttaccattatgtaatggccttctttgtctcttttgatctgtgttggtttgaagtctgttttatcagagactaggattgcaacccctgcctttttttgttttccatttgcttggtagatcttcctccatccctttatattgagcctatgtgtgtctctgcatgtgagatgggtttcctgaatacagcacactgatgggtcttgactctttatccattttgccagtctgtgtcttttaattggagcatttagcccatttacatttaaagttaatattgttatgtgtgaatttgatcctgtcattatgatgttagctggttattttgctcgttagttgatgcagtttcttcctagccttgaaggtctttacaatttggcatgtttttgcagtggctggtaccggttgttcctttccatgtttagtgcttccttcaggagctctcttagggcaggcctggtggtgacaaaatctctcagcatttgcttgtctgtaaaggattttatttctccttcacttatgaagcttagtttggctggatatgaaattctggcttgaaaattcttttaagaatgttgaatattggcccccactctcttctggcttgtagagtttctgccgagaggtcagctgttagtctgatgggcttccctttgtgggtaacccgacctttctctctggctgcccttaacattttttcctgcatttcaaccttggtgaatctgacaattatgtgtcttggagttgctcttctcgag

SEQ ID NO: 12080 - DNA, 4894 bp, Homo sapiens
gtctaacgtttaagtctttaatccatcttgaattgatttttgtataaggtgtaaggaagggatccagtttcagctttctacatatggctagcccgttttcccagcaccgtttattaaatagggaatcctttccccattgcttgtttttctcaggtttgtcaaagatcagatagttgtagatatacggcgttacttctgagggctctgttctgttccattgatctatgtctctgttttggtaccagtaccatgctgttttggttactgtagccttgtagtatagtttgaagtcaggtagtgtgatgcctccagctttgttcttttggcttagaattgacttggcgatgtgggctcttttttggttccatatgaactttaaagtatttttttccaattctgtgaagaaagtcattggtagcttgatggggatggcattgaatctgtaaattaccttgggcagtatggccattttcacgatattgattcttcctatctataagcatggaatgttcttccatttgtttatgtcctcctttatttcattgagcagtggtttgtagttctccttgaagaggtcctttacatcccttgtaagttggattcctaggtattttattctctttgaagcaattgtgaatgggagttcactcatgatttggctctctgtttgtctgttgttggtgtataggaatgcttgtgatttttgcacattgattttgtatcctgagactttactgaagttgcttatcagcttaaggagatattgggctgagacaatggggttttctagatatacaatcatgtcatctgcaaacagggacaatttgacttcctcttttcctaattgaataccctttatttctttctactgcctaattgtcctggccagaacttgcaacactatgttgaataggagtggtgagagagggcatccctgtcttgtgccagttttcaaagggaatgcttccagtttttgcccattcagtatgatattggctgtgggtttgtcatagatatctcttattattttgaaatatgtcccatcaatacctaatttattgagagtttttagcatgaaggttgttgaattttgtcaaaggccttttctgcatctattgagataatcatgtagtttttgtctttggctctgtttatgtgctggattacatttattgatttgcgtatattgaaccagccttgcatcccagggatgaagcccacttgatcatgatggataagctttttgatgtgctgctggattcggtttgccagtattttattgaggatttttgcatcaatgttcatcaaggatattggtctaaaattctcttttttggttgtgtctctgcctggctttggtatcagaatgatgctggcctcataaaatgagttagggaggattccctctttttctattgattggaataatttcagaaggaatggtaccagttcctccttgtacctctggtagaattcagctgtgaatccatctggtcctggactctttttggttggtaagctattgatcattgccacaatttcagatcctgttattggtctattcagagattcaacttcttcctggtttagtcttgggagagtgtatgtgtcaaggaatttatccatttcttctagattttctagtttatttgcgtagaggtgtttgtagtattctctgatggtagtttgtatttctgtgggattggtggtgatatcccctttatcgttttttattgcatctatttgattcttctctctttttttctttattagtcttgctagtggtctatcaattttgttgatcctttcaaaaaaccagctcctggattcattaattttttgaagggttttttgtgtctctatttccttcagttgtgctctgattttagttatttcttgccttctgctagcttttgaatgtatttgctcttgcttttctagttcttttaattgtgatgttagggtgtcaattttggatctttcctgctttctcttgtgggcatttagtgctataaatttccctctacacactgctttgaatgtgtcccagagattctggtttgttgtgtctttgttctcgttggtttcaaagaacatctttatttctgccttcatttcgttatgtacccagtagtcattgaagagcaggttgttcagtttccatgtagttgagcagttttgagtgagattcttaatcctgagttctagtttgattgcactgtggtctgacagatagatagtttgttataatgtctgttcttttacatttgctgaggagagctttacttccaagtatgtggtcaattttggaataggtgtggtgtggtgctgaaaaaaatgtatattctgttgatttggggtggagagttttgtagatgtctattaggtctgcttggtgcagagctgagttcaattcctgggtatccttgttgactttctgtctcattgatctgtctaatgttgacagtggggtgttaaagtctcccattattaatgtgtgggagtcttaagtctctttgtaggtcactcaggacttgctttatgaatctgggtgctcctgtattgggtgcatatatatttaggatagtgagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccctttattttgagcctatgtgtgtgtctgcacgtgagatgggtttcctgaatacagcacactgatgggtcttgactctttatccaatttgccagtctgtgtcttttaattggagcatttagtccatttacatttaaggttaatattgttatgtgtgaatttgatcctgtcattatgatgttagctggttattttgctcgttagttgatgcagtttcttcctagtcttgatggtctttacattttggcatgattttgcagcggctggtaccggttgttcctttccatgtttagcgcttccttcaggagctcttttagggcaggcctggtggtgacaaaatctctcagcatttgcttgtctgtaaagtattttatttctccttcacttatgaagcttagtttgactggatatgaaattctgggttgaaaattcttttctttaagaatgttcaatattggtccccactctcttctggcttgtagggtttctgccgagagatccgctgttagtctgatgggcttccctttgagggtaaccctacctttctctctggctgcccttaacattttttccttcatttcaactttggtgaatctgacaattatgtgtcttggagttgcttttctcgaggagtatctttgtggcgttctctgtatttcctgaatctgaacgttggcctgccttgctagattgggtaaattctcctggataatatcctgcagagtgttttccaacttggttccattctccccatcactttcaggtacaccaatcagacgtagattcggtcttttcacatagtcccatatttcttggaggctttgctcgtttctttttattctcttttctctaaactttccttcctgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaagtcattctccatccagctttgttccgttgctggtgaggagctgcgttcctttggaggaggagaggcgctctgctttttagagtttccagtttttctgttctgttttttccccatctttgtggttttatctccttttggtctttgatgatggtgatgtacagatgggtttttggtgtggatgtcctttctgtttgttagttttccttctaacagacaggaccctcagctgcaggtctgttggagtaccctgcagtgtgaggtgtcagtctgcccctgctggtgggtgcctcccagttaggctgctcgggggtcaggggtcagggacccacttgaggaggcagtctgcccgttctcagatctccagctgcgtgctgggagaaccactgctctcttcaaagctgtcagacagggacatttaagtctgcagaggttactgctgtctttttgtttgtctgcgccctgcccccagaggtggagcctacagaggcaggcaggcctccttgagctgtggtgggctccacccagttcgagcttcctggctgctttgtttacctaagcaagcctgggcaatggtgggcgcccctcccgcagcctcactgccgccttgcagtttgatctcagactgctgtgctagcaatcagcgagactccgtgggcgtaggaccctctgagccaggtgcgggatataatctggtgcgccgttttttaagcccgttggaaaagcgcagtattcgggtgggagtgacccgattttccaggtgccgtccgtcacccctttctttgattaggaaaggtaactccctgaccccttgcgcttcccgagtgaggcaatgcctcaccctctttcggctcgcgcaaggtgcgcgcacccactgacctgcgcccactgtctggcactccctagtgagatgaacccggtacctcagatggaaatgcagaaatcacccgtcttctgcgtcgctcaggctgggagctgtagactggagctgttgctattcggccatcttggctcct

SEQ ID NO: 12081 - DNA, 2564 bp, Homo sapiens
gattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttcattgagcagtggtttgtagttctccttgaagaggtccttcacatcccttgtaagttggattcctaggtattttattctctttgaagcaattgtgaatgggagttcactcacgatttggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaaatgccctggccagaacttccaacactatgttgaataggagtggtgagggagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatccgttgagataatcatgtgggttttgtctttggctctgtttatatgctggattacatttattgatttgcgtatattgaaccagccttgcatcccagggatgaagcccacttgatcatggtggataagctttttgatgtgcttctggattcattttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcagctgtgaatccatctggtcctggactctttttggttggtaaactatcgattattgacacaatttcagctcctgttattggtctattcagagattcaacttcttcctggtttagtcttgggagagtgtatgtgttgaggaatttatccatttcttctagattttctagtttatttgcgtagaggtgtttgtagtattctctgatggtagcttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcgttatgtacccagtagtcatttcaggagcaggttgttcagtttccatgtagttgagtggctttgagtgagattcttaatcctgagttctagtttgattgcactgtggtctgagagatagtttgttataacttctgttcttttacatttgctgaggagagctttacttccaagtatgtgatcaattttggaataggtgtggtgtggtgctgataaaaatgtatattctgttgatttggggtggagagttctgtagatgtctattaggtccgtttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaattgacccctttaccattatgtaatggccttcttggtctcttttaatctttgttggtttaaagtctgttttatcagagactaggattgcaacccctgcctttttttgttttccatttgcttggtagatcttcctccatccttttattttgagcctatgtgtgtctctgcacatgagatgggtttcctgaatacagcacactgatgggtcttgactctttatccaattcgccagtctgtgtcttttaattggagcaattagtccatttacatttaaagttaatattgttatgtgt

SEQ ID NO: 12082 - DNA, 1628 bp, Homo sapiens
  misc_feature (24)..(24): n equals a,t,g, or c
gttctcattggttcaaagacatcnttcatttctgccttcatttcgttatatacccagtagtcattcaggagcaggttgctcagtttccatgtagttgagtggttttgagtgagtttcttaatcctgagttctactttgattgcattgtggtctgagagacagtttgttataatttctgttcttttacatttgctgaggagtgctttacttccaactatgtggtcaattttggaataagtgtggtgtggtgctgagaagaatgtatattctgttgatctggggtggagagttttgtagatgtctattaggtccacttggtgcagagctgagttcaattcctggatatccttgtatatccttgttaactttctgtctcattgatctgtctaatgttgacagtggggtgttaaagtctcccactactattgtgtgggagtctacgtctctttctagtctctaacgacttgctttatgaatctgggtgctcctgtattgggtgcatatatatttaggagagtcagctcttcttgttgaattgatccctttaccattatgtaatagccttctttgtttcttttgatctttgttggtttaaagtctgttttatcagagactaggattgcaacacctgccgttttttgttttccatttgcttggtagatcttcctccatccctttattttgagcctatgtgtgtctctgcacgtgagatgggtttcctgaatacagcacactgatgggtcttgactcttaatccaatttgccagtctgtgacttttaattgcagcatttagcccatttacatttaaggttaatattgttatgtgtgaatttgatcctgtcattatgatgttagctggtgattttgctcgttagttgatgcagtttcttcctagcctcgatggtctttacaatttggcatgtttttgcagtggctggtaccggttgttcctttccatgtttagtgcttccttcaggagctcttgtaaggcaggcctggtggtgacaaaatctctcagcatttgcttgtctgtagagtattttatttctccttcacttatgaagcttagtttggctggatatgaaattctgggttgaaaattcttttctttaagaatgttgaatattggcccccactctcttctggcttgtagagtttctgccaagagatccgctgttactctgatgggcttccctttgtgggtaacccgacctttctctctggctgcccttaatattttttccttcatttcaactttggtgaatctgacaattatgtgtcttggagttgctcttctcgaggagtatctttgtggcattctctgtatttcctgaatctgaatgctggcctgccttgctagattggggaagttctcctggataatatcctgcagtgttttccaacttggttccattctccccgtcactttcaggtacaccaatcagacgtagatttggtcttttcacgtagtcccatatttcttggaggctttgtgtgtttctttttattcttttttctctaaacttctcttctcgcttcatttcattcatttgatcttccatcactgataacctttcttccagttgatcgaatcggctactgaagcttgtgcattcgtcaagtagtt

SEQ ID NO: 12083 - DNA, 4555 bp, Homo sapiens
gtctaacatttaagtctttaatccatcttgaattgatttttgtataaggtgtaaggaagggatccagtttcagctttctacatatggctagccagttttcccagcaccatttatgaaatagggaatcctttccccattgcttgtttttctcaggtttgtcaaagatcagatagttgtagatatgcggcgttatttctgagggctctgttctgttccattgatctatatctctgttttggtatcagtaccatgctgttttggttactgtagccttgtagtatagtttgaagtcaggtagcgttatgcctccagctttgttcttttggcttaggattgccttggtgacgtgggctcttttttggttccatacgaactttaaagtagttttttccacttctctgaagaaagtcattggtagctttatggggatggcattgaatctgtaaattaccttgggcagtatggccattttcacgatattgattcttcctacccatgagcatggaatgttcttctgtttgtttgtatcctcttttatttccttgagcagtggtttgtagttctccttgaagaggtccttcacatcccttgtaagttggattcctaggtattttcttctctttgaagcaattgtgaatgggagttcactcatgatttggctctctgtttgtctgttattggtgtataagaatccttgtgatttttgtacattgattttgtatcctgagactttgctgaagttgcttatcagcttaaggagatttggggctgagacaatggggttttctatatatacaatcatgtcatctgctaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatactggctgtgggtttgtcatagatagctcttattattttgaaatacgtcccatcagtacctaatttcttgagagtttttagcatgaagggttgttgaatttttgtcaaaggctttttctgcatctattgagataatcatgtggtttttgtctttggctctgtttatatgctggattacatttattgatttgcgtatattgaaccagccttgcatcccagggatgaagcccacttgatcatggtggataagcttttggatgtgctgctggattcgttttgccagtatttgattgaggatttttgcatcaatgttcatcaaggatattggtctaaaattctcttttttggttgtgtctctgccaggctttggtgtcagaataatgctggcctcataaaatgagctagggaggactccctctttttctattgattggaatagtttcagaaggaatggtaccagttcctccttgtacctctgatagaattcggctgtgaatccatctggtcctggactctttttggttggtaaactattgattattgccacaatttcagctcctgttattggtctattcagagattcaacttcttcctggtttagtcttgagagagtgtatgtgtcgaggaatttatccatttcttctggattttctagtttatttgcgtagaggtgtttgtagtattctctgatggtagtttgtatttctgtgggattgctggtgatatcccctttatcattttttattgcatctatttgattcttctctctttttttctttattagtcttgctagcggtctatcagttttgttgatcctttcaaaaaaccagctcctggattcattgattttttgaagggttttttgtgtctctatttccttcagttctgctctgattttagttatttcttgccttctgctagcttttaaatgtgtttgctcttgcttttctagtttttttaattgtgatgttagggtgtcaattttggatctttcctgctttctcttgtgggcatttagtgctataaatttccctctacacactgctttgaatgcgtcccagagattctggtatgttgtgtccttgttctcgttggtttcaaagaacatctttatttctgccttcatttcgttatgtacccagtagtcattcaggagcaggttgttcagtttccatgtagttgagcggttttgagtgagattcttaatcctgagttctagtttgattgcactgtggtctgagagatagtttgttataatctctgttcttttacatttgctgaggagagctttacttcccagtatgtggtcaattttggaataggtgtggtgtggtgctgaaaaaaatgtatattctgttgatctggggtggagagttctgtagatgtctattaggtccgcttggtgcagagctgagttcaattcctgggtatccttgctgactttctgtctcgttgatctgtctaatgttgacagtggggtgttaaagtctcccattattaatgtgtgggagtctaagtctctttgtaggtcactgaggacttgctttatgaatctgggtgctcctgtattgggtgcatatatatttaggttagttagctcttcttgttgaattgatccctttaccattatgtaatggccttctttgtctcttttgatctttgttggtttaaagtctgttttatcagagactaggattgcaaccctgccttttttttgttttccatttgcttggtagatcttcctccatccctttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggtgattttgctcgttagttgatgcagtttcttcctagtctccatggtctttacattttggcatgattttgcagcggctggtaccagttgttcctttccatgtttagcgcttccttcaggagctcttttaaggcaggcctggtggtgacaaaatctctcagcatttgcttgtctgtaaagtattttatttctccttcgcttatgaagtttggtttggctggatatgaaattctgggttgaaaattcttttctttaagaatgttgaatattggcccccactctcttctggcttgtagggtttctgccgagagatccgctgttagtctgatgggcttccctttgagggtaacccgacctttctctctggctgcccttaacattttttccttcatttccactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccccatcactttcaggtataccaatcagacgtagatttggtcttttcacatagtcccatatttcttggaggctttgctcatttctttttattcttaaacttcccttctcgcttcatttcattcatttcatcttgcattgctgataccctttcttccagttgatcacatgggctcctgaggcttctgcattcttcacgtagttctcaagccttggttttcagctccatcagctccttaagcactttctctgtattgattattctagttatacattcttctaaattttttcaaagttttcaacttctttgcctctggtttgaatgtcctcccgtagctcagagtaatttgatcgtctgaagccttcttctctcagctcgtcaaagtcattctccgtccagttttgttccattgctggtgaggaactgcgttcctttggaggaggagaggtgctctgcgttttagagtttccagtttttctgctctgttttttccccatctttgtggttttatctacttttggtctttgatgatggtgatgtacagatgggtttttggtgtggatgtcctttctgtttgttagttttccttctaacacacaggaccctcagctgcaggtctgttggaataccctaccgtgtgaggtgtcagtgtgcccctgctgggggttgcctcccagttaggctgctctggggtcaggtgtcagggacccacttgaggaggcagtctgccccttctcagatctccagctgcgtgctgggagaaccactgctctcttcaaagctgtcagacagggacatttaagactgcagaggttactgctgtctttttgtttgtctgtgccctgcccccagaggtggagcctacagaggcaggcaggcctccttgagctgtggtgggctccacccagttcgagcttaagggctgctttgtttacctaagcaagcctgggcaatggcgggcgcccctcccccagcctcgctgccaccttgcagtttgatctcagactgctgtgctagcaatcagcgagactccgtgggcataggaccctccgagccaggtgcgggatat

SEQ ID NO: 12084 - DNA, 4556 bp, Homo sapiens; identical to SEQ ID NO: 12058

SEQ ID NO: 12085 - DNA, 4121 bp, Homo sapiens
gtctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgtggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcatgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggccctctgtctgtctgttgttggtgtataagaatgcttgtgatttttgtacattgattttgtatcctgagactttgctgaagttgcttatcagcttaaggagattttgggctgagacaatggggttttctagatacacaatcatgtcatctgcaaacagggacaatttgacttcctcttttcctaattgaataccctttatttccttctcctgcctaattgccctggccagaacctccaacactatgttgaataggagtggtgagagagggcatccttgtcttgtgccagttttcaaagggaatgcttccagtttttgcccattcagtatgatattggctgtgggtttgtcatagatagctcttattattttgaaatacgtcccatcaatacctaatttattgagagtttttagcatgaagcgttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcgttttgccagtattttattgaggattcttgcatcaatgttcatcaaggatattggtctaaaattctcttttttggttgtgtctctgcccagctttggtatcagaatgatgctggcctcataaaatgagttagggaggattccctctttttctattgattggaatagtttcagaaggaatggtaccagttcctccttgtacctctgatagaattcggctgtgaatccatctggtcctggactctttttggttagtaaactattgattattgccacaatttcagctcctgttattggtctattcagagattcaacttcttcctggtttagtcttgggagagtgtatgtgtcgaggaatttatccatttcttctagattttctagtttatttgcatagaggtgtttgtagtatgctctgatggtagtttgtatttctgtgggatcggtggtgatatcccctttatcattttttattgcgtctatttgattcttctctctttttttctttattagtcttgctagcggtctatcaattttgttgatcctttcaaaaaaccagctcctggattaattaattttttgaatggttttttgtgtctctatttccttcagttctgctctgattttagttatttcttgccttctgctagcttttgaatgtgtttgctcttgcttttctagttcttttaattgtgatgttaggtgtcaattttggatctttcctgctttctcttgtgggcatttagtgctataaatttccctctacacactgctttgaatgcgtcccagatattctggtatgttgtgtctttgttctcgttggtttcaaagaacatctttatttctgccttcatttcattatgtatccagtagtcattcaggagcaggttgttcagtttccatgtagttgagtggttttgagtgagattcttaatcctgagttctagtttgattgcactgtggtctgagagatagtttgttataatctctgttcttttacatttgctgaggagagctttacttccaagtatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtcttgttgatctgtctaatgttgacagtggggtgttaaagcctcccattattaatgtgtgggagtctaagtctctttgtaggtcactcaggacttgctttatgaatctgggtgctcctgtattgggtgcctatatatttaggatagttagctcttcttgttgaattgatccctttaccattatgtaatggccttctttgtctcttttgatctttgttggtttaaagtctgtttcatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggtgattttgctcattagttgatgcagtttcttcctagtctcaatggtctttacattttggcatgattttgcagcggctggtaccggttgttcctttccatgtttagcgcttccttcaggagctcttttagggcaggcctggtggtgacaaaatctcccagcatttgcttgtttgtaaagtattttatttctccttcacttatgaagcttagtttggctggatatgaaattctgggttgaaaattcttttctttaagaatgttgaatattggcccccactctcttctggcttgtagggtttctgccaagagatctgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgagcgttggcctgccttgctagattggggaagttctcctggataatctcctgcagagtgttttccagcttggttccattctccccatcactttcaggtacaccaatcagacatagatttggtcttttcacatagtcccatatttcttggaggctttgctcatttctttttattcttttttctctaaacttcccttctcacttcatttcattcatttcatcttccattgctgataccctttcttccagttgattgcatcggctcctgaggcttctgcattcttcacgtagttctcgagccttggttttcagctccatcagctcctttaagcacttttctgtattggttattctagttatacattcttctaaatttttttcaaagttttcaacttctttgcctttggtttgaatgtcctcccatagctcggagtaatttgatcgtctgaagccttcttctctcagctcgtcaaagtcattctccatccagctttgttccgttgctggtgagaactgcgttcctttggtggaggagagggctctgcgttttagagtttccagtttttctgttctgtttttcccccatctttgtgttttatctacttttggtctttgatgatggtgatgtaaagatgggtttttggtgtggatgtcctttctgtttgttagttttccttctaacaaacagacaggaccctcagctgcaggtctgttggaat

SEQ ID NO: 12086 - DNA, 2900 bp, Homo sapiens
ttcatttatttaattattattttactttaagttctatggtacatgtgcacaacgtgcaggtttgttacatatgtatacatgtgccatgttggtgtgctgcactcgttaactcgtcatttacattaggtatatctcctaatgctatccctcccccttcccccaaccccaagacaggccccagtgtgtgatgttccccaccctgcatccaagtgttctcattgttcaattcccacctatgagcgaggacatgcggtgtttggttttctgtccttgcaatagtttgcttagaatgatggtttccagcttcatccgtgtccctacaaaggacatgaactcatccttttttatggctgcatagtattccatggtgtgtatgtgccacattttcttaatccagtctatcattggtggtcatttgggttggttccaagtctttgctattgtgaatagtgctgcaataaaaatacatgtgcatgtgtctttatagcagcatgatttatagtcctttgggtatatgcccagtaatgggatggctgggtcaaatggtatttctagttctagatccttgaggaatagccacactgtcttccacaatggttgaactagtttacagtcccaccaacagtgtaaaagtgttcctatttctctacatcctctccagcacctgttgtttcttgactttttaatgattgccattctacctggtgtgagatggtatctcattgtggttttgatttgcatttctctgatggccagtgatgatgagcactttttgatgtgtctgttggctgcataaatgtcttgttttgagaagtgtctgttcatatccttcacccactttttgatggggttgtttgattttttcttgtaaatttgtttaagttctttgtagattctggatattagccctttttcagatggatagatttcttctagattctctagttcatttgcatagaggtgtttatagtattctctgatggtagtttgtatttctgtgggatcagtggtgatatcccctttatcattttttattgcatctatttgattcctctctcttttcttctttattagtcttgctagctgtctatcaattttgttgagcttttcaaaaaaccagctcctggattcattgattgtgtgaagggttttttttcgtgtctctatctccttcagttctgttctgatcttagttatttcttgccttctgctggctttcgaatgtgtttgctgttgcttctctagttcttttaattgtgttgttagggtgtcaattttagatctttcctgctttctcttgtgggcatttagtgctataaatttccctctacacactgctttaaatgtgtcccagagattctggtatgttgtgtcttcattctcattggtttcaaagaacatctttatttctgccttcatttcgttgtgtacccagtagtcattcaggagcaggttgttcagtttccatgtagttgtgtggttttgagtgagtttcttaatcctgagttctagtttgattgcactgtggtctgagagacagtttgttataatttctgttcttccacatttgccgaggagtgctttacttccaactatgtggtcaattttggaataagtgtgaggtggcactgagaagaatgtatattctgttgatttgtggtggagagttctgtagatgtctattaggtccactcggtgcagagcttagctcaattcctgtatatccttgttaactttctgtcccgttgatctgtctaatgttgacagtggggtgttgaagtctcccattattatttgtgggagtctaagtctctttgtaggtctctaaggacttgctttatgaatctgggtgctcttgtattgggtgcatatatatttagtatagttagctcttcttgttgaattgatccctttaccattatgtaatgacctcctttgtctcttctgatctttgttggtttaaagtctgttttatcagagactaggattgcaacccctgttttttttgttttccatttgcttggtagatcttcctccatccctttattttgagcctatgtgtgtctctgcatgtgagatgggtctcctgaatacagcacactgatggctcttgactctttatccaatttgctagtctgtgtcttttaatgggagcatttagcccatttacatttaaggttaatattgttatgtgtgaatttgatcctgtcattatgatgttagctggttattttgctcgttagttgatgcagtttcttcctagcatgatggtctttacaatttggcatgtttttgcagtggctggtactggctgttcctttccatgtttagtgcttccttcaggagctcttgtaaggcaggcttggtggtgacaaaatctctcagcatttgtttgtctgtaaaggattttatttctctttcacttctgaagcttagtttggctggatatgaaattcttggttgaaaattcttttctttaagaatgttgaatattggcccccactctcttctggcttgtagagtttctgctgagagatccactgttagtctgatgggcttccctttgtgggtaacctgacctttctctctgattgcccttaacattttttcctttatttcaactttgatgaatctgacaattatgtgtcttggagttgctcttcttgaggagtatctttgtggcattctttgaatttcctgaatttgaatgttggcctgccttgctagattggggaagttctcctggataatatcctgaagagtgttttccaacttggttccattctccctgtcactttcaggtacaccaatcagatgtagatttggtcttttcatgtgatcccatatttcttcaaggctttgttcatttctttttactcttttttctctaagcttctctt

SEQ ID NO: 12087 - DNA, 299 bp, Homo sapiens
caacccctgcctttttttgttttccatttgcttcgtagatcttcctccatccttttattttgagcctatgtgtgtctctgcaagtgagatgggtttcctgaatacagcacactgatgggtcttgactctttatccaatttgccagtctgtgtcttttaattggagcatttagtccatttacatttaaagttaatattgttatgtgtgaatttgatcctgtctttatgatgttagctggttattttgctcattagttgatgcagtttcttcctagcctccatggtctttacaaattggca

SEQ ID NO: 12088 - DNA, 3697 bp, Homo sapiens
gtctaacatgtaagtctttaatccatcttgaattaatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcatcatttctgagggctctgttctgttccattggtctatatctctgttttggtaccagtaccatgctgttttggttactgtagccttgtagcatagtttgaagtcaggtagcgtgatgcctccagctttgttcttttggcttaggattgtcttggcaatgcgtgctcttttttggttccatatgaactttgaagtagttttttccaattctgtaaagaaagtcattggtagcttgatagggatggcattgaatctatcaattaccttgggcagtatggccattttcacgatattgattcttcctacccatgagcatggaatgttcttccatttgtttgtatcctcttttatttcattgagtagtggtttgtagttctccgtgaagaggttcttcacatcccttgtaagttggattcctaggtattttattctctttgaagcaattgtgaatgggagttcactcatgatttggctctctgtttgtctgttattgttgtataagaatgcttgtgatttttgcacattgattttgtatcctgagactttgccgaagttgcttatcagcttaaggagattttgggctgagacaatggggttttctagatatacaatcatgtcatctgcaaacagggacaatttgacttcctcttttcctaattgaatgccttttatttccttctactgcctgattgccctggccagaatgtccaacactatgttgaataggagtggtgagagaggccatccctgtcttgtgccagttttcaaagggaatgcttccagtttttgtgcattcagtatgatactggctgtgggtttgtcatagataactcttatatttttgagatacaccccatcaatacctaatttattgagagtttttagcatgaagcgttgttgaattttttcaaaggccttttctgcatctattggtataattgtgtggttttttttctttggttctgttgatatgctggattatgtttattgattttcgtatgttgaaccagccttgcatcccagagatgaagcccacttgatcatggtggataagctttttgatatgttgctggattcagtttgccagtattttattgaggatttttgcatcaatgttcatcagggatattggtctaaaattctcgttttttattgtgtctctgccaggctttggtatcaggatgatgctgacctcataaaatgagttagggaggattccctctttttctattgattggaatagtttcagaaggaatagtaccagctcctccttctacctctggtagaattcggctgtgaatccatctggtcctggaatttttttggttggtaagctattaattattgcctcaatttcggagcctgttattggtctattcaaagattcaacttcttcctggtttagtcttggaagagtgtatgtgttgaggaatttatccatttcttctagattttctactttattcctgtagaggtgtttagagtattctctgatgatagtttgtagttctgtgggattggcggtgatatcctctttgtcatattttattgcatctaattgattcttctctcttttcttctttattaaccttgctagcagtctatcaattttgttgatcttttcaaaaaaccagctcctggattcattgattttttgaagggttttttgtgtctctatttccttcagttctgctctgaccttagttatttcttgccttctgctagcttttgaatgtgtttgctcttgcttctctagttattttaattgtgatgttagggtgtcaattttagatctttcctgctttctcttgtgggcattcggtgctataaatttccctctacatactgctttgaatgtgtcccagagattctggtatgttatgtctttgttctcattggtttcaaagaacatctttgtttctgccttcatttccttatgtacccagtagtcattcaggagcaggttgttctgtttccatgtagttgagcggttttgagtgagtttcttaatcctgagttctagtttgattgcactgtggtctgagagacagtttgttataatttctgttctttcacatttgctgaggagtgccttacttccaactatatggtcaattttggaataagtgtggtgtggtgctgaaaagaatgtatattctgttgatttggggtggagagttctgtagatgtctattaggtctgcttggtgcagagctgagttcaattcctggatagccctgttaactttctgtctcattgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagagtaggattgcaacccctgcctttttttgttttccatttgcttggtagatcttcctccacccctttattttgagcctatgtgtgtctctgcatgtgagatgggtttcctgaatacagcacactgatgggtcttgactctttatccaatttgccagtctgtgtcttttatttggagcacttagcccatttacatttaaggttagtattgttatgtgtgaatttgatcctgtcatgatgatgttagctggttattttgctcgttagttgatgcagtttcttcctagccttgatggtctttgcaatttggcatgtttttgcagtggctggtaccagttgttcctttccatgtttagtgcttccttcaggagctcttttagggcaggcctggtggtgacaaaatatctcagcatttgcttgtctgtaaagtattttatttctccttcacttatgaagcttagtttggctggatatgaaattctgggttgaaaattcttttctttaagaatgttgaatattggcccccactctcttctggcttgtagaatttctgccaagagatcagctgttagtctgatgggcttccctttgtgggtaagctgacttttctctctggctgcccttaacattttttccttcatttcaactttggtgaatctgacaattaggtgttttggagttggtcttctcaaggagtatctttgtggcgttctctgtatttcctgaatttgaatgttggcctgccttgctagattggggaagttctcttggataatatcctgcagagtgttttccaacttggttccattctccccatcactttcaggtacagcaatcagatgtagttttggtcttttcacatagtcccatatttcttggaggctttgttgatttctttttattcttttttctctaaacttcacttctcacttcatttcattcatttcatcttccatcactgataccctttcttccagttgatcacatcggttactgaggcttgtgcattcatcatgtagtt

SEQ ID NO: 12089 - DNA, 5567 bp, Homo sapiens
ttttctttttttaaaaattttattattattgtactttaagttttagggtacatgtgcacaacgtgcaggtttgttacatacgtatacatatgccatgttggtgtgctgcacccattaactcgtcatttagcattaggtatatctcctaatgctatccctccccccttcccccaccccacaacagtccctactgtgtgatgttccccttcctgtgtccatgtgttctcattgttcaattcccacctacgagtgagaacatgcggtgtttggttttttgtccttgtgatagtttgctgagaatgatggtttccagtttcatccatgtccctacaaaggacatgaactcatcattttctatggctgcatagtattccatggtgtatatgtgccacattttcttaatccagtctatcgttgttggacatttgggttggttccaagtcttcgctattgtgaatagtgctgcaataaacatacgtgtgcatgtgtctttatagcagcatgatttataatcctttgggtatatacccagtaatgggatggctgggtcaaatggtatttctagttctagatccctgaggaatcgccacactgaattccacaatggttgaactagtttacagtcccaccaaagtgtaaaattctccctatttctccacctcctctccagcacctgttgtttcctgactttttaatgatcgccattctaactggtgtgagatggtatctcattgtggttttgatttgcatttctctgatggccagtgatgatgagcattttttcatgtgttttttggctgcataaatgtcttcttttgagaagtgtctgttcatatcctttgcccactttctgatggagttgtttgtttttttcttgtaaatttgtttgagttcattgtagattctggatattagccctttgtcagatgagtaggttgcaaaaattttctcccattctgtaggttacctgttcactctgatggtagtttcttttgctgtgcagaagctctttagtttaattagatcccatttgtcaattttggctttcattgccattgcttttggtgttttagacatgaagtccttgcccatgcctatgtcctgaatggtaatgcctaggttttcttctagggtttttatggttttaggtctaacatttaagtctttaatccatcttgaattaatttttatataaggtgtaaggaagggatccagtttcagctttctacatatggctagccagttttcccagcaccatttattaaatagggaatcctttccccattgcttgtttttctcaggtttgtcaaagatcagatagttgtagataggtggcattatttctgagggctctgttctgttccattggtctatatctctgttttggtaccagtaccatgctgttttggttactgtagccttgtagtatagtttgaagtcaggtagcatgatgcctccagatttgttcttttggcttaggattgacttggcaatgcgggctcttttttggttccatatgaactttaaagtagttttttccagttctgtgaagaaagtcattggtaggttgatggagatggcattgaatctataaattaccttgggcagtatggccattttcatgatattgattcttcctacccatgagcatggaatgttcttccatttgtttgtatcctcttttatttcattgagcagtggtttgtagttctccttgaagaggtccttcacatcccttgtacgttggattcctaggtattttattctctttgaagcaattgtgaatgggagttcactcacgatttggctgtttgtctgttattggtgtataagaatgcttgtgatttttgtacattgattttgtatcctgagactttgctgaagttgcttatcagcttgaggagattttgggctgagacaatggggttttctagatatacaatcatgtcatctgcaaacagggacaatttgacttcctcttttcctaactgaataccctttatttccttctcctgcctgattgccctgaccagaacttccaacactatgttgaataggagtggtgagagagggcatccctgtcttgtgcccgttttcaaagggaatgcttccagtttttgcccattcagtatgatattggctgtgggtttgtcatagatagctcttattattttgagatacatcccatcaatacctaatttattgagagtttttagcatgaagtgttgttgaattttgtcaaaggccttttctgcatctattgagatttggttctgtttatatgctggattacatttattgatttgcatatgttgaaccagccttgcatcccagggatgaagcccacttgatcatggtggatatgctttttgatgtgctgctggattcggtttgccagtattttattgaggatttttgcatcgatgttcatcaaggatattggtctaaaattctctttttttgttgtgtctctgccaggctttggtatcaggatgatgctggcctcataaaatgagttagggaggattccctctttttctattgattgcaatagtttcagaaggaatggtaccagctcctctttgtacctctgatagaatttggctgtgaatccatctggtcctggactttttttggttggtaagctattgattattgcctcaatttcagagcctattattggtctattcagagattcaacttcttcctggtttagtcttgggagggtgtatgtgtccaggaatttatccatttcttctggattttctagtttatttgcatagaggtgtttatagtattctctgatggtagtttgtatttctgtgggattggtggtgatatcccctttatcattttttattgcgtctatttgattcttctctcttttcttctttattagtcttgctagtggtctatcaattttgttgatcctttcaaaaaaccagctcctggattcattacttttttgaagggtgtttttgtgtctctatttccttcagttctgctctgattttagttatttcttgccttctgctagcttttgaatgtgtttgctcttgcttttctagttcttttaattgtgatgttagggtgtcaattttggatctttcctgctttgtcttgtggcctttagtgctataaatttccctctacacactgctttgaatgtgtcccagagattctggtatgttgtgtctttgttctcattggtttcaaagaacatctttatttttgccttcatttcattatttacccagtagtcattcaggagcaggttgttccgtttccatgtagctgagcggttttgagtgagtttcttaatcctgagttctagtttgattgcactgtggtctgagggacagtttgttataatttctgttcttttacatttgctgaggagtgctttacttccaactatgtggtcaattttggagtaggtgtggtgtggtgctgaaaagaatgtatattctgttgatttcaggtggagagttctgtagatgtctattaagtctgcttggtgcagagctcagttcaattcctgggtatccttgttaactttctgtcttgttgatctgtctaatgttgacagtggagtgttaaagtctcccattattattgtgtgggagtctaagtctctttgtaggtcactaaggacttgctttatgaatgtgggtgctcctgtattgggtgcatatatatttaggatagttagctcttcctgttgaattgatccctttaccatgatgtaatggccttctttgtctcttttgatctttgttggtttaaagtctgttttatcagagactaggattgcaacccctgcctttttttgttccatttgcttggtagatgttcctccatccctttattttgagcctatgtgtgtctctgcccgtgagatgggtttcctgaatacagcacactgatgatgggtcttgactctttatccaatttaccagtctgtgtcttttaattggagcatttagccaatttacatttaaagttaatattgttatgtgtgaatttgatcctgtcattatgatgttagctggttattttgctcgttagttgatgcagtttcttcctagccttgatgatctttacaatttggcatgattttgcagtggctggtaccagttgttcctttccatgtttagtgcttccttcaggagctcttttagggcaggcctggtggtgacaaaatctctcagcatttgcttgtctgtaaagggttttatttctccttcacttatgaagcttagtttggctggatatgaaattctgggttgaaaattcttttctttaagaatgttgaatattggtctccactctcttctggcttgtagagtttctgccgagaggtccgctgttagtctgatgggcttccctttgagggtaacccgacctttctctctggctgcccttaacattttttccttcattttaactttggtgaatctgacaattatgtgtcttggagttgctcttctcgagaagtatctttgtggtattctctgtatttcctgaatttgaatgttggcctgccttgctagactggggaagttctcctggataatatcctgcagagtgttttccaagttggttccattctccccgtcactttcaggcacaccaatcagacgtagatttggtcttttcatatagtcccatatttcttggaggctttgttcgtttctttttactctttttcctctaaacttctcttatcatttcatttcattcatttcatcttccatcactgataccctttcttccagttgatcgcatcggctcctgaggcttctacattcgtcaggtagctctcgtgccttggttttcagctccatcaggtcctttaaggacttctgtgcattggttattctagttatccattcgtctaaatttttttcaaagattttaacttctttgccattggttcagatttcctcctgtagctcggagtagtttgatcttctgaagccttcttctctcaactcgtcaaagtcattctctgtccaactttgttccattgctggtgaggagctgcgttcctttggaggaggagaggcactctgatttttagagtttccagtttttctgctctgtttttttcccatctttgtggttttatctacctttggtctttgatgatggtgacgtatagatgggtttttggtgtggatgtcctttctgtttgttagttttccttctaacagacaggaccctcagctgcatgtctgctggagtttgctagaggtccactccagaccccgtttgcctgggtatcagcagtggtggctgcagaacagcagatattggtgaaccgcagatgctgctgcctgatcattcctctggaagttttgtctcagaggagtactcggccgtgtgaggtgtcagtccgccccactgggggatgcctcccagttaggttactcgggggtcagggacctacttgaggaggcagtctgcccgttctcagatctcaagctgcgtgctgggagaaccactactctcttcaaagcgtcagagagggacattttaagtctgcagaggttactgctgtcttt

SEQ ID NO: 12090 - DNA, 2984 bp, Homo sapiens
gaaagtcattggtagcttgatggggatggcatggaatctataaattaccttgggcagtatggccattttcacaatattgattctttctacccatgagcatggactgttcttccatttgtttgtatcctcttttatttcattgagcagtggtttgtagttctccttgaagaggtccttcacatcccttgtaagttggattcctaggtattttattctctttgtagtgattgtgaatgggacttcactcatgatttggctctctgtttgttatcggtgtataagaatgcttctgatttttgtacattgattttgtatcccgagactttgctgaagttgcttatcggcttaaggagattttgggctgagatgatggggttttctagatatacaatcatgtcatctgcaaacagggacaatttgacttcctcttttcctaattgaataccctttatttccttctcctgcctgattgccctggccagaacttccaacactatgttgaataggagtggtgagagagggcatccctgccttctgccagttttcaaagggaatgcttccagtttttgcccattcagtatcatattggctgtggatttgtcatagatacctctgattattttgagatacatcccatcaatacctagtttattgagagtttttagcatgaagcattgctgaattttggcaaaggccttttctgcatctattgagataataatgtggtttttgtctttggttctgtttatatgttggattacatttattgatttgcatatgttgaaccagccttgcaccccaggggtgaagcccacttgatcatggtggataagctttttgatgtgctgctggatttggtttgccagtattttattgaggatttttgcatcgatgttcatcaaagatattggtctaaaattctctttttttttgttgtgtctctgccaggctttggtatcaggatgatgctggcctcataaaatgagttagggaggattccctgtttttctattgattggaatagtttcagaaggaatggtaccagttcctccttgtacctctggtagaattcgcctgtgaatccatctggtcctggactttttttggttggtaagctattgattattgcctcaatttcagatcctgttattggtctattcagagattcaacttcttcctggtttagtcttgggaggatgtatgtgtcgaggaatttatccctttcttctagattttctagtttatttgcgtagagatgtttgtagtattctctgatggtagtttgcatttctgtgggatcggtggtgatatccccttcatcatttttcattgcgtctatttgattcttctctcttttcttctttattagtcttgctagcggtctatcaattttgttgatcttttcaaaaaaaccaactcctggattcattaattttttaagggttttttgtgtctctatttccttcagttctgctctgatcttagttatttcttgccttctgctagcttttgaatgtgtttgctcttgctgttctagttcttttacttgtgatgttagggtgtcaattttagatcttttctgctttctcttgtggggatttagtgctataaatttccctctacacactgctttgaatgcgtcccagagattctggtatgttgtgtctttgttctcgttggtttcaaagaatatctttatttatgccttcacttcattatttacccagtagtcattcaggagcaggttgttcagttaccatgtagttgagcggttttgagtgagtttcttaatcctgagttctagtttgattgcactgtggtctgagagacagtttgctataatttctgttcttttacatttgctgaggagtgctttacttacaactatgtggtcagttttggagtaggtgtggtgtggtgctgaaaagaatgtatattctgttgatttggggtggagagttctgtagatgtctattaggtctgcttggtgcagagctgagttcaattcctggatatccctgttaactttctgtctcgttgacctgtctaatgttgacagtggggtgttaaagtctcccattattattgtgtgataataatcacttattatccttaggtccttagtccttaggtcactaaggacttgctttatgaatctgggtgctcctgtattgggtgcatatatatttaggatagttagctcttcctgttgaattgatccctttaccattatgtaatggccttctttgtctcttttgatctttgttggtttaaagtctgttttatcagagtctaggattgcaacccctgcctttttttgttttccatttgcttggtagatcttcctccatccttttattttgagcctatgtgtgtctgtgcacgtgagatgggtctcctgaatacagcacactgatgggtcttgactctttatccaatttgccagtctgtgtcttttaattggagcatttagcccatttacatttaaagttaatattgttattatgtgtgaatttgatcctgtcattatgatgttagctggttattttgctcattagttgatgcagtctcttcctagcctcgatggtctttacaatttggcatgtttttgcagtggctggtaccggttattcctttccatgtttagtgcttccttcatgagctcttttagggtaggcctggtggtgacaaaatctctcagcatttgcttgtctgtaaaggattttatttctccttcacttatgaagcttagtttggctggatatgaaattctgggttgaaaattcttttctttaagaatgttgaatattggtccccactctcttctggcttgtagagtttctgctgagagatcagctgttagtctgatgggcttccctttgtgggtaacccgacctttctctctggctgcccttaacattttttccttcatttcaactttggtgaatctgacaattatgtgtcttggagttgctcttctcgag

SEQ ID NO: 12091 - DNA, 2471 bp, Homo sapiens
  misc_feature (4)..(4): n equals a,t,g, or c
cctntatcgggtgcatatatatttaggatagttagctgttcttgttgaattgatccctttaccattatgtaatggccttctttgtctcttttgatctttgttggtttaaagtctgttttagcagagactaggattgcaacccctgcctttttttgttttccatttgcttcgtagatcttcctccatccctttattttgagcctatgtgtgtctctgcacatgagatgggtttcctgaatacagcacactgatgggtcttgactctttatccaatttgccagtctgtgtcttttaattggggcatttagtccatttacatttaaggttaatattgttatgtgtgaatttcatcctgtcattatgatgttagctggttattttgctcgttagttgatgcagtttcttcctagcctcgatggtctttacaatttggcatgattttgcagtggctggtaccagttgttcctttccacgtttagtgcttccttcaggagctcttttagggcaggcctggtggtgacaaaatctctcagcatttgcttgtctgtaaagtattttatttctccttcacttatgaagcttagtttggctggatatgaaattctaggttgaaaattcttttctttaagaatgttgaatattggcccccactctcctctggcttgtagagtttctgccgagagatccgctgttagtctgatgggcttccctttgtgggtaagctgacctttctctctggctgcccttaacattttttccttcatttcaactttggtgaatctgacaattatgtgtcttggagttgctcttctcgaggagtatctttgtggcattctctgtatttcctgaatctgaatgttggcctgccttgctagattggggaagttctcctggatagtatcttgcagagtgttttccaacttggttccattctccctgtcactttcaggtacaccaatcagacgtagatttggtcttttcacatagtcccatatttcttggaggctttgttcgtttctttttattcttttttctctaaacttcccttctcgcttcatttcattcatttcatcttccattgctgataccctttcttccagttgatcatatcggctcctgaggcttctgcattcttcacgtagttctcgagccttggctttcagctccatcagctcctttaagcacttctctgtattggttattctagttatacattcatctaaatttttttcaaagtttttaacttctttgcctttggtttgaatttcctcctgtagctcggagtagtttgatcctctgaagccttcttctctcaactcgtcaaagtcattctctgtccagctttgttccgttgctggtgaggaactgcattcctttggaggaggagaggggctctgctttttagagtttccagtttttctgctctgtttttttcccatctttgtggttttatctacttttggtatttgatgatggtgatgtacagatgggtttttggtgtggatgtcctttctgtttgttagttttccttctaacagacaggaccctcagctgcaggtctgttggagtttgctagaggtccactccagactctgtttgcctgggtatccgcagcggtggctgcagaacagcggattttcgtgaactgtgaatgctgctgtctgatcgttcctctggaagttttgtctcagagtagtacccagctgtgtgaggtgtcagtctgcccctgctgagggttgcctcccagttaggctgcttgggggtcaggggtcagggacccacttgaggaggcagtctgcccattctcagatttccagctgcgtgctgggagaaccactgctctcttcaaagctgtcagacagggacatttaagtctgcagaggttattgctgtctttttgtttgtctgtgccctgcccccagaggtggagcctacagaggcaggcaggcctccttgagctgtggtgggctccacccagttcgaacttcccggctgctttgtttacctaagcaagcctgggcaatggggggcgcccctcccccagcctcgctgccaccttgcagtttgatctcagactactgtgctagcaatcagcaagactccatgggcgtaggaccctccgagccaggtgcgggatataatctcctggtgtgccgttttttaagcccgttggaaaagcgcagtattagggtgggagtgacccgattttccaggtgctgtctgtcacccctttctttgactaggaaagggaactccctgaacccttgcacttcccgagtgaggcaatgccttgccctgctttggctcgcgcacggtgcactacacccactgtcctgcgcccactgtctggcactccctagggagatgaacccggtacctcagatggaaatgcagaaatcacccgtcttctgcgtcgctcacgctgggagctgtagaccagagctgttcctattcggccatcttggctgccc

SEQ ID NO: 12092 - DNA, 670 bp, Homo sapiens
caacccctgcctttttttgttttccatttgcttggtagatcttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttgctcgttagttgatgcaatttcttcctagtctcgatggtctttacattttggcatgattttgcagcggctggtaccagttgttcctttccatgtttagtgcttccttcaggagctcttttagggcaggcctggtggtgacaaaatctctcagcatttgcttgtctgtaaaggattttatttctccttcacttatgaagcttagtttggctggatatgaaattctgggttgaaaattttttctttaagatgttgaatattgggccctactctcttctggcttgtagggtttctgccgagagatctgctgttagtctgaatggcttccccttgagggtaaccgacctttctctctggcggcccttaacatttttcctttatttcacttttgggaaactgacaaaatgtgttttggagtgctcttctc

SEQ ID NO: 12093 - DNA, 2216 bp, Homo sapiens
cacgatgatcctggcctcataaaatgagttagggaggattccctctttttctattgattggaatagtttcagaaggaatggtaccagctcctgcttgtacctctggtagaattcggctgtgaatccatctggccctgggcttttttttggttggtaggctattaattattgcctcaatttcagagcctgttattggtctattcagggattcaacttcttcctagtttagtcttgggagggtgtatgtgtccaggaatttatccatttcttctagattttctagtttatttgcatagaggtgtttatagtattctctgatggtagtttgtatttctgtaggatcggtggcgatatctcctttatcattttttattgcatctatttgattcttctctcttttcttattagtcttgctagcggtctatcaattttgttgatctttacaaaaacccagctcctggattcattgatttttttgaagggttttttgtatctctatttccttccattctgctctgatcttagttatttcttgccttctgctagcttttgaatttgttttctcttgcttctctagttcttttaattgtgatgttagggcgtcaattttagatctttcctgctttctcttgtgggcatttagtgctataaatttccctctacacactactttaaatgtgtcccagagattctggtatgttgtgtctttgttctcattggtttcaaataacatctttatttctgccttcattttgttatgtacccagtagtcattcaggagcaggttgttcagtttccatgtagtcaagtggttttgagtgagtttcttaatcctgagttctagtttgattgcactgtggtctgagacaagtttgttataatttctgttattttacatttgctgaggagtgctttacttccaagtatgtggtcaattttggaataagtgcgatgtgatgctgagaagaatgtatattctgttgatttggggtggagagttctgtagatgtctattatgtccgcttggtgcagagctgagttcaattcctggatatccttgttaactttgtctcgttgatctgtctaatgttgacagtggggtgttaaagtctcccattattattgtgtgggagtctaagtctctttgtaggtccctaaggacttgctttatgaatctgggtgctcctgtattgagtgcatatatatttaggatagttagctattcttgttgaattgatccctttaccattatgtaatggccttgtctcttttcatctttgttggtttaaagtctgttttatcagagactaggattgcaacccctgccttttttttgttttccacttgcttggtagatctttctccatccctttattttaagcctatgtgtgtctccgcacatgatatgggtctcctgaatacagcacactgatgggtcttgactctttatccaatttgccagactgtgtcttttaattggagcatttagcccatttacatttaaggttaatattgttatgtgtgaatttgatcctgtcattatgatgttagctggttattttactcattagttgatgcagtttcttcctagcatcgatggtctttacaatttggcatgtttttgcagtggctggtactggttgttcctttccatgtttagtgcttccttcaggagctcttgtagggcaggcctggtggtgacaaaatctctcagcatttgcttgtctctaaaggattttatttctccttcacttatgaagcttagtttggctggatatgaaattctgggttgaaaattcttttctttaagaatgttgaatattggcccccactctcttctggtttgcggagtttctgccgagaaatccactgttagtctgatgggcttcactttgtggataacctgacctttctctctggctgcccttaacattttttccttcatttcaactttggtgaatctggcaattatgtgtcttggagttgctcttctcgaggagtatctttgtggcattgtctgtatttcctgaatttgaatgttggcctgccttgctaggttggggaagttctcctggataatatcctgcagagtgttttccaacttggttccattctccccatcactttcaggtacaccaatcagacatagatttggtcttttcacatagtcccatatttcttggaggttgtgtttgtttctttttacttttttctct

SEQ ID NO: 12094 - DNA, 5015 bp, Homo sapiens
gtctaatgtttaagtctttaatccatcttgaattaatttttgtataaggtgtaaggaagggatccagtttcagctttctacatatggctagccagttttcccagcaccatttattaaatagggaatcctttccccattgctttttttctcaggtttgtcaaagatcagatagttgtagatatacggcgttatttctgagggctctgttctgttccattgatctatatctctgttttggtaccagtaccatgctgttttggttactgtagccttgtagtatagtttgaagtcaggtagcgtgatgcctccagctttgttcttttggcttaggattgacttggtgatgtgggctcttttttggttccatatgaactttaaagtagttttttccaattctgtgaagaaagtcattggtagcttgatgggggtggcattgaatctgtaaattaccttgggcagcatggccattttcatgatattgattcttcctacccatgagcatgaaatgttcttccatttgtttgtatcctcttttatttcatcgagcagtggtttgtagttctccttgaagaggtccttcacgtcccttgtaagttggattcctaggtattttattctctttgaagcaattgtgaatgggagttcactcatgatttggctctctgtttgtctgttattggtgtataagaatgcttatgatttttgtacattgattttgtatcctgagactttgctgaagttgcttatgagcttaaggagattttgggctgagacaatggggttttctagatatacaatcatgtcatctgcaaacagggacaatttgtcttcctcttttcctaattgaataccctttatttccttctcctgcctaattgccctggccagaacttccaacactatgttgaataggagtggtgagagagggcatccctgtcttgtgcccgttttcaaagggaatgcttccagtttttgcccattcagtatgatattggctgtgggtttgtcatagatagctcttattattttgagatatgtcccatcaatacctaatttattgagagtttttagcatgaagggttgttgaattttgtcaaaggccttttctgcatctattgagataatcatgtgatttttgtctttcgttctgtttacatgctggattacatttattgatttatgtatattgaaccagccttgcatcccagggatgaagcccacttgatcatggtggataagctttttgatgtgctgctggatttggtttgccagtattttattgaggatttttgcatcaatgttcttcaaggatattggtctaaaattctcttttttggttgtgtctctgcctggctttggtatcaggataatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattatttccacaatttcagagcctgttactgatctgttcagagatccaacttcttcctggtttagtcttgggagggtgtatgtgtcgaggaatttatccatttctcctagattttctagtttatttgcgtagagctgtttgtagtattctctgatggtagtttgtatttctgtgggatcggtggtgatatcccctttatcattttttattgcgtctatttgattcttctctcttttcttctttattaatcttgctagcgttctatcaattttgttgatcctttcaaaaaaacagctcctggattcattaatttttgaagggtttttttgtgtctctaattccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgagtgtgtcccagagattctggtatgttgtgtctttattctcgttggtttcaaagaacatctttatttctgccttcatttcgttttgtacccatagtcgttcaggagcaggttgttcagtttccatgtaattgagcggttttgagtgagtttcttaatcctgagttctagtttgattgcattgtggtctgagagacagtttgttataatttctgttcttttacatttgctgaggagagctttacttccaactatgtggtcaattttggaataggtgtggtgtggtgctgaaaagaatgtatattctgttgatttggggcggagagttctgtagatgtctattaggtctgcttggagcagagctgagttcaattcctaggtatccttgttaactttctgtctcgttgatctgtctaatgttgacggggtgttaaagtctcccattattattgtgtgggagtctaagtctctttgtaggtcactcaggacttgctttatgaatctgggtgctcctgtgttgggtgcatatgtatttaggatagttagctcttcttgttgaattgatccctttaccattatgtaatggccttctttgtctcttttgatctttgttggtttaaagtctgttttatcagagactaggattgcaacccctgccttttttttttccatttgcttggtagatcttcctccatccttttattttgagcctatgtgtgtctctgcatgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttgctcgttagttgatgcagtttcttcctagcctcgatggtctttacaatttggcatgtttttgcagtggctagtaccggttgttcctttccatgtttagtgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgtcaaatattggcccccactctcttctggcttgtagagtttctgccgagagatccgcttttagtctgatgggcttccctttgtgggtaacctgacctttctctctggctgcccttaacattttttccttcatttcaactttggtgaatctgacaattatgtgtcttggagttgctcttcttgaggagtatctttgtggcgttctctgtatttcctgaatctgaatgttggcctgccttgctagattggggaagttctcctggataatatcctgcagagtattttccaacttggttccattctccccatcactttcaggtacaccaatcagacatagatttggtcttttcacatagtcccacatttcttggaggctttgttcatttctttttcttcttttttctctaaacttcccttcttgcttcatttcattcatttcatcttccatcactgatacccttacttccagttgatcacatcagctcctgaggcttctgcattcttcacgtagttcttgagccttggctttcagctccatcagctcctttacacacttctctgtattggttattctagttatacattcgtctaaatttttttcaaagttttcaacttctttgcctttggtttgaatttcctcctgtagctcggagtagtttgattgtctgaagccttcttctctcaactcgtcaaagtcattctctgtccagctttgttccgttgctggtgaggagctgcattcctttggaggaggagaggcgctctgctttttagagtttccagtttttctgctctgttttttccccatctttgtggttttatctacttttggtctttgatgatggtgatgtacagatgggtttttggtgtggatgtcctttctgtttgttagttttccttctaacagacaggaccctcagctgcaggtctattggagtttgctagaggtccactccagaccctctttgcctgggtaccagcagcggtggctgcagaacagcagattttcgtgaaccacaaatgctgctgtctgatcgttcctctggaagttttgtctcagaggagtacccggccgtgtgaggtgtcagtctgcccctactggagggtgcctcccagttaggctgctcgggggtcaggggtcagggacccacttgaggaggcagtctgcctgttctcagatctccagctgcgtgctgggagaaccactgctcccttcaaagatgtcagacagggacatttaagtctgcagtggttactgctgtctttttgtttgtctgtgccctgcccccagaggtggagcctacagaggcaggcaggcgtccttgagctgtggtgggctccacccagttcgagcttcccggctgctttgtttacctaagcaagcctgggcaatggtgggcgcccctcccccagccttgctgccgccttgcagtttgatctcagactgctgtgctaccaatcagcgagactccgtgggcataggaccctctgagccaggtgtgggatataatctcctgatgcgctgttttttaagcccgtcggaaaagcgcagtattggggtgggagtgacctgattttccaggtgccgtctgtcacccctttctttgactaggaaagggaactccctgaccccttgtgcttcccaagtgaggcaatgcctcgccctgcttcggctcgtgcacggtgcactgcacccactgtcctgcgcccactgtctggcactccctagtgagatgaacccagtacctcagatggaaatgcagaaatcacccatcttctgcgtcgctcacgctgggagctgtagactggagctgttcctattcagccatcttggctccc

SEQ ID NO: 12095 - DNA, 5017 bp, Homo sapiens
atctaatgttgacagtggggtgttaaaatctcccactattattgtgtgggagtctaagtctctttgtaggtctgtaaggacttgctttatgaatctgggtgctcctgtattgggtgcatatatatttaggatagttagctcttcttgttgaattgatccctttaccattacgtaatggccttctttgtctcttttgatctttgttggtttaaagtctgttttatcagagactaggattgcaactcctgccttttttgttttccatttgcttggtagctcttcctccatccctttattttgagcctatgtgtgtctctgcacatgagatgggtctcctgaatacagcacactgatgggtcttgactctttatccaatttgccagtctgtgtcttttattggagcatttagcccatttacatttaaggttaatattgttatgtgtgaatttgatcctgtcattatgaatttagctggttattttgctcgttagttgctgcagtttcttcctagcatcgatggtctttacaatttggcatgtttttgcagtggctggtaacagctgttcctttccatgtttagtgcttccttcaggatgtctcagcatttgcttgtctgtaaaggattttatttctccttcagttatgaagcttagtttggctggatatgaaattctgggttgaaaattcttttctttaagaatgttgaatatcggcccccactctcttctggcttatagagtttctgctgagagatcagctgttagtctgatgggcttccctttgtgggtaacccgacctttatctctggctgcccttaacattttttccttcatttcaactttggtgaatctgacaattatgtgttttggagttgctcttctcaaggagtatctttgtggtgctctctgtatttcctgaatttgaatgttggcctgccttgctaggttggggaagttctcctggataataacctgcagagtcttttccaacgtggttccattcttcctgtcactttcaggcacaccaatcagacgtagatttggtcttttcacatagtcccatatttcttggaggctttgttcatttctttttactcttttttctctaaacttctcttctcgcttcatttcattcatttgatcttcaatcactgataccctttcttccagttgatcaaattggctactgaagcttatgtgttcatcacatagttctcgtgccatggttttctgctccatcgggtcatttaaggacttctctacaatggttattctagttagccattcgtctaatcttttttcaaggttttaacttctttgcgatgtgttcgaacttcctcctttagctcggagaagtttgatcgtctgaagccttcttctctcaactcatcaaagtcattctctgtccagctttgttccttgctggagaggagctgcgttcctttggagggggagaggcgctctgatcaacattagacagatcaacgagacagaaagttaaaaaggatatccaggaattgaactcaactctgcaccaagtggacctaatagacatctacagaactctacaccccaaatcaacaaaatatacattcttctcagcaccacatcgcagttattccaaaactaaccacatagttggaagtaaagcactcctcaacagaaattataacaaactgtctctcagaccacagtgtaatcaaactagaactcaggattaagaaactcactcaaaaccactcaactacatggaaactgaacaacctgctcctgaatgactactgggtacataatgaaatgaaggcaaaaataaagatgttctttgaaaccagtgagaacaaagacacaacaaaccagcatctctgggacacattcaaagcagtatgtggagggaaatttatagcactaaatgcccacaagagaaagcaggaaagatctaaaattgacaccctacatcacaatgaaaagaactagagaagcaagagcaaacacattcaaaagctagcagaaggcaagaaataactaaaatcagagcagaactgaaggagatagagacacaaaagacccttcaaaaaatcaatgaatccaggagctggttttttgaaaagattaacaaaattgatagaccacacagcaagactaaaaaagaagaaaagaaagaagaatcaaatagacgcaataatgataaaggggatatcaccaccaatcccacagaaatacaaattaccatcagagaatactataaacacctctacgcaaataaactagaaaatctagaagaaatggataaattcctggacacatacaccctcccaagactaaaccaggaagaagttgaatccctgaatagacccataacagggtctgaaattgaggcaatcattaatagcctaccaaccaaaaaaagtccaggaccagacggattcacagccgaattctaccagaggtacaaggaggagctggtaccattccttctgaaactattccaatcaaaagaaaaagagggaatcctccctaactcattttatgaggccagcatcatcctgataccaaaggctggcaaaaacacaacaaaaaaagagaattttagaccaatatccttgatgaacatcaatgcaaaaatcctcaataaaatactggcaaaccaaatccagcagcacatcaaaaagcttatccaccatgatcaagtgggcttcatccctgggatgcaaggctggctcaacatatgcaaatcaataaatgtaatccagcatataaacaaaaccaaagacaaaaaccacatgattatctcaatagatgcagaaaaggcctttgacaaaattcaacagcccttcatgctaaaaactctcaataaattaggtattgatgggacgtatctcaaaataataagagctatttatgacaaacccacagccaatatcatactgaatgggcaaaaactggaagcattccctttgaaaactggcacaagacagggatgccctctctcaccactcctattcaacatagtgttggaagttctggccagggcaatcaggcaggagagagaaataaagggtattcaattaggaagagaggaagtcaaattgtctgtttgcagatgacatgattgtatatttagaaaaccccattgtctcagccccaaatctccttaagctgataagcaacttcagcaaagtctcaggatacaaaatcaatgtgcaaaaatcacaagcattcttatacaccaataacagaaaaacagagagctccattcacaactgcttcaaagagaataaaatacctaggaatccaacttacaagggatatgaaggacctcttgaaggagaactacaaaccactgctcaatgaaataaaagaggacacaaacaaatggaagaacattccatgctcatgggtaggacgaatcaatgtcatgaaaatggccatactgcccgaggtaatttctagattcaatgccatccccatcaagctaccaatgactttcttcacagaattggaaaaaactactttaaagttcatatggaaccaaaagagagccctcatagccaagacaacccaaaagaacaaagctggatgcatcacactacctgacttcaaactatattacaaggtgacagtaaccaaaacagcatggtactggtaccaaaacagagatgtagaccaatggtacagaacagagttctcagaaataataccacacatctacaactatctgatctttgacaaacctgacaaaaacaagaaatggggaaaggattccctgtttaataaatggtgctgggaaaactggctagccatatgtaggaagctgaaactagatcccttccttacaccttatacagaaattaattcaagatggattaaagacttaaatgttagacctaaaaccataaaaaccctagaagaaaacctaggcaataccattcaggacataggcatgggcaaggacttcatgtctaaaacaccaaaagctatggcaataaaagccaaaattgacaaatgggatctaattaaactaaagagcttctgcacagcaaaagaaaccaccatcagagtgaacaggcaacctacaaaatgggagaaaatttttgcaatttactcatctgacaaagggctaatatccagaatctacaaagaactcaaacaaatttacaagaaaagaaccaccccatcaacaagtgggcgaaggatatgaacagacacttctcaaaagaagacatttatgcagccaacagacacatgaaaaaatgcttatcatcactggccatcagagaaatgcaaatcaaaaccacaatgagataccatctcataccagttagaatggcgatcattaaacagtcaggaaacaacaggtgctggagaggatgtggagaaataggaacacttttacactgttggtgggactgtaaactagttcaaccatcgtggaagacagtgtggcgattcctcaaggatctagaactagaaataccatttgacccagccatcccattactgggtatatgcccaaaggattataaatcatgctgctataaagacacatgcacacatatgttcattgcggcactattcacaatagcaaagacttggaaccaacccaaatgtccatcaatgatagactggattaagaaaatgtgacagatatacaccatggaatactatgcagccataaaaaaggatgagttcatgtcctttgtagggacatggatgaagctggaaaccatcattctcagcaaactatcgcaaggacaaaaaaccaaacaccgcatgttctcactcatatgtgggaattgaacaatgagaatacttggacacaggaaggggaacatcacacaccagggcctgtcgtggggtagggggaagggggagggatagcattaggagatatacctaatgaaaatgacgagttaatgggtgcagcacaccaacatggcatgtatatacatatgtaacaaacctgcacgttatgcacatgtaccctagaacttaaagtataaaaaaaaaaaagaatctca

SEQ ID NO: 12096 - DNA, 4429 bp, Homo sapiens
ggccattttcacgatattgattcttcctacccatgagcctggaatgttcttccatttctttgtatcctcttttatttccttgagcagtgatttgtagttctccttgaagaggtccttcacatcctttgtaagttggattcctaggtattttattctctttgaagcaattgtgaatgggagttcactcatgatttggctctctgtttgtctgttattggtgtataagaatgcttgtgatatttggacattgattttgtatactgagactttgctgaggtcgcttatcagcttaaggagattttgggctgagacaatggggttttctagatatataatcatatcgtctgcaaacagggacaatttgacttcctcttttcctaattgaataccctttatttccttctcttgcctaattgccctgggccagaacttccaacactatgttgaataggagtggtaagagagggcatccctgtcttgtgccacgtttcaaagggaatgtttccagtttttgcccattcagtatgatattggctgtgggtttgtcatagatagctcttattattttgagatatgtcccatcaacacctaatttattgagagtttttagcatgaagggttgttgaattttgtcaaaggctttttctgcatctattgagataatcatgttgtttttgtctttggctctgtttatatgctggattacatttattgatttgcatatattgaaccagccttgcataccagggatgaagcccccttgatcatggtggataagctttttgatgtgctgctggattcgttttgccagtattttattgaggatttttgtatcaatgttcatcaaggacattggtctaaaattttctttgttcgttgtgtctctgcccagctttggtatcaggatgatgctggcctcataaaatgagttagggaggattccctctttttctattgattggaatagtttcagaaggaatggtaccagttcctccttgtacctctggtagaattcagctgtgaatccatctggtcctggactctttttggttggtaaactattgattattgccacaatttcagatcctgttattggtctattcagagattcaacttctccctggttttgtcttgggagagtgtatgtgttgaggaatttatccatttcttccagattttctagtttatttgcgtagaggtgtttgtagtattctctgatggtagtttgtatttctgtgggatcagtggtgatatcccctttatcattttttattgtgtctatttgattcttctctctttttttctttattagtcttgtagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtgaagtttggatctttcctgctttctcttgtgggcatttagtgctataaatttccctctacacactgctttgaatgtgtcccagagattctggtatggtgtgtctttgttctcattggtttcaaacaacatctttatttctgccttcatttcattatgtacccattagtcattcaggagcaggttgttcagtttccatgtagttgagcagttttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattgctgggtatccttgttgactttctgtctcgttgatctgtctaacattgacagtggggtgttaaagactcgcattattaatgtgtgggagtcgaagtctctttgtaggtcactaagcacttgctttatgaatctgggtgctcctgtattgggtgcatatatatttcggatagttagctcttcttcttgaattgatccttttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttgctcgttagttgatgcagtttcttcctagtctcgatggtctttacattttggcatgattttgcagcggctggtaccagtttttcctttccatgtttagcgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctctaagaatgttgaatattggcccccactctcttctggcttgtagggtttctgccaagaaatccgctgttagtctgatgggcttccctttgagggtaagccgacctttctccctggctgcccttaacattttttccttcatttcaactttggtgaatctgacaattatgtgtcttggagttgctcttctcgaggagtaactttgtggcattctctgtatttcctgaatctgaacattggcctgccttgctagattggggaagttctcctggataatatcctgcagagtgttttccaacttggttccattctccccatcactttcaggtacaccaatcagatgtagatttggtcttttcacatagtcccatatttcttggaggctttgctcatttctttttattcttttttctctaaacttcccttctcgcttcatttcattcatttcatcttccattgctgataccctttcttccagttgattgcatcggctcctgaggcttctgcattcttcacgtagttctcgagccttggttttcagctccatcagctcctttaagcacttctctgtattggttattctagttatacattcttctaaatttttttcaaagttttcaacttctctgcctttggtttaaatgtcctcccatagctcagagttaatttgatcgtctgaatccttcttctctcagctcgtcaaagtcattctccatccagctttgttccattgctggtgaggaactgcgttcctttggaggaggagaggtgctctgctttttagagtttccagtttttctgttctgttttttccccatctttgtggttttatctacttttggtctttgatgatggtgatgtacagatgggtttttggtgtggatgtcctttctgtttgttagttttccttctaacatacaggaccctcagctgcaggtctgttggaataccctgccgtgtgaagttcagtgtgcccctgctggggggtgcctcccagttaggctgctcgggggtcaggggtcagggacctacttgaggaggcagtctgccctttctcagatctccagctgggtgcttggagaaccactactctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcctggctgctttgtttacctaagcaagcctgggcaatggtgggcgcccctcccccagcctcgctaccgccttgcagtttgatctcagactgctgtgctagcaatcagtgagactccgtgtgtgtaggaccctcccagccaggtgcaggatataatctcgtggtgcaccggtttttaagccggtcagaaaagcgcagtattctggtgggagtgacccgattttccaggtgcgtccgtcacccctttctttgactgggaaagggaactccctgaccccttgagcttcccaagtgaggcaatgcctcgccctgcttcggctcgcacatggtgcacacacccactgacctgcacccactgtctggcactccctagtgagatgaacctggtacctcagatgcaaatgcagaaatcacccgtcttctgcgtcgctcacgctgggagctgtagaccggagctgttcctattcggccatcttggctcct

SEQ ID NO: 12097 - DNA, 2526 bp, Homo sapiens
  misc_feature (1976)..(1976): n equals a,t,g, or c
ctgtatatgtctattaggtccacttggtgcagagctgagttcaattcctgggtatccttgttgactttctgtctcgttgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttaccgttatgtaatggccttctttgtctcttttgatctttgttagtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttgctcgttagttgatgcagtttcttcctagtctcgatggtctttacattttggcatgattttgcagcggctggtaccggttgttcctttccatgtttagtgcttccttcagaagctcttgtaaggcaggcctggtggtgacaaaatctctcagcatttgcttgtctgtaaaggattttatttctccttcacttatgaagcttagtttggctggatatgaaattctgggttgaaaattcttttctttaagaatgttgaatattggcccccactctcttctggcttgtagggtttctgccgagagatccgctgttagtctgatgggcttccctttgagggtaacccgacctttctctctggctgcccttaacattttttcctacatttcaactttggtgaatctgacaattatgtgtcttggagttgctcttctcgaggagtatctctgtggcgttctctgtatttcctgaatctgaacgttggcctgccttgctagattggggaagttctcctggataatatcctgcagagtgttttccaacttggttccattctccccatcactttcaggtacaccaatcagacgtagatttggtcttttcacatagtcccatatttcttggaggctttgctcatttctttttattcttttttctgtaaacttcccttctctcttcatttcattcatttcatcttccattgctgataccctttcttccagttgattgcatcggctcctgaggcttctgcattcttcacgtagttctcgagccttggttttcagctccgtcagctcctttaagcacttctctgtattggttattctagttatacattcttctaaatttttttcaaagttttcaacttctttgcgtttggtttgaatgtcctcccgtagctcagagtaagttgatcgtctgaaaccttcttctctcagctcctcaaagtcattctccatccagctttgttccgttgctgatgaggaactgcattcctttggaggaggagagtcactctgctttttagagtttccagttcttctgttctgtgttttccccatctttgtggttttatctacttttggtctttgatgatggtgatgtacagatgggtttttggtgtggatgtcctttctgtttgttagttttccttctaacagagaggaccctcagctgcaggtctgttggaataccctgccttgtgaggtgtcagtgtacccctgctggggggtgcctcccagttaggctgctcaggggtcaggggtcaaggacccacttgaggaggcagtctgcccgttctcagatctccagctgcgtgctgggagaaccactgctctcttcaaagctgtcggacagggacatttaagtctgtagaggttactgctgtctttttgtttgtctgtgccctgccnccagaggtggagcctacagaggcaggcaggcctccttgagctgtggtgggctccacccagttcgagcttacaggctgctttgtttacctaagcaagcctgggcaatgtctgtcgcccctcccccagcctcgctgccgccttgcagtttgatctcagactgctgtgctagcaatcagcgagactccgtgggcgtaggaccctccgagccaggtgcgggacataatctcgtggtgcgccgttttttacgccggtccgaaaagcgcaatattcgggtgggagtgacccgattttccaggtgagtccgtcacccctttctttgactcggaatgggaactccctgaccccttgcgcttcccgagtgaggcaatgcctcgccctgcttcggctcgcgcacggtgcgcgcacccactgacctgcgcccactgtctggcactccctagtgagatgaacccggtacctcagatggaaatgcagaaatcacccgtcttctgcgtcgctcacactgggagctgtagaccggagctgttcctattcggccatcttggctcct

SEQ ID NO: 12098 - DNA, 666 bp, Homo sapiens
ttttgttttccatttgcttagtagagcttcctccatccctttattttgagcctatgtgtgtctctgcacgtgagatgggtttcctgaatacagcacactgatgggtcttgactctttatccaatttgccggtctgtgtcttttaattggagcatttagcccatttacatttaaggttaatattgttatgtgtgaatttggtcctgtcattatgatgttagctggttattttgctcgttagttgatgcagtttcttcctagccttgatggtctttacaatttggcatgattttgcagtggctggtagcggttgttcctttccatgtttagtgcttccttcaggagctcttttagggcaggcctggtggtgacaaaatctctcagcatttgcttgtctgtaaagtatttttatttctccttcacttatgaagcttagtttggctggatatgaaattctgggttgaaaattgttttattaaaaatgttgaatattgtcccctactctcttctggcttgtagagtttctgccgagagatccgctgttagtctgatgggcttccctttgtgggtaacccaacctttctctctggctgcccttaacattttttccttcatttcaactttggtgaatctgacaattatgtgtcttggggttgctcttctcaag

SEQ ID NO: 12099 - DNA, 2940 bp, Homo sapiens
ggccattttcacgatattgattcttcctacccatgagcatggaatgttcttccatttgtttgtatcctcttttatttccttgagcagtggtttgtagttctccttggagaggtccttcacatcccttgtaagttggattcctaggtattttattctctttgaagcaattgtgaatgggagttcactcatgatttggctctctgtttgtctgttgttggtgtataagaatgcttgtgatttttgtacattgactttgtatcctgagactttgctgaagttgcttatcagcttaaggagattttgggctgagacaatggggttttctagatatacaattatgttgtctgcaaagagggacaatttgacttcctcttttcctaattgaataccctttatttccttctcctgcctaattgccctggccagaacttccaacactgtgttgaataggagtggtgagagagggcatccctgtcttgtgccagttttcaaagggaatgcttccagtttctgcccattcagtatgatattggctgtgggtttgtcatagatagctcttattattttgaaatacgtcccatcaatacctaatttactgagagtttttagcatggagggttgttgaattttgtcaaaggctttttctgcatctgttgagataatcatgtggtttttgtctttggctctgtttatatgctggattacatttattgatttgcgtatattgaaccagccttgcatcccagggatgaagcccacttgatcatggtggataagctttttgatgtgctgctggattcgttttgtcagtattttattgaggatttttgcatcaatgttcatcaaagatatgggtctaaaattctctttttttgctgtgtctctgcctggctttggtatcagaatgatgctggcctcataaaatgagttagggaggattccctctttttctattgattggaatagtttcagaaggaatggtactagttcctccttgtacctctggtagaattcggctgtgaatccatctggtcctggactctttttggttggtaagctattgattattgccacaatttcagctcctgttattggtctattcagagattcaacttcttcctggtttagtcttcagagagtgtatgtgtccaggaatttatccatttcttctagattttctagtttatttgcatagagatgtttgtagtattctctgatggtagtttgtatttctgtgggatcggtggtgatatcccctttatcattttttattgcatctattcgattcttctttttttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacaaactgctttgaatgcgtcccagagattctggtatgttgtgtctttgttctcgttggtttcaaagaacatctttatttctgccttcatttcgttgtgtacccagtagtcattcaggagcaggttgttcagtttccatgtagttgagcggttttgagtgagattcttaatcctgagttccagtttgattgcactgtggtctgagagatagtttgtataatttctgttcttttacatttgctgaggagagtttgtacttccaactatgtggtcattttggaataggtgtggtgtggtgctgaaaaaaatgtatattctgttgatttggggtggagagttctgtagatgtctattaggtccgcttggtgcagagctgagttcaattcctgggtatccttgttgactttctgtctcattgatctgtctaatgttgacagtggggtgttaaagtctcccattattaatgtgtgggagtctaagtctctttgtaggtcactcaggacttgctttatgaatcttggtgctcctgtattgggtgcatatatatttaggatagttagctcttcttgttgaattgatccctttaccattatttaatggccttctttgtctcttttgatctttgttggtttaaagtctgttttatccgagactaggattgcaacccctgccttttttttgttttccatttgcttggtagatcttcctccatccttttattttgagcctatgtgcgtctctgcacatgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttgctcgttagttgatgcagtttcttcctagtctcgatggtctttacattttggcatgattttgcagcagctggtaccggttgttcctttccatgtttagtgcttccttcaggagctcttgtaaggcaggcctggtggtgacaaaaatcccttcaggagctcttgtaaggcaggcctggtggtgacaaaatctctcagcatttgcttgtctgtaaaggattttatttctccttcacttatgaagcttagtttggctggatatgaaattctgggttgaaaattcttttctttaagaatgttgaatattggcccccactctcttctggcttgtagggtttctgccgagagatccgctgttagtctgatgggcttccctttgagggtaacctgacctttctctctggctgcccttaacattttttccttcatttcaactttggtgaatctgacaattatgtgtcttggagttgctcttc

SEQ ID NO: 12100 - DNA, 4532 bp, Homo sapiens
gtctaacgtttaagtctttaatgcctcttgaattaatttttgtataaggtgtaaggaagggatccagtttcagctttctacatatggctagccagttttcccagcaccatttattaaatagggaatcctttccccattgcttgtttttctcaggtttgtcaaagatcggatagttgtagatatgcggcattatttctgagggctctgttctgttccattgatctatatctctgttttggtaccagtaccatgctgttttggttactgtagccttgtagtatagtttgaagtcaggtagcgtgatgcctccagctttgttcttttggcttaggattgacttggtgatgcaggctcttttttggttccatatgaactttaaggtagttttttccaattctgtgaagaaagtcattggtagcttgatggggatggcattgaatctgtaaattaccttgggcattatggccattttcacgatattgattcttcctacctatgagcatggaatgttcttccatttgtttgtatcctcttttatttcattgagcagtggtttgtagttctccttgaagaagtccttcacatcccttgtaagttggattcctaggtattttattctctttgaagcaattgtgaatgggagttcactcattgtttggctccctgtttgtctgttattggtgtataagaatgcttgtgatttttgcacattgattttgtatcctgagactttgctgaagttgcttatcagcttaaggagatttggggctgagacagtggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttttgccagttttcaaagggaatgcttccagtttttgcccattcagtatgatatttgctgtgggtttgtcatagatagctcttattattttgagatacatcccatcaatacctaatttattgagagtttttagcatgaagcgttgttgaattttgtcaaaggccttttctgcatctattgagataatcatgtggtttttgtctttgattctgtttatatgctggattacatttattgatttgcatatattgaaccagccttgcatcccagggatgaagcccacttgatcatggtggataagctttttgatgtactgctggattcagtttgccagtattttattgaggatttttgcatcaatgttcatcaaggatattggtctaaaattctcttttttggttgtgtctctgcccagctttggtatcaggatgatgctggcctcattaaatgagttagggaggattccgtctttttctattgattggaatagtttcagaaggaatggtaccagttcctccttgtacctctggtagaattcggctgtgagtccatctggtcctggcctctttttggttggtaagctattgatcattgccacaattttagagcctgttattggtctattcagagattcaacttcttcctggtttagtcttgggagggtgtatgtgtcgaggaatttacccatttcttctagattttctagtttatttgcgtagaggtgtttgtagtattctctgatggttgtttgtatttctgtgggatcggtggtgatatcccctttatcattttttattgcgtctatttgattcttctctcttttcttctttattagtcttgctagcggtctatcaattttgttgatcctttcaaaaaaccagctcctggattcattcattttttgaagggttttttgtgtctctatttccttcagttctgctgtgattttagttatttcttgccttctgctagcttttgaatgtgtttgctcttgcttttctagttcttttaattgtgatgttagggtgtcaattttggatctttcctgctttctcttctgggcatttagtgctataaatttccctctacacactgctttgaatgcatcccagagattctggtatgttgtgtctttgttctcgttggtttcaaggaacatctttatttctgccttcatttcgtcatgtacccagtagtcattcaggagaaggtttttcagtttccatgtagttgatcggttttgagtgagtttcttaaacctgagttctagtttgattgcactgtggtctgagagacagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtccccttggtgcagagctgagttcaattactgggtatccttgttaactttctgtctcgttgatctgtctaatgttgacagtgggttgttaaagtctcccattattattgtgtgggagtctaagtctctttgtaggtcactcaggacttgctttatgaatctgggtgctcctgtattgggtgcgtatatatttaggatagttagctcttcttgttgaattgatccctttaccattatgtaatggccttctttgtctcttttgatctttgttagtttaaagtctgttttatcagagactaggaatgcaacccctgcctttttttgttttccatttgcttggtagaccttcctccatccttttattttgagcctatgtgtgtctctgcacatgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttgctcgttagttgatgcagtttcttcctagcctcaatggtctttacaatttggcatgattttgcagcggctggtaccagttgttcctttccatgtttagtgcgtccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagagtttctgccgagagatccgctgttagtctgattggcttccctttgtggttaacccgacctttctctctggctgcccttaacattttttcctttatttcaactttggtgaatctgccaattatgtgtcttggagttgctcttctcaaggagtatctttgtggcgttctctgtatttcctgaatctgaatgttggcctgccttgctagattggggaagttctcctggataatatcctgcagagtgttttccaacttggttccattctccacgtcactttcaagtacaccaatcagatgtagatttggtcttttcgcatagtcctatatttcttggaggctttattagtttctttttattcttttttctctaaacttcccttctcgcttcatttcattcatttcatcttccatcactgataccctttcttccagttgatcgcatgggctcctgaggcttctgcgttcttcacgtagttctcgagccttggctttcagctccatcagctcctttaagcacctctctgtattggttattctagttatacattcgtctaaatttttttcaaagttttcaacttctttgcctttggtttgaatttcctcctgtagcttggagtagttttatcgtctgaagccttcttctctcaactcatcagtcattctccgtccagctttgttccgttgctggtaaggagctgcgttcctttggaggaggagaggcactctgctttttagagtttccagtttttctgctctgttttttccccatctttgtggttttatctacttttggtctttgatgatggtgatgtacagatgggtttttggtgtggatgtcctttctgtttgttagttttccttctaacagacaggaccctcagctgcaggtctgctggagtttgctagaggtccactccagaccctgtttgcctgggtactagcagcggtggctgcagaacagtggattttcgtgaaccatcaatgctgctgtctgatcgttcctctggaagttttgtctcagaggagtacccagccgtgtgaggtgtcagtctgcctttactggggggtgcctcccagttaggctgctcagtggtcaggggtcagggacccacttgaggaggcagtctgcctgttctcagatctccagctgcgtgctgggagaaccactgctctcttcaaagctgtcagacagggacatttaagtctgcagaggttactgctgtctgtttgtttgtctgtgcctgcccccagaggtggagcctacagagccgtcatgcctccttgagctgtgtggctccacccagttgagctt

SEQ ID NO: 12101 - DNA, 3290 bp, Homo sapiens
gaaagtcattggtagcttgatggggatggcattgaatctgtaaattaccttgggcagtatggccattttcacaatattgattcttcctacccatgagcatggaatattcttccatttgtttgtatcctcttttatttccttgagcagtggtttgtagttctccttgaagaggtccttcacatcccttgtaaattggattcctaggtattttattctctttgaagcaattgtgaatgggagttcactcatgatttggctctctgtctgttgttggtgtataagaatgcttgtgatttttgtacattgattttgtatcctgagactttgctgaagttgcttatcagcttaaggagattttgggctgagacaatggggttttctagatatacagtcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggccttttctgcatctattgagataatcatgtggtttttatctttggttctgtttatatgctggattacatttattgatttgcatatattgaaccaaccttgcatcccagggatgaagcccacttgatcatggtgaataagctttttgatgtgctgctggattaagtttgccagtattttattgaggatttttgcattgatgttcatcaaggatattggtctaaaattctcttttttggttgtgtctctgcccggctttggtatcaggatgatgctggcctcataaaatgagttagggaggattccctctttttctattgattggaatagtttcagaaggaatggtaccaattcttccttgtacctctggtagaattcggctgtgaatccatctagtattggactctttttgattggtaagctattgattattgccacaatttcagagcctgttattggtctattcagagattcaacttcttcctggtttagttttgggagggtgtatgtgtcgaggaatttatccatttcttctagattttctagtttatttgcatagaggtgtttgtagtattctctgatggtggtttgtatttctgtgggattggtggtgatatcccctttatcattttttattgcgtctatttgattcttctctcttttcttctttattaatcttgctagcagtctatcaattttgttgatcctttcaaaaaaccagctcctggattcattaattttttgaagggttttttgtgtctctatttccttcagttctgctctgattttagttatttcttgccttgtgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgactttgttctcattggtttcaaagaacatctttatttctgccttcatttcgttatgtacccagtagtcattcaggagcaggttgttcagtttccgtgtagttgagcagttttgagtgagtttcttaatcctgagttctagtttgattgcactgtggtctgagagacagtttgttataatttctgttcttttacatttgctgaggagagctttacttccaacgatgtggtcaattttggaataggtgtggtgtggtgctgaaaaaaatgtatattctgttgatttggggtggagagttctgtagatgtctattaggtctgcttggtgcagagccgagttcaattcctgggtatccttgttaactttctgttttgttgatctgtctatatgttgacagtggggtgctataggctcccattattattgtgtgggagtctaagtctctttctaggtcactcaggacttgccttatgaaactgggtgctcctgtattgggtgcatatatatttaggatagttagtccttcttgttgaattgatccctttaccattatgtaatggccttctttgtctcttttgatctttgctggtttaaagtctgttttatcagagactaggattgcaacccctgcctttctttgttttccatttgcttggtagatcttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattttgatgttagctggttattttgctcattagttgatgcagtttcttcctagcctcgatggtctttacaatttggcatgattttgcagtggctggtaccggttgttcctttccatgtttagtgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtacagtttctgctgagatatctgctgttagtctgatgggcttccctttgagggtaacctgacctttctctctggctgcccttaacattttttccttcatttcaacttcggtgaatctgacaattatgtgtcttggagttgctcttctcgaggagtatctttttggcattctctgtatttcctgaatctgaatgttggcctgccttgctagattggggcaattctcctggataatatcctgcagagtgttttccaacttggttccattctccctgtcactttcaggtacaccaatcagacgtagatttggtcttttcacatagtctcatatttcttggaggctttgttcgtttctttttatccttttttctctaaacttcccttcttgcttcatttccttcatttcatcttccatcactgataccctttcttccagttgatcgcatcagctcctgaggcttctgcattcttcacgtagtt

SEQ ID NO: 12102 - DNA, 3588 bp, Homo sapiens
gtctaatgtttaagtctttaatccatcttgaattaatttttgtataaggtgtaaggaagggatccagttttagctttctacatatggctagccagttttcccagcaccatttattaaatagggaatcctttccccattgcttgtttttctcaggtttgtcaaagatcagatagttgtagatatgcggcattatttctgagggctctgttctgttccattggtctatatctctgttttggtacaagtaccatgctgttttggttactgtagccttgtagtatagtttgaagtcaggtagcgtgatgcctccagcttttttcttttggcttaggattgacttggcaatgcgggcccttttttggttccatatgaactttaaaatagttttttccaattctgtgaagaaagtcattgatagcttgatgtggatggcattgaatctataaattaccttgggcagtatggccatttttacgatatagattctttctacccatgagcatggaatgttcttccatttgtttgtatcctcttttatttcattgagcagtggtttgtagttctccttgaaaagatcccttacatcccttgtaagttggattcctaggtattttattctctttgaagcaattgtgaatgagagttcactcatgatttggctctctgtttgtctgttattggtgtataagaatgcttgtgatttttgcacattgattttgtatcctgagacttcgctgaagttgcctatcagcttaaggagattttgggctgagacgatggggttttctagatatacaataatgtcatctgcaaacagggacgatttgacttcctcttttcctaattgaatgccctttatttccttctcctgactgattgccctggccagaacttccaacactatgttgaataggagtggtgagagagggcatcccagtcttgtgccagttttcaaagggaatgcttccagtttttctccattcagtatgatactggctgtggatttgtcatagatagctcttattattttgagatacgtcccatcaatacctaatttattgagagtttttagcatgaaggttgttgaattttgtcaaaggccttttctgcatctgttgagataatcatgtggtttttgtcgttggttctgtttatatgctggattacgtttattgatttgcgtatgttgaaccagccttgcatcccagggatgaagcccacttgatcatggtggataagctttttgatgtgttgctggattcggtttgctagtattttattgacgatttttgcatcgatcttcatcaaggatattggtctaagattctatttttttgttgtatctctgccaggctttggtatcaggatgatgctggcctcataaaatgagttagggaggattccctctttttctattgattggaatagtttcagaaggaatggtaccagctcctgcttgtacctctggtagaattcggttgtgaatctgtctggtcctggactttttttagttggtaagctattaattattgcctcaatttcagagcccgttattggtctattcagagattgaacttcttcctggtttagtcttgggagagtgtatgtgtcgaggaatttatccatttcttctagattttctagtttatttgcatagaggtgtttgtactattctctgatggtagtttgtatttctgtgggatcagcggtgatatcccctttgtcattttttattgcatctatttgattcttctctcttttcttctttattagtctcgctagcggtctatcaattttgttgatcttttcaaaaaaccagctcctggattcattgattttttgaagggttttttgtgtctctatttccttcagttctgctctgatcttagttattgtttgtcttctgctagcttttgaatgtgtttgctcttgcttctctagttcttttaattgtgatgttagggtgtcaattttaggtctttcctgctttctcttgtgggcatttagtgctataaacttccctctacacactgctttgaatgtgtcccagagattctggtatgttgtatctttgttcttgctggtttcaaagaacatctttatttctgccttcattttgttaggtacccaatagtcattcaggagcagattgttcagtttccatgtagttgagcagttttgagtgagtttcttaatcctgagttctagtttgattgccctgtggtctgagagacagtttgttataatttctgttcttttacatttgctgaggagtgctttacttccaactatgtggtcaattttggaataggtgtggtgtggtgctgaaaagaatgtatattctgttgatttggggtggagagttctgtagatgtctattaggtccacttggtacagagctgagttcaattcctggatatccttgttaactttctgtctcgttgatctgcctaatgttgacagtggggtgttaaagtctcccattattattgtgtgggagtctaagtctctttgtaggacactaagaacttgctttatgaatctgggtgctcctgtattgggtgcatatatatttaggatagttagttcttcttgttgaattgatccctttaccattatgtaatggccttctttgtctcttttgatctttgttggttgaaagtctgttttatccgagactacgattgcaacccctgcctttttttgttttccatttgcttggtagatcttcctccatccctttattttgagcctatgtgtgtctctgcacgtgagatgggtttcctgaatacagcacactgatgggtcttgactctttatccaatttgccagtctgtgccttttaattggagcatttagcccatttacatttaaggttagtattgttatgtgtgaatttgatcctgtcattatgatgttagctggttattttgctcattagttgatgcagtttcttcctagccttgatggtctttacaatttggcatgtttttgcagtggctggtactggttgttcctttccatgtttagtgcttccttcaggagctcttttagggcaggcctggtggtgataaaatctctcagcatttgcttgtctgtaaagtattttatttctccttcacttatgaagcttagtttggctggatatgaaattctgggttgaaaattcttttctttaagaatgttgaatattggccccccactctcttctggcttgtagagtttctgccaggagatccgctgttagtctgatgggattccctttgtgggtaacccgacctttctctctggctgctcttaacatttttcccttcatttcaactttggtgaatctgacaattatgtgtcttggagttgctcttctcgagaagtatctttgtggtgttctctgtatttcctgaatttgaatgttggcctgccttgctagattgaggaatttctcctggataatatcctgcagagtgttttccaacttggttccactctctccgtcattttcaggtacaccaattatacttagatttggtcttctcacatagacccatatttcttggaggctttttcatttctttttattcttttttctct

SEQ ID NO: 12103 - DNA, 4317 bp, Homo sapiens
gtctaacgtttaagtctttaatgcctcttgaattaatttttgtataaggtgtaaggaagggatccagtttcagctttctacatatggctagccagttttcccagcaccatttattaaatagggaatcctttccccattgcttgtttttctcaggtttgtcaaagatcggatagttgtagatatgcggcattatttctgagggctctgttctgttccattgatctatatctctgttttggtaccagtaccatgctgttttggttactgtagccttgtagtatagtttgaagtcaggtagcgtgatgcctccagctttgttcttttggcttaggattgacttggtgatgcaggctcttttttggttccatatgaactttaaggtagttttttccaattctgtgaagaaagtcattggtagcttgatggggatggcattgaatctgtaaattaccttgggcattatggccattttcacgatattgattcttcctacctatgagcatggaatgttcttccatttgtttgtatcctcttttatttcattgagcagtggtttgtagttctccttgaagaagtccttcacatcccttgtaagttggattcctaggtattttattctctttgaagcaattgtgaatgggagttcactcattgtttggctccctgtttgtctgttattggtgtataagaatgcttgtgatttttgcacattgattttgtatcctgagactttgctgaagttgcttatcagcttaaggagatttggggctgagacagtggggttttctagatatacaatcatgtcatctgcaaacagggacaatttgacttcctcttttcctaattgaataccctcttttcctaattgaataccctcctgcctaattgccctggccagaacttccaacactatgttgaataggagtggtgagagagggcatccctgtcttttgccagttttcaaagggaatgcttccagtttttgcccattcagtatgatatttgctgtgggtttgtcatagatagctcttattattttgagatacatcccatcaatacctaatttattgagagtttttagcatgaagggttgttgaattttgtcaaaggccttttctgcatctattgagataatcatgtggtttttgtctttgattctgtttatatgctggattacatttattgatttgcatatattgaaccagccttgcatcccagggatgaagcccacttgatcatggtggataagctttttgatgtactgctggattcggtttgccagtattttattgaggatttttgcatcaatgttcatcaaggatattggtctaaaattctcttttttggttgtgtctctgcccagctttggtatcaggatgatgctggcctcattaaatgagttagggaggattccgtctttttctattggttggaatagtttcagaaggaatggtaccagttcctccttgtacctctggtagaattcggctgtgagtccatctggtcctggcctctttttggttggtaagctattgatcattgccacaattttagagcctgttattggtctattcagagattcaacttcttcctggtttagtcttgggagggtgtatgtgtcgaggaatttacccatttcttctagattttctagtttatttgcgtagaggtgtttgtagtattctctgatggttgtttgtatttctgtgggatcggtggtgatatcccctttatcattttttattgcgtctatttgattcttctctcttttcttctttattagtcttgctagcggtctatcaattttgttgatcctttcaaaaaaccagctcctggattcattaattttttgaagggttttttgtgtctctatttccttcagttctgctgtgattttagttatttcttgccttctgctagcttttgaatgtgtttgctcttgcttttctagttcttttaattgtgatgttagggtgtcaattttggatctttcctgctttctcttctgggcatttagtgctataaatttccctctacacactgctttgaatgcatcccagagattctggtatgttgtgtctttgttctcgttggtttcaaggaacatctttatttctgccttcatttcgtcatgtacccagtagtcattcaggagaaggtttttcagtttccatgtagttgatcggttttgagtgagtttcttaaacctgagttctagtttgattgcactgtggtctgagagacagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtccccttggtgcagagctgagttcaattactgggtatccttgttaactttctgtctcgttgatctgtctaatgttgacagtgggttgttaaagtctcccattattattgtgtgggagtctaagtctctttgtaggtcactcaggacttgctttatgaatctgggtgctcctgtattgggtgcgtatatatttaggatagttagctcttcttgttgaattgatccctttaccattatgtaatggccttctttgtctcttttgatctttgttagtttaaagtctgttttatcagagactaggaatgcaacccctgcctttttttgttttccatttgcttggtagaccttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttgctcgttagttgatgcagtttcttcctagcctcaatggtctttacaatttggcatgattttgcagcggctggtaccagttgttcctttccatgtttagtgcgtccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagagtttctgccgagagatccgctgttagtctgattggcttccctttgtggttaacccgacctttctctctggctgcccttaacattttttcctttatttcaactttggtgaatctgccaattatgtgtcttggagttgctcttctcaaggagtatctttgtggcgttctctgtatttcctgaatctgaatgttggcctgccttgctagattggggaagttctcctggataatatcctgcagagtgttttccaacgtggttccattctccacgtcactttcaagtacaccaatcagatgtagatttggtcttttcgcatagtcctatatttcttggaggctttattagtttctttttattcttttttctctaaacttcccttctcgcttcatttcattcatttcatcttccatcactgataccctttcttccagttgatcgcatgggctcctgaggcttctgcgttcttcacgtagttctcgagccttggctttcagctccatcagctcctttaagcacctctctgtattggttattctagttatacattcgtctaaatttttttcaaagttttcaacttctttgcctttggtttgaatttcctcctgtagcttggagtagttttatcgtctgaagccttcttctctcaactcatcagtcattctccgtccagctttgttccgttgctggtaaggagctgcgttcctttggaggaggagaggcactctgctttttagagtttccagtttttctgttctgttttttccccatctttgtggttttatctacttttggtctttgatgatggtgatgtacagatgggtttttggtgtggatgtcctttctgtttgttagttttccttctaacagacaggaccctcagctgcaggtctgctggagtttgctagaggtccactccagaccctgtttgcctgggtactagcagcggtggctgcagaacagtggattttcgtgaaccatcaatgctgctgtctgatcgttcctctggaagttttgtctcagaggagtacccagccgtgtgaggtgtcagtctgcctttactggggggtgcctcccagttaggctgctc

SEQ ID NO: 12104 - DNA, 3693 bp, Homo sapiens
gtctaacgtttaagtctctaatccatcttgaattaatttttgtataaagtgtaaggaagggatccagtttcagctttctacacatggctaaccagttttcccagcaccatttattaaatagggaatcctttccctattgcttatttttcccaggtttgtcaaagatcacatagttgtagatatgcgccattatttctgaaggctctgttctgttccattgatctatatctctgttttggtaccagtaccatgctgttttggttactgtaggcttgtagtatggtttgaagtcaggtggcgtgatgcctccagctttgttcttttggcttaggattgacttggcgatgcgggctcttttttggttccatatgaactttaaagtagttttttccaattctgtgaagaaaatcattgttagcttgatggggatggcattgaatctataaattaccttgggcagtatggccattttcacgatattgattcttcctacccatgagcatggaatgttcttccatttgtttgtatcctcttttacttcattgagcggtggtttgtagttttacttgaagaggtccttcacatcccttgtaagttggattcctaggtattgtattctctttgaagcagttgtgaatgggagttcactcatgatttggctctctgtttgtctgttattggtgtataagaatgcttgtgatttttgcacattgattttgtatcctgagactttgctgaagttgcttatcagcttaaggagattttgggctgagacagtggggttttctagatatacaatcatgtcgtctgcaaacagggacaatttgacttcctcttttcgtatttgaataccctttatttccttctcctgcctaatttccctggccagaacttcccacactatgttgaataggagtggtgagagagggcatccctgtcttgtgccagttttcaaagggaatgcttccagtttttgcccattcagtatgatattggctgtgggtttgtcatagataggtcttattattttgagatacatcccatcaatacctaattgattgagagtttttagcatgaagcgttgttgaattttgtcaaaggccttttctgcatctattgagataatcatgtggtttttgtctttggttctgtttatatgctggattacatttattaatttgcgtatattgaaccagccttgcatcccagagatgaagcccacttgatcatggtggataagctttttgatgtgctgttggatttggtttgccagtattttattgaggatttttgcatcaatgttcatcaaggctattggtctaaaattctcttttttggttgtgtctctgccaggctttggtatcaggatgatgctggcctcataaaatgagttagggaggattccctctttttctattgattggaatagtttcagaagcaatggtaccagttcctccttgtacctctggtagaatttggctgtgaatccatctggtcctggaccctttttggttggtaagctattgattattgccacaatttcagagcctgttattggtctattcagggattcaacttcttcctggtttagtcttgggagggtgtatgtgtcaaggaatttatccatttcttctagattttctagtttatttgcatagaggtgtttgtagtatcctgtgatggtagtttgtatttctgtgggattggtggtgatatccgctttatcattttttattggtctatttgattcttctctgttttcttctttattagtcttgctagtggtctatcaattttgttgatcctttcacaaaaccagctcctggattcattaattgtttgaagggttttttgtgtctctatttccttcagttctgctctgattttagttatttcttgccttctgctagcttttgaatgtgtttgctcttgcttttctagttcttttaattgtgatgttagggtgtcagttttggatctttcctgctttctcttgtgggcatttagtgctataaatttccctctacacactgctttgaatgtgtcccagagattctggtatgttgtgtctttgttctcattggtttcaaagaacatctttatttctgccttcatttcgttatgtacccagtagtcattcaggagcaggttgttcagtttccatgtagttgagcggttttgagtgagtttcttaatcctgagttctagtttgattgcactgtggtctgagagacagtttgttataatctctgttcttttacatttgctgaggagagctttacttccaagtatgtggtcaattttggaataggtgtggtgtggtgctgaaaaaaatgtatattctgttgatttggggtggagagttctgtagatgtctattaggtccacttggtgcagagctgagttcaattcctgggtatcttgttaactttctgtctcgttgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttaccattatgtaatggcctcctttgtctcttttgatctttgttggtttaaagtctgttttatcagagactaggattgcaacccctgccttatttgttttccatttgcttgatagatcttcctccatccttttattttgagcctatgtgtgtctctgcacgtgagatgggtttcctgaatacagcacactgatttgtcttgactctttatccaatttgccagtctgtgtcttttaattggagcatttagtccatttacatttaaagttaatattgttatgtgtgaatttgatcctgtcattatgatgttagctggttattttgctcgttagttgatgcagtttcttcctagcctcaatggtctttacaatttggcatgattttgcagtggctggtatcagttgttcctttccatgtttagtgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagagtttctgccgagagatccactgttagtctgatgggcttccctttgtggttaacccgaccgttctctctggctgcccttaacagtttttccttcatttcagctttggtgaatctgacaattatgtgtcttggagttgctcttctggaggagtatctttgtggcgttctctgtatttcctgaatctgaattttggcctgccttgccagattggggaagttctcctggataatatcctgcagagtgttttccaacttggttccatcctccccatcactttcaggtataccaatcagacgtagatttggtcttttcacatagtcgcatatttcttggaggctttgttcgtttctttttattcttttttctctaaacttcccttctcgcttcatttcattcatttgatcttccatcactgataccctttcttccagttgatcgcgtcggctcctgaagcttctgcattctttgcgtagtt

SEQ ID NO: 12105 - DNA, 1322 bp, Homo sapiens
cttctagattttctagtttatttgcatagaggtgtttatagtattctctgatggtagtttgtatttctgtgggatcagtggtgatatcccgttcatcattttttattgtgtctatttgattattctctcttttcttctttattagtcttgctagcagtctgtcaattttgttgatcttttcaaaaaaccagctcctggattcattgattttttgaagggttttttgtttctccatctccttcagttctgctctcatcttagttatttcttgccttctgctagcttttgaatgtgtttgctcttgcttctctagttcttttaattgtgatgttagggtgtcaattttagatctttcctgttttctcttgtgggcattcagtgctataaatttccctctacacactgctttaaatgtgtcccagagattctggtatgttttgtctttgctctcattggtttcaaagaacatctttatttctcccttcatttcgttatttacccagtagtcattcaggagcaggttgttcagtttctgtgtagttgagcggttttgagtgagtttcttaatcctgagttctagtttgattgcactgtggtctgagagacagtttgttataatttctgttcttctacatttgctaaggagtgccttacttccaactatgtggtcaattttggaataagtgtgatgtggtgctgagaagaatgtatattctgttgatttggggtggagagttctgtagatgtctgttaggtcttcttggtgcagagctgagttcaattcctggatatccttgttaactttgtctcattgatctgtctaatgttgatggtgggatgttaaagtctcccattattattgtgtgggagtctaagtctctttgtaggtctctaaggacttgctttatgaatctgggtgctcctgtattgggtgcatatatgtttaggatagttagctcttcttgttgaattgatccctttaccattatgtaacggccttctttgtctcttttgatctttgttggcttaaagtctgttttatcagagactaggattgcaactcctgcctttttttgttttccatttgcttggtagacttccctccatccctttattttgagcctatgtgtgtctctgcacgtgagatgggtctactgaatacagcacattgatgggtcttgactcttatccaatttgccagtctgtgtcttttaattggagcatttagcccgtttacatttaaggttaatattgttatgtgtgaatttgatcctgccattatgatgttagctggttattttgctcgttagttgatgtagttt

SEQ ID NO: 12106 - DNA, 4113 bp, Homo sapiens
tctaacatttaagtctttaatccatcttgaattgatttttgtataaggtataaggaagggatccaatttcagctttctccatatggctagccagttttgccagcaccatttattaaatagggaatcctttccccattgcttgtttttgtcaggtttgtcaaagatcagttagttgtagatatgtggcattatttctgagggctctgttctgttccagttgtctatatctctgttttggtaccagtaccatgctgttttggttactgtagccttgtatagtttgaagtcaggtagcgtgatgcctccagcttttttctcttggcttaggattgacttggcgatgcaggctttttgtttccatatgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatctcttttatttccttgagcagtggtttctagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgcacattgattttgtatcccgagactttgctgaagttgcttatcagcttaaggagattttgggctgagaccatggggttttctagatatacaatcatgtcatctgcaaatagggacaatttgacttcctcttttcctaattgaataccctttatttccttctcctgcctgattgccctggccagaacttccaacaatatgttgaataggagtggtgagagagggcatccctgtcttgtgcccgttttcaaagggaatgcttccagtttctgtgcattcagtatgatattggctgtgggtttgtcaatagatagctcttattattttgagatacgtcccatcaatacctagtttattgagagtttttagcatgaatggttgttgaattttgtcaaaggccttttctgcatctattgagataatcatgtggtttttgtctttggctctgtttatacgctggatacatttattgatttgcatatgttgaaccagccttgcatcccagggatgaagcccacttgatcatggtggataagctttttgatgtgctgctggattcggtttgccagtattttattgaggatttttgcatcgatgttcatcaaggatattggtctaaaattctcttttttttttgtgtctctgccaggctttggtatcaggatgatgctggcctcttaaaatgagttagggaggattccctctttttctattgattggaatagtttcagaaggaatggtaccagttcctctttgaacctctggtagaatttggctgtgaattcatctagtcctggacttgttttggttggtaagctattgattattgcctcaatttcagatcctgttactggtctattcagagattcaacttcttcctggtttagtcttgggagagtgtatgtgtcgaggaatttatccatttcttctagattttctagtttatttgcgtagaggtgtttgtagtattctctgatggtagtttgtatttctgtgggatcggtggtgatatcccctttatcattttttattgcgtctatttgattcttctctctttttttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcatttaattgtgatgttagggtgccaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcattatgtacccagtagtcattcaggagcaggttgttcagtttccatgtagttgagcggttttgagtgagattcttaatcctgagttctagtttgattgcactgtggtctgagagatagttaggtataatctctgttcttttacattttctgaggagtagctttacttccaagttgtggtcaattttggaataggtgtggtgcggtgctgaaaaaaatgtatattctgttgatttggggtggagagttctgtagatgtctattaggtccgcttggtgcaaaactgagttcaattcctgggtatccttgttgactttctgtctcgttgatctgtctaatgttgacagtggggtgttaaagtctcccattattaatgtgtgggagtctaagtctctttgtaggtcactaaggacttgctttatgaatctgggtgctcctgtattgggtgcatatatatttaggatagttagctcttcttgttgaattgatccctttaccattatgtatggccttctttgtgtcttttgatctttgttggttgaaagtctgttttatcagagacttggattgcaacccctgcctttttttgttttccatttgcttggtagatcttcctccatccctttattttgagcctatgtgtgtctctgcatgtgagatgggtttcctgaatacagcacactgatgggtcttgactctttatccaatttgtcagtctgtgtcttttaattggagcatttagtccatttacatttaaagttaatattgttatgtgtgaatttgatcctgtcattatgatgttagctggttcttttgctgattagttgatgcagtttcttcctagcctcaatggtctttacattttggcatgattttgcagcggctggtaccagttgttcctttccatgtttagtgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagagtttctgccgagagatccgctgttagtctgttgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatctcctgcagagtgttttccaacttgtttccattctccccatcactttcaggtacaccaatcagacatagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcatgtagttcttgagccttggttttcagctccatcagctcctttaagaatttctctgtattggttattctagttatacattcttctaaagttttttcaaagttttcaacttctttgcctttggtttgaatgtcctcccatagctcagagtaatttgatcgtctgaagccttcttctctcagctcgtcaaagtcattctccatccagctttgttccattgctggtgaggaactgtgttcctttggaggaggagaggtgctctgctttttagagtttccagtttttctgttctgtttttttccccatctttgtggttttatctacttttggtctttgatgatggtgatgtacagatgggtttttggtgtggatgtcctttctgtttgttagttttccttctaacagacaggaccctgagctgcaggtctgttggagt

SEQ ID NO: 12107 - DNA, 13030 bp, Homo sapiens
gcctaattgccctggccagaacttccaatactatgttgaataggagtggtgagagagggcatccctgtcttgtgccggttttcaaagggaatgcttccagtttttgcccattcagtatgatattggctatgggtttgtcatagatggctcttattattttgagatacatctcatcaatacctaatttattgagagtttttagcaataagcattgttgaattttgtcaaaggccttttctgcatctattgagataatcatgtggtttttgtctttggttccgtttatatgctggattacatttattgatttgcatatattgaaccagccttgcatcccagggatgaagcccacttgatcatggtggataagctttttgatgtgctgctggattcggtttgccagtattttattgatgatttttgcatcaatgttcatcaaggatattggtctaaaattctcttttttggttgtatctctgcccatctttggtatcaggatgatgctggccttataaaatgagttagggaggattacctctttttctatggattggaatagtttcagaaggaatggtaccagttcctccttgtacctctggtagaattcggctgtgaatccgtctggtcctggactctttttggttggtaagctattgattattgccataatttcagagcctgtttttggtctattcagagattcaacttcttcctggtttagtcttgggagagtttatgtgtcgtggaatttatccatttcttctagattttctagtttatttgcgtagaggtgtttctagtactctctgatggtagtttgtatttctgtgggaatggtggtgatatcccctttatcattttttattgcatctatttgattcttctctcttctttcctgtattagtcttgctagcggtctatcaattttgtagatcctttcaaaaaaccagctcctggattcattaattttttgatgggtttttttggtctctatttccttcagttctgctctgattttagttatttcttgccttctactagcttttgaatgtgtttgctcttgcttttctagttctttcaattgtgatgttagggtgtcaattttggatctttcctgctttctcttgtgggcatttagtgctataaatttccctctacacattgctttgaatgtttcccagagattctggtatgttgtgtctttgttctcattggtttcaaagaacatctttttatttctgccttcatttcgttatgtacccagtagtcattcaggagcaggttgttcagtttccatgtagttgggcggttttgagtgagtttcttaatcctgagttctagtttgattgcactgtggtctgagagacagtttgttataatttctgttcttttacatttgctgaggagagctttacttccaactatgtggtcaattttggaataggtatggtgtggtgctgaaaaaaagtataatctgttgatttggggtggagagttctgtagatgtctattaggtctgcttggtgcagagctgagttcaattcctgggtatccttgttaactttctgtctcattgatctgtctaatgttgacagtggggtgttaaaatctcccattattattgtgtgggagtttaagtctctttgcaggtcactcaggacttgctttatgcatctgggtgctcctgtattgggtgcatatatatttaggatagttagctcttcttgttgaattgatccctttaccattatgtaatggccttctttgtctctttcaatctttgttggtttaaagtctgttttatcaaagactaggattgcaacccctgcctttttttgttttccatttccttggtagatcttcctccatccttttattttgagcctatgtgtgtctctgcacgtgagatgtgtttcctgaatacagcacactgatgggtcttgactctttatccaatttgccagtctgtgtcttttaattggagcatttagtccattttcatttaaagttaatattgttttgtgtgaatttgatcctgtcattgtgatgttagctggttattttgctcgttagttgatgctgtttcttcctaatctcgatattagatggttctgacctgaagccagtatggccctgagtattactccaggctcgtagtgagtactacctggctaccactgatgtttattcaaggaccaagggctctttagtcacctggtgatggatccttccaaagctgagtccttcccttcaaggcagtgtgctcccttctggtccactttatgtctagaaatgttatctgggagctagggcctggaatgagggcctctgttctctgcctggtgccttattctactgtggctaaactggtatccaagttgcaagacaaagttctcattactgtctcctcttctctctttaagaagaaaggaatctctcctggcacttgcagttgcactgcccggggttgggggagcggtgacccaatcactccctggtgtcttaccaggtcacatgcattccatgtccactggctctaagcccagaacagtacccagacatacccaggacttttagtccttatgtcctagatggccattcaagtttatttagaacccaagggcactttagcctgcagtggtagagctagccagagctcaagttctgactgttgggttggatgattcccttctggctagagctggtctaaatgttccctccatgggtgccagctgaattctgccaagtgttgctttctgctacggcaggcagcactgagtttcattgcaaagtcctacagtcgctgtgctctgccttccccaagtgcactgattccctcctgtacaacatggatgctgctgggagataagggagggatggtgttaacaattcaagattttctttcctatcctcttcagtgcctcttttcttgttatgatgttaaaatcatgtgccatgatcattcatccaatttttggttcttatgaaggtggtttcttgtgtggatagttgttcattttggtgttcttatgggggtgacaattgctggaggcttctgtttggccatcttagtccacctcctctcatctatttttgattttgattaagtatttttttcaagtactttctaacgtataacattttacctttagcatgtaggtccatgagttatagatttataatcaaattagacaatttcaattttacctttatccatgaagttaaaggtgaacatgttttcctccatgtcatatttccaccttcatctgtggacatctgtgtgttatttttaagtttcacatttatacttgtgtaaggctgttctttcactgccataaaaaaatacctgagactgggtaatttataaagaaaagagctttaattggctcatggttctgcaggctgtaccaaaagcatgccaccggcatcttctcagggaagcctcagggaccacacatgtcacatggcaaaagcagaaggaggggctgattggaggtgccacacacttttaaatgaccggttctcatgagaactcactcactgtcttgaggacatgaccaagggaatggtgccaagccatttatgagaaatccaccgccatgattcagtcacctcccaccaggcctcacctccaacactgagcactacattttaagatgagattttggtggggacaaatatccaaactatatgaataaatttttttctaagacatgaataatatttttctagtagagatctaaacactttcagagtcaagatacagttgtgatgagagaataaacctggcttaatatctgctctgagtaatattaacagaggatcacctgatacatttttgagtagagtttctgaaaaactaaaggaaatctaagacattgattaatatctgtaatgagcatatggtactgagaaaaaaggaaacagatgtaaaacgttcttgagtcatggtaatggccaagtactgtaatcagtatcttaaactcctgttcctattgtccctagagatgtctgactgaatatttgtaccagatgactgtatttgattcagatgagtgaatatttgtatccccccgtgttgaaacccaaaaccaaaagtgagggtatctggaggtaaaggtgggtccttagatttacatgaagtcttgagaatgggatccctatgatgctgttaatgtcctcataagacgataagatggaatcttttctctctccaccatgcaaggtcattgtgagaaggtgtttttcaccagccaggaatacatccctcactaggaactaaatcagctggcgctttaattttgaacttctcaacctctagaactataagaaataaatttcttttgtttcagccagtcagtctatggtatttctgttatggaagcccaagctgactaagacaccttgaaactaaaattacatccaactcaattatctatgacgcctgaccccctgcatttccatgagagtcctatctcatcattaccttacttaaatttgtacaataattctcccctttactagtgttttctcaactaagaagttttttttttcaaaacaaaacaaattctaattaaaacatgatattaagttttagttgaattacagaaaataattacaatctagggccttgtatttacattagatacaaactagagactcattttgtataattgcagttgaaacctaaaacaaaacagtttacaaaacctttcttttacatttgacaagatttccttatacctaattgtctgagctattgtttcaaatttctagcaggttatatgcaaatagagaaaaccgtagtgatgcatagttttacctatttttgccataaaaaatatattatggcttaaattgattaaaaagaatagaaaagaaagttccattgggtataagtttttacctttatacaaataatagaattaaaatatacagcttggtgaactgctcacaggtgtttggcagaaatgatagcagtttgcttatcagaatgaggtaaaaagaacaaaaacagggacagcacaacctggcatatttcctcagattccagagcatttcaacatgatgaaaatatccaaacagccacaaaggtttacaaaaccattattttccagaagtcttttaacatttaactctgtaattttaaaaataaaatttctagcaaataaaactttaaagcaaattacactaaagatgaaaatacacaaatgatgaaaatagtagcatatgcatataatagcaaagggagacctttgctattatggtactggaaaacttgcaagtacccacatgattgtaattgtaagaagaaactggcaaggattttcatctttgaagcttaaaacccttccatgtgagacagcatttgataaatcagggttattcaagctctccttatcaagtcttgccaggtttatgctgtctcttatcatcaatgaactgcagtggctctccccagcccacctctagattcttcttgtaataggtagcactgtggatcatctcatctctccattaccaaacagctcccaaaccagcatccatgtcaattcctatcgagagcctcctgcagctcttagcaccgtatccagcccacagtggtggagtagcacatgctgttaggtgaatgtaattttctgctaggtaacattttttacccactctggctgcaagaatcttgactacattaatcagatagtgtacagtcaacccaaataatctgtctatgaaggctgttttatgtcactagatttaaggtaatttgtcacatagtctgagcaagtggaacagaagataagaggggtgggaaggaaaataattaaattccttattaatggaatgtttgattgaaatagtgtagtatatctgtattttactggaaattttcactatgtcagggacagatattattgtaagtctactttctctgaataaaaattgaaatgtttttctttctgagaatgatacaaagatttttaaagctaataacataatttgtatattaacaatagctgcatgacctcacagtgattaggatgtcagtgaactattaacttcactgcagtgccattgattaaagtaaagaaatgggataggctactacaaaaaagactggtgcataagttatttggaggtgaacactttgtgcttcaaatagcttaagttgattaaaaagaatggaaaagaaagttccattggctataagtttttacctttattcaaatattggaattaaaatacacagcttggtgaactgctcacaggtgtttggcagaaatgatagcagttatatatatacatatgatagctatatatatatattcagttttcttacttgcttatggttgtaaatgactcaatttacttggcaaaatgtgatctaattacaatgagagcgttcaagatatttggagaaaatctaggtcccataaaatgtaatatgaaaattcttaagcttagtactgacgctaaatgacataaaaaccctagaacttacacattctcccaagaccacctttatatataacaagattcatcttgacacatgaggaactggtaaaatcaaatgcactaaacaaatataattacaacaaaagcgatgtacaacatagtccatattgtagtgggaatctgccctatcatttcgtatgaagagggtcttttcctatgtgaaaaatactgtggttgtctttcctttggattccatcctttattaaattgattgcaaaatactcattctttttgtacagaggtttacaaatctgttaaacaatggtatgaaaaaatggatcatgtttatttcatagtttaacttaataaagtaaaatgttttaaagaagtcttccacaaaaaggcatagctgtttatattaaattatttataaataaaatatagtataacatatattaatactccgctaacatatgttaatggttgtgaaattatattgaaataaagaaatatgatggtacaaattattgtgaaaataatggcacagtaaaattacaagttaatattcttttttactcttttaaattttatgtaggtaaattttttttcttaaaaataaaattatatcattatttattattcccatatttcttctcattatttcttaaagctgaaatttcctctttattgtatctaacatgcttttgaggtatttgttatgttatagtaatgtaagttttggtactaatactactaatattttgaaatttttgagaatatatgcaaaaccatatatagttcttgatgttaatttagtgttcaaatatagttgcatcaagttaagtcatatgtatcttagaaatctgctgaagtcactattcttctgcatcagtacagtcactgacacagatatacaaacacatgcaaacaaattacagcatcctaaaccacatccctatccagtgaccttccccagattagagtgaattcccagaagcttataatttcatggcacatttggcttctaagtttctgatgctgctgaaaatctcttgtgtctcatcacctgaggctgttcctgtctcttttctctgctgtaacttgaacctcagccctcttttcttgtgtatccagaagcgacataaaacaaaagctttcaggagacatttgtattttgtaatggtcttagcttaagaaaagggtctacttcacagcaatgccagcaatttacaattaaaagcagacatttccatatttaagcatttgtttaaaccaacagcagaaattatgagacacttttatacacaggcataggtataggcacaaaaatgtattttatgcagagtaattcatttatttttaaacctaagacctaacttcagaagccatccatacattcactgataaccttatagagtcagaagaagcttccaaagtttttctttcaagatcagtttatctagcagaacatggataatagaaagatgtgttgttccctacacagaaaacattgctatggaggaggtgcagtgaataaatgtctatttatatatttatttaataataattaatgagttactccttgtgcagtcacaaagagaagtactaggaatacaaagatgaacaagacatcggttctgtatctgaggagctcagggattcttatgagaaaacagagagtaaaggattcgttacaattaccatggtatgtgagtgagatagacttaacaacacacagcaggaagggaaacacaagagtggatagggatgttgggcagaatgcacagacacaggctgtagtgagatgaggatagagtagggtgaaggtatgctcagattgacttccctgaaaaaaaagtacatacagatgatacataaagaatgagctggaatcattaaggtgaatgacaggtatttaggaggttttaggcatagaaagcaatattaaactcattgaggaggaaatacttgagtataagataaaaaggaaggagtggtagaaaagaggatgagggataggtaaagaatgatcataaaaaaactgtgtttatcattagcagcaatttaattttatagtacaagaaataatttttttatttttattatactttaagttctagggtacatgtgcacaacgtgcaggtttgttacatatgtatacatgtgccatgttggtgtgctacactcattaactcgtcatttacattaggtatatctcctaatgctatccctgccccctcccccgaccccacaacaggccccggtgtgtgatgttccccaccatgtgtccaagtgttctcattgttcaattcccacctaagagtgagaacatgcagtgtttgatttttttgtccttgcgatagtttgctgagaatggtggtttctagcttcatccatgtccctacaaaggacatgaactcatacttttttatggctgtatagtatttcatgatatatatgtggcacattttcttaatccagtctatcactgatggacatttgcgttggttccaagtctttgctattgtgagtagtgctgtaataaacatatgtgtgcatgtgtctttatagcagcatgattgataatcctttgggtatatacccagtaaagagaaggctgggccaaatggtatttctagttctacatccttgaggaattgccacactgtcttccacaatggttgaactagtttacagccccaccaacagtggaaaagtgttcccatttctccacatcctctccagcacctgttgtttcctgactttttaatgatcaccattctaactggtgtgagatggtatctcattgtggtattgatttgcatttctctgatggctagtgatgatgagaaatttttcatatgtctgttggctgcataaatgtcttcttttgagaagtgcctgttcatgtactttgcccactttttgatggggttgtttgagtttttcttgtaaatttgtttaagttctttgtagatgctggatattagccttttgtcagatgggtagattgtaaaaattttctcccattctttagattacctgttcacactgatggtagtttcttttgctgtgcagaagctctttagtttaatcagatcccatttgtctattttggcttttgtggccatttgtgttttagtcatgaagtccttgcccatgcctgtgtcctgaatggtattgcctaggttttcttctagggtttttatggttttaggtctaacatttacatctttaatacatcttgaattaatttttgtataggtgtaaggaagggatccagttttagctttctacatatggctggccagttttcccagcaccatttattaaataggaaatcctttccccattgcttgtttttgtcaggtttgtcgaagatcagatggttgtagatttgtgatgttatttctgaggcccctattctgttccattggtctatatctctgttttggtataagtactatgctgttttggttactgtagccttgtagtatagtttgaagtcacatagcatgatgcctccagctttgttcttttggcttaggattgacttggcaatgtgagctcttatttggttccatatgaattttaaaatagttttttccaattctgtgaagaaagtcgttattggtagcttgatggggatggcattgaatctataaattaccttgggcagtatggccattttcatgatattgattcttcctacccatgagcatggaatgttcttccatttgtttgtgtcctcttttatttcgttgagcagtggtttgtagttttccttgaagaggtccttcacatcccttgtaagttggtttcctaggtattttattctctttgaagcaattgtgaatgggagttctctcatgatttggctctctgtttgtctgttattggtgtataagaatgcttgtgatttttgcacattgattttgtgtcctgagactttgctgaagtttcttattagattaaggagattttgggctgaaatgatggggttttctaaatatacaatcatgtcatctgcaaacagggacaatttgacttcctcttttcctaattgaataccctttatttctttctcctgcctgattgtcctggtcagaacttccaacactatgttgaataggagtggtgagagagggcatccctgtcttgtgccagttttcaaagggaatgcttccagtttttgcccattcagtatgatattggctgtgggtttgtcataaatagctcttattattttgagatacgtcccaacaatacctagtttattgagagtttttagcatgaaaggccgttgaattttgtcgaaggccttttctgcatctattgagataatcatgtggtttttgtctttggttctgtttatgtgatgcattacatttattgatttgcatatgttgaactagcgttgcatcccagggatgaagcacacttgatcatggtggataagctttttgatgtgctgctggattcggcttgccaacattttattgaggatttttgcatcaatgttcatcaaggatattggtctaaaattctcttttttggttgtgtctctgccaggctttggtatcaggatgatgctggcctcataaaatgagttagggaggattctctctttttctattgattgggatagtttcagaaggaatggtaccagctcctctttgtacctctggtagagttcggctgtgaatctgtctagccctggactttttttggttagtaggcgattaattattgccttaatttcagagcctgttattggcctattcagagattcaacttcttcctggtttagtcttgggagggtgtatgtgtctaggaatttatccctttcctctagattttctagtttatttgcatagaggtgtttatagtattctctgaaggtagtttgtatacctgtgggatcggtggtgatatcccctttatcattttttattgcatctatttgattcttctctcttttcttctttattagtcttgctagtggtctatcaattttgttgatcttttcaagaaaccagctcctggattcattgatttttttgaagggttttttatgtctctgtctccttcagttctgctccgatcttagttatttcttgccttctgctagctttcgaatgtgttcgctcttgcttctctagttttttttaattgtgatgttagggtgtcaattttagatctttcctgctttctcttgtgtgcagttagtgctataaatttccccctacacactgctttaaatgtgtcccagagattctggtatgttgtgtctttttttctcattggtttcaaggaatatctttatttctgccttcatttcgttatgtatccagtagtcattcaggagcaggttgttcagtttccatgtagttgagcggttttgagtgagtttcttaatcctgaatcctaatttgattgcactgtggtctgagatacagtttgttataatttctgttcttttacatttgctgaggagtgctttacttccaagtatgtggtcaattttggagttaagtgcggtgtggtgctgagaagaatgtatattctgttgatttggggtggagagttctgtaaatgtctgttaggtccacttggtgcagagctgagttcaagtcctggatatccttgttatctttctgtctcgttgatctgtctaatcttaacagtggggtgttgaagtctcccattattattgtgtgggagtccaagtctctttgtaggtctctaaggacttgctttatgaatctgggtgctcttgtattgggtgcatatattttaggatagttagctcttgttgaattgatccctttaccattatgtaatggccttctttgtctcttttgatctttgttgttttaaagtctggtttaacagagactaggattgcaacctctacttttttctgttttccatttgcttggtagatctttctccatccctttattttgagcctatgtgtgtctctgcacgtgagatgggtttcctgaatacagcactgatgggtcttgactctatccaatttgccagtctgtatcttttaattggagcatttagcccatttacatttaaggttaatattgttttgtgtgagtttgatcctgtcattatgatgttagctggttattttgcttgttagctgatgcagtttcttcctagcatcgatggtctttacaatttggcatgtttttgcagtggctgatacaggttgttcctttccatgtttagtgcttccttcaggagctcttgtaaggcagggctggtgttgacaaaatctctcagcatttacttgtatgtaaaggattttatttctccttcacttatgaagcttagtttggctggatatgtaattctgtattgaaaattcttttctttaagaatgttgaatattaaccgcactctcttctgacttgtagagtttctgctgagagatcagctgttagtctgatgggcttccctttgtgggtaacccgacctttctctcttactgcccttaacattttttccttcatttcaactttggtgaatctggcaattatgtatcttggagttgctcatc

SEQ ID NO: 12108 - DNA, 1285 bp, Homo sapiens
  misc_feature (76)..(76): n equals a,t,g, or c
ttgaataagtgcagtgttgtgctgagaagaatgtgtattctgttgatgtggggtggagagttccgtagatgtctantaggtctgcttggtgcagagctgagttcaattcctggatatccgtgtgaattttctgtctcatcgatctgtctaatgttgacagtggggtgtgaaagtctcccattattattgtgtgggagtctaattctctttgtaggtctctaaggacttgttttatgaatctcggtgctcctgtattgggtgcatatatatttaggatagttagctcttcttgttgaattgatccctttaccattatgtaatggccttctttgtctcttttgatctttgttggttgaaagtctgttttatcagagactaggattgcaacccctgtcttttttcgttttccattttcttggtagatcttcctccatccctttattttgagcctacgtgtgtctctgcacgtgagatgggtttcctgaatacagcacactgatgggtcttgactctttatccaatttgccagtctgtgtcttttaattggagcatttagcccatttacatttaaggttaatattgttatgtgtgaatttgatcctgtcattatgatgttagctggttattttgcttgttagttgatgcagtttcttcctagccttgatggtctttacaatttggcatgtttttgcagtggctggtaccagttgttcctttccatgtttagtgcttccttcaggagctcttgtagggcaggcctggtggtgacaaaatgtctcagcatttgcttgtctgtaaaggattttatttctccttcacttatgaagcttagtttggctggatatgaaattctgggttgaaaattcttttctttaagaatgttgaatattggcccccactctcttctggcttgtagagtttctgccaagagatcagctgttagtctgatgggcttccctttgtgggtaacctgacctttctctctggctgcccttaacactttttccttcatttcaaccttggtgaatctgacaattatgtgtcttggggttgcttttctcgaggagtatctttgtggtgttctccgtatttcctgaatttgaatgttggcctgccttgctaggttggggaagttctcctggataatatcctgcagagtgttttccaacttggttccattctccccattactttcaggtacaccaatcaaatgtagatttggtcttctcacatagtcccatatttcttggaggcttggtttgtttctttttactcttttttctct

SEQ ID NO: 12109 - DNA, 3688 bp, Homo sapiens
gtctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcagcattatttctgagggctctgttctgttccattgatctatatctctgttttggtaccagtaccatgctgttttggttactgtagccttgtagtatagtttgaagtcaggtagtgtgatgcctccagctttgttcttttggcttaggattcacttggcgaagcgggctcttctttggttccatatgaactttgaagtagttttttcaattctgtgaagaaagtcattggtagcttgatggggatggcattgaatctgtaaattaccttgggcagtgtggccattttcacgatattgattcttcctgcccatgagcatggaatattcttccatttgtttgtatcttcttttatttccttgagcagtggtttgtagttctccttgaagaggtccttcacatcccttgtaagttggactcctaggtattttattctctttgaagcaattgtgaatgggaattcactcatgatttggctctctgtttgtctgttattggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctattgaataccctttatttccttctcctacctaattgccctggccagaacttccaacactatgttgaataggagtggtgagcgagggcatccctgtcttatgccagttttcaaagggaatgcttccagtttttgcccattcagtatgatattggctgtgggtttgtcatagatacctcttattattttgaaatacgtcccatcaatacctaatttattgagagtttttagcatgaagggttgttgaattttgtcaaaggccttttctgcatctattgagataatcatgtggtttttgtctttggttctgcttatatgctggattacatttattgatttgcatatattgaaccagccttgcatcccagggatgaagccctcttgatcatggtggataagctttttgatgtgctgctggattcgttttgccagtattttattgaggatttttgcatcaatgttcatcaaggatattggtctgaaattctcttttttggttgtgtctctgcccggctttggtatcaggatgatgctggcctcataaaatgagttagggaggattccctctttttctgttgattggaatagtttcagaaggaatggtaccagttcctccttgtacctctggtagaattccgctgtgaatccttctggtcctggactctttttggttggtaagctattgattattgccacaatttcagatcctgttattggtctattcagagattcaatttcttcctggtttagtcttgggagagtgtatgtgttgaggaatttatccatttcttctagattttctagtttatttgcatagaggtggttgtagtattctctgatggtagtttgtatttctgtgggatcagtggtgatatcccctttatcattttttattgcatctatttgattcttctctctttttttctttattagtcttgctagtggtctatcaattttgttgatcctttcagaaaaccagctcctggattcattaattttttgaagggttttttgtgtctctatttccttcagttctgttgattttagttatttcttgccttcttctagcttttgaatgtgttttctcttgcttttctagttcttttaattgtgatgttagggtgtcaattttggatctttcctgctttctcttgtgggcatttagtgctataagtttccctctacacactgctttgaatgcgtcccagagattctggtatgttttgtctttgttctcaatggtttcaaagaacatctttatttctgccttcatttcgttatgtacccagtagtcattcaggagcaggttgttcagtttccatgtagttgagcggttttgagtgagattcttaatcctgagttctagtttgattgcactgtggtctgagagatagtttgttataatttctgttcttttacatttgctgaggagagctttacttccaagtatgtggtcaatttttgaataggtgtggtgtggtgctgaaaaaaatgtatattctgttgatttggggtggagagttctgtagatgtctattaggtccgcttggtgcagagctgagttcaattcctgggtatccttgttgactttctgtctcattgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttgttgttgaattgatccctttaccattatgtaatggtcttctttgtctcttttgatctttgttggtttaaagcctgttttatcagagactaggattgcaacccctgcctttttttgttttctatttgcttggtagatcttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttgctcgttagttgatgcagtttcttcctagtctcgatggtctttacattttggcatgattttgcagcagctggtaccagttgttcctttccatgtttagtgcttccttcaggagctcttttagggcaggcctggtggtgacaaaatctctcagcatttgcttgtttgtaaagtattttatttctctttcacttatgaagcttagcttggctggatatgaaattctgggtttaaaattcttttctttaagaacgttgaatattggcccccactctcttctggcttgtagagtttctgccgatagatctgctgttagtctgatgggcttccctttgagggtaacctgacctttctctcttgctgcctttaacattttttccttcatttcaactttgatgaatctgacaattgtgtgtcttggagttgctcttctcaaggagtatctttgtgacattctctgtatttcctgaatctgaatgttggcctgccttgctagattggggaagttctcctggataatatcctgcagagtgttctccaacttggttccattctccctgtcactttcaggtacaccaatcagacgtagatttggtcttttcacatagtcccatatttcttggaggctttgctcgtttctttttattcttttttctctaaacttcccttctgtcttcatttcattcatttcaacttccatcgctgataccctttcttccagttgatctcatcagctccggaggcttctgcattcttcacgt

SEQ ID NO: 12110 - DNA, 5728 bp, Homo sapiens
attttttttcttccttgttttaaattatactttaagttttagggtacatgtgcacaacgtgcaggttagttaaatatgtatacatgtgccatgttggtgtgctgcacccattaactcgtcatttaacattaggtatatctcctaatgctatccctcccccctcccccaccccacaacaggccccggtgtgtgatgttccccttcctgtgtccatgtgttctcattgttcagtacccactgacgagcgagaacatgtggtgtttggttttttgtccttgcgatagtttgctgagaatgatggtttccaccttcatccatgtccctacaaaggacatgaactcatccttttttatggctgcatagtattccatggtgtatatgtgccacattttcttaatccagtctatcattgttggacatttgggttggttccaagtctttgctattgtgaatagtgccgcagtaaacatacatgtgcatgtgtctttatagcagcatgatttataatcctttgagtatatatccagtaatgggatggctgggtgaaatggtatttctagttctagatccctgaggaatcgccacactgacttccacaatggttgaactagtttacagtcccaccaacagtgtaaaagtgttcctatttctccacatcctctccagcacctgttttttcctgactttttaatgattgccattctaactggtgtgagatggtatctcattgtggttttgatttgcatatctctgatggccagtgatgatgagcatttttcatgtgtcttttggctgcataaatgtcttcttttcagaagtgtctgttcatatccatcacccactttttgatggggttgtttttttcttgtaaatttgtttgaattcattgtagattctggatattagccctttgtcagatgagcagattgtaaaaattttctcccattctgtaggttgcctgttcactctgatggtagtttcttttgctgtgcagaagctctttagtttaattagatcccatttgtcaattttggcttttgttgccattgcttttgtgttttagacatgaagtccttgcccatgcctatgtcctgaatggtattgcctaggttttcttctaggttttttatggttttaggtctaacatttaagtctttaatccatcttgaattaatttttgtataaggtgtaaggaagggatccagtttcagctttctacatgtggctagccagttttcccagcaccatttattaaatagggaatcctttccccattgcttgtttttgtcaggtttgtcaaagatcagatggttgtagatatgtggcattattgctgagggcgctgttgtgttccattggtctatatctctgttttggtaccagtaccatgctcttttggttactgtagccttgtagtatagtttgaagtcaggtagcgtcatgcctccagctttgttcttttggcttatgattgacttggcagtgcgggctcttttttggttccatgtgaactttaaagtagttttttccaattgtgtgaagaaagtcattggtagcttgatggggatagcattgaatgtataaattaccttgggcagtatggccatttacacgatactgattcttcctatccatgagcatggaatgttcttccatttgtttgtatcctcttttatttcattgagcagtggtttgtagttctccttgaagaggtctttcacgtcccttgtaagttggattcctaggtattttattctctttgaagcaattgtgaatgggagttcactcatgatttggctctctgtttgtctgttattggtgtataagaatgcttgtgatttttgcacattgattttgtatcctgagactttgctgaagttgcctattggcttaaggagatttagggctgagacaatggcattttctagatatacaatcatgtcatctgcaaacagggacaatttgacttcctctcttcctaaatgaataccctttatttccttctcctgcctgattgccctggccagaacttccaacactatgtcgaataggagtggtgagagagggcatgcctgtcttgtgccagttttcaaaggcaatgcttccagtttttgcccatttagtatgatattggctgtgggtttgtcatagatagctcttattattttgagatacgtcccatcaatacccaatttattgagagtttttagcaagaagggttgttgaatttagtcaaaggccttttctgcatctattgagataatcatgtggtttttgtcattggttctgtttatatgctggattacatttattgacttgcgtatgttgaaccagccttgcatcccagggatgaagcccacttgatcatggtggataagctttttgatgtgctgctggattcagtttcccattattttattgaggatttttgcatcgatgttcatcagggatattggtctagaattctctttttttgttgtgtctctgccaaggtttggtatcaggataatgctggcctcataaaatgagttagggaggattccctatttttctttcgattggaatagtttcagaaggaatggtaccagctcctccttgtacctctggcagaattaggctgtgaatccatctggtcctggactttttttggttggtaagctattaattattgcctcaatttcagagcctgttattggtctattcagagattcaacttcttcctggtttagtcttgggagggtgtatgtgttgaggaatttatccatttcctctggattttctagtttatttgcatagaggtgtttatagtattctctgatggtagtttgtatttctgtcagatcggtggtgatatcccctttatcattttttattgtgtctatttgattcttctctcttttcttctttattagtcttgctagtggtgtatcaattttgttgatcttttcaaaatccagcccctggattcattgattttttgaagggttttttgtgtctctatttccttcagttctgctctgagcttagttatttcttgccttctgctagcttttgaatgtgtttgctcttgcttctctagttcctttaattgtgatgttagagtgtcaattttagatctttcctgctttctcttgtgggcatgtagtgctataaatttccctctacacactgctttgaatgtgtcccagagattctggtatgttgtgtctttgttctcgttgatttcaaagaacatctttatttctgccttcatttcgttatgtacctagtagtcattcaggagcaggttgttcagtttccatgtagttgagcgtttttgagtgagtttcttaatcctgagttctagtttgattgcactgtggtctgagagacagtttgttataatttctattcttttacatttgctgaggagtgctttacttccaactatgtggtcaattttggaatagatgtggtgtggtgctgagaacaatgtatattctgttgatttggggtggagagttctgtagatgtctattagatccgcttggtgcagagctgagttcagttcctggatatccttgtgaactttctgtctcgttgatctgtctagtgttgacagtggggtgttaaagtctcccattattattgtgtggtggtctaagtctctttgtaggtcattcaggacttgctttatgaatctggctgctcctgtattgggtgcatatatatttaggatagttagctcttcttgttgaattgatccctttaccgttatgtaatggccttcattgtctcttttgatctttgttggtttaaagtctgttttatcagagactaggattgcaacccctgcctttttttgttttccatttgcttggtagatcttcctccatccctttattttgagcctatgtgtgtctctgcacgtgagatgggtttcctgaatacagcacactgatgggtcttgactctttatccaatttgccagtctgtgtcttttaattggagcatttagcccatttacatttaaggttaatattgttttgtgtgaatttgatcctgtcattatgatgttagctggttattttgcttgttagttgatgcagtttcttcctagcctcgatggtctttacaatttggcatgtttttgcagtggctggtaccagttgttcctttccatgtttagtgcttccttcaggagctcttgtagggcaggcctggtggtgacaaaaatctctcagcatttgcttgtctgtaaaggattttatttctccttcacatatgaagcttagtttggctggatatgaaattctgggttgaaaattcttttctttaagaatgttgaatattggctcccactctcttctggcttgtagagtttctgctgggagatccactgttagtctgatgggcttccctttgtggtaacccaacctttctctctggctgcccttaacattttttccttcatttcaactttggtgaatctgacaattatgtgtcttggagttgctcttctcgaggagtatctttgtggcatcctctgtatttcctgaatttgaatattggcctgccttgctggattggagaagttctcctggataatatcctgcagagtgttttccaacttggttccattctccccgtcagtttcaggcacaccaatcagacgtagatttggtcttttcaaatagtcccatatttcttggaggctttgttggtttctttttattcttttttctgtaaacttctcttctcacttcatttcattcatttgatcttccatcactgatatcctttcttcctgttgatcgaatcggctactgaggcttgtgcattcgtcacatagttctcatgccttggttttcagctccatcaagtcctttaaggacttctctgcattggttattctagttagccattcttctaattttttttcaaggtttttaacttctttgccatgggttcaaacttcctcctttagctcagagtagtttgatcgtctgaagtcttcttctctcaagtcgtcaaagtcattctccgtccagctttgttccattgctggtgatgagctgcattcctttggaggagaagaggcactctgatttttagagtttccagtttttctgctctgttttttccccatctttgtggttttatctacctttggtctttgatgatggtgacgtacagatgggtttttggtgtggatgtcctttctgtttgttagttttccttctaacagtcaggaccctcagctgcaggtgtgttggagtttactggaggtccactccagaccctgtttgcctgcgtatcagcagcagaggctgcagaacagcggatattggttaacagcaaatgttggtgcctgatcattcctctggaagttttgtctcagaggagtacccggccatgtgaggtgtcagtctgcccctactggggggtgcctcccagttaggctactcgggggtcagggacccacttgaggaggcagtctgtccgttctcagatctccagctgcgtgctgggagaaccactactctcttcaaagctgtcagacagggacatttaagtctgcagtgttttctgctgccttttgtttggttatgccctgcccccagaggtggagtctacagaggcaggcaggcctccttgagctgcagtgggctccacccagttccagcttccaggccgctttgtttacctactcaagcctcagcaatggcgggcgcccctcccccagcct

SEQ ID NO: 12111 - DNA, 401 bp, Homo sapiens
caacccctgcctttttttgttttccatttgcttggtagatcttcctccatccctttattttgagcctatgtgtgtctctgcatgtgagatgggtttcctgaatacagcacactgatgggtcttgactctttatccaatttgccagtctgtgtcttttaattggagcatttagcccatttacatttaaggttaatattgttatgtgtgaatttgatcctgtcattatgatgttagctggttattttgctcgttagttgatgcactttcttcctagcctcgctggtctttacaatttggcatgtttttgcagtgggtggtaccagttgttcctttccatgtttagtgcttccttcaggagctcttttagggcaggcctggtggtgagaaaatctctcagcatt

SEQ ID NO: 12112 - DNA, 2130 bp, Homo sapiens
gtgtggtgctgaatagaatgcatattctgttgatttggggtgaagagttctgtagatgtctattaggtctgcttggtgcagagctaagttcagttcctggatatccttgttaactttctgtctcgttgatctgtctaatgttgacagtggggtgttaaagtctcccattattattgtgtgggagtctaagtctctttgtaggtctctatggacttgctttatgaatctgggtgctcctgtattgggtgcatatatatttaggatagttagctcttcttgttgaattgatccctttatcattatgtaatggccttctttgtctcttttgatctttgttggtttaaagtctgttttattaaagactaggattgcaacccctgccttttttttgttttccatttgcttggtagatcttcctccatccctttattttgagcctatgtgtgtctctgcacgtgagatgggtttcctgaatacagcacactgatgggtcttgactctttatccaatttgccagtctgtgtcttttaattggagcatttagcccatttacatttaaggttaatattgttatgtgtgaatttgatcctgtcattatgatgttagctggtgattttgctcgttagttgatgcagtttcttcctagcctctctggtctttacaatttggcatgtttttgcagtggctggtaccagttgttcctttccatgtttagtgcttccttcaggagctcttttagggcaggcctggtggtgacaaaatctctcagtatttgcttgtctgtaaaggattttatttctccttcacttatgaagcttagtttggctggatatgaaattcttggttgaaaattcttttctttaagaatgttgaatattggcccccactctcttctggcttgtagagtttctgccaagagatcagctgttagtctgatgggcttccctttgtgggtaacctgacctttctctctggctgcccttaacattttttccttcatttcaactttggtgaatctgacaattatgtgtctttggagttgctcttctcgaggagtatctttgtggcattctctgtatttcctgaatttgaatgttggcctgccttgctagattggggaagttctcctggataatatcctgcagagtgttttccaacttggttccattctccccgtcactttcaggtacaccaatcagacatagatttggtcttttcacatagtcccatatttcttggaggcttcgttcgtttctttttatccttttttctctaaacttctcttcttgcttcatttcattcatttggtcttccatcactgataccctttcttccagttgatcgaatcagctactgaggcttgtgcattcatcacgtatttctcgtgccatggttttcagctctatcaggtcctttaaggacttctctgcattggttattctagttagccattcgtctaattttttttcaaggtttttaacttctttgccatgggttcgagcttcctcctttagcttggagtagtttgatcatctgaagccttcttctctgaagtcgtcaaagtcattctccatccagctttgttccattgctggtgaggagctgcgttcctttggaggaggagaggtgctctgatttttagagtttccagtttttctgctctgttttttccccatgtttgtggttttatctaccttttgtctttgatgatggtgacatacagatggagttttggtgtggatgtcctttctgtttgttagttgtccttctaacagtcaggacactcagctgcaggtctgttggagtttgctggaggtccactccagaccctgtttgcctgggtattagcagcggaggctgcagaaccgcggatattggtgaacagcaaatgttgctgcctgatcgttcctctggaagttttgtctcagagcagtacccggccatgtgaggtttcagtctgcccctactggggggtgcctcccagttagtctactcgggggtcatggacccacttgaggaggcagtctttccattctcagatctccagctgtgtgctgggagaaccactactctcttcaaagctgtcagactgggacatttaagtctgcagagttttctgctgccttttgt

SEQ ID NO: 12113 - DNA, 541 bp, Homo sapiens
tctaatgttgacagtggggtgttaaagtctcccattattattgtgtgggagtctaagtctctttgtaggtcactaaggacttgctttatgaatctgggtgctcctgtattgggtgcatatatatttaggatagttagtagttctccttgttgaattgatccctttaccgttatgtaatggccttcttttctcttttgaactgtgttggtttaaagtctgttttatccaagactaggattgcaacccctgccttttttgttttccatttgcctggtagatcttcctccatccctttattttgagcctatgtgtgtctctgcacgtgagatgggtttcctgaatacagcacactgatgggtcttgactctatatccaatttgccagtctgtgccttttaattggagcatttagcccatttacatttaaggttagtattgttatgtgtgaatttgatcctgtcattatgatgttagctggttattttgcttgttagttgatgcagtttcttcctagccttgatggtctttacaatttggcatgt

SEQ ID NO: 12114 - DNA, 2284 bp, Homo sapiens
tttttgatgtgctgctggatttggtttgccagcattttattgaggattttcacatcaatgatcatcagggatattggtctaaaattctctttttttgttgtatctctatcaggctttgctatcaggatgatgctggcctcataaaatgagttagggaggattccctctttttctattgtttggaatagtttcagaaggaatggtaccagctcctctttgtacctctggtagaattcagctgtgaatccatctggtcctggactttttttggttggtaggctattgatttttgcctcaatttcagagcctgttattggtctatgcagggattcaacttcttcctggtttaattttgggagggtgtatgtgtcaaggaatttatccatttcttctagattttctagtttatttgcatagaggtgtttatagtattctctgatggtagtttgtatttctgtgggatcggtggtgatatcccctttatcattttttattgtgtctattttattcttctctcttttcttctttgttagtcttgctagcgatctatcaattttgttgatcttttcaaaaaaccagctcctggattcattgattttttgaagggttttttgtgtctctatctccttcagttctgctctgatcttagttatttcttgccttctgctagcttttcaatttgtttgctcttgcttctctagttcttttaattgtgatgttagggtgtcaatttttgatctttcctgctttctcctgtgggcatttagtgctgtaaatttctctctacacactgttttaaatgtgtccccaagattctggtatgttgtgtctttgttctcgttggtttcagagaacatctttatttctgccttcatttcgttatttacccagtgtcattcaggaacaggttgttcagtttccatgtagttgtccagttttgagtttcttaatcctgagttctagtttgattgcactgtggtatgagagacagtttgttatcatttctgttcttttagaattgctgaggagtgctttacttccaattatgtggtcaattttggaataagtgcaatgtggtactgagaagaatgtatattctgttgatttggggtggagagttctgtagaagtctattaggtccatttggtgcagagatgagttcaagtcctgcatatccttgttaactttctgtctcattgatctgtctaatgttgacagtggggtgttaaagtatcccattattattgtgtgggagtctaagtctctttgtaggcctctaaggacttgctttatgaatctgggtgctcctgtagtgggtgcatatatatttaagatggttagctcttcctgttgaattgatccctttaccattatgtaatggccttctttgtctcttttgatctttgttggtttaaaatctgtcttgtcagagactaggattgcaacccctgcttttttttgttttccatttgcttggtagatcttcctccattcctttattttgagcctatgtgtgtctctgcacgtgagatgggtctcctgaatacagcacactgatgggtcttgactgtttatccaatttgccagtctgtgtcttttaattggagcatttagcccatttacatttaaggttaatattgttatgtgtgaatttgatcctgtcattatgatgttagctggttattttgctcattagttgatgcagtttcttcctagccttgatggtctttacaatttggcatgtttttgcagtggctggtaccggttgttcctttccatgtttagtgcttccttcaggagctcttgtaaggtcagcctggtggtgacaaaatctctcagcatttgtttgtctgtaaaggattttatttctccttcacttatgaatcttagtttggctggatattaaattctggtttgaaaattcttttctttaagaatgttgaatattggcccccactctcttctggcttgtagagtttctgctgagagatccactgttagtatgatgggcttccctttgtgggtaacctgacctttctctctggctgcccttaacattttttccttcatttcaactttggtgaatctgacaattatgtgtcttggagttgctcttctcaaggagtatctttgtggtgttctctgtatttcctgaatttgaatgttggcctgctttgataggttgaggaagttctcctggataacatcctgaacagtgttttccaacttggttccattctccccatcactttcaggtacaccactcagacatagatttggtctt

SEQ ID NO: 12115 - DNA, 2525 bp, Homo sapiens
tttttgtgtctctatttccttcattctgctctgattttagttatttcttgccttctgctagcttttgaatgtgtttgctcttgcttttctagttcttttaattgtgatgttagggtgtcaattttggatctttcctgctttatcttgtgggcatttagtgctataaatttccctctacacactgctttgaatgtgtcccagagattctggtatgttgtgtctttgttcttgttggtttcaaagaacatctttgtttctgccttcatttcgttatgtactgtacccattcaggagcaggttgttcagtttccatgtagttgagcggttttgagtgagattcttaatcctgagttctagtttgattgcactgtggtctgagagacagtttgttataatttctgttcttttacatttgctgaggagagctttacttccaactatgtggtcaattttggaataggtgtggtgctgaaaagaatgtatattctgttgatttggggtggagagttctgtagatgtctattaggtccgcttggtgcagagctgagttcaattcctgggtatccttgttgactttttgtctcgttgatctgtctaatgttgacagtggggtgttaaagtctcccattattattgtgtgggagtctaagtctctttgtaggtcactcaggacttgctttatgaatctgggtgctcctgtattggttgcatatatatgtaggatagttagctcttcttgttgaattgatccctttaccattatgtaatggccttctttgtttcttttgatctttgttggtttaaagtctgttttatcagagactagtattgcaacccctgcctttttttgttttccatttgcttggtagatcttcctccatccttttattttgagcctatgtgtgtctctgcacgtgagatgggtttcctgaatacagcacactgacgggtcttgactctttatccaatttgccagtctgtgtcttttaattggagcatttagtccatatacatttaaagttaatattgttatgtgtgaatttgatcctgtcattatgatgttagctggttattttgttcgttagttgatgcagtttcttcctagtcttgatggtctttacattttggcatgattttgcagtggctggtactggttgttcctttccatgtttagtgcttccttcaggagctcttttagggcaggcctggtggtgacaaaatctctcagcatttgcttgtctgtaaagtattttatttctacttcactgatgaagcttagtttggctggatatgaaattctgggttgaaaattcttttctttaagaatgttgaatattggcccctactctcttctggcttgtagggtttctgccaagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaacctgaacgttggcctgccttgctagattggggaagttctcctggataatatcctgcagagtgttttccatcttggttccattctccccatcactttcaggtacaccaatcagatgtagatttggtcttttcacatagtcccatatttcttggaggctttgttcgtttctttttattcttttttctctaaacttcccttctcgcttcattttattcatttcattttccattgctgataccctttcttccagttgatcgcatcagctcctgaggcttctgcattcttcacgtagttttcgagccttggctttcagctccatcagctcctttaagcacttctctgtattggttattctagttatacatttgtctaaatttttttcaaagttttcaacttctttgcctttggtttgaatttcctcctgtagctcggagtagtttgatcatctgaagccttcttctctcaactcgtcaaagtcattctccatccagctttgttccattgctggtaaggaactgcgttcctttggaggaggagaggcgctctcctttttagagtttccagtttttctgctctgttttttccccatctttgtggttttatctacttttggtctttgatgatggtgatgtacagatgggtttttggtgtggatatcctttctgttgttagttttccttctaacagacaggaccctcagctgcaggtctgttggagtttgctagaggtccactccagaccctgtttacctgggtatcagcagcggtgtctgcagaaccacggattttcatgaaccgcgaatgctgctgtctgatcgttcctctggaagttttgtctcagaggagtacctggccatgtgaggtatcagtctgccccactggggggtgcctcccggttaggctgctcaggggtcaggggtcagggacctacttgaggaggcagtctgcccattctcagatctcaaactgcgtgctgggagaac

SEQ ID NO: 12116 - DNA, 3688 bp, Homo sapiens
gtctaacatttaagtctctaatccatcttgaattaatttttgtataaggtgtaaggaagggatccagtttcagctttctacatatggctagtcagttttcccagcaccatttattaaatagggaatcctttccccattgcttgtttttgtcaggtttgtcaaagatcagatagttgtagataagcggcattatttctgagggatctgttctgttccattggtctatatctctattttggtaccagtaccatgctgttttggttactgtagccttgtagtatagtttgaagtcaggtagtgtgatgcctccagctttgttcttttggcttaggattgacttggcaatgcgggctctttttttggttccatatgaactttaaagtatttttttccaactctgtgaagaaagtcattggcagcttgatggggatggcattgaatctataaattaccttgggcagtatggctgttttcacaatattgatttttcctatccatgagcatggaatgctcttccatttgtttgtatcctcttttatttcactgagcagtggtttgtagttctccttgaagaggtccttcacatcccttgtttgttggattcctaggtatgttattctctttgaagcaattgtgaatgggagttcactcattatttggctctctgtttgtctgttattgatgtataagaatgcttgtgatttttgtacattgattttgtatcctgagactttgctgaagttgcttatcagcttgaggagattttgggctgagacgatggggttttctagatatacaatcatgtcatctgcaaacaggaacaatttgacttcttcttttcctaattgaataccctttatttccttctcctgcctgattgccctggccagaacttccaacactatgttgaataggagtggtgagagagggcatctctgtcttgtgccagttttcaaagggaatgcttccagtttttgcacattcagtatgatattggctgtgggtttgtcacagatagcttattattttgagatacgtcccatcaatacctaatttattgagagtttctaggatgaaggttgttgaattttgtcaaaggccttttctgcatctattgagataatcatgtggtttttgtctttggttctgtttatatgatggattacatttattgatttgtgtatgttgaaccagccttgcatcccagagatgaagcccatttgatcatgatggataagctttttgatgggctgctggattctgtttgccagtattttattgaggatttttgcattaatgttcatcaaggatattggtctaaaattctcttttttggttgtgtctctgccaggttttggtattaggatgatgctggcctcataaaatgacttagggaggattccctctttttctgttgattggaatagtttcagaaggaatggtaccagctcctctttgtacctctggtagaattcggctgtgaatccatctggtcctggactttttttggttggtaagctattgattattgcctcaatttcagagcctgttattggtctattcagagattcaacttcttcccggtttagtcttgggaggatgtatgtgttgaggaatttatccatttcttctagattttctagtttgtttgcatacaggtgtttatagtattctctgatggtagtttgtatttctgtgggattggtggtgatatcccctttatcatttttcattgcgtctatttgattcttctgtcttctttattagtcttgctagcagtctatcaattttgttgatcttttcaaaaaaccagctcctggattcattaattttttgaagggttttttgtgtctctatttccttcagttctgctctgatcttagttaattcttgccttctgctagcttttgaatgtgtttgctcttgcttttgtagctcttttaattgtgatgttaaggtgtcaattttagatctttcctgccttctcttgtgggcatttagtgctataaatttccctctacacactgctttgaatgtgtcccagagattctggtatgttgtgtctttgttctcattggtttcaaagaacatctttatttctgccttcatttcattatttacccagtagtcattcaggagcaggttgttcagtttccatgtagttgagcggttttgagttagtttcttaatcctgagttctaatttgattgcactgtggtctgagagacagtttgttataatttctgttcttttacatttgctgaggagagctttacttccaactatgtggtcaattttggagtaggtgtggtgtggtgctgaaaagaatgtatattctgttgatttggggtggagagttctatagatgtctcttaggtcaatttggtgcagagctgagttcaattcctgggtatccttgttaactttctgtctcgttgatctgtctaatgttgacagtggggtgtaaagtctcccattattattgtgtgggagtctaagtctctttgtaggtcactcaggacttgctttatgaatctgggtgctcctgcattgggtgcatatatctttaggatagttagctcttccttttgaattgatccctttaccattatataatggccttctttatctcttttaatctttgttggtttaaagtctgttttatcagagactaggattgcaacccctacatttttttgttttccatttgcttggtagatcttcctccatccctttattttgagcctatgtgtgtctctgcacgtgagatgggtttcctgaatacagcacactgatgggtcttgactctttatccaatttgccagtctgtgtcttttaattggagcatttagcccatttacatttaaagttaatattgttatgtgtgaatttgatcctgtcattatgatgttagctggttattttgcttgatagttgatgcagtttcttcctagcctttatggtctttacaatttggcatgtttttgcagtggctggtaccagttgttcctttccatgtttagtgcttccttcaggagctcttttagggcaggcctggtggtgacaaaatctctcagcatttgcttgtctgtaaagtattttatttctccttcacttatgaagcttagtttggctggatgtgagattctgggttgaaaattcttttcttaaagaatgttgaatattggtccccactctcttctggcttgcagagtttctgccgagagatcagctgttagtctgatgggcttccctttgtgggtaacctgaccttcctctctggctgcccttaacattttttccttcatttcaactttggtgaatctgacaattatgtgtcttggacttgctcttcttgaggagtatctttgtggagttctctgtatttcctgaatttgaatgttggcctgcctttctagattggggaagttctcctggataatatcctgcagagtgttttccaacttggttccattctccccgtcactttcaggtacaccaatcagacgtagatttggtcttttcacatagtcccatatttcttggaggctttgttcatttctttttattcttttttctctaaatttctcttctcgcttcatttcattcatttcatcttccatcactgatacactttcttccagttgatctcctcggctactaaggcttctgcattcgtcacgtagct

SEQ ID NO: 12117 - DNA, 4751 bp, Homo sapiens
ccatcccctgactgtacaacaggccccggtttgtggtgttccccaccctgtgtccaagtgttctcattgttcagttcccacctatgagtgagaacatgcagtgtttggttttctgtccttccaagagtttgctcagaatgatggtttccagcttcatctatctccctacaaaggacatgaactcatccttttttatggcttcatagtattccatgttgtatatgtgccacattttcttaacccagtctatcactgatggacatgtgggttggttccaagtatttgctattgtgaatagtgccgcaataaacatacgtgtgcatgtgtctttatagtagcatgatttataatcctttgggtatatacccagtaatgggatggctgggtcaaatagtatttctagttctagatccttgaggaattgccacactgtcttccacaatggttgaactagtttacagtcccaccaacagtgtaaaagtgttcctatttctccacatcctcaccagaacctgttgttttcctgactttttaatgatcaccattctaactggtgtgagatggtatctcattgtggttttgatttgcatttctctgatggccagtgatgatgagcattttttcatgtgtctgttggctgcataaatgtcttcttttgagaagtgtctgttcatatcctttgcccactttttgatggggttgtttgattttttcttgtaaatttgtttaagttctttgtagattctggatgctagccttttttcagatgggtagattgtaaaaaattttctcctgttctgtaggttgcctgttcactctgatggtagtttcttttgctgtgcagcagctgtttagtttaattagatcccatttgccaattttggcttttattgccattgcttttggtattttagtcatgaagtccttgcccatgcctatgtcctgaatggtattgcctaggttttcttctagggtttttatggttttaggcctaacatttaagtatttaatccatctttaattaattttggtttaaggtgtaaggaagggatccagtttcagctttctacatatggctagccagttttcccagcaccatttattaaatagggaatcctttccccatttcttgtttttgtcaggtttgtcaaagatcagatggttgtagatatgtggtattatttctgagggctctgttctgttccattggtctatatctctgttttggtaccagtaccatgctgttttagttactgtagccttgtagtatagtttgaagtcaggtggcatgatgcctccagccttgttcttctggcttatgatttccttggcaatgtgggctcttttttggttccatatgaactttaaagtagtttttttcaattctgtgaaaaaagtcattggtagcttgatggggatggcattgaatctataaattatcttgggcagcatggccattttcatgatactgactcttcctatctgtgagcatggaatgttcttctatttgtttgtgtcctcttttattttgttgagcagtggtttgtagttctccttgaagaggtccttcacgtcccttgtaagttggattcctaggtattctctttgaagtaatagtgaatgggagttcactcatgatttggctctctgtttgtctcttattggtgtataggaatgcttgtgattttttcacattgattttgtatcctgagactttgctaaagttacttatcagcttaaggagattttgggctaagacgatggggttttctaaatatacaatcatgtcatctgcaatcagggacaatttgatttcctcttttcctaactgaataccctttatttctttctcctgcctgattgccctggtcagaacttccaacactatgttgaataggagtggtgagagagggcatccctgtcttgtgccagttttcaaagggaatgcttccagtttttgcccattcagtatgatattggctgtgggtttgtcataaatagctcttattattttgagatacgtcccatcaatacctagtttattgagagtttttagcatgaagggctgttgaatgctttttctgcatctattgagataatcatgtggggcttttttttggtttttgtttttgagacagagtctcgctttgttgcccaggctggagtgcagtggcgcgatcttggctcactgcaagctccgcctcccaggttcacgccattctcctgcctcagcctcccgagtagctgcaactacaggcacccaccaccacacccagctaattttttgtatttttagtagagatggggtttcaccatgttagccaggatggtctcaatctcctgacctcgtgatctgcccaccttggcctcccaaagtgttgggactacaggtgtgagccaccgctcccagccccaatcatgtggtttttgtctttggttctgtttatataatggattacgtttattgatttgcatatgttaaaccagccatgcatcccagggatgaagccaacttgatcatgatggataagctttttgatgtgctgctggattcagtttgctagtattttattgagcattttcacttcaatgttcatcagggatattggtctataattctctttttttgttgtgtctctgccaggctatggtatcaggatgatgctggcctcataaaatgagttagggagaattcccttgttttctattgattggaatagtttcagaaggaatggtaccagctcctctttgtacctctggtagaattcggctgtgaatccatctggtcctggactttttttggttggtaggctattaattattacctcaatttcagagcctgttattgatctattcagggattcaacttcttcctggtttagtcttgggagggtgtatgtgtccaggaaggtagattttctagtttatttgcacagaggtgtttatagtattctctgatggtcatttgtatttctgtgggattggtggtgacatcccctttatcattttttattgagtctatttgattcttctctcttttcttctgtattagtcttgctagtggtctatcaattttgttgatcttttcaaaaaaccagctcctagattcattgattttttgaagggtttttcatgtctctatctccttcagttctggctctgatcttagttatttcttaccttctgctagcttttgaatgtgtttgctcttgcttctctagttcttttcattgtgattttagggtgtcaattttagatctttcctgctttctcttgtgggcatttagtgctataaatttccctctacacactactttaaatgtgtcccagagattctggtacgtcatgtctttgttctcattggtttcaaagaacatctttatttctgctttcacttagttatttactcaatagccattcaggagcaggttgttcagtttccatgtagttgagtggttttgagtgagtttcttaatcctgagttctaatttgattgcactgtggtctgagagacagtttgttataatttctgttcttttacatttgttgaggagcgctttacttccaactatgtggtcaattttggaataagtgccatgtggtgcggagaagaatgtatattctgttgatttggggtggagagttctgtagaagtctattaggtctgcttggtgcagagctgagttaaagtcctggatatccttgttaactttctgtctcattgatctgtctaatgttgacagtggagtgttaaagtctcctattattattgtgtggaagtctaagtctctttgtaggtctctaaggacttgctttatgaagctgggtgctcctgtattgggtgcatatatatttaggatagttatctcttcttgttgaattgatccctttaccattatgtaatggccttctttgtctcttttgatctttgttggcttaaagtctgttttatcagagactgggattgcaacccctgcttttcttttgctttccatttgcttggtagatcttcctccatccctttattttgagcctatgtgtgtctctgcacatgagatgggtctcctgaatacagcacactgatgatgcgtcttgactcattatcgaatttgccagtctgtgtcttttaattgggggcatttagcccatttacatttaaggttaatattgttatatgtgaatttgatcctgtcattatgatgttagctggttattttgcttgttagttgatgcagtttcttcctagcatcaatggtctttacaatttggcatgtttttccagtggctggtaccagttctttttcatgtttagtgtttccttcaggagctcttgtaaggctggtggtgacaaaatccctcagcatttgcttgtctgtaaaggattttatttctccttcacctatgaagtttggctggatatgaaattctgggttgaaaattattttctttaagaatgttgaatattggcccccactctcttctggcttatagagtttctgctgagaggtccgctgttagtctgatgggcttccctttgtgggtaacgcgacctttctctctggctgcccttaacattttttctgtcatttcaaccttggtgaatctgacaattatgtgtcttggggttgctcttctcaaggagtatctttatggcattctctgtatttcctgaatttcaatgttggcctgccttgctaggttggggaagttctcctcgataatatcctgaagagcgttttccaacttggttc

SEQ ID NO: 12118 - DNA, 4040 bp, Homo sapiens
ttttttttttttcttttattattatactttaagttttatgatacatgtgcacattgtgcaggttagttacatatgtatacatgtgccacgctggtgcgctgcacccactaactcgtcatctagcattaggtatatctcccaatgctatccctcccccctccccccaccccacaacagtccccagagtgtgatgttccccttcctgtgtccatgtgatctcactgttcaattcccacctatgagtgagaatatgcggtgttttgtttattgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgctgcaataaacatacctgtgcacctgtctttatagcagcatgatttatagtcctttgggtatatacccagtaatgggatggctgggtcaaatggtatttctagttctagatccctgaggaactgccacaccgacttccacaatggttgaactagtttacagtcccaccaacagtgtaaaagtgttcctatttctccacatcctctccagcacctgttgtttcctgactttttagtgactgccattctaactggtgtgagatggtatctcattgtggttttgatttgcatttctctgatggtcagtgatgatgagcattttgtcatgtgttttttggctgcataaatgtcttcttttgagaagtgtctgttcatatccttcacccactttttgatggggttgtttgtttttttcttgtgaatttgtttgagttcattgtagattctggatattagccctttgtcagatgaataggttgcaaaaattttctcccatttgtaggttgcctgttcacactgatggtagtttcttttgctgtacagaagctctttagtttaattagatcccatttgtcaattttgtcttttgttgcccttgcttttggtgttttagacatgaagtccttgcccatgcctatgtcctgaatggtattgcctaggttttcttctagggtttttatggttttaggtctaatgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcgttatttctgagggctctgttctgttccattggtctatatctctgctttggtaccagtaccatgctgttttggttactgtaggcttgtagtatagtttgaagtcaggtagtgtgatgcctccagctttgttcttttggcttaggattgacttggcgatgcgggctctttcttggttccatatgaactttaaagtggttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttcattgagcagtggattgtacttctccttgaagaggtccttcacatcccttgtaagttggattcctaggtattttattctctttgaagcaattgtgaatgggagttcactcatgatttggctctctgtttgtttgttgttggtgtataagaatgtttgtgatttttgtacattgattttgtatcctgagactttgctgaagttgcttatcagcttaaggagattttgggctgagacaatggggttctctagatatacaatcatgtcgtctgcaaacagggacaatttgacttcctcttttcctaattgaataccctttatttccttctcctgcctaattgccctggacagaacttccaacactatgttgaataggagtggtgagagagggcatccctgtcttgtgccagttttcaaagggaatgcttccagtttttgcccattcagtatgatattggctgtgggtttgtcatagatagctcttactattttgagatacgtcccatcaatacctaatttactgagagtttttagcatgaagggttgttgaattttgtcaaaggccttttctgcatctattgagataatcatgtggtttttgtctttggttctgtttatatgctggattacatttattgatttgcgtatattgaaccagccttgcatcccagggatgaagcccacttgatcatggtggataagctttttgatgtgctgctggatttggtttgccagtattttattgaggatttttgcatcaatgttcatcaaggatattggtctaaaattctcttttttggttgtgtctctgccaggctttggtatcagaatgatgctggcctcataaaatgagttagggaggattccctctttttctattgattggaatagtttcagaaggaatggtaccagttcctccttgtacctctggtagaattcagctgtgaatccatctggtcctggactctttttggttggtaagctattgattattgccacaatatcagatcctgttattggtctattcagagattcaacgtcttcctggttttgtcttgggagagtgtatgtgtcgaggaatttatccatttcttctagattttctagtttatttgcgtagaggtgtttgtagtattctctgatggtagtttgtatttctctgggattggtggtgatatcccctttatcattttttattgcgtctatttgattcttctctctttttttctttattagtcttgctagtggtatatctattttgttgatcctttcaaaaaaccagctcctggattcattaattttttgaagggttgtttgtgtctctatttccttcagttctgctctgattttagttatttcttgccttctgctagcttttgaatgtgtttgctcttgcttttctagttcttttaattctgatgttagggtgtcaattttggatctttcctgctttctcttgtgggcatttagtgctataaatttccctctacacgctgctttgaatgcgtcccagagattctggtatgttgtgtctttgttctcgtcggtttcagagaacatttttatttctgccttcatttcgttatgtacccagtagtcattcaggggcaggttgttcggtttccatgtagttgagtggttttgagtgagattcttaatcctgagttctagtttgattgcactgtggtctgagagatagtttgttgtaatttctgttcttttacatttgctgaggagagctttacttccaagtatgtggtcaattttggaataggtgttgtgtggtgctgaaaaaaatgtatattctgttgatttggggtggagagttctgtagatgtctattaggtcagcttggtgcagagctgagttcaattcctaggtatccttgttgactttctgtcttgttgatctgtctaatgttgacagtggggtgttaaagtctcccattattaatgtgtgggagtctaagtctctttgtaggtcactcaggacttgctttttgaatctgggtgctcctgtattgggtgcatatatatatttaggatagttagctcttcttgttgaattgatccctttaccattatgtaatggccttctttgtctcttttgatctttattggtttaaagtctgttttatcagagactaggattgcaacccctgcctttttttgttttccatttgcttggtagatcttcctccatccttttattttgagcctatgtgtgtctctgcacatgagatgggtttcctgaatacagcacactgatgggtcttgactctttatccaatttgccagtctgtgtcttttaattggagcatttagtccatttacatttaaagttaacattgttatgtgtgaa

SEQ ID NO: 12119 - DNA, 3211 bp, Homo sapiens
ggccattttcatgatattgattcttcctgcccatgagcgtggaatgttcttccatttgtttgtatcctcttttatttcattgagcagtggtttgtagttctccttgaagaggtccttcacgtcccttgtaagttggattcctaggtattttattctttttgaagcaattgtgaatgggagttcactcatgatttggctctctgtttgtctgttatttgtgtataagaatgcttgtgatctttgcacactgattttgtatcctgagactttgctgaagttgcctatcagcttaaggagattttgggctgagacgatggggttttctaggtatacaatcatgtcatctgcaaacagggacaatttgacttcctcttttcctaactgaataccctttatttccttctcctgcctgattgccctggccagaacttccaacactatgttgaatagcagtggtgagagagggcatccctgtcttgtgccctggaatgcttccagtttttgtccattcagtatgatattggctgtgggtttgtcatagatagctcttattattttgagatacgtcccatcaatacctaatttattgagagtttttagcatgaagggctgttgaattttgtcaaaggccttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcagtttgtcagtattttattgaggattttcacattgatgttcatcagggatattggtctaaaattctctttttttgttttgtctttgcaaggctttggtatcaggatgatgctggcctcataaaatgagttagggaggattccctctttttctattgattggaatagtttcagaaggaatggtaacagctcccccttgtacctctggtagaattcggctgtgaatccatctggtcctggactttttttggttggtaagctattaattattgcctcaatttcagatcctgttattggtctattcagggattcaacttcttcctggtttagtcttgggagggtgtatgtgtcgaggaatttatccatttcttctagattttctagtttatttgcgtagaggtgtttatagtattctctgatggtagtttgtatttctgtgggattggtggtgatatcacctttatcattttttattttgtctatttgattcttctctcttttcttccttattagtcttgctagcggtctatcaattttgttgatcttttcaaaaaaccagctcctggattcaatgattttttgaagggttttttgtgtctctatttccttcagttcttttctgatcttagttatttcttgccttctgctagcttttgaatgcgtttgctcttgcttccctagttcttttaattgtgatgttagggtgtcagttttagatctttcctgctttttcttgtgggcatttagtgctataaatttccctctacacactgctttgaatgtgtcccagagattctggtatgttgtgtctttgttcttgttggtttcaaagaacatctttatttctgccttcatttcgttatgtacccagtagtcattcaggagcaggttattcagtttccatgtagttgagtggttttgattgagtttcttaatcctgagttctagtttgagtgcactgtggtctgagagacagtttgttataatttctgttcttttacatttgctgaggagtgctttacttccaactatgtggtcaattttggagtaggtgtggtgtggtgctgaaaagaatgtatattccattgatttggggtggaaagttctataaatgtctattaagtccgcttggtgcagaggtgagttcagttcctggatatccttgttaactttctgtctcaatctgtctaatgttgacagtggggtgttaaagtcttccattattattgtgtgggagtctaagtctctttgtaggtctctaaggacttgctttatgaatctgtgtgctcctgtattggatgcatatatatttaggatagctagctcttcttgttgaattgatccctttgccattatgtaatggccttccttgtctcttttgatctttgttggtttaaagtctgttttatcagagactacgattgcaatctctgcttttttgtttgtttgttttccatttgcttgttagatcttcctccatccctttattttgagtctatgtgtgtctctgcacatgagatgggtctcctgactacagcacactgacgggtcttgactctttatccaatttgccagtctgtgtcttttaattggagcatttagcccatttacatttaaggttaatattgttatgtgtgaatttgatcctgtcattatgatgttagctggtgattttgcccattagttgatgcagtttcttcctagcatcgatggtctttacaatttggcatgtttttgcagtggctggtaccggttgttcctttccatgtttagtgcttccttcaggagctcttttagggcaggcccagtggtgacaaaatctctcagcatttgcttgtctgtaaagtattttatttctccttcacttatgaagcttagtttggctggataggaaattctgggttgaaaattcttttctttaggaatgttgaatattggcccccactctcttcaggcttatagagtttctgctgagagatcagctgttagtctgatgggcttccctttgtgcgtaacctgacctttctttctggctgcccttaacatttttccttcatttcaactttggtgaatctgacaattatgtgtcttggagttgctcttctctaggagtatctttgtggcgttctctgtatttcctgaatttgaatgttggcctgccttgctagattggggaagttctcctggataatatcctgcagtgttttccaacttggttccattctccccgtcactttcaggtacaccaatcagacgtagatttggtcttttcacatagtcccatatttcttggaggctttgttcatttctttttattcttttttctctaaacttctcttctcgcttcatttcattcatttgatcttccatcactgataccctttcttccagttgatcaaatcagctactgaggcttgtgcat

SEQ ID NO: 12120 - DNA, 4559 bp, Homo sapiens
gtctaacgtttaagtctttaatccatcttgaattgatttttgtataaggtgtaaggaagggatccagtttcagctttctacgtatggctagccagttttcccagcaccatttattaaatagggaatcctttccccattgcttgtttttgtcaggtttgtcaaagatcagatagttgtagatatgcggcgttatttctgagggctctgttctgttccattgatctatatctctgttttggtaccagtaccatgctgttttggttactgtagcgttgtagtatagtttgaagtcaggtagtgtgatgcctccagctttgttcttttggcttaggattgccttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctctttaatttccttgagcagtggtttgtagttctccttgaagaggtccttcacatcccttgtaagttggattcctaggtattttattctctttgaagcaattgtgaatgggagttcactcatgatttggctctctgtctgttgttggtgtgtaagaatgcttgtgatttttgtacattgattttgtatcctgagactttgctgaagttgcttatcagcttaaggagattttgggctgagacgatggggttttctagataaacaatcatgtcatctgcaaacagggacaatttgacttcctcttttcctaattgaataccctttatttccttctcctgcctaattgccctggccagaacttccaacactatgttgaataggagtggtgagagaggacatccctgtcttgtgccagttttcaaagggaatgcctccagtttttgcccattcagtatgatattggctgtgggtttgtcatagatagctcttattattttgaaatatgtcccatcaatacctaatttattgagagtttttagcatgaagggttgttgaattttgtcaaaggctttttctgcatctattgagataatcatgtggtttttgtctttggctctgtttatatgctggattacatttattgatttgcgtacattgaaccagccttgcatcccagggataaagcccacttgatcatggtggataagctttttgatgtgctgctggattcggtttgccagtattttattgaggatttttgcatcaatgttcatcaaggatattggtctaaaattctctttttttgttgtgtctctgcctggctttggtatcagaatgatgctggcctcataaaatgagttagggaggattccctctttttctattgattggaatagtttcagaaggaatggtaccaattcctccttgtatctctggtagaattcggctgtgagtccatctggtcctggactctttttgattggtaagctattgattattgccacaatttcagctcctgttattgggctattcagagattcaacttcttcctggtttagtcttgggagagtgtatgtgtccaggaatttatccatttcttctagattttctagtttatttgcgtagaggtgtttgtagtattccctgatggtagtttgtatttctgtgggatcggtggtgatatcccctttatcattttttattgcgtctatttgattcttctctctttttttctttattagtcttgctagcggtctatcaattttgttgatcctttcaaaaaaccagctcctggattcattaattttttgaagggttttttgtgtctctatttccttcagttctgctctgattttagttatttcttgctttctgctagcttttgaatgtgtttgctcttgcttttctagttctttcaattgtgatgttagggtatcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcgttatgtacccagtagtcattcaggagcaggttgttcagtttccatgcagttgagcggttttgagtgagattcttaatcctgagttctagtttgattgcactatggtctgagagatagtttgttataatttctgttcttttacatttgctgaggagagctttacttccaagtatgtggtcaattttggaataggtgtggtgtggtgctgaaaaaaatgtatattctgttgatttggggtggagagttctgtagatgtctgttaggtctgcttggtacagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatcttggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgagggtcttgactctttatccaatttgccagtctgtgtcttttaattggagcatttagtccatttacatttaaagttaatattgttatgtgtgaatttgatcctgtcattatgatgttagctggttattttgctcgttagttgatgcagtttcttcctagtcttgatggtctttacattttggcatgattttgcagcggctggtactggttgttcctttccatgtttagtgcttccttcaggagctcttgtaaggcaggcctggtggtgacaaaatctctcagcatttgcttgtctgtaaagtattttatttctccttcacttatgaagcttagtttggctggatatgaaattctgggttgaaaattcttttctttaagagtgttgaatattggcccccactctcttctggcttgtagggtttctgctgagagatctgctgttagtctgatgggcttccctttgagggtaacccgacccttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaagttggttccattctccccatcactttcaggtacaccaatcagacgtagatttggtcttttcacatagtcccatatttcttggaggctttgctcatttctttttattcttttttctctagacttcccctctcgcttcatttcattcatttcatcttctatcgctgataccctttcttccagttgatcgcattggctcctgaggcttctgcattcttcacgtagttctggagccttggttttcagctccatcagctcctttaagcacttctctgtattgtttattctagttatacattcttctaaatttttttcaaagttttcaacttctttgcctttggtttgaatgtcctcccgtagctcagagtaatttgatcgtctgaagccttcttctctcagctcgtcaaagtcattctccatccagctttgttccgttgctggtgaggaactgcattcctttggaggaggagaggtgctctgctttttagagtttccagtttttctgttctgttttttccccatctttgtggtttttatctacttttggtctttgatgatggtgatgtacagatgggtttttggtgtgggtgtcctttctgtttgttagttttccttctaacagacaggaccctcagctgcaggtctgttggagtaccctgccgtgtgaggtgtcagtgtgcccctgctggggggtgccttccagttaggctgctcaggggtcaggggtcagggacccacttgaggaggcagtctgcccgttctcagatctccagctgcgtgctcggagaaccactgctctcttcaaagctgtcagacagggacatgtaagtctgcagaagttactgctgtctttttgtttgtctgtgtcctgcccccagaggtggagcctacagaggcaggcaggcctccttgagctgtggtgggctccacccagtttgagcttccaggctgctttgtttacctaatcaagcctgggcaatggcgggctcccctcccccagcctcgctgctgccttgcagtttgatctcagactgctgtgctagcaatcagcgagactccgtgggcataggaccctcggagccaggtgtgggatat

SEQ ID NO: 12121 - DNA, 1314 bp, Homo sapiens
aggtcaatttggtgcagagctgagttcaattcctgggtatccttgttaactttctgtctcgttgatctgtctaatgttgacagtggggtgtaaagtctcccattattattgtgtgggagtctaagtctctttgtaggtcactcaggacttgctttatgaatctgggtgctcctgcattgggtgcatatatctttaggatagttagctcttccttttgaattgatccctttaccattatataatggccttctttatctcttttaatctttgttggtttaaagtctgttttatcagagactaggattgcaacccctacatttttttgttttccatttgcttggtagatcttcctccatccctttattttgagcctatgtgtgtctctgcacgtgagatgggtttcctgaatacagcacactgatgggtcttgactctttatccaatttgccagtctgtgtcttttaattggagcatttagcccatttacatttaaagttaatattgttatgtgtgaatttgatcctgtcattatgatgttagctggttattttgcttgatagttgatgcagtttcttcctagcctttatggtctttacaatttggcatgtttttgcagtggctggtaccagttgttcctttccatgtttagtgcttccttcaggagctcttttagggcaggcctggtggtgacaaaatctctcagcatttgcttgtctgtaaagtattttatttctccttcacttatgaagcttagtttggctggatgtgagattctgggttgaaaattcttttcttaaagaatgttgaatattggtccccactctcttctggcttgcagagtttctgccgagagatcagctgttagtctgatgggcttccctttgtgggtaacctgaccttcctctctggctgcccttaacattttttccttcatttcaactttggtgaatctgacaattatgtgtcttggacttgctcttcttgaggagtatctttgtggagttctctgtatttcctgaatttgaatgttggcctgcctttctagattggggaagttctcctggataatatcctgcagagtgttttccaacttggttccattctccccgtcactttcaggtacaccaatcagacgtagatttggtcttttcacatagtcccatatttcttggaggctttgttcatttctttttattcttttttctctaaatttctcttctcgcttcatttcattcatttcatcttccatcactgatacactttcttccagttgatctcctcggctactaaggcttctgcattcgtcacgtagct

SEQ ID NO: 12122 - DNA, 1178 bp, Homo sapiens
ctatttgattcttctctctttttttctttattagtcttgctagcggtctatcaattttgttgatcctttcaaaaaaccagctcctgggttcattgattttttgaagggttttttgtgtctctatttccttcagttcttctctgattttagttatttcttgccttctgctagcttttgaatgtgtttgctcttgcttttctagttcttttaatgtgatgttagggtgtcaattttggatctttcctgctttctcttgtgggcatttagtgctataaatttccctctacacactgctttgaatgtgtcccagaaattctggtatgttgtgtctttgttcttgttggtttcaaagaacatctttatttctgccttcatttcgttgtgtacccagtagtcattaaggagcaggtttttcagtttccatgtagttgagcagttttgagtgagtttcttaatcctgagttctagtttgattgcattgtggtctgagaggcagtttgttataatttctgttcttttacatttgccgaggagttctttacttccaactatgtggtcaattttggaggataagtgcagtgtggtgctgagaagaatgtatattctgttgatttggggtggagagttctgtacatgtctattaggtccgcttggtgcagagctgagttcaattcctggatatccttgttaactttctctcttgttgatctgtctaatgttgacagtggggtgttaaagtctcccattattattgtgtgggagtctaagcctctttgtcggtctctaaggacttgctttatgaatctgggtactcctgtattgggtgcatatatatttaggatagttagctcttcttgttgaattgatccctttaccgttatttaatggccttctttgtctcttttgatctttgttggtttgatgtctgttttatcagactaggattgcaacccctgcattttttgttttccatttgcctggtagatcttcctccatccttttattttgagcctatgtgtgtctctgcacatgagatgggtttcctgaatacagcacactgatgggtcttgactctttatccaatttgccagtctgtgtctttcaactggggcatttagcccatttacatttaaagttaatattgttatatgtgaatttgatcctgtcattatgatgtt

SEQ ID NO: 12123 - DNA, 1350 bp, Homo sapiens
  misc_feature (97)..(97): n equals a,t,g, or c
gttattggtctattcagagattcatcttcttcctggttatgtcgtgggagggtgtatgtgtcgaggaatttatccatttcttctagattttctagtntatttgtgtagaggtgtttgtagtattctctgattgaagtttgtatttctataggattggtggtgatatcccctttacattttttattgcgtctattagattcttctctcttttttttctttattagtcttgctagcagtctatcaattttgttgatcctttcaaaaaaccagctcctggattcattaattttttgaagggttttttgtgtctctatttccttcagttctgctctgattttagttatttcttgccttctgctagcttttggatgtgtttgctcttgctttgctagttcttttaattgtgatgttagggtgtcaattttggatctttcctgctttctcttgtgggcatttagtgctataaatttccctctacacacggctttgaatgcgtcccggagattctggtatgttgtgtctttgttctcatgggtttcaaagaacatctttatttctgccttcatttcgttatgtaaccagtagtcatccaggagcaggttgttcagtttccatgtagttgagcggttttgagtgagattcttaatcctgagttctagtttgattgcactgtggtctgcgagatagtttgttataatttctgttcttttacatttgctgaggagagctttacttccaagtatgtggtcaattttggaataggtgtggtgtggtgctgaaaaaaatgtatattctgttgatttggggtggagagttctgtagatgtctattaggtctgcttggtgcggagctgacttcaattcctgggtatccttgttgactttctgtctcgtggatctgtctaatgttgacagtggggtgttaaagtctcccattattaatatgtgggagtctatgtctctttgtaggtcactcaggacttgctttatgaatcttggtgctcctgtattgggtgcatgtatatttaggatagttagctcttcttgttgaattgatccctttaccattatgtaatggccttctttgtctcttttgatctttgttggtttaaagtctgttttagcagagactaggattgcaacccctgcctttttttgttttccatttgcttggtagatcttcctccatccttttattttgagcctatgtgtgtctctgcacatgagatggatttcctgaatgcagcacactgatgggccttgactctttatccaatttgccagtctgtgtcttttaattggagcatttagtccatttacatttaaagttaatattgttatgtgtgaattt

SEQ ID NO: 12124 - DNA, 2772 bp, Homo sapiens
cttcatatggctagccagttttcccagcatcatttattaaatagggaatcatttccccatttcttgtttttgtcaggtttgtcaaagatcagatggttgtagatgtgtggtattatttctgggggctctattctgttccattggtctatatctctgttttggtaccagtaccatgctgctttggttactgtagccttgtagtatagtttgaagtcaggtagcatgatgcctccagctttgttcttttggattaggattgtcttggccatgcgggctcttttttggttccatatgaactttacagtagttttttccaattctgtgaagaaagtcattggtagcttgatggggatggcattgaatctataaattaccttggacagtacggccattttcacaatattgattcttcctacccatgagcatggaatgtaattccacttgtttgtatcctcttttatttcattgagcaggggtttgtagttctccttgaagaggtccttcacatcccttgtaagttggattcctaggtattttattctctttgtagtaattgttaatgggagttcactcatgatttggctctctgtctgttcttgctgtataggaatgcttgtgatttttgcacattgattttgtatcctgagactttgctgaagttgcttatcagcttaaggagattttgggctgagatgatggggttttctaaatatacaatcatgtcatctgcaaacagggacaatttgacttcctcttttcctaattgaataccctttatttctttctcctgcctaattgccctggccagaacttccaacactatgttaaataggagtggtgagagagggaacccctgtcttgtgccagttttcaaagggaatgcttccagtttttgccctttcagtataatattggctgtgggtttgtcataaatagctcttattattttgagacatgacccatcaatacctagtttattgagagtttttagcatgaagggctgttgaattttgttgaagggcttttctgcatctattgagataatcatgtggtttttgtctttggttctgtttatatgctggattacatttattgatttgcatatgttgaaccagccttgcatcccagggatgaagccaacttgatcgtggtggataagctttttgatgtgctgctggattcggtttgccagtattttattgaggttttttgcatcgttgttcatcagggttattggtctaaaattctcttttttcattgtgtctttaacagaccttggtatcaggataacgttggcctcataaaatgaattagggaggattccctccttttctatttattggaatagtttcagaaggaatggtaccagctcctctttgtacctctggtagaatatggctgtgagtcagtcaggttatggactctttttgtttggtaggctattaattattgcctcaatttcagaatctgttattggtctattcagagattcaacttcttcctggtttagtcttgggagggtgtatgtgtccaggaatttatccatttcttctagattttctaatttatttacatagaggtgtttatagtgttctctgatggtagtttgtatttctgtgggatcagtggtgatatcccctttgtcattttttattgcgtctatttgattcttctctcttttcttctttgttactcttgctagtggtcaatcaattttgttgatcgtttcaaaaaatcagctcctggattcattgattttttgaagggttttttgtgtctctatctccttcagttctgctgtaatctgagttatttcttgccttctgctagcttttgaatgtgtttgctcttgcttctctagttcttttaagtgtgatgttagggtgtcaattttagatctttcctgcttttggtgtgggcatttagtgctctaaatttccctctacacactgctttaaatgtgtcccagagattttggtgtgttgtgtctttgttctcattggtttcaaagaacacctttatttctgccttcatttcgttatgtaccgagttgtcactcaggagcaggttgttcagtttccatgtagttgagcagttttgagtgagtttcttactcctgagttctagtttgattgcactgtggtctgagagatagtttgttataatttctcttcttttgcatttgctgaggagtgctttacttccaactatgtggtcaattttggaataagtgcagtgtggtgctgagaagaatttatattctgttgatttggggtggagagttctgtagatgtctattaggtccacttggtgcagagctgagttcaattcctggatatccttgttaactttctgtcttgttgatctgtctaatgttgacagtggagtgttaaagtctcccattattattgtgtgggagtctaagtctctttgtaggtctctgaggacttgccttatgagtctgggtgctcctgtattgggtgcatatatatttaggatagttagctcttcttgttgaattcatccctttaccgttatgtaatggccttgtctcttttgatctttgttggtttaaagtctgttttatcagagactaggattgcaacccctgctttttttttttggttttccatttgcttggtagatcttcctccatccctttattttgagcctatgtgtgtctctgcacatgagatgggtctcctgaatacagcacactgatgggtcttgactctttatccaatttgccagtctgtgtcttttaattggagc

SEQ ID NO: 12125 - DNA, 6639 bp, Homo sapiens
atatctcctaagctatccctccccactcccccaaccccacaacaggccccagtgtgtgatgttccccaccctgtgtccatgggttctcattgttcagttcccacctatgagtgagaacatacggtgttttgttttctgtccttgcgatagtttgctcagaatgatggtttccagcttcatccatgtccctatgaaggacatcaacgtatccttttttatggcggcatagtattccatggtgtatatgtgccacattttcttaatccagtctatcattgatggacatttgggttggttccaagcctttgctattgtgaacagtgccacaataaacatacgtgtgcatatgtctttataccagcatgatttataatcatttgggtatatgcccagtaatgggatggctgggtcaaatggtatttctagttctagatccttgaggaatcgccacactgtcttccacaatggttgaactagtttacagtcccaccaacagtgtaaaagcattcctatttctccacatcctctccagcacctgttgtttcctgactttttaatgatcgccattctaactggtgtgagatggcatctcgttgtggttttgatttgcatttcgctgatggtcagtgatgatgagcattttttcatgtgtctattggctgcataaatgtcttcttttgagaagtgcctgttcatatactttgcccacttgttgatggggttgttggattttttcttgtaaatttgtttaagttcttcatagattctggatattagccctttgtcagatgggtatattataaaaattttctcccattccgtaggttgcctgttcactctgatggtagtttattttgctgggcagaagctctttagtttaattagatcccattggtcaattttggcttttgatgccattgcttttggtgttttagacatgaagtccttgcccatgcctatgtcctgaatggtattgcctaggttttcttcttgggtttttatggttttaggtctaacatttaagtctttaatccatcttgaattaatttttgtacaaggtgtaaggaagggatctagtttcagctttctagatatggttagccagtttccccagcaccatttataaaatagggaatcctttccccatttcttgttttcgtcaggtttgtgaaagatcagatggctgtagatgtgtggtattatttccaagggctctattctgttccactagtctatatctctgttttggtaccagtaccatgctgttttggttactgtagccttgtagtatagtttgaggtcaggtagcgtgatgcctccaactttgttcttttggcttaggactgacttggcaatgcgggctcttttttggttccatatgaactttagttttttccaattctgtgaagaaagtcattggtagcttgatggggatggcattgaatctatgaattaccttgggcagtatggccattttcacgatattgattcttcctatccatgagcatggaatgttcttccatttgtttgtgtcctcttttatttcgctgagcagtggtttgtagttctccttgaagaggtcgttcacatcccttgtaatttggattcctaggtattttattctctttgaagcaattgtgaatgggagttcactcatgatttggctctctgtctgtctgttattggtgtataggaatgcttgtgaattttgcacattgattttgtatcctgagactttgctgaagttgcttatcagcttaaggagattttgggctgagatgatagggttttctaaatatacaatcatgtcatctgcaaacagggacaatttgacttcctcatttcctaattgaataccctttattgctttctcttgcctgattgccctggccagaacttccaacactacgttgaaaaggagtggtgagagacggcatccctgtcttgtgccagttttcaaagggaatgcttccagtttttgcccattcagtatgatattggctgtgggtgtgtcataaacagcttttactattttgagatacgtcccatcaatacctaatttattgagagtttttagcatgaagagctgttgaattttgtaaaggccttttctgcatctattgagataatcatgtggtttctgtctttagttctgtttataggatggattatgtttatggatttgcatatgttaaaccagccttgcatcccagggatgaaactgacttgatcgtggtggataagctttttgatgtgctgctggattcagcttgccagtattttattgaggatttttacatcgatgttcatcggggatattggtctaaaattctctttttttgttgtgtctctgccaggctttggtatcaggatgatactggcctcataaaatgaattagggaggatcccctctttttctattgattggaatagtttcagaaggaatggaaccagcccctctttgtacctctggtagaattcagctgtgaatccgtctggtcttggactttttttggttggtaggctattaattattgcctcaatttcagaacccgttattggtctattcagggattcaacttcttcctggtttagtcttgggagggtgtatgtgtcgaggaatttatccatttcttctagattttctagtttatttgcgtagaggtgtttatagtactctctgatggccatatttctgtgggatcagtggtgatatcccctttatcattttttattgtgtctatttgattcttctcgcttttgttctttattagtcttgctagtggtctatcaattttgttgatcttttcaaaaaaccagctcctggcttcattgatatttttgaagggttttttgtgtctatctccttcagttctgctctgatcttagttatttcttgccttctgccagcttttgaatgtgtttggtcttccttctctagttcttttaattgtgatgttagggtgtcaattttagatctctcctgctttctcttgtgggcatttagtgctataaatttccctctacacactgtattaaatgtgtcccagagattctggtatgttgtgtctttgttctcattgatttcaaagaacatctttatttctgccttcatttcgttatgtacccagtagtcattcaggagcaggttgttcagtttccatgtagttgagcggttttgactgagtttcttaattctgagctttagtttgattgcactgtggtctgagagacagtttgttataatttctgttcttttactgagtaaatttgttataatttactgttcttttatttgctgaggagtgctttacttccaactatgtggtcaattttggagtaagtgtgatgtggtgctgacaagaatgtatattctgttgttttggagtggagagttctgcaggtgtctattaggtctgcttggtgcagagctgagttcaattcctggatatccttattaactttctgtctcgttgatctgtctaatgttgacagtggggtgttaaagtctcccattattattgcgtgggagtctaagtctctttgtaggtctttaaggacttgctttatgaatctgggtcctcctgtattgggtgcatatatatttaagatagttagctcctcttgttgaattgatccctttaccattatgtaatggccttttgtctcttttgatctgttggtttaaagtctgttttatcagagactaggactgcaatccctgccttttttttgttttccatttgcttggtagatcttcctccatccctttattttgagcctatgtgtgtctctgcacgtgagatgggtttcctgaatacagcagatgggtcttgactctatccaatttgccagtctgtgtcttttaattggagcatttagcccatttacatttaaggttaatattattatgtgtgaatttgagcctgtcattatgatgttagctggttattttgctcattagttgatgcagtttctccctagtatagatggtctttacaatttggcatgtttttgcagggctggtaccggttgttcctttccgtgttttagtgcttccttcaggagctcttgtaaggcaggcctggttgtgacaaaatctctcagcatttgtttgtctgtaaaggattttatttctccgtcacttatgaagctgagtttggctgaatatgaaattctgggttgaaaattcttttaagaatattgaatattggcccccactctcttctggcttgtagagtttctgccgagagatcagctattagtctgatgggtttccctttgtgggtaatgagacctttctctctggctgcccttaacatttttttcttcatttcaactttggtgaatctgacaattatgtgtcttggaattgctattctcgaggagtatctttgtggtgttctctgtatttcctgaatttgaatgttggcctgcctcactaggttggggaagttctcctggatgatatcctgaagagtgctttccaacttggttgcattctccccatcactttcaggtacaccaatcagatgtagatttggtcttctcacatagtcccatatttcttggaggctttgttcatttctttttactcttttttctctaaacttctcttctcacttcatttcattcatttgatcttcaatcactgataccctttcttccatttaatcaaatcagctactgaagcttgtgcatgcatcacgtagttcttgtgccatggttttcagctccatcaggtcatttatggacttatctatgctgtttattctcgttagccatttgtctactcttttttcaaggtttttaagcttctttgtgatgggttcaaacatcctcctttagctgggagaagtttgttattaccgattgtctgaagccgccttctctcgactcgtcaaagtcattctccatacagctttgttccgctgctggcaaggagctcatgttgctgcctaatccttcctctggaagcttcatctcagaggggcacccagccttatgaagtgccagtcgcccccctactgggagatgcctcccagttaggctactcgggggtcagggacccacttgaggaggcagtctgtctgttctcagatctcaaactcagtgctgggagaaccactactctcttcaaagctgtcacacagggacatttaagtctgcagaagtttctgctgccttctgttcagctatgccctgcccctagaggtggagtctacagaggcagggaggcctccttgagctgaggtgggctccacccagttcgagcttcctggccactttgtttatgtactcgagcctcggcaatggcagatgcccctccctcagccttgctgtcgccttgcagtttgatctcagactgctgtgctagcaatgagcagggctccttgggcatgggaccctctgagccaggcgcgggatataatctcctggtgagccgtttgctaaggccattggaaaagtgcagtattagggtgggagtatcccgattttccaggtgcagtctctcacggcttcccttttgtagtaaagggaattccccgaccccttgcgcttcccaggtgaggcgatgccccgccctgctccatgggctgcacctatttgtctggcaagccccagtgagatgaacctggtacctcagttggaaatgcagaaatcgcccatcttctgcatcgttcatgctgggagctgcagactggagctgttcctattcggccatcttggcgccacctatttcagatttttctaatcagcttaatatacttcgaagagctgaatgcttttgtcttttatgtttattaattttctcaatagcctagtttagagaaattattaatcttttaccaatgtatctatggtcttattctgaagacctgtaatcttataagcttgatttgtttattacaaaatatattcactgtaagtaagagaaagagttataaattttatccagagataaccactattaatgtggcactatatatttttccaggcttatttataatactcccaccttccaccactaccaccaaataaaataagtaaaatcactctgtataaactgagaggaacttactctgtgaaaaagaaaggaagtgaattactgtcataagacaaagtatttgaagctactgttccataatataaaccctgagaacactgctttttacaagtaaatcttggtttatattaatagtaatcactttctgaaaacaaaaatagtttcacaggtactttatgaaagtctacaaccagcctcatctaaacatttattttgaaagaaaaggcttcacatttaagaaatctgagacaaattagttctcttctatttgctatatattcagctttgtttttctgtattaataactgaattaagtttaaagttctaagtaaaaagtacctgagtgtttatgccgtcctgttgagcacagcagtcaatagctactccttggttacaccacctacattacaattctgaggtcctagccatattctcatttctagctccatcatcatggatccagaccagtgccacacactgcagccccatggcttgatacgcaacacagaaattatcactatctgttactcaagcttcctttacctcaaaaataacaaacaataataccccag

SEQ ID NO: 12126 - DNA, 4987 bp, Homo sapiens
tttttttttaaattatacttttaagttctagggtacatgtgcacaacgtgcaggtttgttacatatgtatacatgtgccatgttggtgtgctgcacccattaacttgtcatttacattaggtatatctactaatgctatccctcccccctccccccaccccatgacaggccctggtgtgtgatgttccccttcctgtgtccaagtgttctcattgttcagttcccatctatgagtgagaacatgcagtgtttggttttctgtccttgtgatagtttgctgagaatgatgatttgcatcttcatccatgtccctacaaaggacaggaactcacccttttttatggctgcatagtattccatggtgtatatgtgccacattttcttaatctagtctatcattgatggacatttgggttggttccaagtctttgctattgtgaatagtgctgcaataaacatacgtgtgcatgtgtctttatagcagcatgatttataatcctttgggtatatacccagtaatgggatggctgggtcaaatggtatttttagttctagatccttgaggaatcaccacactgtcttccacaatggttgaactagtttacagtcccaccaacagtgtaaaagtgttcctatttctccacatcctgtccagcacctgttgtttcctgacgttttaatgatcaccattctcactggtgtgagatggtatctcattgtggttttgatttgcatttctctgatggccagtgatgatattttttcatgtgtttgttggctgcataaatgtcttctttttagaagtgtctgttcatatcctttgcccacttgttgatggggttgtttgtttttttcttgtaaatttgtttgagttcattgtagagtctggatattagccctttgtcagatgagtagattgcagaaactttttcccattctgtaggttgcctgttcactctgatggtagtttcttttgctgtgcaaaagctctttagtttaattagatcccatttgccaattttggcttttgttgccattgcttttggtgttttagacatgaagtccttgcccatgcctatgtcctgaatggtattgcctaggttttattctaggatttttgtggttttatgtctaacatttaagtctttaatccatctggaattaatttttgtataagctgtaaggaagggacccagtttcagctttctacatatggctagctagttttcccagcaccatttattaaatagggaatcctttccccatttcttgtttttgtcaggtttgtcaaagatcagatggttgtagatgtgtggtattatttctgagggctctgttctgttccattggtctatatctctgttttggtgtcagtaccatgctgttttggttactgtagccttgtagtatagtttgaagtcaggtagcatgatgcctccacctttgttcttttggcttaggattgacttggcaatgtgggctcttttttggttctataggaactttaaagtagttgtttccaattctgtgaagaaagtcattggtagcttgatggggatggcattgaatctataaattaccttgggcagtaacgccgtgttcacgatattgattcttcctatccttgagcatggaatgttcttccatttgtttgtgtcctcttttatttcgttgagcagtggtttgtagttctccttgaagaggtccttcacatcccttgtaagttggattcctaggtattttattctctttgaagcagctgtgaatgggagttcactcatgatttggctctctgtctattattggtgtataagaatgcttgtgatttttgcacattgattttgtatcctgagactttgctgaagttgcttatcagcttaaggagattctgggctgagacagtggggttttctagatatacaatcatgtcatctgcaaacagggacaatttgacttcctcttttcctaattgaataccctttatttctttctcctgcctgattgccctggccagaacttccaacactgtgttgaataggagtggtgagagagggcatccctgtcttgtgccagttttcaaagggagtgcttccagtttttgcccattcagtatgatattggctgtgggtttgtcataaatagctcttattattttgagatatgtcccatcaatacctaatttactgagagtttttagcatgaagggctattgaattttgtcaaaggccttttctgcatctattgagataatcatgtggtttttgtctttggttctgtttatatgctggattacgtttattgatttgcgtatgttgaaccagccttgcatcccagggatgaagcccacttgatcatggtggataagcttttcgatgtgctactggattcggtttgccagtattttattgaggatttttgcatcgatgttcttcagggatattggtctaaaattctctttttttgttgtgtctctgccaggctttggtatcaggatgatgctggcctcataaaatgagttagggaggattccctctttttctattgattggaatagtttcagaagaatggtaccagctcctccttgtacctctggtagaaatcggctgtgaatccgtctggtcctggactttttttggttggtaagctattaattattgcctcaatttcagagcctgttactggtctattcagagattcaacttcttcctggtttagtcttgggagggtgtatgtgtcgaggaatttatccatttcttctagattttctagtttatttgcatagacgtgtttatagtattctctgatggtagtttgtatttctgtgggatcggtggtgatatcccctttatcattttttattgcgtctatttgattcttctctcttttcttctttattagtcttgctagcggtctatcaattttgttgatcttttcaaaaaaccagctcctggattcattgattttctgaagggttttttgtgtctctatctccttcagttctgctctgatcttagttatttcttgccttctgctagcttttgaatgtgtttgctcttgcttctctagttcttttaattgtgatgttagggtgtcaattttagatctttcctgctttctgttttgggcatttagtgctataaatttccctctacacactgctttaaatgctataaatttccctctatacactgctttaaatgtgtcccagagattctggtatgttgtgtctttgttctcattggtttcaaagaacatctttatttctgccttcatttcattatgtacccagtagtcattcaggagcaggttgttcagtttccatgtagttgagcggttttgagtgagtttcttaatcctgagttctagtttgattgcactgtggtctgagagacagtttgttataatttctgttcttttacatttgctgaagagtgctttacttccaactatgtggtcaattttagaataagtgtgatgtggtgctgcgaagaatgtatattctgttgatttggggtggagagttctgcagatgtctgttaggtccgcttggtgcagagctgagttcaattcctggctatccttgttaactttctgtctcattgatctgtctaatgttgacagtggggtgttaaaatctcccattattattgtgtgggagtctaagtctctttgtaggtctctaaggacttgctttatgaatctgggtgctcctgtattgggtgcatatatatttatgatagttagctcttcttgttgaattgatccctttaccattatgtaatgaccttctttgtctcttttgatctttgttggtttaaagtctgttttatcagggactaggattgcaacccctgtcttttttttgttttccatttgcttggtagatcttcctccatccctttattttgagcctatctgtgtctctgcacgtgagatgggtctcctgaatacagcacactgatgggtcttgactctatccaatttgccggtctgtgtcttttaattggagcatttagcccatttacatttaaggttaatattgttatgtgtgaatttgatcatgtcattatgatgttatctggttattttgctcgttagttgatgcagtttcttcctagcagggatggtctttacaatttggcatgtttttgcagtggctggtaccagttcctttccatgtttcatgcttccttcaggagctcttgtagggcaggcctggtggtgacagaatctctcagcattggcttgtctgtaaaggattttatttctccttcacttatgaagcttagtttggctggttatgaaattctgggttgaaaattcttttctttaagaatgttgaatattggcccctactctcttctggcttatagagtttctgccaagagttccgctgttagtctgaggggcttccctttgtgggtaacccaacctttctctctggctgcccttaacatttttcccttcatttcaactttggtgaatctgacaattatgtgtcttggagttgctcttctcgcggagtatctttgtggcattctcggtatttcctgaatttgaatgttggcctgccttgctaggttggggaagttctcctcgataatatcctgcagagtgttttccaacttggttccattctccctgtcactctcaggtacaccagtcagacgtagatttggtcttttcacatagtcccatatttcttggaggctttgtttgtttctttttactctcttttctctaaacttctcttcttgcttcatttcattcatttgatcttcaatcactgatactgtttcttccagttaatcaaattggctactgaagcttgtgcattcgtcacatacttcttgtgccatggttttcagctccatcaggtcatttaaggacttctctacactggttattctagttagccattcgtctaatctttttttaaaggtttttagcttccttgcgatgggttcgaacttccttctttagctcg

SEQ ID NO: 12127 - DNA, 4492 bp, Homo sapiens
catgtgttctcattgttcaattcccacctatgagtgagaacatgaggtgtttggttttttgttcttgtgatagtttactgagaatgatgattttcaatttcatccatgtccctacaaaggacatgaacccattattttttaaggctgcataggattccatggtgtatatgtgccacgttttcttaatccagtctatcattgttggacgtttgggttggttccaagtctttgctattgtgaatagtgccacaataaacatacgtgtgcatgtgtctttatagcagcatgatttatagtcctttgggtatatacccagtaatgggatggctgggtcaaatggttttctagttctagatccctgaggaatcgccacactgacttccacaatggttgaactagtttacagtcccaccaacagtgtaaaagtgttcctttttctccacatcctctccagtacctgttgtttcctgactttttaatgattgccattctaactggtgtgagatgatatctcattgtggttttgatttgcatttctctgatggccagtgatggtgagcattttttcatgtgttttttggctgcataaatgtcttcttttgagaagtgtctgttcatgtccttcgcccactttttgatggggttgtttgttttttcttgtaaatttgtttgagttcattgtagattctggatattagccctttgtcagatgagtaggttgcaaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctacgttttcttctagggtttttatggttttaggactaatgtttaagtctttaatccatcttgaattaatttttctataaggtgtaaggaagggatccagtttcagctttctacatatggctagccagttttcccagcaccatttattaaatagggaatcctttccccattgcttgtttttttcaggtctgtcaaagatcagatagttgtagatatgcggcgttatttctgagggctctgttctgttccattgatctatatctctgttatggtaccagtaccatgctgttttggttactgtagccttgtagtatagtttgaagtcaggtagcatgatgcctccagcttttttcttttggcttaggattgacatggcgatgcgggctcttttttggttccatatgaactttaaagtagttttttccaattctctgaagaaagtcattggtagcttgatggggatggcattgaatctataatttcacgatattgattattcctacccatgagcatggaatgttcttccatttgtttatatcctcttttatttccttgagcagtggtttgtagttctccttgaagaggtccttcacgtcccttgtaagttggattcctaggtattttattctctttgaagcaattgtgaatgggagttcactcatgatttggctctctgtttgtctgttattggtgtttaagaatgcttgtgatttttgtacattgattttgtatcctgagactttcctgaagttgctttccagcttaaggagattttgggctgagacagtggggttttctagatatacaatcatgtcatctgcaaacagggacaatttgacttcctcttttcctaattgaatacactttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagacagctcttattattttgagatatgtcccatcaatacctaatttattgagagtttttagcatgaagcgttgttggattttgtcaaaggccttttctgcatctattgagataatcatgcggtttttgtctttggttctctttatatgctggattacatttattgatttgtgtatattgaaccagccttgaatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccagctttggtatcaggatgatgctgccctcataaaatgagttagggaggattccctctttttctattgattggaatagtttcagaaggaatggtaccagttcccccttgtacctctggtagaattcggctgtgaatccatctggtcctggactctttttggttggtaagctattgattattgccacaatttcagagcctgttattggtctattcagagattcaacttcttcctggtttagtgttgggagaggtatgtgtcgaggaatttatccatttcttctagattttctagtttatttgcatagaggtgtttgtagtattctctgatggtagtttgtatttctgtgggatcggtgttgatatcctctttatcattttttattgcgtctatttgattcttctctcttttcttctttattagtgttgctagtggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttctcgttggtttcaaagaacatctttatttctgccttcatttcgttaggtacccagtagtcattcagaagcaggttgttcagtttccatgtagttgaatgcttttgagtgagtttcttaatcctgagttctagtttgattgcactgtggtctgagagactgttataatttctgttcttttacttttgttgaggagagctttacttccaagtatgtggtcaattttggaataggtatggtgtggtgctgaaaaaaatgtatattctattgatttggggtggagagttccgtagatgtctattacgtccgcttggtgcagagctgagttcaattcctgggtatccttgttaactttctgtctcgttgatctgtctaatgttgacagtggggtgttaaagtctcccattattactgcgtgggagtctaagtctctttgtaggtcactcaggacttgctttatgaatttgggtgctcctgtattaggtgcatatatatttaggatagttagctcttcttgttgaattgatccctttaccattatgtaatggccttctttgtctcttttgacctttgttggtttaaagtctgttttatcagagactaggattgcaacccctgcctttttttgttttccatttgcttggtagatcttcctccatccttttattttgagcctatgtgtgtctctgcatgtgagatgggtttcctgaatacagcacactgatgggtcttgactctttatccaatttgccagtctgtgtcttttaattggagcatttagtccatttacatttaaagttaatattgttatgtgtgaatctgatcctgtcattatgatgttagctggttattttgctcgttagttgatgcagtttcttcctagcctcgatggtctttacaatttggcatgattttgcagtggctggtaccagttgttcctttccatgtttagtgcttccttcaggagctcttttagggcaggtctggtggtgacaaaatctctcagcatttgcttgtctgtaaaggattttatttctccttcacttatgaagcttagtttggctggatatgaaattctgggttgaaaattcttttctttaagaatgttgaatattggtccccactcccttgtggcttgtagagtttctgccgagagatccgctattagtctgatgggcttccctttgtgggtaacccgacctttctctctggctgcccttaacattttttccttcatttcaacattggtgaatctgacaattatgtgtcttggagttgctcttcttgaggagtatctttatggcgttccctgtatttcctgaatctgaatgttggcctgccttgctagattggggaacttctcctggataatatcctacagagtgtttttcaacttggttccattctccccgtcactttcaggtacaccattcagacatagatttggtcttttcacatagtcccatatttcttggaggctttgttcatttctttttattcttttttctct

SEQ ID NO: 12128 - DNA, 2345 bp, Homo sapiens
gtctctgccaggctttggtatcaggatgattttggcctcataaaatgaattagggaggattccctctttttctattgattggaatagtttcagaaggaatggtaccagctcctctttgtacctctggtagaattcggctgtgaattcatctgctcctggacttcttttggttggtaggatattaattactccctcaatttcagaacgtgttattggtctattcagggattcaacttcttcctgatttagtcttgggagggtgtatgtgtccaggaatttatccatttcttctagattttctagtttatttgcgtagaggtgtttatagtattctctgatggtagtttgtatttctgtgggatctgtggtgatatcccctttatcattttttattgcatctatttgattcttctctcttttcttctttattagtcttgctagtggtctatcaattttgttgatcttttcaaaaagccagctcctggattcattaattttttgaagggttttttgtgtctctatttccttcagttctgctctgatcttagttatttcttgccttctgctagcttttgaatgtgtttgctcttctctagttcttttaattgtgatgttagggtgtcaattttggatgtttcctgctttctcttgtgggcatttagtgctataaatttccctctacacactgctttacatgtgtcccagagattctggtatgttgtgtctttgttctgattggtttcaaagaacatctttatttctgccttcatttcgttatgtacccagtagtcattcaggagcaggttgttcagtttccatgtagttatgcggttttgagtgagtttcttaatcctgagttctagtttgattgcactgtgatctgagagacagtttgttataatttcttttcttttacatttgctgaggagagctttacttccaactatgtggtcaattttggaataagtgtgatatgctgagaagaatgtatattctgttgattttggatggagagttctgtagatgtctattaggtccgcttggtgcagagctgagttcaattcctggatatccttgttaacgttctgactcattgaactgtctaatgttgacagtggggtgttaaagtctcccattattattgtgtgagagtctaagtctctttgtaggtctctaaggacttgctttatgaatttgggtgctcctgtattgggtgcatatatatttaggatagttagttcttcttgttgaattgatccctttaccattatgtaatggccttctttgtctcttttgatctttgttggtttaacgtctgttttatcagagactaggattgcaacccctgcctttttttgttttccatttgcttggtagatcttcctccattcctttattttgagcctatgtgtgtctctgcacgtgagatggatctcctgaatacagcacactgatgggtcttgactctttatccaatttgccagtctgtgtcttttaattggagcatttagcccatttacatttaaggttaatattgttatgtgtgaatttgatcctgtcattatgatgttagctggtgattttgctcgttagttgatgcagtttcttcctagcctcgatggtctttacaatttggcatgtttttgcagtggctggtaccagctgttcctttccatgtttagtgcttccttcaggagctcttgtaaggcaggcctggtggtgacaaaatgtctcagcatttgtttgcctgtgaaggattttatttctccttcacttatgaagcctagtttggctggatatgaaattctgggttgaaaattcttttctttaagaatgttgaatattggcccccactctcttctggcttgtagagtttctgctgagagatccactgttagtctgatgggcttcgctttgtgggtaaccctacctttctctctggctgccttaacattttttccttcatttcaactttggtgaatctgacaattatgtgtcctggagttgctcttctcgaggagtatctttgtggcattctctgtatttcctgaatttgaatgttggcctgccttgctaggttggggaagttctcctgtataatatcctgcagagtgttttccaacttggttccattctccctgtcactttcaggtacaccaatcagatgtagatttggtcttttcacagagtccggtatttcttgtaggctttatttgtttctttttactcttttttctctaaacttctcttcttgcttcatttcattcatttgatcttccatcactgataccctttcttccagttgatcgaatcagctgctgaagcttgtgcattcatcacgtagt

SEQ ID NO: 12129 - DNA, 2667 bp, Homo sapiens
ttcttgccttctgctagctttcgaagtgtttgcttttgcttttctagttcttttaattgtgatgttagggtgtcaattttggatctttcctgctttctcttgtgggcatttagtgctataaatttccctctacacactgctttgaatgcgtcccagagattctggtatgctgtgtctttgttctcgttggtttcgaagaacatgtttatttctgccttcatttcgctatatacccagtagtcattcaggagcaggttgttcaatttccatgtagttgagcggctttgagtgagattcttaatcctgagttctagtttgattgcactgtggtctgagagatagtttgtgtaatttctgttcttttacatttgctgaggagagctttacttccaactatgtggtcaattttggaataggtgtggtgtggtgctgaaaaaaatgtatattctgttgatatggggtggagagttctgtagatgtctattaggtctgcttggtgcagagctgagttcaattcctggatatccttgttgactttctgtctcgttgatctgtctaatgttgacagtggggtgttaaaatctcccattattaatgtgtgggagtctaagtctctttgtaggtcactcaggacttgctttatgaatctgggtgcctctgtattgggtgcatatatatttaggatagttagctcttcttgttgaattgatccctttaccattatgcaatggccttccttgtctcttctgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttgctcgttagttgatgcagtttcttcctagtctcgatggtctttacattttggcatgattttgcagcggctggtacccgttgttcctttccatgtttagcgcttccttcaggagctctttcagggcaggcctggtggtgacaaaatctctcagcatttgcttgtctgtaaagtattttatttctccttcacttatgaagcttagtttggctggatatgaaattctgggttgaacattcttttctttaagaatgttgaatattggcccccactctcttctggcttgtagagtttctgccgagagatccactgttagtctgatgggcttccctttgagggtaacccgacctttctctctggctgcgcttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccccatcactttcaggtacaccaatcagacgtagatttggtcttttcacatagtcccatatttcttggaggctttgctcgtttctttttattcttttttctctaaacttcccttctcgcttcgtttcattcatttcatcttccattgctgataccctttcttccagttgatcacatcggctcctgaggcttctgcattcttcacgtagttctcgagccttggttttcagctccatcagctcctttaagcacttctctatattggttattctagttatacattcttctaaatttttttcaaagttttcaacttctttgcctttggtttgaatgtcctcccgtagctcagagtaatttgatcgtctgaagccttcttctctcagctcgtcaaagtcattctccgtccagctttgttccgttgctggtgatgaactgcgttcctctggaggaggagaggcgctctgctttttagagtttccagtttttctgttctgttttttccccatctttgtggttttatctacttttggtctttgatgatgatgatgtacagatgggtttttggtgtgggtgtcctttctgtttgttagttttccttctaacagacaggaccctcagctgcaggtctgttggagtaccctgccatgtgaggtgtcagtgtgcccctgctggggggtgcctcccagttaggctgctcggtggtcaggggtcagggacccacttgaggaggcagtctgcccattctcagatctccagctgcgtactgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcccagctgctttgtttatctaagcaagcctgggcaatggtgggcgcccctcctccagcctcgctgccgccttgcagtttgatctcagactgctgtgctagcaatcagtgggactccgtgggcgtaggaccctccgagccaggtgtgggatat

SEQ ID NO: 12130 - DNA, 3928 bp, Homo sapiens
  misc_feature (3899)..(3899): n equals a,t,g, or c
gtctaacgtttaagtctttaatccatcttgaattgatttttgtataaggtgtaaggaagagatccagttacagctttctacatatggctagccagttttgccagcaccatttattaaatagggaatcctttccccattgttgtttttctcaggtttgtcaaagatcagatggttgtagatatgcggagttatttctgagggctctgttctgttccattgatctatatctctgttttggtaccagtaccatgctgttttggttactgtaggcttgtagtatagtttgaagtcaggtagcatgatgcctccagctttgttcttttggcttaggattgacttggcgatgcgggctcattttcggttccatatgaactttaaagtagttttttccaattctgtgaagaaaggcattggtagcttgatggggatggcattgaatctgtaaattaccttgggcagtatggccattttcacgatattgattcttcctacccatgagcctggaatgttcttccatttctttgtatcctcttttatttccttgagcagtgatttgtagttctccttgaagaggtccttcacatcctttgtaagttggattcctaggtattttattctctttgaagcaattgtgaatgggagttcactcatgatttggctctctgtttgtctgttattggtgtataagaatgcttgtgatatttggacattgattttgtatactgagactttgctgaggtcgcttatcagcttaaggagattttgggctgagacaatggggttttctagatatataatcatatcgtctgcaaacagggacaatttgacttcctcttttcctaattgaataccctttatttccttctcttgcctaattgccctggccagaacttccaacactatgttgaataggagtggtaagagagggcatccctgtcttgtgccacgtttcaaagggaatgtttccagtttttgcccattcagtatgatattggctgtgggtttgtcatagatagctcttattattttgagatatgtcccatcaacacctaatttattgagagtttttagcatgaagggttgttgaattttgtcaaaggctttttctgcatctattgagataatcatgttgtttttgtctttggctctgtttatatgctggattacatttattgatttgcatatattgaaccagccttgcataccagggatgaagcccccttgatcatggtggataagctttttgatgtgctgctggattcgttttgccagtattttattgaggatttttgtatcaatgttcatcaaggacattggtctaaaattttctttgttcgttgtgtctctgcccagctttggtatcaggatgatgctggcctcataaaatgagttagggaggattccctctttttctattgattggaatagtttcagaaggaatggtaccagttcctccttgtacctctggtagaattcagctgtgaatccatctggtcctggactctttttggttggtaaactattgattattgccacaatttcagatcctgttattggtctattcagagattcaacttctccctggttttgtcttgggagagtgtatgtgttgaggaatttatccatttcttccagattttctagtttatttgcgtagaggtgtttgtagtattctctgatggtagtttgtatttctgtgggatcagtggtgatatcccctttatcattttttattgtgtctatttgattcttctctctttttttctttattagtcttgttagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtgaagtttggatctttcctgctttctcttgtgggcatttagtgctataaatttccctctacacactgctttgaatgtgtcccagagattctggtatggtgtgtctttgttctcattggtttcaaacaacatctttatttctgccttcatttcattatgtacccattagtcattcaggagcaggttgttcagtttccatgtagttgagcagttttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattgctgggtatccttgttgactttctgtctcgttgatctgtctaacattgacagtggggtgttaaagactcgcattattaatgtgtgggagtcgaagtctctttgtaggtcactaagcacttgctttatgaatctgggtgctcctgtattgggtgcatatatatttcggatagttagctcttcttcttgaattgatccttttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttgctcgttagttgatgcagtttcttcctagtctcgatggtctttacattttggcatgattttgcagcggctggtaccagtttttcctttccatgtttagcgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctctaagaatgttgaatattggcccccactctcttctggcttgtagggtttctgccaagaaatccgctgttagtctgatgggcttccctttgagggtaagccgacctttctccctggctgcccttaacattttttccttcatttcaactttggtgaatctgacaattatgtgtcttggagttgctcttctcgaggagtaactttgtggcattctctgtatttcctgaatctgaacattggcctgccttgctagattggggaagttctcctggataatatcctgcagagtgttttccaacttggttccattctccccatcactttcaggtacaccaatcagatgtagatttggtcttttcacatagtcccatatttcttggaggctttgctcatttctttttattcttttttctctaaacttcccttctcgcttcatttcattcatttcatcttccattgctgataccctttcttccagttgattgcatcggctcctgaggcttctgcattcttcacgtagttctcgagccttggttttcagctccatcagctcctttaagcacttctctgtattgggtattctagttatacattcttctaaatttttttcaaagttttcaacttctctgcctttggtttaaatgtcctcccatagctcagagttaatttgatcgtctgaatccttcttctctcagctcgtcaaagtcattctccatccagctttgntccattgctggtgaggaactgcgttcctt

SEQ ID NO: 12131 - DNA, 17174 bp, Homo sapiens
ctgtctttttttttgttattatactttacgttttagggtacatgtgcacaatgtgcaggtttgttacatatgtatacatgtgacatgttggtgtactgcacccattaactcgtcatttagcattaggtatatctcctaatgctatccctcccccctccccctaccccacaacagtccccggagtgtgatgttccccttcctgtgtccatgtgttctcattgttcaattcccacctatgagtgagaacatgcggtgtttggtgttttgtccttgcgatagtttgctgagaatgatggtttccagtttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacatgtgcatgtgtctttataatagtatgatttatagtcctttgggtatatatccagtaatgggatggctgggtcaaatggtatttctagttctagatccctgaggaatggccacactgacttccacaatggttgaactagtttacagtcccaccaacagtgtaaaagtgttcctatttctccacatcctctccagcacctgtgtttcctgactttttaatgattgccattctaactggtgtgagatggtatctcattgtggttttgatttgcatttctctgatggctagtgatgatgagcatattttcctgggttttttggctgcataaatgtcttcttttgagaagtgtctgttcatgtccttcgcccactttttgatggggttgtttgttttttttctgtaaatttgtttgagttcattgtagattctggatattagcccttgtcagatgagtaggttgcgaaaattttctcccattttgtaggttgcctgttcactgtgatggtagtttcttttgctgtgcagaagatctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagtttttccagcaccatttattaaatagggaatcctttccccattgcttgtttttctcaggtttgtcaaagatcaggtagttgtagatatgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcaatatggccattttcacgatattgattcttcctacccatgagcatggaatgttcttccgtttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttactgaagttgcttatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagagcatccctgtcttgtgccagttttcaaagggaatgcttccagtttttgcccattcagtatgatattggctgtgggtttgtcatagatagctcttattattttggaatacgtcccatcaatacctaatttattgagagtttttagcatgaagggttgttgaattttgtcaaaggctttttctgcatctattgagataatcatgtggtttttgtctttggctctgtttatatgctggattatatttattgatttgcgtatattgaaccagccttgcatcccagggatgaagcccacttgatcatggtggataagctttttgatgtgctgctggattcgttttgccagtattttattgaggatttttgcatcagtgttcatcaaggatattggtctaaaattctcttttttgattgtgtctctgccaggctttggtatcagaatgatgctggcctcataaaatgagttagggaggatttcctctttttctattgattggaatagtttcagaaggaatggtaccagttcctccttgtacctctggtagaattcggctgtgaatccatctggtcccggactctttttggttggtaagctattgattattgccacaatttcagctcctgttattggtctattcagagattcaacttcttcctggtttagtcttgggagagtgtatgtgtcgaggaatttatccatttcttctagattttctagtttatttgcgtagaggtgtttgtagtattctctgatggtagtttgtatttctgtgggatcggtggtgatatcccctttatcattttttattgcgtctatttgattcatctctctttttttctttattagtcttgctagtggtctatcacttttgttcatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaactgtgatgttagggtgtcaattttggatctttcctgctttctcttgtgggcatttagtgctataaatttccctctacacactgctttgaatgcatcccagagattctggtatgttgtgtctttgttctcgttggtttcaaagaacatctttatttctgccttcatttcattatgtacccagtagtcattcaggagcaggttgttcagtttccatgtagttgagcggttttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttcttgactttctgtctcattgatctgtctaatgttgacagtggggtgttaaagtctcccattattaatgtgtgggagtctaagtctctttgtaggtcactcaggacttgctttatgaatcttggtgctcctatactgggtgcatatatatttaggatagttagctcttcttgttgaattgatccctttaccattatgtaatggccttctttgtctcttttgaattttgttggtttaaagtctgttttatcagagactaggattgcaatccctgcctttttttgttttccattggcttggtagatcttcctccatccttttattttgagccgatgtgtgactctgcacatgagatgggtttcctgaatacagcacactgatgggtcttgactctttatccaatttgccagtctgtgtcttttaattggagcatttagtacattgacatttaaagttaatattattatgtgtgaatttgatcctgtcattatgatgttagctggttattttgctcgttagttgatgcagtttcttcctagtctcgatggtctttacattttggcatgattttgcagcggctgggactggttgttcctttccatgtttagtgcttccttcaggagctcttgtaaggcaggcctggtggtgacaaaatctctcagcatttgcgtgtctgtaaagtattttatttctccttcacttatgaagcctagtttggctggatatgaaattctgcgttgaaaattcttttaagaatgttgaatattggcccccactctcttctggcttgtagggtttctgctgagagatccgctgttagtctgatgggcttccctttgagggtaacccgacctttctctctggctgcccttaacattttttccttcatttcaactttggtgaatctgacaattatgtgtcttggagttgctcttcttgaggagtatctttgtggcgttctctgtatttcctgaatctgaacgttggcctgccttgctagattggggaagttctcctggataatatcctgcagagtgttttccaacttggttccattctccccatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttcttgagccttggttttcagctccatcagctcctttaagcacttctctgtattagttattctagttatacattcttctaaatttttttcaaagttttcaacttctttgcctttggtttgaatgtcttcccctagctcagggtaatttgatcgtctgacaccttcttctctcagctcgtcaaagtcattctccatccagctttgttccgttgctggtgaggaattgcgttcctttggaggaggagaggcgctctgctttttagagtttccagtttttctgttctgttttttccccatctttgtggttttatctacttttggtctttgatgatggtgatgtacagatgggtttttggtgtggatgtcctttctgtttgttagttttccttctaacagagaggaccctcagctgcaggtctgttggaataccctgccgtgtgagatgtcagtgtgcccctgctagggggtgcctccgagttaggctgctcgggggtcaggggtcagggacccacttgaggaggcagtctgcccgttctcagatctccagctgcatgctgggagaaccactgctctcttcaaagctgtcagacagggacatttaagtctgcagaggttactgctgtctttttgtttgtctgtgccctgcccccagaggtggagcctactgaggcaggcaggcctccttgagctgtggtgggctccacccagttcgagcttcctggctgctttgtttacctaatcaagcctgggcaatggcgggcgcccctcccccagcctcgctgccgccttgcagtttgatctcagactgctgtgctagcaatcagcgagactccgtgggcgtaggaccctccgagccaggtgcgggatatattctcgtggtgcgccgttttttaagcccgtcggaaaggcgcagtatttgggtaggagtgacccgattttccaggtgccgtccgtcacccctttctttgactcagaaagggaactccctgaccccttgcgcttcccaagtgaggcaatgcctcgccctgcttcggctcgcgcatggtgctcgctcccactgacctgcgcccactgtctggcactccctagtgagatgaacccggtacctcagctggaaatgcagaaatcacccgtcttctgcgtcgctcacgctgggagctgtagactggagctgtagacaggagctgttcctattcgggcatcttggctcctccttgagtgagtatcttaatcctgagttctagtttgattgcactgtgttctgagagacagtttgttataatttctgttcttttacatttgctgaggagtgcttcacttccaactgtgtggtcagttttggaataggtgtggtgtggtgctgagaagaatgtatatcattgatttggggtggagagttctgtagatgtctattaggtccgcatggtgcagagctgaattcaattcctggacatccttttaactttccgtctcattgatctgtctaatgttgacagtggggtgttaaagtctcccattattattgtgtgggagtctaagtctctttgtaggtctctaaggacttgctttgtgaatctgggtgctcctgtattgggtgcatatatatatttaggatagttagctcttcttgttgaattgatccctttaccattatgtaatggccttctttgtctcttttgatctttgttggtttaaagtctgttttatcagagactagaattgcagcccctgctttttttttgttttccatttgcttggtagatcttcctccatccctttgttttgagcctatgtgtgtctctgcacctgagatgggtctcctgaatacagcacactgatgggtcttgactctttatccaatttgccaatctgtgtctgtagccatttacatttaaggttaatattgttatgtgtgaattttatcctgtcattatgatgttagctggttattttgctcgttagttgatgcagtttcttcctagcatcaatggtcttacaatttgacatgttttcacggtggctgatatcagttgttcctttccatgtttagtgcttccttcaggagctcttgtagggcaggcctggtggtgacaaaatctctcagcatttgcttgtctgtaaaggattttatttctccttcacttatgaagcttagtttggctggatatgaaattctgggttgaaaattcttttctttaagaatgtcaaatattggtccccactctcttctggcttgtagagtttctgccaagagatctgctgttagtctgatgggcttccctttgtgagtaacccgacctttctctctggctgaccttaacattttttccttcatttcatctttggtgaatctgatgattatgtgtcttggagttgctcttcttgaggagtatctttgtggcattctctgtatttcctgaatttgaatgttggcctgccttgctaggttggggaagttctccttgataatatcctgaagagtgttttccacttgattccattctccccatcactttcaggtacaccaatcagacgtagatttggtcttttcacatagtcctatatttcttggaggctttgttcatttctttttactctattttctctaaacttctcttctcgcttcatttcattcatttgatcttcaatcactgacaccctttcttccagttgatcaaatcggctagtgaagcttgtgcatgcatcacgtagttctcatgccatagttttcagctccatcaggtcatttaaggtcttctctacgctgtttatcctagttagccattcatctaatcttttttgaaggtttttagcttctttgccatgggttcaaacttcctcctttagctcggaggagtttgttattactgcttgtctgaagccttcctctctcaactagtcaaagtcattctccgtccagcttcattccatcgctggcgaggagctgcattcctttgaaggagaggaagcgctctgatttttagaattttcagcttttctgctctggtttctccccatctttgtggttttatctatctttggtctttgatgatggtgacgttcagatggggttttggtgtggatgtcctttctgtttgttagttttccttctaacagtcaggacctcagctgcaggtctgttggagtttgctgcaggtccaccagtggaggctgcagaacagcaaatattgcagaacggcaaatgttgctgtctgatcgttcctcctggaagcttcatctcagaggggcactgggccatatgaggtatcagtcagcccctactgggaggtgcctcccagttaggctactcgggggtcaaggacccatttgaggaggcagtctgtccattctgacatctcaaactccgtactgggagaaccactactctcttcaaagctcagttggaaatgcagaaatcacccgtcttctgcatcgctcaccctgggagctgtagactggagctgttcctattcggccatcttggaacccctcccaggtatcccttttatacagtgatttccatttctttagacaaatatctagtggtgggatacctggatcatatagtaattctatttttattttttttttagaaacctccatactgtattagtaaatggctgtactaatttacattccaccaacagtgtataagagtttccttttctctggctgggcatggtggctcactcctgtaatcccagcactttgggaggccgactagggcaggtcacttgaggtcaggagttcaagaccagcctggccaacatggtgaaaccccatctctactaaaatacacacacacaaaaatagctgggtgtggtggcagacacctgtaatcccagctactcaggaggctgaggcaggataatcacttgaacccaggaggcaggggttgctgtgagctgagttcacatcattgtactccaccctgggcaatagagtgagactccgtctcaaaaaacaaaaaaaaagatttctcttttctctgcagcatcaccagcatttattttttctttctttcagccattctaaccagggtgagatgacatttcattgtgcttttgattttcatttccctgatgattagcgatattgagcatttttcatatacctgttggtcatttgtatatcttcttttcagaaatatctattcaatttatagaccaccttttagttggatgatttgagtttttgctgttgagttgtttgtgttccttgtatactctggatatgtctcttgtcagatgaatagtttgcaaagattttctcctattctacaggctgtctcctcactctgctgattgtttacttttctgggcaggaacttttcggtttaatatattgccacttgtctatatgtttgttgcctgtgcttttgaagtcttagccatgaaatctttgcctaaactaatgtcctaaagcatttctcctatgttttcttttagtggttttctagtttgggtcttacagcctttaatccatttttagttgattttttgtgtggtgagaaataggcatctggtttcattcttctgcatacggatattcagttttcccagcaccatttattgaggacattgtcctttccccaatgtatgttcttggcactttgtcaaaaatcagttggttgtaaatatacggatttatgtctgggttctctattgtgttccattagtctatgtttcccctttcataccaatgccactctgttttggtttctatagctttgttgtatattttgaagttaggaaatgtgatgcctctacatttgtcatttttgctcagcattgctttggctatttgggatattttggttctatatgaattttagaattctttttctgtttctgtgaaaaatgtcattgatattttgatagggattgcattgattctatagattgctttgggtagtatgctaattttaacattattaattattccaatacatgagcatgggatgtcttgacacttgtttgtttccttttcaatttctttcattgcctttttttttttttaagagatagggtctttctatgttgcccaggctggattcaaactcctgggctcaagtgatcctttcatctctgtatctgggactacaggtgcaccaccacaccaggctcattgcaagagatatggagaaatatttccctaggacctgagtattgttagataagactgcaggttttttagattacaaattgctccatgtcaacactgagaaccagatgacaagtgacagaggtacccatgtgtccttaaaaaattcttttgtgggtatagatgtaatatatggggccactaccaactcagtactactttacacaaaatgattgatatggaattgtttggataatatgatgtctaactccagaaggtagagactttggttaagaatttcaagggagagatttctttccttttaattttttccaccaagatccaaagcctccacagatatgcctcttcatcattcttgccaggcaggttttagttttcctaatttactcaatgaatgtggtgtctttcggaaatctctactttgtgtaagaattgtcaagctaattaagcctgtgtgcttggttagcacccctatctttattgaagcacttatcacaatagctaagatatggaatcaatctaaatgtccaccaacagataatggataaagaaaatgcattatgtatacacaatggaatactattcagtcgttaaaaaaataaaaccatgtcatttgtggcaaatggatgagcctggagaacattgtgttaagcgaaataagtcaggcacagaaagataaatactacatgttctccctcagatgtgggaactaaaagaaattaacaaaatgggcaaagaaattaacacaatcttacatcttttagcaaactaggaattagaggatatgtcttttgagtgattaagtgcatatgccacaaactttgactcaattccgtgttgaatacttttcccctaagatcagggactggcaaactatgtctacatctctactttttctcaacattttactggaggttgtagcaaatataagggtaagaaataaaaataaaaggcatacaggataaaaaggaagaagcaaaactctctttgttcatagaaaacatgactgtgaacatagaatatcctaaggaattcacaaagaaactattaaaagtaaagagtgaatttagcaaagttctagcatacaaggtgaatatataaaaatcaactgtattttccagtggtgaatactgaaaactaaaatgtaaaagataccatttacgatagcatacaaaaaacttataaaacacataaggataaattagtaaatactgtacaagacttatacactgaaaatcacaaaagaggcaaatttttctgtaaaggaccagatagtagatattataggctctgaagattgcatatggtctctgttgcatattttcctctgtttttcttccttttttcctttcctcttttctacaaactttgaaaactcttatcaccattctaaggttattggcattacagaaacagactggaaagaattcagctcatgaactgtaatttgtcattcccaaccacaaaatagtctctgagagaaaattaaagcattctaaaggccgggcgcggtggctcacgcttttgggaagctgaggtaggtggatcacctgaggtcaggagttcgagaccagcctgaccaacgtggtgaaacccagtgtctactaaaaatacaaaattagctgggcatagtggtgcatgcctgtagtcccagctactcgagaggctgaggcaggataatcacttgaacccgggaggtggaggctatagggagctgagattgcactattgcactccagcctgggcaacaagagtgaaactctgtccaaaaaaaaaaaagagttctaaatataaggaactatttaccatcctgatagagtacactatttgatatcagtaaattgccaatttcagccaggatcctaaaaagtaggtctatggaattgtcacaagagatgttggtgtccttggagcataaggctcttaagacagagtgtatcttgcacctaagtggtctcctgtcctgtacctgggagaagatagttcacagacagctgtgtggtttgtgcaagactcatttagcagagaaatgcccaatatggttgtgctgacaattggtgctctccaccctgcatcttctgatgcaggcagtgaacactctcatgacaggtgtacatggtgctaagtaccctaaggactatttaaaaatgtaaatacgtgacacacatgatgaggcatcaccactgtcaggtggtcaatggataaactctggaatcagacagtctgagttcaaatcctgactctcccttacgcccacatgggtgacctgaggaaggcgcaaagtcctaaatgctgtttgcaattcgaaaaatttgttaaaagagggaagatctgcttgcctggaagggatggtatggggtgcaggacctgggaaaattggggtgccaagtacccatctcagaaaccttcacagcccagctggactcacatctcatgcccatggacccacaccttcctgggtggccacagagaagatatgcctgctccaagacttgagaggccctagagggatccctggaggaaacagtgtgtggtaaccctgagctaccacatgggaaggggacattgtgggggtaaactagtgtcctctgcagaggttgcctgaaaggaagaggtcagggcaaatcacgccccacactgcttggtctctcctccccatcagagcacgtgtcttgcagctgcagccctgctgggccacctgggtgcaccagtaatggcatgagacagagttgatccctgctggccacacccccacctctcctaccctgacctcctgtgagccagggccccttcctggcaggatctagggcgctctgacctctgacctccaataaccccagagaaaagggctaggagactcacaggcactagttgctgcccctaggttagatgctgaggagcctgcagacctggtgatctgggggtgacagttatgtggggtcctataatacacagtcctggatgcttttccatgtcatcgggcacacctggtgccaagcacctgcaaagagcatgagctgtctcaagctctcaaaagtcctgctgggattcccctttgtcctttggtgccttgtcttccctctctgctctagcacacactttctctggtgtgtgttccaatgacatgtcacaaacatccagcatggtttgccttggaggaacatgcagctaggagacctctccaaatttcttactagactctcagtgtcagacagcacacaaactgctcttcacggacaacttcctcagtaagcctcaccccgcctggcccccaggccaccatcctcctttttctccctgccctctctgttcctgcttctggcaggaatcctcctgctgcacctgtgcatcttctgaaaacagttcctgggagcaacacggtcacctttaccccctcggtttatatcacccctgagaggccttatgcaacccagcaagctcagtgtttacatcagaagggggcctccccttggtgtcatgccagggctctcagaaagacagcactgtatgcttgcacctcaaagaagtgcagccacttaggaaaagtactgatcctacctgcagggggaaactgacttctcttcctgtcgctatctgagcgacatctgcgctccttcaatagcaggagcgctatatgggccatctgattactcccctgatccttgcttaaaagagactgagggccgggcatggtgtctcacgcctgtaatcccagcactttgggaggccgaggcgcgcagatcacctgaggtcaggagttcgagaccagcctggccaacatggtgaaaccccatctctactaaaaatacaaaaattagctgggcgtggttgcgcacacctgtagtcccagctacttgggaggctgaggcaggagaatcacttggatccaggagacggaggtttgcttgaacccaggaggcagaggcggaggcgggagaatcgcttgaacctgagaggtggaggcctgaggcaggagaatggcatgaaccctggaggcggagcttgcagtgagccaagatcgcgccactgcactccagcctgggcgacagagcgaaactccgtctcaaaaaaaaaggggatcaagataaagggccactgcagcagtgccatgcaccatcaatatctaagcccctttgggtggtggcaggtttgcagtcattgtgtctgtcccaaaccctggctccttgtcaggggtcattgaaatctgcagaagggctgacaacactcagaaccacaacttattctaggaagggcttagacctgagcaccaggtcctgcctgcctatagcatccctgttgcaatgagggaagatcagctctacggagcagaaatctgttttgggagccctttccttcctggctacagagtgactgaggcccacccagccaaagcatacctgttactattgaaggagataacatcgctaagaaggagcatatatcagaataaacttctgttcctccttgtgttcggatcacccgggtcccatcccgctagagcacatcagttggacgggtatctctataacggtgctggagataattctgttgctgtctatagtcagaccacctgggacacacctggccagaatgcatcggtagccttgagggttccaacaccacacttgtgcttagaggccctcttgtgtccgcctacatgcaaagcacctgggctccacctgttcagagcacatgtgttgcaatgggagggcacagcacaactgtgacaaagagtcctctttctgcacctcgtcagagcatttggggcccacctggctaataaacacatgttcccactttctatcaggcacccacgggagcacatgtgctactgttggagggcctgacaccacacttgtggttggagatgctactgtttatgaatccagttcagagcaccacggaccttccagccctgggcatagattggtacagtgggaggggacaccgccatacctgtgtttgggaacatttccatacccaccatcattcagagaacctgggatgcttatggccagagcactgttgtagccagaggagggcaacatcataaacttagaggaagacacttttagtgtccctttcagtccaaactcctggagcgtaagccagggagcctaccccttttgactttgtaggagccaacatcactgagaaaatacttgtgcttcaggtggagtaaatgtccctctgtggtgggcacagcaaatggcagccttgtctttggtccctgcccccgcccccaagcccccgttgcctgcccaggtcttcacagaagatggaagtactggattgccaacctactcatttttctctagtgaaagaaccaggaactcagtgcctaagaagcaaaatcttcttgtagaaatggcagtgggtggccactgtccaccatgaaagaaccttactctgctggaaaggctcaacccattctagttatgtcaaactcaacctgctcttcctcctcctctagcaagcttgaaggtgagcacctcgaagggcttctttttatgttgaaaggcacgggtttgcatggcggttcatcagaggtcaataccccagtttgagaaagtccactgtggggaggaaagagagacttgtaagtaccaactgtgctccactctggttttgtctgtaagcctggaagactcaagctctgggacactttccttctagtcttgggactggtagcacctccagcaactcccaccccgctgcgggcaagctgttccttttcttttaacctatttgtctccatggtccttttacttgcttttccggattaaatatctaaagcctccttcatgttcatgagtctctgctctggggtcttcacttttaggccagtctagaaggaaggatgccttctatgaatggtgacaggttgagccagacttgacatttcaaaattttctgtggctcagctaatgtgacatggaagtagcacactctaggactgtttgtgctgacttctgatgtctctgatgagagtgtgaggatatcagcccaggaagaggagaggtccagagaaagagagaccaggacatgcccttgccacctccctctgtgcttcccctacaccatctgacctccccaaaggtcagatcctccctgctgtgtgacaggaaagcacactttactgttttcgtcttttaaaaatgtttgaatatcttttctatgtgttttttttttaaattagattggggccaggcattccactgtgaaatacaaataaaacccagaggccggttgaggtggctcacgcttgtaatcccagcactttgggaggccgaggtggggtggatcacctgaggtcaggagttcaagaccagtctggccaacatggtgaaaccccatctctacaaaaatacaaaaattagccgggcatggtgccatgtgcctataatcccagctgctcgtgaggctgaggcagaattgcttgaaccctggaggtggaggttgcagtgagccaagaccgtgccactgcactccagcctgggtgacagagcgagactccgtctcagaaaaataaacaaacaaataaataataaaaccctgagccctctgactgactgaacagacccctcttggccaaggtgacccccaaaaaactaaaaactaagtttcccggccgtaaggagatgggaaattgcgcctccgtataccccttcctcactgttaccagggtttttttttgtttgtttcccaaattaaacagaaacaagccctggaaaaacaaagaatggaacacccctccgctgacttcaaccaactgcctgctgatgcggcctgactcccagccctttttgcagttttgaagtgacaaactgactaggctacaaagtattcaaccatgggctggttctggctggttcaccgaggctgtgtacaaagtgtcttcatgtcctgtgtttcaccttttaacatacagaacctaattttactgcattttaatgttaattctccactcgaaggtgaacatgggatgtatgtaacacatatgtttgcttatcaagcacacatatgaccccctttcatgaatattcatagttccccctgtgacctgttgaatatgtctgtttagccaacctgtttggcataaaactcctatcccaccctatctccctcaaagtacctgtttgtggtctcagctggaggtgccacttcccagcctgcagtttgcaacccttctcaagaaataaagtcttcctttccaagtttac

SEQ ID NO: 12132 - DNA, 3216 bp, Homo sapiens
ggccattttcacgatattgattcttcctaaccatgagcatggaatgttcttccatttgtttgtatccttttttatttcattgagcagtgttttgtagttcttcttgaagaggtccttcacatcccttgtaagttggatttctaggtattttattctctttgaagcaattttgaatgggagttccctcatgatttggctctctgtttgtctgctattggtgtataagaatgcttgtgatttttgcacatcaattttgtatcctgagcctttgctgaagttgcttatcagcttaaggagattttgggctgagacaatggggttttctagataatacaatcatgtcatctgcaaacagggacaatttgacttcctcttttcctaattgaataccctttatttccttctcctgcctaatggccctggccagaacttccaacactatgttgaataggagtggtgagagagggcatccctgtcttgtgcccgttttcaaagggaatgcttccagtttttgcccattcagtatgatattggctgtgtgtttgtcatagatagctcctattattttgagatatgtcccatcaatacctaatttattgagagtttttagcatgaagagttgttgaattttgtcaaaggccttttctgcatctattgagataatcatgtggtttttgtctttggttctgtttatatgctggattatatttattgatttgcatatattgaaccagccttgcatgccagggatgaagtccacttgatcatggtggataagtttttgatgtgctgctggatttggtttgccagtattttattgaggatttttgcattaatgttcatcaaggatattggtctaaaattctcttttttggttgtgtctctgcccagctttggtatcaggatgatgctgggctcataaaatgagttagggaggattccctctttttctattgattggaatagtttcagaaggaatggtaacaattcctccttgtacctctggtagaatttggctgtgaatccgtctggtcctggactctttttggttggtaagctattgattattgccacaatttcagagcctgttattggtctattcagagagtcaaattcttcctggtttagtcttggaaatgtgtatgtgtcgaggaatgtatccatttcttctagattttctagtttatttgcatagaggtgtttgtaatattctctgatggtagtttgtatttctgtgggatcagtggtgatatcccctttatcattttttattgcgtctatttgattcttctctcttttcttctttattagttttgctagcggtctatcaattttgttgatcctttcaaaaaaccagctcctggattcattaattttttgaagggttttttgtgtctctatttccttcagttctgctctgtttttaattagttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtcttagttctcgtggtttcaaagaacatctttatttctgcttcatttcgttacgtacccagtagtcattcaggagcaggttgttcagtttccatgtaactgagcggttttgagtgagtttcttaatcctgagttctagtttgattgcatggtcgtctgagagacagtttgttataatttctgttcttttccatttgctgaggagagctttacttccaagtatgtggtcaattttggaataggtgtggtgtggtgctgaaaaaaatgtatattctgttgatttggggtggagagttctgtagatgtctattaggtccacttggtacagagctgagttcaattcctgggtatccttattaactttctgtctcgttgatctgtttaatgttgacagtggggtgttaaagtctcccattattattgtgtgggagtctaagtctctttgtaggtcactcaggacttgctttatgaaactgggtgctcctgtattgtgtgcatatatatttaggatagttagctcttcttgttgaattgatccctttaccattatgtaatggccttctttgtctcttttgatctttgttggtttaaagtctgtttaatcagagactaggattgcaacctctgcctttttttgttttccatttgcttggtagatcttcctccatccctttatttcgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttgctcattagttgatgcagtttcttcctagccttgatggtctttacaatttggcatgattttgcagtggctggtaccagttgttcctttccatgtttagcgcttccttcagaagctcttttagggcaggcctggtggtgacaaaatctctcagcatttgcttgtctgtaaaggattttatttctccttcacttatgaagcttagtttggctggaaatgaaattctgagttgaaaattcttttctttaagaatgttgaatattggcccccactctcttctggcttgcagggtttttgccgagagatctgctgttagtctgatgggcttccctttgtgggtaacccgacctttctctctggctgcccttaacattttttccttcatttcaactttggtgaatctgacaattatgtgtcttggagttgcttttctcgaggagtatctttgtggcgttctctgtatttcctgaatctgaatgttggcctgccttgctagactggggaagttctcctggataatatcctgcagagtgttttccaacttggttccattctccccgtcactttcaggtacaccaatcagacgtagatttgatcttttcacatagtcccatatttcttggaggctttgttcatttctttgtattcttttttctctaaacttcccttctcacttcatttcattcatttcatcttccatcactgataccctttcttccagtgatcgcatcggctcctgagcttctgcat

SEQ ID NO: 12133 - DNA, 3228 bp, Homo sapiens
ggccattttcacgatagtgattcttcccacccatgagcagggaatgttcttccatttgttcgcatcctcttttacttcattgagcagtggtttgtagttctccttgaagaggtccttcacatcccttgtaagttggattcctaggtattttattctctttgaagcagttgtgaatgggagttcactcatgatttggctctctgtttgtctgttgttggtgtataagaatgtttgtgatttttgcacattgattttgtatcttgagattttgctgaagttgcttatcagcttaaggagattttgggctgagacgatggggttttctagatatacaatcatgtcatctgcaaacagggacaatttgacttcctcttttcctaactgaatgtcctttatttccttctcctgcctgattgccctggccagaacttccaacactatgttgaataggagtggtgagagagggcatccctgtcttgtgccagttttcaaagggaatgcttccattttttgtccattcagtatgatattggctgtgggtttgtcatagatagctcttattattttgagataggtcccgttgatacctaatttattgagagtttttagcatgaaaggttgttgaattttgtcaaaggctttttctgcttctattgagataatcctgtggtttttgtctttggttctgtttacatgttggattacgtttattgattttcatatgttgaaccagccttgcatcccagggatgaagcccacttgatcatggtggataagctttttgatgtgttgctggattcggtttgccaatattttattgaggatttttgcatcgatgttcatcaaggatattggtctaaaattctcttttttggttgtgtctctgccaggctttggtatcaggatgatgctggcctcataaaatgagttagggaggattccctctttttctattgattggaatagtttcagaaggaatggtcccagctcctccttgtacctgtggtagaattcagctgtgaatccatctggtcctggactttttttggttggtaagctattgattattgcctcaatttcagagcctgttattggtctattcagagattcaacttcttcttggtttagtcttgggagagtgtatgtgtcgaggaatgtatccatttcttcgagattttctagtttatttgcatagaggtgtttatagtattctctgatggtagtgtgtattcctgtgggatcagtggtgatatcccctttgtcattttttattgcatctatttgattcttctctcttttcttctttattagtcttgctagcagtctttcaattttgttgatcttttcaaaaaaccagctcctggattcattgattttttgaagggttttttgtgtctctatctccttcagttctgctctggtcttagttatttcttgccttctgctagcttttgaatgcgtttgctcttgcttctctagttcttttaattgtgatgttagggtgtcaattttagatctttcctgctttctcttgtgggcatttagtgctataaatttccctctacacactgctttgaatgtgtcccagagattctggtatgttgtgtctttgttctcattggtttgaaagaacatctttatttctgccttcattccgttatgtacccagtagtcattcaggagcaggttgttcaatttccatgtagttgagccgttttgagtgagtttcttaatcctgagttctagtttgattgcactggggtctgagagagagcctgttataatctccgttcttttacatttgctgaggagtgctttacttccaacatgtggtcaattttggaatgggtgtggtgtggtgctgaaaagaatatatattctgttgatttggggtggagagttctgtagatgtctattaggtccacttggtgcagagctgagttcaattcctggatattcttgttacctttctgtctcgttgatctgtctaatgttgacagtggggtgttaaagtctcccattattgtgtgggagtctaagtcactttgtaggtcactaaggacttgctttataaatctgggtgctcctgtattgtgtgcatatatatttaggatagttagttcttcttgttgaattgatctctttactgttatgtaatggccttctttgtctcttttgatctttgttggtttaaagtctgttttatccgagactaggattgcaacccctgccttttttgttttccatttgcttggtagatcttcctccatccctttattttgagcctatgtgtgtctctgcacgtgagatgggtttcctcaatacagcacactgatgggccttgactctttatccaatttgccagtctgtgtcttttaattggagcatttagcccatttacatttaaggttagtattgttacgtgtgaatttgatcctgtcattatgatgttagctggttattttgctcgttagttgatgcagtttcttcctagccttgatggtctttacaatttggcatgtttttgcagtggctggtaccagttgttcctttccaggtgtagtgcttccttcaggagctcttttagggcaggcctggtggtgacaaaatctctcagcatttgcttgtctgtaaaggattttatttctccttcacttatgaagcttagtttggctgcatatgaaattctgggttgaaaattcttttctttaagaatgttgaatattgacccccactctcttctggcttgtagagtttctgccaagagatccgctgttagtctgatgggcttccctttgtgggtaacttgacctttctctctggctgcccttaacatttgttccttcatttcaactttggtgaatctgacaattatgtgtcttggagttgctcttcttgaggagtatctttgtggcgttctctgtatttcctgaatttgaatgttggcctgccttgctagattggggaagttctcctggataatatcctgcagagtgttttcccacttggttccattctccttgtcactttcaggtacaccaatcagatgtagatttggtcttttcacatagttccatatttcttggaggctttgttcgtttctttttattcttttttctctaagcttctcttcacacttcatttcattcatttcgtcttccatcgctgataccctttcttccagttgatcgcatcagctcctgaggcttgtgcattcgtcacgtagtt

SEQ ID NO: 12134 - DNA, 1125 bp, Homo sapiens
gtcttgctagcagcctatcaattttcttgatctgttcaaaaaaccagctcctggattcattgattttttgaagggtttttttttgtctctatttccttcagttctgctctgatctttgttatttcttgccttctgctagcttttgaatgtgtttgctcttgcttctctagttcttttaattgtgatgttagggtgtcaattttagatctttcctgctttctcttttgggcatttagtgctataaattttcctctacacactgctttaaatgtgtcccagagattcgggtatgttgtgtgtttgttcttgttggtttcaaagaacaactttatttctgccttcatttcgttatgtacccagtagtcattcaggagcagcttgttcagtttccatgtagttgagcagttttgagtgagtttcttaatcctgagttctagtttgattgcagtgtggtctgagagacagtttgttataatttctgttcttttacatttgctgaggagtgctttacttccaactatgtggtcagttttggaatacgtgcgatgtggtgctgaaaagaatgtatattctgttgatttggggtggagagttctatagatgtctattaggtctgcttggtgcagagctgagttcaattcctggatatccttgttaactttctgtctcattgatctatctaatgttgacagtggggtgttaaagtctgccactattattgtgtggaagtctaagtctctttgtatgtctctaaggacttgctttatgaatctgggtgctcctgtattgggtgcatatatatttaggacagttagctcttcttgttgaattgatccctttaccattatgtaatggccttgtctcttttgatctttgttggtttaaaatctgttttatcagagactaggtttgcaacccctgcctttttttgttttccatttgcttggtagatcttcctccatccctttattttgagcttatgtgtgtctctgcacgtgagatgcgtttcctgaatacagcacactgatgggtcttgactctttatccaatttgccagtctgtgtcttttaattggagcaaatagtccacttacatttaaagttaatattgttatgtgtgaatctg

SEQ ID NO: 12135 - DNA, 5015 bp, Homo sapiens; identical to SEQ ID NO: 12094

SEQ ID NO: 12136 - DNA, 32992 bp, Homo sapiens
gattttgtatactgagacttcgctgaagttgcttatcagcttgagattttgggctgagacgatggggttttctagatatacaatcatgtcatctgcaaacagggacaatttgtcttgctcttttcctaattgaacaccctttatttctttctgctgcctgattgccctggccagaacttccaacactatgttgaataggagtggtgagagagggcatccctgtcttgtgccagttttcaaagggaatgcttccagtttttgcccattcagtatgacactggctgtgggtttgtcataaatagctcttattattttgagatacgtcccatcaatacctaatttattaagagtttttagcatgaagggctgttgaattttgtcaaaggccttttcagcatctattgagataatcatgtggtttttgtctttggttctgtttatatgctggattacatttattgatttgcatatgttgaaccagtcttgcatcccagggatgaagcccacttgatcatggtggataagctttttgatgtgctgctggattttgtttgccagtatattattgaggattttcgcatcgatgcttatcagggatattggtctaaaattctctttttttgttgtgtctctgccaggctttggtatcaggatgatgctggcctcataaaatgagttagggaggattccctcttttcctattgattggaatagtttcagaaggaatggtaccagctccttcttgtacctctgatagaattcagctgtgaatccatctgatcctggactttttttgggtggtaagctattaattattgcctcaatttcagagcctgttattgatctattaagagattcaaattctttctggtttagtcttgggagggtgtatgtgtcaaggaatttatccatttcttctagattttctagtttatttgcgtagaggtgtttatagtgttctctgatggtagtttgtatttctgtgggatctgtggtgatattccctgtatcattttttattgcgtctatttgattcttctctcttttcttctttattagtcttgccagtggtctatcaattttgttaatcttttcaaaaaaccagctcctggattcattggtttttttgaagggttttttgtgtctcttatctccttcagttgtgctctgatcttagttatttcttgccttctgctagcttttgaatgtgtttgctcttgcttttctagttcttttaattgtgatgttagggtgtcaattttagatctttcctgctttctcttgtgggcatttagtgctataaatttccctctacacactgctttgaatgtgtcccagagattctggtatgttgtgtctttgttctcattggtttcaaagaacatctttatttctgccttcatttcggtatgtacccagtagtcattcaggggcaggttgttcagtttccatgtagttgagcagttttgagtaagtttcttaatcctgagttctagtttgattgcactgtggtctgagagacagtttgttataatttctgttgttttaatttgctgaggagtgctttacttccaactgtgtggtcaattttggaataggtgcactgtggtgctgagaagaatgtatattctgttgatttggggtggagagttctgtagatatctattaggtccgcttggtgcagagctgagttcaattcttggatatccttgttaactttctgtctcgttgacctgtctaatgttgacagtggggtgttaaagcctcccattattattgtgtgggagtctaagtctttttgtaggtctctaaggacttgctttgtgaatctgggtgctcctgtattgggtgcatatatatttaggatagttagctcttcttgttgaattgatccctttaccattatgtaatggccttctttgtttcttttgatctttgttggtttaaagtctgttttatcagagactaggattgcaacccctgcctttttttgttttccatttgcttggtagctcttcctccatccctttattttgagcctatgtgtgtctctgcatgtgagatgggtttcctgaatacagcacactgatgggtcttgactctttatccaatttgccagtctgtgtcttttaattggagcatttagcccatttacatttaaggttaatattgttatgtgtgaatttgatcctgtcattatgatgttagctggttattttgctcgttagttgatgcagtttcttcctagcctcgatggtctttacaatttggcatgtttttgcagtggctggtacagttgttcctttccatgtttagtgcttccttcaggagctcttttagggcaggcctggtagtgacaaaatctctcagcatttgcttgtctgtaaagtattttacttctccttcaattatgaagcttagtttggctggatatgaaattctggcttgaaaattctttaagcacgttgaatattggcccccactctcttctggcttgtagagtttctgccaagagatcagctgttagtctgatgggcttccctttgtgggtaacctgaccgttctctctggctgcccttaacattttttccttcatttcaactttggtgaatctgacaattatgtgtcttggagttgctcttctcgaggagtatctttgtggcattctctgtatttcctgaatttgagtgttggcctgccttgctaggttggggaagttctcctgggtaatatcctgcagagtgttttccagcttggttctgttctccccatcactttcaggtacaccaatcagacgtagatttggtctattcacatattcctatatttcttggaggctttgtttctttttattgttttttctctaaacttctcttctcacttcatttcattcatttgatgttccatcactgataccctttcttccagttgatcaaatcagctactgaaggttgtgcatccgtcacgtagttctcatgccatggttttcatctccatcaggtcctttaaggacttatctgcattggttattctagttagcaattcctgtaatcttatttcaaggtttctaacttctttatgatgggttcgaacttcctcctttaactcagagaaggttgattgtctgtagccttcttctctcaacttgtcaaagtcattctccgtccagctgtgttccattgctggtgaggagctgcattcctttggaggaggagaggagctctgatttttagaattttcagtttttctgttctgttttttccccatctttgtggttttatccacctttggtctttgatgatggtgacatacagatggggttttggtgtggatgtcctttctgtttgttagttttccttctaacagtcaggaccctcagctccaggtcttttggagtttgctggaggtccactccagaccctgtttgcctgggtatcagcagcggaggctgcagaacagtggatattggtgaacagtaaatgttgctctgtgatcgttcctctggaggttttgtctcagaggagtacctggccgtgtgaggtgtcagtctgcccctactggggggtgcctcccagttaggctactcgggggtcagggacccacttgaggaggcagtctctccattctcagatctcaaactctgtgctgggagaaccactactctcttccaagctgtcagacagggacattaaagtgtggagaggtttctgctgccttctgttcagctatgccctgcccccagaggtggagtctacagaggcaggcaggcctccttgagctgtggtgggctccacacagttcgagcttcccggccactttgtttacctactcaagccttagcaatggcgggcgcccctccctcagccttgctgccaccttgaggttcgatctcagactgctgtgctggcaatgagcaaggctctgtgggcgtgggaccctctgagccaggcacgggacatgatctcctggtgtgccatttgctaagactgttggaaaaacgcagtattatggtgggaatgacccgattttccaggtgctgtctgtcacagcttcccttggctaggaaagggaattgcctgaccccttgcacttcccgggtgaggcgatgcctcgccctgcttcggctcacgctcggtgggctgtacccactgtcctacgcccactctctgacaagccccagtgagatgaacccggtacctaagttggaaatgcagaaatcacccatcttctgcgtcactcacgctgggagctgtagaatggagctgtttctattcggccatcttggacactatacgttttttttgagacacagtctcattctgtctccctggctggagtgcagtggtgccatcttggctcactgtaagctccaactcccaggttcaagtgattcttgtgcctcaggctctagagtagctgggattacaggtgcgagccaccacaaccagcttctaagagagtcccatgatgtctccatgtggtggtgtccatgattaggtttcattaggtggtaaaggtgaagtaattttgaagatatagttaagtagttaagatgtctaatcaattggctttaaattaactgaaagagtgatttacctggccaggtgtgacctaatcaaatgagctctttaaaagagactctgtcttctactggtcccagtgaagcaaacagctgtcttataaaccgctggaggggagcagcagccctcaggagctgaggacctcagtcctaccactgtaagaagctgaagttctccaaacctgagggagcttgaagtgcattcttttcaagttgcattcttcagatgggaatgcagcccactgacaccttgactgcagctttgtgaaaccatgagcaaaggacctagctaggcccacctggactcctaacccatgaaagctgtgagataagtgtgtgtgggtttaagatgttaattttgtgatagtttgttatgcagtattaaaaaacatatacactcaaaagcacagagaatagtacaatgccatgctactcaaactgtgctccatgaactcatgctgtccacagtctgttcctgatccctgagaaaatcagtacggaaactagagcaagcactgagtaacttctacagcagtcggacactgccatgacacccaagtgtgtgaccactagactcatctccagggcaggaccagtttgcatttgtgaaacttacatgacaaattgtgcatggtatagtctgtgtgctagatacatgttacaacatgtatggtttcagttttagtgtgatgattgaaatccaaaattatcaaaatctgagaaatgtaagcatttacttattttctaacttcttattttcaatttttattcaagcttgtttggtttaggtttagcaaattattaaattagagaaataaaagtccaattatttatttttaaacctgtgttattttaaccccatgtttcaacaacatagcttgatgtactcaagaactgaccagtgatacagaaaaccaactcttagaacagataaaactggtgaatttttcactgcagttcaaagaatgtgtgggtttgctaatggtacagttctagtatgtgtgcaatttgaacacgatgccgatatgaagaatttagctccattaccaatcaacacaactagctgtgaactacataaaactatgaaagaggctgagtgtggtggctcatatctgtaatcccaacactttgggaggctgaggcaggaagatcccttgagcctggaagtttgggactagcctggacagcatagtgggacgctctctcttcaaaaactaaaaaaattaacagggtggtggtgcacacctgtggtcctagctacttgggaggctgaagtggaaggctcatttgaacctgggaggccaaggcagcagtgaaccgtgattacatcactgtactccagcccgggcaacagagtgaagaccaccctatctcaaacaacaacaacaacaacaacaacaacctatgaaagaatacattgtccacaaatgtggctttgagtttaaagtgcgtggagagagtattcttgtgttctgacagctgcaataacaggagaatattctggagcagagagagcagtcatccagattaaggagtttgtggcagaatgtaagtcaaatgcatggtttcattccgtgagaaagtcttgctaccaaaaacactaaaacaaatcctaaaagacccccagtgaactgaatagtatatccagtaatgaatcaagaatttgtgaattacatgaagacaaatgcactaaagattttccttcttttatgtgataatatgtgagtggaacacaataatctcttactgcatgttgagatacaatcgttttggcagaagtctgtcaggaacaaaatacagaacaaagtcatcacgcttccgcaagataaggaatccatttgacccagtgtttaaagagtaaactggacatccagacttactgatttttctgatatctcaggtctcttaaatttattttttaattaattaatttttaaattgacacacttgtaattgcacatattatgaggtacaatttgatgttttgatacatatgtgttgtataatgatcaaatctgtgtatttagcatgtttactacctcatgtacttatttctttatggtaagaacattcaaaaacctctcttgtagctattttgtgatatacaataccttactgttcaccgtggtcaccctactgtgccatagatgctaggacttatcttgcctattgtacccttgtacccattgaccaacctttccacattctcctcttctctctcccctccccactctctggtaaccactgttctactctctgcttctactttattttagattctagatatgagtgagatcatatggtatttgttaggtatttttaatgatctttaaattttcatgtaaggtaggaatgcaagaaaacatcaaaaggcaaaaccaaaaattagaatttctacagatttttatgacatgttttgtctcatcaacaataatcagaaatgtagtggatggcctattactgtatacctgcatacttgtgaaatttgaattttatttgtatcagatacaatgctcacataagaaaactatggttctggaatctatttctttcatcaatagatgtggataatttaaatgaaactgtgactttacagaataaattgaaactgtctactgaccaaggactgaagacaaattttgaaaatataacattatttgctttatttttggataacagttttaaatgaatattctgagcttgctgaaattgctttaaaatctcttctgccttggccaggtgaggtggctcatgtctgtagtcccagcttctcaggaggctgaggcaggagggtcgcctgagtccaggagttggaggctgcagtaaactatgatagcactactgtactccagcctgggcaacagagtgagactctgcctccaaaaaaaaaaaaaaaaaaagttttgtctttactctttttatatgatatgtttgttttgattatatttattgaaatataattttatgtctgttgaatacaatgaaaaattttgacttacatcttgtatgtctggttttttatatcatttaatttttttggtaattcacttttattgtattttataaaagtattagtctatgataaattggaagtttttttttaaaaaaagcaaatctgcccttcttcccatgaggaggagaaggcacatggttgtaaaaccacagagaccacacctgcttccacaaagacccacttttcaacactcttgtctcagctgttctcccacttctattttttgctggagtattttaaagcaaatcctagacatcatatacttgtatgagcaactacttcagtatatagttttaaaaataatgccttaaaaactctaatcacaatatcatcacattcaacaaaataagtattataattcctaatagtatctaatacttggcttatcttcacttccctgattatcttgaaaacaactttgaggttggtttgttcaagtcaggatgcaaacaagggccacatactgcatttggctgctctgtctcaagtctcctttgatctaacacttccctcttctatttctttaaaaccataaggctgttgaagaaagagagtcatttgtcctgcagaatttttcacatatctgaatttggcttactgcttccagggacggtctgttaatctcttcctctatccccaatagttctatctcctgtgagttagtcaaaggctttattagattaatgcttgtgtgtgtgtgtgtatgtgcatgcatgcatgcaagattacttcctaggtggtgccatgtatttccgattgcatcagcccgagagacacctaagtctggttgccaccctcagtgactatgacattgatcagtgggtttagtttttcaccctgatccacccattatcatatcctccattgacttttacttaatggttagcaaccattaattattgctacctagatccattatttcactggggatttgaaaagtggtgattttctaaacatctctttccctcttcatttattagcttgaatggatttctacagaggaaacattatctcttctctttatttggttatcttgaaatacagactgtagaaaagaacaggaacaatgctcaattttttcccttccttttataaatttccagaataataaatttgcaccttatcaatttcccaagataactgattaattttgttttattttgtattttttaaatagtatctatacgaactcatagattttatatatttggtatgtttcaaaacactgccatcattattcaaatggccctgtctttgggcaatgggcacctcttcaggctggttctggggtctattttgacatcaatctagtagacattaagagctctttgttttcaggcatgacaaggtgtcccaggctcatcttgtatgctttcagccccaggcatgaaatcagccatttttctactctggttccttttagtggaagttgaaacttatgagccacagtctaggttctatagctctaagtcctttacaccctcttcccatggactggaagagctcattaaagattaaatatgtagaagtttgaggccaagaccattgctttgatttgagagtctagtgtacacatcaccttcaaggagcccatgaggagacagacttgggtctcccaacacaataccagaaaataacacttgtaccaccccttaaaacctctaactggtttgaaatgacttcattcatttactcatttgtccattcaacaaatactttgagcacctattatatctattgtgtcaagccccaggcatatatatatgtatatgtgtatatatatatatatatatatatgtatatataaatgaacaaaacagacctaatctctgctctcaggcacacgatgttctagtgaggggaggacaatgaacaggtaaacacgttcgtgacagagtgtggggcatgctttctatatagcatggtctggtgaagatctggagcaaatacctgaggaaatgaggaaggatggcaggcagaaatctagggaaaagtgtcaggacagagggaacagtcagtgcaagggccctgagccagaagtgcactcatcgtgatttctaaccctagagatactgacaaattctttactctccaacacgtcctatcaatttcaaaatattttctcacagtaacattttataagttcacagcttgcctctcagcagtgacctttttatatggtaacttttatgccatcacttcacaatgtcttgaaagatataacatcttcccccatatcccaacacttatattcttaaaaataacttttctaattccagaagtttggggtgtttattgcagaacacatggaaaacacacacacacacacaaaacacataacaaaattaaatgaaaacaaaacagaagccatctgtttctccccccaccgcccctgctactgagaattcacctctgttgacactgaaatttgtgtccttccattttatttacaaaaatgtagtgagtccaggaccttgccttctcatttgtggacatggctttcagtacctgtagagactgccggcttataactgcccaatagtaatttctcaaagcagtagcttcttcctgagttatggcttgcacgtgctaaattatccttttatacctagagggcacttccggtgtatcacaaaccctgtccttccctctctccagaggtcatgccactgagttccactgtttccaaattatcaggcggtccttgcttctcagatagatttctctgatagatgtgacaaaaagaatctgtccccactctcaccctttccccttcctgccaagagagaccctttagggtgggtgggatagtgaggcaggcaatatttgaaatgtaatattgaaatggtggagacagaatttaatgaattttattttagtgtaaaatagaattttaatttacctagtttgctttcatcacccgatgctgtgcatggtattgtcaccgaggtcctgtttatttggtaagtttcatcaccaattatctgaacacttgtacacgcagaatattcttaacaaacttaggtgaaaacaacaaagaccatccagatgagagcaagcagaagccattcgttcagagctatagcaagggagtcagccacagccagcaccatggtgttgggcagaggctccaaggcaggcagggagtggggatgcttcctagtggaaaagggtaggcttcaggtatgctctgactggaggctgttagcgtgggggagctggaggcagactaactagaagtggggcatcctatgtgattgttctggagcacatattgggctttatctggtttgtcccgtgttggggaggggatgaggataaaacacagggaagctgcagttgctgccgggtgctgatccttccgggctggtcaccacagtggttgtggtttggcttcccagttttgtggctatacagattgcaagtcagaatctcatcatcatatgtagtcagtcattgttcattcagtctctcacatatgtttcaaaatgtcacattgacgatttgagtgtcatgatggaaagatattttcctttagaactgaggtccatggggtatggtggtgtgagagaaatgctcagacatcacaatgaatgtttgaattccagcaggtgaccctagacaggccatttcctcattagtaaaatagaaaaatattaaacccacctcgtatggttgttgaaagcgtaagaaacatgtgtttatgcaaggcctagtataaagaagacttggttagggctgtgtgttggagagaagcagctgatgctctcttctgggggtcacttaggggccttggcagagctgtgactttggacaccaactttggtttagaaaaagactcaataaatgcaactttccttcagccacttggcagtgggagtggaaggtccttgctatgtagaaccctgtggtctctgggtccctcctgctctgtccagtggcatttgctatcattcggaaagtttgcaaggccatccctgacaggccgatcatttccccaattactggtctgcgtttgtgttgaagtctatagtatagcagaaaaacagactaaagctcccaacagtacatgttctcatgattcatgcagacagccctgccatcttcagcaagtgcaaactagaactacatgttaagcaataaaaccacatgccatgctgtccagacagggcctactgacttcttacagcttagctggggttgaattttctatacaagctctcacactctcctccaaggatgaccggatctagcaagtatctgctccacccaatgtttctgttttccatcccacatgctgagtctggaacttactctgcacaggctctgtgggtgatcgacaccccaggacttgaattggagaccttgtacatttaacttaggacctaagtgtcaatatgtgtcactctgttcttccctttgtccaccagactgatgactgtgattcagagaggatgtgagctccaacctgaattccatcagcctacaaacaacctcattcctcaaaggttcctattcagacaggctttatctgtagttattaataaaatatgttagcaaccgagtcagctttggctggcaatcatacataagcctacctaactaaccatacaccacattgtagaaagaagttcatactctcaaagagcaagtttctatggaaatatacatctaactacatttggactatatgtttatacatctatacacctatatacatttatattagactcctaggcctgctgtaacaaagcatcccaaatttggtggcttaaaacacaagaaatgtgtgccatcatacttctgtatgctagaagcctagaatcaaggggcaggcagggccgtgccctccctgaagcctctagcagagatccttctttgcctcttccaggcctttgtctgctgctggcactctttgcataccttggcttgtagatgcattattcgaatctctggtgtcacatggtgttctctctgtgtgtctgtccaaatctcccccttgttttaagggcaccagttattgtattagcacccaccttaatccagtatgagctcatcttagtttgattatattttgcaaagaccctattaccaaataaggtcacattcacagccatggggtgggggggtaggacttcaaaagatcttttggagagacacaattctacccccaacaggtacctctacactaataagaggagtacttttgagagacagcatagcccagttgttaggagagggattctcaccagattcaactcctggctttgttgcttcttagctgtgtgatcttgggaaatataggtaggcaatctgtgccttagtttctttacctgtaaaatgggaggtgctaatcaaaatgccagcctcagaggagcataacaggctcctgtgagtcagcccccataaagtacagggcacagagctggcacatggcaggtgtcagtccacaggggccctgctgattgaccaggtactcttctgagctcttcatagtattaacctacttaatcctcaaaacaatgaaattggtactattatcactcccattttatagaaggttaactgaggcacagataggttaataattagcccaaggtcccacatcagaaagtggcacagctgggacctaaacccaggcagtcccgctcagagcctgtcctccactgtaacatcggatatcattacccactgcataatctacccagtgttctccatcacacccaaagaggctgtttcttttgaatatcttctcttcctcatgtcttagactcaaataggatatagttctaagtttaaaatataaggctttttctgccttctcagtcctttggggctatggccttcatcatgtgctgtctttactctcctagctgcacagactttggcctttgtcacaaactcctcagtctattcctgcctttgcttactgcagggagctgcccacaagagatcagctgcaaaatgcatgtctatatggagggctgccttgcagttggactggccatttctcatcctttgctccttcttctttgtttattagtcttgctccttttgtagaaacacctcagccccagtgctggtaacttcatgttttgcttgtattataaggaatggccctttttagagttctcatcccagttccccatgagtgtaagccagagacagacaggtggcgacacctgagcacagacgagggaggggcgcagcttggcattaggtgagtttgggaggaagttatccagaggataccttgagtcaggactggaaataagtgaggaagttctcagcctgctcttgtggtctagcaagcagggaagacacatagcagttcctggggtgcgaggcaagtgccaaaatggagggcctgccgaggtcaaggaaggattcctggaggaggggaccttgagctgagttagacctgagttacagttcatcactccctaactgtaacatgttatcagcttctctggccttttgtcctcactggcaaacttgggctgttgtgaaacaaaatatgccccatctatggcacacagagttgccgtataaatcacagtaggtagtgctattatattgttattattgtacctcctagtaataagaatggttgcttaataataacataccctcctctttcagagagtaaattcatttccaataacaaacctcagcctacgtgcaaatacagctcttcaaaaatatgattatatatatatttatatatatatatatatgaacaagatttttgaaaggtatcacaagtggatttcattccaggccgctccatgcagctcctgcacctgcagtttcccactcctgaagagtctgctacaaaaaagtgaacaactggggatcttcagaactggaatcagtcttcccatccccaggactgacttccttcttgagggatatcaacaatgatattttctccacatttgatgcattacgagggatgtgtaattacgatgatgatggaagagtctcggctccctgcgaaggcatcttagtgatgattattttataatattgtcattatgtctccacagagtacaactgagtgaagccaagttgctgagacagatggtatgagcatgtcattgcattaaatggacattttccccttgtagcctttagtaatttatatctttaaaaaggagacaaggatctgtctgcctagttaattaaaaataccgaatctcacagatgagaagtatggttcttattaaagtgtccatttactaccttgacagtttgtaagaagcaaatatttctcctgctccatgcataaaggaactaagttactcagccaagggaaatccactttggaaaacaaacgaatccatgagattcccgatgatgccatagcgtcagtgtggggtcagatgataaagtgaaatgcctgcggaaaaatacagttctcattaaataagggaattggaactttcttcatcccaatattggcctatagtccacacagattctccctgttttatcaaggaggagatttattgagcagaagtattagacatttccccacaaaggacagaaagacctcactgaggagtagttttctgagaagttgggctgagctgaaagcgtgatagaattccagtaaaatatgcggtggggatgctgtcacctaccactgcctctccccaacgtcctctaaaatgacagtgaagaaacgaacagacaaacaaaaagacacaagcccaataagataaagagacaggcaaagagaccatagaagaggggaaggcaacaaaaatgtggaaaccagatgtctgagtggccactgacctcacaaaccagaggaagctccgggctgagaactgagagttggcagggaagagagctggtcagccagccatgtgagctatgagcagggaggactcagcaccagaggtgtcaggggactgagcacacagatgcagttcagaccagagagaggaaagagcagcccctggaagctagctggcacagatagctagctagcccttgacagtctcctgccaaacaaaaacagtttcacagaacatacatcagacaaggccactctgtgactgtgatggataaagataaaaacaaaaccactccataaccatgcctgggcatccataaaaacagcaaccctgtccaaacctgaaaaatgaccaaggcacctctctttctggcaaatacgagtggctgtggcttcttcattgattacagcttttgccctgcttcactcctcccaactcccagacaagattcatgatgtcatcacaagattactccgcatttgccagcacccaatccagagaactcaaatccaatttcaagtctttcctaattctctcttccagagacacccatagttctccatgatggcagtttccctcattaataagtcaataaaccccaaatgtgtctgactataggtgtgctcttgatgatctttgactgaggaacatcaacaggccccagactcccattccccgtgtgccattcttcaggaggtaactctggagagactgagcctgggaaacggagacccagggagcagctgagactgctgaagaaggggtgtatctccagaacaggggattaaattaatgatgacataatagccagaccccaaatcccttcccccaccttgcccaaaaaaatctggtaggcagacgtacatcccctttggcagagactaaacagtccccagctgtggaaacgaacagcccaagagaaagacttcccatcctccctctaaatgaaataagtgggcagccaagccccaccagatatttgaagaaagacagagtcagagcaagaaaaaaacaagaatgtcagaggaggcagaagcaatgacaaaaaaatgaagagaatgtctaaaggtgaagcatattctccaacaaatacattataagggggaaaaaagagttggaagggtaactccaactgaaagagacttgtgaactataacaacccattgcaaagtgtagaccttacttggatcctgattttaaaaaagcataaaaataaaaccatttatgaaacagtgagggaaaggtaaatattgactgcatatttggtgatatgagagaattatcatcaaagtttttagatgtgataattgtactatggttatgtttacataaaagattccttatcttttggagattcatatgggaatatttatatgctatgaattctggaattttcttcaaaataattaactgggcaggtggggtggcaggaaaagatgaaccaagattggcacaaattgaactgtcaaagctgtctgggggatacatagaggtttatcattctattagctttactgttgcacatgtttgcaattttccataatagaaaatgaaccaaacaaaagcaaagcaaaccaaaaactctggaagtataactttctttaaccttgaggactatgcaaaaatgcatcagcttatccagaccagtcccagacctggaagccactatgtcaaggcagtacatgctcaaagcctgcagacatggaggaaagctttagaaactctttgaaaatgttataaaccttgtcaaggatcataaagggaggtaacaggacagcctcaagcactattgtaaattgctctcccctccttcctgcttctttttcctgaccctttggtaactctgtggtatctgtgggtgactttccctctataccccaggaattctctcacagggcaacttggttggggtattctggggggcaaaacacaggtgggggttgtggggtcagatttggctctcagagggggaaaagaggtgacttgacctgactcagcatagggttccaagctgctcccacccaccgtgctccctgcccctaccttggaagctgggatgtggaatgaggtggccagaagggcggtgggtgggcagatgagtccacaaaagaaagagcaccatgaggaaagtcccaggagggccacacagggcagtggacaatgaggagaggaagtgacagccacttgccctcctggaagactccctggggcacagtctggagcagattcctgggcagagtgccggctaggtaagggactaggtgaggtggcaccactggccgcaagggggtgcagggtatggccagaactggccttggatttgacagaggggacataaatggaggctggctccataagggacatgggaattggcagaatggggaatggggagtggagaagatttcactctttgattcaaggagatggagctcaggttttttcctaagggatgcggctcaagggactgtgacttctaaaaattcctcttcagtgttaatcttgggagaagaaatccttcatctcagactgagtaaagttcactgtgagactcagcagcagcttgaaactgagaatgccctttttttatttttttgccttaacaagaaatttccaagggctcttctgcttttgagcaacatatcttgcttttcatatttttaaaagacttgttgctttcagcctctttgaaatacagtgaaaagatatttttccatctcagtattagaaagcactgttatgctttatatataagagttttcactgagtgcatggacctgatgattcatttactgatggctagatggaagtttgtagctaataaagagctgttttctaaaaatagacaattaccagtgtacttgactcaccaggaaagggcaccatcaaaacagtattgaaaaaatgcacaagccagagccatgtctcctgaccttttcagagtaatgggaatctgagagtctaatggaagacatgaacacctcaaagaagtgtcgaaaatgtgtgcgtgtgcatattttgcatatcatttcagaaggttcatgaacccaggaaaaagctccagagcaagaacaacaaagagttgagaggaagcaacagatcaattccattacaaaaggattctttgctctaaaaaatgatttgctatgggctccaaaatgccttctggtatattccagttggtttattggatttgcaactatcccatgtctatgagactttacagctaagacactgttttcatcagttcaagcctattccctacacaaacccattaatgaaacaacaaattcttttaacaaatatttgttgcaccccctttctgtgctaggcctgtaggccacagaacaggcacaggggagctgacagtcagctgggtaagagatgaggtctgtgtggttcttgctgtgtctccagaaccttggacagctctccattctatctatgggatcaatgcatgaattaacaataaggaagcaaaatacgaagtgctataaagaaaatcaagtgctataattgtaactgcccgttggggttcttcttgcctccttcccagatgtcaagacaggcaaattgcaatagagaaagagtttaatgcactacagcaagccaaacaggagaccagagttttattattacttaaagcagcctcccccaaaattgggaggctagggtttttttgttttttgttttgttttgtttttgttttttgagacagagtattgctccgtcacccaggctggagtgcaatggcatgatcttgtttcactgcaacccccacctcctgggttcaagtgattctcctgcctcaacctcccgagtagctgggattacaggtgcctgccaccatgcccagcaaatttttgtatttttagtagagacagggtttcaccatgttgttcaggttggtctcaaactcctgacctgaggtgatccgcctgccttggcctgtaaagtgctgggattacaggcatgatcgtgcctggtcaaggctagggtctttcaaagatagcgtggccgccagggagctagggaatggatgctgctgattggttggtgatggaatcataagagttgggaaaatggaaaatgatccttgtgcactgagtcttgatggagggaagccacagggatgttgagtcatgaatcttgggtccaggtggggccacctggttgttagaaatgcaaaagtctgaaaggacatctcaaaaggctaatcttaggttccacaatagtgatgttatttataggagtaattgggaagtgacaaatcttgtgacctccagaataatggatggtaaaagtttatgcctacatcttagcagattcaggcccctctcatcttcctaaccttatggtttttcatgagttttacaaaggcggtttagttttaggaagggctattacatcatttaaactatacaggaaatgtctcccaaatttagcttggcccatgtccggtaatgaccaagaacagtttggagattaaagacaagatggaattggttagatcggatctccttcactgttataattttctcactgttataatttttgcaaaggtggtttcatgatggtgactaagggatgggaaggagggaaaaatctctgtggaagcagagagttggggagaggtgttcgggaaggtgtccgcagggagcagaaatttaggctgagctctgaaagaggagtcccgggggaagagcatttcagatggaaagaccagcgtgagtagaaaccccttggtcaggagaggtatgccctggcggggacaggggaggtcagagtcactggggctcctggggagtgtaggaagtgcggaggacacaatgacctgtggtgtgggaaggaagcagatgatacagggccttctaggccatggtgaagggccactgctttaaatctggatgctgtgggaagcaactggaggggcttaagccatggagtgatatgatttgatatgtgttttcaggaaaaccactttggctgctgtgtaaagaataaatcactgggagtagaggacacaggggacagctggaggccaggcagctggacaagaagtgatgctggctgtttgcatgtgggcgtgggttgggagtggcaagaaatgcctggatttaagtgaccatcagagagagagttgaccaggtgtagtgatagattggatgtggacagatgaggcccaagtcagctctctgacttctggctgggaggatggtgatgttactcacagagctgaggaaaatggagaaacaggttttgagggagcaatgacaagttcagagtgggatatgttgggactgagaagttgattgggcatccaaggggagatgtaaaggagaagtgctgtaggaggaggagtacaggtgttggagtgtgaatcagaagctgcagcagcagagggggcatgaaaacctggaaaggtaaggcgacacagagacatggaagaggacttggagatctcatgccaggcaccagaatcgagaggaagctggtacaggagatggagagggagggagagtggttagggaagctaggctctcacctgaccccaactgccttctccaaggccctcacaatttctcacaagacctctctgcacttcagccaggctgctggggcccctgaggctggaaggcgccatctcaacagcagcctttgtgctgttcttgcctagaatgccctccttgatcttctagactcttcttaattcccctgccctgcctgtatgagaagccatgggccaggcagccccttgccctgcatgttttccagacagacatcacacgccgtccatgccaccaccaaaccacagagaacatgaatccagctcttcacgtgtcctgctgaagcccctctctgtaccaaaggtgaaggggaaacccccacatcccaactcagcccattatgccctggatgagggttacaggtggaaaagtcacagaatttccaacaagtcctcctttgtaggctcacacttccctggaacatggcagcttgtgcaatttgctgtctgcccaaactgcctttcatatgtcccattacatgtgtaggtctggccctttgttcctaaaaggacaaaggattagaggcagtgatggccttcatgtggacaccaaagcagggacaggctttagaaaggaagcaaggaggccagagagcaagcacaggagcagagaccctgcagggcaaaaggggctggggacacctggaggatggaggccaagggcagaaaactcaggtacttggcacctgggccatttcaatgattctctttggccaaaaggatgctggacctaggccatgatagaatgaggctggctcaccaacataaactaactccctcccaaagcctcattctaaagagtaactggactgcagggctgggggtcactgagacccagagtggggagttagtgctggatgtggcagccgtagggaggcagtgtagatcctagaggagggaagagacatcaagagccttgtgaggtgaagccagatgcagcctgggggtgctgagaaatcagtgggaggctgctcccatcatccaggcacaaggcaggaaccttggacgtcctgaggatgagaaaacctgtgaggcctcaggcattggatgtcttccaggagaggtgggtccagggctgaaggagaggatgggggacaggtccctctggggattacctaagagccaagagggaggggtgcgcagtccagcagaccctctagtggtgcttttcatgcagctgctttcacttgctactttgtgctgcacccacagaggaactctgcaggcctttggccctggccaaacatctgcaatgcccaaagctgcccttctaggcatccgctagatgctgttgaagttcagaacatgtcaccccaaaatgtatcactttgttgtcttcattattttgagctaaaagaaatggacaaccagccagtgtaggaaaagctctttaccttcccctcaacagcctaaaataaggtataaattttacattttgtaaagaaaatttacatttataaaagaaattgttattagtaaaagtgtctgtaccaggaagggcactactctgagacaacttttatcacctgagagacttttaactgcataacaagctgacctttattcacaagacatttcctccacttcctgtcccgtaacttgccttcaccacctccagaagccccaaacccctattcctttctgtacctcagaatgcttaaaagcctcagccaggcgcggtggctcacacctgtattcccagcactttgggaggccaaggcgggtgaatcacatgaggccaggagttcaagaccagcctggccaacttggtgaaactccacctctactaaaaatacaaaaattagccaggtgtggtggtgtgtgcctgtagtcccagctacttgggaagctgaggcctgggaggtggaggttacagtgagccaagatcgcaccactgccctccagcttgggcgatagagtgagactttgtctcaaaaaaaaacaaaaacaaaaacaaaagaatgcttaaaagcctccatcatctggcctttctttgagtctcatgtttttgtgggactcccgtgcctatgtacatagttaaaatgttttttctcctattaatttttcttacatcaacttaattcatagaccagccaaagaactgaaaggatagagggaagcaactttccttccctacactgtcctgcccagggctgacagataaccccccaagaggttggtgggcacctggtgagggcacccccagaggggcgtagggtgaatggaggcccatagcacctctgggtcatgccagttgttaccagtggttacgtgctggttaacaatcagtttattgaaataaaatgtggggtgctgatttgacctcaatggcatacattgcaggcacgtaatgaaacaatgagtttcaagtatctattacctggattttaaatgtaatttactcgtaggtttacatcatttaatttttaataatgactgttgaaggagcagcatgtaaaattcctgaaaatttaataatcaacccttgagaggtggcacaagccagccccagcacagcacttgctgagcccaggacaggacctgacagggttccgggagcccctacccacagagctctcccacgaggcactgggctcccctgctgttgggaagccttgttcccactgagagaaatgacttccaagaagagcttggaacccgggccagctgggccagctgtgagaggagcaccttccatgtctgcaggcctaagggctgtctgttttaaccaaaaagaacaaaaaactaatttaaaccttgtctttccaagtgtcatttggactggaatggctacgataagacaatgtatcagtgttaagatcaaagtgaaaattaagcacatgctgccctattagtcagcacttctaaggctatattactgtgaagttcagcaaaagagttaacgaatctatttaaatgcaaatatgccataaaaccaactaagagcaatgcatctccaaaatgctgccagcccttctttcagcaggctctactcacaatggtgttgctattttttcaatgcggagaataatatatctgagtaatcctgtgttattatctgggatgggagtctgaggctccttctggggctcagttggcatatgtgtcccagtgtcctctgggactggccagggcttagcatcaccaagcagccttcgggttggagggctctgcctggaggcttcctaactccccatattacctctctggttacaatgctccagaggagcccaatcatttccataagctccagtgagcaggagggtatggctccctgactcaagggctgaatgagacactccttaaaaggagccacgcacagcacttgactcagaggaagtgacctgctagcactaaccactgaacctcccatctctgtaggaaggaggaaacagatgctctcagagcctgtgctatgtgtcaggtgacaaccttaccctcacaatgatcacacagaggaggcattattgctctgtcttgacagaggggctgggaggatgcagcatggggcagtgagagatcgcggacattagggctctgtcagaagtggactggcccatcccctggcctacctgtggaggaagtgggacaccaggaatctggggcagagcttggtggtgagcctggcctgaggctgggtgaaaccatctgttttcagaggcagcaggatttctgttcccaccaaggcctgtgcccatgctgggagcagtcagaggatacccttgggcttgtgccctggactaagaggagactgtgtacttcaaagcccccagaatccacagaacaatctaagaaccacctgattcaaggtggactctgtcaaggagtgagtaaggcctgcccagcacagctcagccccatctcagtcactgaactgggggcaggatctggcccatgagggcgaaaaataaaaatgtgttgagcttttagaaactgtgatacaggtatgtaataactgtaggagcagaatttccagatattaaatttttagtgtacaattagcatgtatgcagctcgttttactcctgtttatttggagtcattcagaatgtggctcgaatggtgctgtgctagtgctggctgttctcccctgtctcctcttcaaagagcctcctgcccccaggatgcacagtggtggcctcaccttgggaaaaagaaatgctggattgtgaaaacctccacttccctctttctttctctgtactagggcactccatgtagaaggggtgcatttcaggcctgggattcctttctgcctgggagaaggggctgaagccatgggcaatgatagggctgagggacgtgttcagagtaaacctgtttaggcagaggcagcatccaggcagctcatctcttaggatcccactcaatatggaaggcagatagaggattgactctgcagagaaggggagcccccactccaggggcatgaaaggaggtagcaaccaatgagggtgtcatctagtcatctagtgaaagctcccatgtgctagacacatgcactatctcatgtgatcttcccttaaactatctgtttgcagataacctgatcttgaatatagaaaatcctcaaaaatacactaacaattgataaaacttcaagttcagcaagcctgcagaatacaagatcaatatacaaaaatcgattgtttccatatacttgcaatggacattcaaaaatgtaattaaaacaattccatttatgatagcatcaaaaaataaaatagtgggttgagcgcagtggctcatgcctataatcccagcactttgggaagccgaggcgggtggatctctagaggtcaggagttcaagaccagcctggccaacatggtgaaaccccatctctactaaaaatacaaaaattggctgggtgtggtggtgcgtgcctgtaatcccagctactggggaggctgaagcaggagaatctcttgaactcaggaggcagaagttgcaatgagccgagatcatgccactgcactccagcttgggcaaaacagcaagacttcatctctaaaataaaataaaaaaggaataaatttaactaaagaagtaaaattaaacttctttaaataataaagacttgaacactgaaaactacaaaacatttattaaaaaaattaaagaccaaaataaatgaacacagcccatgttcctggattggaggtcttgatattaagatggcaacacttcctaaccaagcttcagatccaattcaatccctacaaaattccaggtgccttttttgctgaaattgacaagctaattttacaattcatatggaaatgcaagggacctagaatagccaaaatgatcttgaaaaagaagagtcaagttggaggactcacacttgcccatttcaaagttaaagctacagtatcaagaaagtgtggtactagcataaagatagacatatagactaatgaaatagaactaagagtccagaaataaatcctcatatttatggtcaattgagtttttgacaatggtgccaagaaaattcaatgggggaaagaataatattttcaacaaatggtacttgggacaactagatactcacatgtgaaaaactcctttcccacaccatacataaaaatgaactcaaatggattctagacctaaatgttaaaaataaaactgcaatactcttaggaaaaaaatatagaagtaaagtttcatgaccttagattagaataaacataaatagatatgacagcaaaagcacaagcaacaaaagaaagataaaatggacttcatcaaaatttaaaaaacttttgttctaagaatatgaccaagaaagtgaaaagacaatttagagaataggagaagatattagcaaattatgtatctgataattgtatctaaatatataaatatatatatctgaattgtatctaatatatctgataacttgtatttaaaatatataaagaacacaattcaataataaaaaggcaaagaatcagaatagacatttctccaaagaagacatacaaatggccaataagcaaatgaagagacactcaacattgttagtcctcaaggaaatgcaaatcaaagccatattgcgacgctactgcacagtcactaggatggctagaattaaaaaaaaaaaagagattataataagtgctatacggatgtggaggaattagagacttcatacactgttggtgagaatgtaagcagtacagctactctggaaaagtctggcagtttctcagaaagataaatatatagttacaatatgacccagcaattctacttcaagctatatacccaagagaaatgaaaaaacaactccacataaaaacttgcaaacaaatgtttatagctatgttattaataatagccaaaaagtagaaaccaccctgacatccatcaacttttgaatggatcaatcaaatgtagtatacccatacaatagactattatttgaccatagaaatgaagtacagatacatgctatataacacagatttaccttgaaaatattacggtaagtgaaaggaaactagtcacaaagactacatatggtattattccatttatatgaaatgtctggaataagtaaatccatacagaaagaaagattagtggtcctttagggctggagggttgggggaaaatagggagtgattgctagaggatacaggatttccctttgctgagataaaatgttctaaaacaaattgtgatgatggtttcacaactctgtgaatataccaaaaactattaaattgcccactttaagtgggtgaattgtgtggtatgtgagcaatcctccagtagagctgttgtattaagaaaagaagtatgttggtggaaacattaggagttggagattttttttaatgccgttttaaaccacaaattcaatttttagaattgttaaaggactgtttgagttgtctacttcattttgagtgagactgattgcttgtgatttctgaggatttagtccctttcatgtaatttgtcaattttacttgcatagagatgctattatatttttaatatctgtgaagtctgtagttatattccctttttcattcttgatgtggtcatttccttctttttcttcttttttctttttctttatttttgaaatgaggtctcgctctgtcacccaggctggagtgcagtggtgagatctcagctcactgcaacctctgcctcccaggttcaagtgattctcctacctcagcctcccaagtagctgagattacaggcatgaaccatcacacctggctaagttttgtatttttagtagagatgggcttttgccatgttggctaggctggtctcaaactcctgacttcaggtgatctgcctgccttggcctcccaaaatgctgggattacaggcgtgagccaccatgcccagccctgatttggtgatttctgtcttctctctttttaagtttgtcagtctgagtagtgatatatcaattttattgatcctcaaaagaaccatctcttggtttcattgattctattgtttttctattttcaatttccttttttctttctcttttttttaattattattatactttaagttttaggctacatatgcacaatgtgcaggttagttacatatgtatacatgtgccatgctggtgcgctgcacccactaacttgtcatctagcattaggtatatctcccaatgctatccctcccccctccccccaccccacaaccgtccccagagtgtgatgttccccttcctgtgtccatgtgttctcattgttcaattcccacctataagtgagaatatacggtgtttggttttttgttcttgagatagtttactgagaatgatgatttccaatttcatccatgtccctacaaaggacatgaactcatcattttttatggctgcatagtattccatggtgtatatgtgccacattttcttaatccagtctatcattgttggacatttgagttggttccaagtctttgctattgtgaatagtgccgcaatgaacacacatgtgcatgtgtctttatagcagcatgatttatagtcctttgggtatatacccagtaatgggatggctgggtcatatagtatttctagttctagatccctgaggaatcgccacactgacttccacaatggttaaactagtttacagtcccaccaacagtataaaagtgttcctttttctccacatcctctccagcacctgttgtttcctgactttttaatgattgccattctaactggtgtgagatgataccttattgtcgttttgatttgcatttctctgatggccagtgatggtgagcattttttcatgtgttttttgcctgcataaatgtcttcttttgagaagtgtctgttcatgtccttcgcccactttttgatggggttgtttatttttttcttgtaaatttgtttgtgttcattgtagattctggatattagccctttgtcagatgagtaggttgcgaaaattttctcccattttgtgggttgcctgttcactctgatggtagtttcttttgctgtgcagaagctctttagtttaattagatcccatttgtcaattttggcttttgttgccattgcttttggtggtttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatgtggctagccagttttcccagcaccatttattaaatagggaatcctttccccattgcttgtttttctcaggtttgtcaaagaccagatagttgtagacatgcggcattatttctgagggctctgttctgttccattgatctgtatctctgttttggtaccagtaccagctgttttggttactgtagccttgtagtatagtttgaagtcaggtagtgtgatgcctccagctttgttcttttggcttaggattgacttggcaatgtaggctcttttttggttccatatgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattgagcagtggtttgtagttctcctggaagaggtccttcacgtcccttgtaaggtggattcctaggtattttattctctttgaagcaattgtgaatgggagttcactcatgatttggctctctgtttgtctgttattggtgtataagaatgcttgtgatttttgtacattgattttgtatcctgagactttgctgaagatgcttatcagcttaaggagattttgggctgagatgatgggggtttctagatatacaatcatgtcatctgcaaacagggacaatttgacttcctcttttcctaattgaataccctttatttccttctcctgcctaattaccctggccagaacttccaacactattttgaataggagtggtgagagagggcatccctgtcttgtgccagttttcagagggaatgcttccagtttttgcccattcagtatgatattggctgtgggtttgtcatagatagctcttattattttgagatacatcccatcaatacctagtttattgagagtttttagcatgaaggttgttgaattttgtcaaaggccttttctgcatctattgagataatcatgtggtttttgtctttggttctgtttatatgctggattacatttattgatttgtgtatattgaaccagccttgcatcccagggatgaagcccgcttgatcatggtggataagctttttaatgtgctgctggattcgttttgccagtattttattgaggatttttgcatcaatgttcatcaaggttattggtctaaaattctcttctttggttgtgtctctgccaggctttggtgtcaggatgatgctggcctcataaaatgagttagggaggattccctctttttctattgattggaatagtttcagaaggaatggtaccagtccctccttgtacctctggtagaatacggctgtgaatccatctggtcctggactctttttggttggtaagctattgattattgccacaatttcagagcctgttattggtctattcagagatttcaacttcttcctggtttagtcttgggagagtgtatgtgttgaggaatttatccatttcttctagattttctagtttatttgcatagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattaattttttgaaggggttttttggtctctatttccttcagttctgctctgattttagttatttcttgccttctgctagcttttgaatgtgtttgctcttgcttttctagttcttttaattgtgatgttagggtgtcaattttggatctttcccgctttctcttgtgggcatttagtgctataaatttccctctacacactgctttgaatgtgtcccagagattctggtatgttgtgtctttgttctcattggtttcaaagaacatctttatttctgccttcattttgttatgtacccagtagtcattcaggagcaggttgttcagtttccatgtagttgagcagttttgagtaagtttcttaatcctgagttctagttttattgcactgtggtctgagagatagtttgttataatttctgttcttttacatttgctgaggagagctttacttccaactatgtggtcaattttggaataggtgtggtgtggtgctgaaaaaaatgtatattctgttgttatggggtggagagttctgtagatgtctattaggtccacttggtgcagagctgagttcaattcctgtgtatccttgttaactttctgtctctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttctttttgaattgatccctttaccattatgtaatggcctcctttgtctcttttgatctctgttggtttaaagtctgttttatcagagactaggattgcaacccctgcctttttttgttttccatttgcttggtagatcttcctccatccttttattttgagcctatgtgtgtctctgcatgtgagatgggtttcctgaatacagcacactgatgggtcttgactctttatccaatttgccagtctgtgtcttttaattggagcatttagtccatttacatttaaggttaatattgttatgtgtgaatttgatcctgtcattatgatgttagctggttattttgctcattagttgatgcagtttcttcctagtctcgatggtctttacattttggcatgattttgcagcggccggtacttgttgttcctttccatgtttagtgcttccttcaggagctcttttagggcaggcctggtggtgacaaaatctcttagcatttgcttgtctgtgaaggattttatttctccttcacttatgaagcttagtttggctggatatgaaattctggcttgaaaattctttaagcacgttgaatattggcccccactctcttctgggttgtagagtttctgctgagagatccgctgttagtctgatgggcttccctttgtgggtaacctgacctttctctctggctgcccttaaaattttttccttcatttcaactttggtgaatctgacaattatgtgtcttggagttgttcttctc

SEQ ID NO: 12137 - DNA, 3362 bp, Homo sapiens
gtctaacgtttaagtcttcaatccatcttgaattgatttttgtataaggtgtaaggaagggatccagtttcagctttctacatatgggctagccagttttcccagcaccatttattaaatagggaatcctttccccattgcttgtttttctcaggtttgtcaaagatgagatagttgtagatatgtggcgttatttctgaggactctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttaatggggatggcaatgaatctgtaaattacctttggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctttgtttgtctgttgttggtgtataagaatgcttgtgatttttgtacattgattttgtatcctgagactgctgaagttgcttatcagcttaaggagattttgggctgagacagtggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagtttttagcatgaagggttgttgaattttgtcaaaggccttttctgcatctattgagataatcgtgtgggttttgtctttggttctgtttatatgctggattacatttattgatttgcgtatattgaaccagccttgcatcccagggatgaagcccacttgatcatggtggataagctttttgatgtgctgctggatttggtttgccagtattttattgaggatttttgcatcaatgttcatcaaggatattggtctaaaattctcttttttggctgtgtctctgcctggctttggtatcaggatgatgctggcctcataaaatgagttagggaggattccctctttttctattgatgggaacagtttcagaaggaatggtaccagtttctccttgtacctctggtagaattcggctgtgaatccatctggtcctggactctttttggttggtaagctattgattattgcccaatttcagatcctgttattggtctattcagagattcaacttcttcctggtttagtcttgggagagtgtatgtgtcgaggaatttatccatttcttctagattttctagtttatttgtgtagaggtgtttgtagtattctctgatggtagtttgtatttctgtgggatcagtggtgatatcccctttatcattttttattgcatctatttgattcttctctctttttttctttattagtcttgctagcggtttatcaattttgttgatcctttcaaaacaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcatcccagagattctggtatgttgtgtctttgttctcgttggtttcaaagaacatctttatttgtgccttcatttcgttatgtacccagtagtcattcaggagcaggttgttcagtttccatgtagttgaggggctttgagtgagattcttaatcctgagttctagtttgattgcactgtggtctgagagatagtttgttataatttctgttcttttacatttgctgaggagagctttacttccaagtatgtggtcaattttggaataggtgtggtgtggtgctgaaaaaaatgtatattctgttgattttgggtggatagttctgtagatgcctattaggtccgcttggtgcagagctgagttcaattcctgggtatccttgttaactttctgtctcgttgatctgtctaatgttgacagtggggcattaaagtctcccattattaatgtgtgggggtctaagtctctttgtaggtcactcaggacttgctttatgaatctgggtgctcctgtactgggtgcttatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaatttgccagtctgtgtcttttaattggagcatttagtccatttccatttaaagttaatattgttatgtgtgaatttgatcctgtcatgatgatgttagctggttattttgctcgttagttgatgcagtttcttcctagtctcaatggtctttacattttggcatggttttgcagtggctggtactagttgttcctttccatgtttagcgcttccttcaggagctcttgtagtgcaggcctggtggtgacaaaatctctcaacagttgcttgtctgtaaagtgttttatttctccttcacttgtgaagcttagtttggctggacatgaaattctgggttgaaaattcttttctttaagaatgttgaatattggcccccactctcttctggcttgtagagtttctgccaagaaatccgctgttagtctgatgggcttccctttgagggtaacctgacctttctctctggctgcccttaacattttttccttcatttcaactttggtgaatctgacaattatgtgtcttggagttgctcttctcg

SEQ ID NO: 12138 - DNA, 5642 bp, Homo sapiens
ctttttttaatactttaagtgttagggtacatgtgcacaacgtgcaggttagttacatatgtatacatgtgccatgttggtgtgctgcacccattaactcgtcatttaacattaggtatatcgtctcatgctatccctccccccctccccccactccacaacaggccctggtgtgtgatgttccccttcctgtgtccatgtgttctcattgttcaattcccacctatgagtgagaacatgtggtgtttggttttttgtccttgccatagtttgctgagaatgatggtttccagcttcatccatgtccctacacaggacatgaactcatcattttttatggctgcatagtattccatggtgtatatatgccacattttcttaatccagtctatcattgttggacatttggcttggttccaagtctttgctattgtgaatagcaccacaataaacatacatgtgcatgtgtctttatagcagcatgatttataatcctttgggtatatacccagtaatgggattgctgggtcaaatggtatttctagtcctagatccctgaggaatcgccacactgacttccacaatggttgaactagtttacagtcccaccaacagtgtaaaagtgttcctattttccacatcctctccagcacctgttgtttcctgactttttaatgatcgccattctaactggtgtgagatggtatctcactgtggttttgatttgcatttctctgatggccagtgatgatgaacattttttcatgtgtctttgggctgcgtaaaagtcttcttttgagaagtgtctgttcatatccttcgtccactttttgatggggttgtttgtttttttcttgtaaatttgtttgagttcattgtagattctggatattagccctttgtcagatgagtagattgcaaaaattttctcccattctgtaggttgcctattcactctgatggtagtttcttttgctgtgcagaagctctttagtttaattagatcccatttgtcaattttggcttttgctgccattgcttttggtgttttagacatgaagtccttgcccatgtctatgtcctgaatggtattgcctaggttttcttctagggcttttatggttttatgtctaacatttaagtctttaatccatcttgaattaatttttgtataaagtgtaaggaagggatccagtttcagctttctacatatggctggccagttttcccagcaccatttattaaatagggaatcatatccccatttcttgcttttgtcaggtttgtcaaagatcagatggttgtagatatgtggcattatttccgagggctctgttctgttccattggtctagatctctgttttggtaccagtaccatgctgttttggttactgtatccttgtagtatagtttgaagtcaggtatcgtgatgcctccagctttgttcttttggcttaggattgacttggcaatgcgggctcttttttggttccatatgaactttaaagtagctttttccaattctgtgaagaaagtcattggtagcttgatggggatggcattgaatctataaattaccttgggcagtatggccattttcacgatattgattcttcctacccatgagcatggaaggttcttccatttgtttgtatcctgttttatttcattgagcagtgatttgttgttctccttgaagaggtccttcacatcccttgtaagttggattcctaggtattttattctctttgaagcaattgtgaatgggagttcactcatgatttggctctctgtttgtctgttattggtgtataagaatgcttgtgatttttgcacattgattttgtatcctgagactttgctgaagttgcttatcagcttaaggagattttgggctgagatgatggggttttctagatatacaatcacgtcatctgcaaacaaggacaatttgacttcctcttttcctaattgaataccctttatttccttctcctgcctgattgccctggccagaacttccaacactatgttgaataggagtggtgagagagggcatccctgtcttgtgccagttttcaaagggtatgcttccagtttttgcccattcagtatgatattggctgtgggtttgtcatagatagctctttttattttgagatatgtcccatcaatacctaatttattgagagtttttagcatgaagagttgttgaattttgtcaaaggccttttctgcatctgttgagataatcatatggtttttgtctttggttctgtttatatgctggattacgtttattgatttgcatatattgaaccagccttgcatcccagtgatgaagcccacttgatcatggtggataagctttttgatgtgctgctggattcgttttgccagtattttattgaggatttttgcattgatgttcatcaggtatattggtctaaaattctctttttttttgttgtgtctctaccaggctttggtatcaggatgatgctggcctcatgaaattagggaggattccctctttttctattgattggcatagtttcagaaggaatggtaccagctcctccttgtacctctggtagaattcggctgcgaatccatctggtcctgcactttttttggttggtaagctattaattattgcctcaatttcagatcctgttattggtctattcagagattcaacttcttcctggtttagtcttgggagggtgtatgtgtcgaggaatttatccatttcttctagattttctagtttattttcatagaggtgtttatagtattctctgatggtagtttgtatttctgtgggatcagtggtgatatctttatcattttttattgtgtctatttgattcttctctcttttcttctttattagtcttgctagcggtctatcaattttgttgatcttttcaaaaaaccagctcctggattcattgattttttgaagggttgtttgtgtctctatttccttcagttctgctctgatcttagttatttcttgccttctgctagcttttgaatgcgtttgctcttgcttctctagttcttttaattgtgatgttagggtgtcaattttagatctttcctgctttctcttgtgggcatttagtgctataaatttccctctacacactgctttgaatgtgtcccagagattctggtatgttgtgtctttgttctcgttggtttcaaagaacatctttatttctgccttcatttcattatgtacctagtagtcattcaggagcaggttgttcagtttccatgtagttgagcggttttgagtgagtttgttaatcctgagttctagtttgattgcactgtggtctgagagatagtttgttataatttctgttcttttacatttgctgaggagtgctttacttccaactatgtggtcaattttggaataagtgcgatgtggtgctgagaaggatgtacattctggtgatttggggtggagagttctgtagatgtctattaggtctgcttggtgcagagctgagttcaactcctggatatccttgttaactttctgtcttgttgatccttctaatgttgacagtggggtgttaaagtctcccattattattgtgtaggagtctaagtctctttctaggtctctaaggacttgctttatgaatccgggtgctcctgtattgggtgcatatatatttaggatagttagctcttcttgttgaattgatccctttaccattatataatggccttctttgtctcttttgatctttgttggtttaaagtctgttttaccagagactaggattgcaacccctgccttgttttgttttccatttgcttggtagctcttcctccatccctttattttgagcctatgtgtgtctctgcacgtgagatgggtttcctgaatacagcacactgatgggtcttgactatccaatttgccagtctgtgtcttttaattggagcattcagcccttttacatttaaggttaatattattatatgtgaatttgatcctgtcattatgatgttagctggttattttgctcgttagttgatgcagtttcttcctagcctcgatggtctttacaatttggcatgtttttgcagtggctcgtaccagctgttcctttccatgtttagtgcttccttcaggagctcttttagggcaggcctggtggtgacaaaatctctcagcatttgcttgtctgtaaaggattttatttctccttcacttatgaagcttagtttggctggatatgaaattctgggttgaaaattcttttctttaagaatgttgaatattggcccccactctcatctggcttatagagtttctgccgagagatcagctgttactctgatgggcttccctttgtgggtaacccaacctttctctctggctgcccttaacattttttccttcatttcaactttggtgaatctgacagttatgtgtcttggagttgctcttctcgaggagtatctttgtggcgttctctgtatttcctgaatttgaatgttggcctgccttgctagattggggaagttctcctggataatatcctgcagagtgttttccaacttggttccattctccccgtcactttcaggtacaccaatcagacgtagatttggtcttttcacatagtcccatatttcttggaggctttgttcttttctttttattcttttttctctaaacttctcttcttgcttcatttcattcatttgatcttccatcactgataccctttcttccagttgatcaaatcggctactgaggcttgtgcattcatcacgcagttctcgtgccttggttttcagctccatcaggtcctttaaggacttctctgcattggttcttctagttagccattcgtctaatttttttttcaaggtttttaacttctttgccgtgggttggaacttcatcctttagcttggagtagtttgatcgtctgaagccttcttctctcaacttgtcaaagtcattctccgtccagctttgttctgttgctggtgaggagctgcgttcctttggaggaggagaggtgctctgatttttagagtttccagtttttctgctctgttttttccccatcttcatggttttatctacctttggtctttgatgatggtgacgtacagatggggttttggtgtggatgtcctttctgtttgttagttttccttctaagagtcaggaccctcagctgaaggtctgttggagtttgctggaggtccacttgagaccctgtttgcctgagtatcagcagcagaggctacagaacagtggatattggtgagcagcaaatgtttctgcctgatcgttcctctggaagttttgtctcaggggagtacccggccatgtgaggtgtcagtctgcccctactggggggtgcctcccagttaggctacttgggggtcagggacccacttgaggaggcagtctgtccgttctcagatctcaagctgcctgctgggagaaccactactctcttcaaagctgtcagacagggacatttaagtctgcagaggtttctgctgccttttgttcagctatgccctgcccccagaggtgaggtctacagaggcaggcaggcctccttgagctgcggtgggctccacctag

SEQ ID NO: 12139 - DNA, 1591 bp, Homo sapiens
agtcttgctagtggtctatcaattttgctgatcttttaaaaaaaccagctcctggattcattgattttttgaagggtttttttgtgtctctatttccttcagttctgctctgatcttagttatttcttgccttctgctagcttttgaatctgtttgctcttgcttctatagttcttttaattgtgatgttagggtgtcaattttagatctttgctgctttctcttgtgggcatttagtgctataaatttccctctacacactgctttgaatgtgtcccagagattctggtatgttgtgtctttgttcttgttggtttcaaagaacgtctttatttctgccttcatttcattatttacccagtagtcattcaggagcaggttgttcagtttccatgtagttgagcggttttgagtgagtttcttaatcttgagttctggtttgattgccctgtggtctgagagacagtttgttataatttctgttcttttacatttgctgaggagtgctttacttccaactatgtggtcaattttggagtaggtgtggtgtggtgctgaaaagaatgtatattctgtttatttggggtggagagttttgtatatgtctattaggtccgcctggtgcagagctgagttcaattcctgggtatccctgttaactttctgtctcgttgatctgtctaatgttgacagtggggtgttaaagtctgccattattattgtgtgggagtctaagtctctttgtaagtctctaaggacttgctttatgaatctgggtgctcctgttttgggtgcatatagatttaggatagttagctcttcttgttgaattgatccctttaccgttatgtaatggccttctttgtctcttttgatctttgttggtttaaagtctgttttatcaaagacaaagattgcaacccctgcctttttttgttttccatttgcttggtagatcttcctccatccctttattttgagcctatgtgtgtctctgcacgtgagatgggtttcctgaatacagcacactgatgggtcttgactctttatccaatttgccagtctgtatcttttaattggagcatttagcccatttacatttaaagttaatattgttatgtgtgaatttgatcctgtcattatgatgttagctggttattttggtcgttagttgatgcagtttcttcctagccttgatggtctttacaatttggcatgtttttgcagtggctggtactggttgttcctttccatgtttagtgcttccttcaggacctcttttagggcagtcctggtggtgacaaaatctctcagcatttgcttgtctgtaaaggattttatttctccttcacttatgaagcttagtttggctgcatatgagattctaggttgaaaattctttcctttaagaatgttgaatattgacccccactgtcttctggctcatagcgtttctgccaagagatcagctgttagtctgatgggcttccctttgtgggtaacccaacctttctctcttgctgcccttaacattttttccttcatttcaactttggtgaatctgacaattatgtgtcttggagttgctctt

SEQ ID NO: 12140 - DNA, 23699 bp, Homo sapiens
ttcaatctttatagtttatttttattttttttattatactttaagttttagggtacatgtgcacaacatgcagattagttacatgtgtatacatgtgccatgttggtgtgctgcacccagtaactcatcatttaacattaggtatatctcctaatgctatccctccccctccccccaccccacagcaggccccggtgtgtgatggtccccttcctgtgtccatgagttcgcattgttcaattcccacctatgagtgagaacatgcggtgtttggttttttgttcttgcaatagtttgctgagaatgatggtttccagcttcatccatgtccctacaaaggacatgaactcatccttttttatggctgcatagtattccatggtgtatatgtgccacattttcttaatccagtctatcgttgttggacatttggattggttccaagtctttgctattgtgaatagtgctgcaataaacatacatgtgcatgtgtctttatagcagcatgttttataatcctttgggtatatacccagtaatgggatggctgggtcaaatagtatttctagttctagatccctgaggaatcaccacactgacttccacagtggttggactagtttacactcccaccaacagtgtaaaagtgttcctatttctccacatcctctccagcacctgttgtttcctgactttttaatgatcaccagtcttactggtgtgagatgatatctcattgtggttttgatttgcatttctccaatggccagtaatgatgagcattttttcatgtgtctgttggctgcataaatgtcttcttttgagaagtgtctgttcatatcttttgcccacttgttaatggggttgtttgttttttctgtaaatttgtttgagttcattgtagattctggatattagccctttgtcagatgagtagattgcaaaaattatctcccattctgtaggttgcctgttcactctgatggtagtttcttttgctgtgcagaagctctttagtttaattagatcccatttgtcaattttggcttttgttgccattgcttttggtgttttagacatgaagtccttgcccatgcctatatcctgaatggtaatgcctaggttttcttctagggtttttatggttttaggtctaacatgtaagtctttaatctatcttgaattaatttttgtataaggtgtaaggaagggatccagtttcagctttctacatatggctatccagttttcccagcaccatttattaaatagggaatcctttccccattgcttgtttttctcaggtttgtcaaagatcagatagttgtagatacgcggcgttatttctgagggttctgttctgttccattggtctatatctctgttttggtaccagtaccatgctgttttggttactgtagccttgtagtatagtttgaagtcaggtagcgtgatgcctccagctttgttcttttggcttaggattgacttggcaatgtgggctcttttttggttccatatgaactttaaagtagttttttccaattctgtgaagaaagtcattggtagcttcatggggatgacattgaatctataaattaccttgggcagtatggccattttcacaatattgattcttcctacgcatgagcatggaatgttcttccatttgtttgtatcctcttttatttcattgagcagtggtttgtagttctccttgaagaggtccttcacatcccttgtaagttggattcctaggtattgtattctctttgaagcaattgtgaatgggagttcactcatgatttggctctctgtttgtctgttattggtgtataagaatgcttgtgatttttgcacattgattttgtatcctgagactttgctgaagttgcctatcagcttaaggagattttgggctgagacgatggggttttctagatatataatcatgtcatctgcaaacagggacaatttgacttcctcttttcctaattaaatgccctttatttacttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattatttcaagatacatcccatcaatacctaatttattgagagtttttagcatgaagggttgttgaattttgtcaaaggccttttctgcatctattgagataatcatgtggtttttgtcgttggttctgtttatatgctggattacgtttattgatgtgcgtatgtggaaccagccttgcatcccagggatgaagcccacttgatcatggtggataagctttttgatgtgctgctggattcggtttgccagtattttattgaggattttggcgtcgatgttcatcagggatattggtctgaaattctctttttttgttgtgtctctgccaggctttggtatcaggatgatgctggcctcataaaatgagttagggaggattccctctttttctgttgattggaatagtttcagaaggaatggtaccagctccttgtacctctggtagaattcagctgtgaatccatctggttctggactttttcagttggtaagctattaattattgcctcaattttagagcttgttattggtctattcagagattcagcttcttcctggtttagtcttgggagggcgtatgtgttgaggaatttatccatttcttctagattttctaatttatttgcgtagaggtgtttatagtattctctgatggtagtttgtatttctgtgggatctgtggtgatatcccctttatcattttttattgcgtctatttgattcttctctcttttcttcattagtcttgctagcagtctatcaattttgttgattttttcaaaaaaccagctcctggattcattgatttttgaagggttttttatgtctgtatttccttcagttctgttctgatcttagttatttcttgccttctgctaacttttgaatgtgtttgctcttgcttctctagttcttttaattgtgatgttagggtgtcaattttggatcttttctgctttctcttgtgggcatttagtgctataaattttcctctacacactgctttgaatgtgtcccagagattctggtatgctgtgtctttgttctcattggtttcaaagaacatctttctttctgctttcatttcgttatgtacccagtagtcattcaggagcaggttgttcagtttccatgtagttgagcggtttttagtgagtttcttaatcttgagttctagtttgattgcactgtggtctcagagacaatttgttataatttctgttcttttacatttgctgaggagtactttacttcccactatgcggtcaattttggaataggtgtgatgtggtgctgaaaagaatgtatattctgttgatttggggtggagagttctgtagatgtctattaggtccgcttggtgcagagctgagttcaattcctgggtatgcttgctaactttctgtctcgttgatctgtctaatgttgacagtggggtgttaaagtctcccattattattgtgtgggagtctaagtctctttgtaggtctctaaggacttgctttgtgaatctgggtgctcctgtattgggtgcacgtatatttaggatagttagctcttattgttgaattgatccctttgccattatgtaatggccttctttgtctcttttgatctttgttggtttaaagtttgtttcatcagagactaggattgcaacccctgcctttttttgttttccatttgcttagtagatcttcctccatccctttattttgagcctatgtgtgtctctgcatgtgagatgggtttcctgaatacagtacactgatgggtcttgactctttatccagtttgccagtctgtgtcttttaattggagcatttagcccatttacatttaagattaatattgttatgtgtgaatttgatcctgtctttatgatgttagctggttattttgctcgttagttgatgcagtttcttcccagcctcaatggtctttacgatttggcatgtttttgcagtggctggtactggtttttcctttccatgtttagtgcttccttcaggagctcttttagggcaggcttgttggtgacaaaatctctcagcatttgtttgtctgtaaagtattttatttctccttcacttatgaagcttagtttggctggatatgaaattctgggttgaaaattcttttctttaagaatgttgagtattggcccccactctcttctggcttgtagagtttctgccaagacatcagccgttagtctgatgggcttccctttgtgggtaacccaacctttctctctggctgcccttaacgttttttccttcatttcaactttggtgaacctgacagttatgtgtcttggagttgctcttctcaaggagtatctttgtggcattctctgtatttcctgaatttgaatgttggcctgccttgctagattggggaagttctcctggataatatcctgcagagtgttttccaacttggttccattctccccgtcactttcaggtacaccagtgagacacagatttggtcttttcacatagtcccatatttcttggaggctttgttggtttctttttattcttttttctctaaacttctcttctcgcttcatttcattcatttgatcttccatcactgataccctttctaccagttgatcaaatcggctactgaggcttgtgcattcgtcacgtagttcacatgccatggttttcagctccatcaggtcctttaaggacctctctgcattggttattctagttagccattcgtctaattttttttcaaggtttttaacttctttgccttgggttcgaacttcttcctttagctcagagtagtttgatcatctgaagccttcttctctcaactcgtcaaagtcattctctgtccagctttgttccgttgctggtaagtagctgcattcctttggaggatgagaggcgctctgatttttaaagtttccagtttttctgctctgttttttccccatctttgtggttttatctacttttggtctttgatgatggtgacgtacagatggggttttggtgtggatgtcctttctgttagttttccttctaacagtcaggaccctcagctgcaggtctgttggagtttcctggaggtccactccagaccctgtttgcctgggtatcagcagcggagcctgcagaacagcatatattggtgaacagcaaatgttgctgcctgatcattcctctggaagttttgtctcagaggagtacccagccgtgtgaggtgtcagtctgcccttactgggggctgtctcccagttaggctactcggggttcagggacccacttgaggcagtctgtctgttctcagatctccagctgcatgctgggagaaccactactctcttcaaagctgtcaaacagggacatataagtctgcagaggtttctgctgcgttttgtttgcttatgccctgccctcagaggtggagcctacagaggcaggcaggcctccttgagctgtggtgggctccacctagttcaagcttcctggccgctttgtttacctactcaagcctcggtaatggcaggtgcccctcccccagcctcactgccaccttgcagtttggtctcagactgctgtgctagcaatcagcgaggctccgtgggcgtaggaccctccgagccaggcatgggatataaaatctcctgttgtgccatttgctaagaccgttggaaaagtgcagtattagggtgggagtgacctgatgttacaggtgccatctgtcacccctttctttgactaggaaagggaattccctgaccccttgcgcttcccaggtgaggcgatgcctcgccctgcttaagctcatgcttggtgcactgaacccagtgtcctgcacccactttctgacactccccagtgagatgaacccggtacctcagttggaaatgcagaaatcactcgtcttctgcgtcactcatgctgggagctgtagactggaactgttcctattcggccatcttggctccacttcctatgttttttaaattaatttattttttagattgacagataaaattgtgtatttatatagtacaacatggtgttttgaagtacatatacattgctgaatggttaaatctggctagttaacatgcattatctcacattatcattttttatagtgagagcacttaatgtcctctcttaacatttttcagaaatacagtattttatctatagtcaccatggtgtagtcaccgtgcaattgatctattaaacttattccttctacctagctgtaattttatatcctttggccaacatcttcctaacccctccctcaactgccccagcctctggtaactatcattcttctctctacttctgtaagatcaacttttttagattccacatattagtaaggttgtacactatttgtctttccatgcctggcttgtttcacttaatataatgtccttcaggttcatctgtgttgttgcaaatggcaggatttccctttttttatggccaactagtattccattgtgtatatatactacattttatttattcattcatccattgatggttgcttaagttgattccacatcttggctattgcaagtataatttatctttggacttaccgcttctctatttgataattatctgtctgctatattataccaacagccttcaagctcccgaatggcagagtctgtacccaagttttatctctataacaagtctattgtagcaggtctgttgtattgtttgctctctctctctctctctatatatatatatgtgatactttgccatgttctagacttggaaaatgattgactaggactcatgaacccatggccattccttagataataatgatcacagccgtaacagctaatactgattgagggcctactatgtgacagacactgttaagggtgttacctgtcataattccatttaatccttataataacctcataggggtagagtagatactattgtcatctctgttttccaaatgaggaaaattaaacattcaaagataaaataatttgtccaaggtcacatagctagtaaatggtagactagtatttgaaccaaagctttctggctgcagagtcatatcactattgtagacttgcactgaaatgaataaaacttctcctatgcatgtctcctcttaaagatggctttaaatctaattcctcaaggctgttatttatttttgtttaaagtgacttaccttccctgtttgctctttgagccttctgagaagggcaaggatgcagcagagagagccttggagagagtaaactgtattctcaggaatacaatggcagaagagcacctggagagatttgagcagtgcccttttccctttccttgggaggtgacaggctaagagggtgctttcatggcagtggctgccctttcagcttcaggcttgtgtaccttgtacatgatgagactggagaacagtggactgtctgagccagtgaccgtgcaggctgctctctggaaaagcagggtgtgaatgcaaatttattgtcctgggacattccccaatataaatagactttttgtgctaactcctgcttttccaattgagggctattttctctttctttttttaaaacaatctttctagatggcattttttttccttcctgtctttgagtgatagggctcacatctaggaaggaaatgatcttttacttcaaaggttatatccctgtcagacttaaagttgtttaaaattaagtctttgcctctggagctctgagtcaaggtgaagaatgctcactccagagttctgactccttgaggactagaagtaagagtgaactcttgccttgagccaggtacagtcggtcagggaataagtctttattgagccctgactaggtgcttgggcttgtgataggatgaaatccttgccccaagttgcttacaaccatggggaaatggtgtaggagagtcaagatcataatatgtgaaataaccagacaacagtaagataatacataattaagaaccaaatacatatatcaaactccagcagttgtaagcattctcagaatcagtgtgatgcaatggttaaagaattttggctttggggttagaggttctgggtttgaattccagctttaccacctgctagctatataactttagacctactatttaactatttaaactatttaaactaaggagtttaactatttaaactccttaggccttagttttctcatctgcaaaatggagatgataatagtatctaaagtaagtttgctgttaggcttaaataagatgatccattcattcagttaaaaaaaatttcagtgccttctttgtgcaaggcactattttaagtatgtggaatacacagatgaccttggaatctcagtggcaataacgacaaatgtttgtttttctcacatactacatgtccactctggatcagctttagctctgctcccttctcctttattctaagaccaaagctaaaggtgagcccctatgtgggaaatgctggcaagggaaaagggcaatagaaaaccatgcatccaccctagtagagcagaaaatcactgttggggcagagtgagaagtgatttcagatggagagaaagagagtcctgaaggcccactagattagaacattattgcagtgattcagatgaaagatcttgacattctggacttggataagcacagtagcaaaggagagaagagaacaggtggagggaacaaggatacagggaaatggagaggacttagtgagtggctgtatttgaggaataagggagaaggatggagctaaactaagagcactagcttccaaaattagctgtgctactaagtttacttagttgtgtaaactcaagtcattgaacctctctggccttgagttttgaacatttataaaatgagagtcctgagtttgatgtggtccctaaggttccttccagctctattcctctggctctaaaactccaaggtctttgttctggaagaccacacactactgggagtggtgctattgggaggctaaattaatttcgagagaaagatgttacaaaaacctagttttgcatttgtctgcttctattgggttgtgtgcctttcctttttgcctttgctcgtagccttcgctttctccttggcttgattgtgaatccagaaaggagatagaatttattcttcatctccaaggtgggatccttgggaagacacagggcctggaggtcgtggaactaatgcagccttgtgtacaacgcctttccagtgtctttggtatcttggcatctttatatgcttccattagcatattttgcagtatgataacatcttcacagatgttagccaggaggtctgtttggagagaaactttatgttcccctattcccacatatccacagaatcagaaactttggccaactctttcttcttctcaagggcatgcttcttcctctcttttatctcttgcttgctccttctcatgggaagaggagcaacttgtctcattggttagagtctggcaatcatttggtccctctttgttgtacagagttaatgtgttaacaactcctgctccaaaaagacaacatggtcttatccttttcttttgctttctttgatcacctagttcaggcagggtgggccttccttctgctcaccattacagtaagcagattaggatggaattgcctctgataaacccagacaggtctttctttcaacttctctttcaggtcacttttcccctgggatttagataacattaatttagtcggagaggcggcagaaaacacctgctatagcctctgacaccagtccatgtaagtcagcactgtactttattagttgggtctccattagcaaaagtagtaccttgatcacagtttagctgcttagtttctgctcttcctgtttgaaattggagaatctagtaaataagtgacaccatgacctttggcagaacccgttcggcatcacatcacagttgttaatggtttcctatccctctttcccagctttgccagtaggagagtacaattatcaaagaggaagacggtttgcatcttgcatcgtaggaagtagtttacaaagctgagtggccatcaaccagtatatgcttgacccataaactgtgcttccaggaaacagtccagctttatatcctggcattttaaccatttcagatggtcttttcagttaaatgattactttgacttctcagtattaaatttattatgcagtatgagctctctgaagatgaatgttgtacttaatttttttaaaaaaaaacctccttctcatacccatccctattccatatcccatatagtgttttgtaataaaacttttcaactggaaagtacttaataaattctgacatgatatcgaaagacttttttttgttgtttgtttgtttctaaaatgagaggccaactcagttgaaatggctaagccatttgtgtgcatagttgcaatcccagttgattcgttacagaaaaaatttaaatcttaataattattttcaggacctctgtcatgagacagagctcatgggccttgatttattccacaaacatgtataccagatactgtatgaggcacaacagagaaaaagaataagccaggggccttgctttcaaggcatcatagcccagttgagaaatgaaattcctgaacaaagaattataatctaccagtatgagaacccacatagagaaatgtgttaagtgctatgggaagcagagtaaaatatgactagttcttcctaggaatcaaggaagatttcacagatgttgactcattccgaccagtgacttgaaaagaactgtacaacagtaagttgaatggtgacaggtagagaatggacatcctaatggtaagctctgttagttacaaggagattttagaactatggttaaggggaaagtgtgcattgcctcactatttaagtcctttgtcagcattgtgctttattttgcaaggagagggttttgccagcatttatccttctggttctaggcaaagcttgggtataaaagaagtaaacttggcatattctgaggcagccataatttgaagcctttcagtcttgatgtttcactcattcattcatttgtttattcattctctcctgctctttctgtgcaatctgatagaacaaaatttagtttctttttaaccatcccctattctttcagttcttctttggtataactatgtctcctgtttcttactgtgtttgtcggagactaattgtaagaaaccaaaatccatccaaactagttcaatcaacacagagtggtaaggaaaggatatggtacatttcataagacccaataaaagcaagtatttctgtgcctggtggagacaggagtaggaattgcttacaaccagagattactctcacagtcttctttcttctctttttctctttctcctttttgcatcactctctaccttccagaacagcctcctctttttacttgtgtctctcttcttcctatgtaatttcagcttgcactggcatcactttggcccatgccctgcagttctctgatgcacatttacccttatcttaacactgtctcaaaagaaaacccagccaattcatctgtccgttaattagctgcttgagttaggtgggcatacctagtccagtcagctacagtaaaaaagtatgcgtgtgttggggttgggaatttatctggttatatagggcttctcctccccaaggccagggtagagcagaagggtaaattgggaaaggtaggcagaattgaatgatactctgctttatttccctagagagacaaaccagcgtacaatctaagatgacagttgagattttcttaacgaaagtttttcatagttggacaacagagtgctcctacatgcccacattcagtgtccattccaaaacaaattctacttcttccatgtgtagcattttgcagataaactgagtagtgattattcatccagcacatagttcttacccctgtttctcacttgctttggcctcggcaggccgggatatatgagaaaaaccaagaatttggagtcactggatttattagttccatctcttactaattcagtgaccatgaataagctccaacatcttagaacctctcttccctgattcaaaaaatgaggttgacttgtgcctcaccagcctccctggatacttacaaggggcacatgataaatgtgtgtggaatgactttgtgaatagtaaagcactgtgcaaatgagttcaattattaacaaattatgttagagatggaaacaaaggttgatttttggcttgtctgacatttagcatgaagtactaaggaatagattctctgatatctgctcatccaagtcaaggcatggttttaggcaagattcgtaaacaacacgtttctggtgctctggctctcagactgtcatcaagcatgtgaagttccttgaatgaaagacgtaatggaaacaaatgggtgcatgctcctacatcaatgtgtgtgtgtcagtatggcctccaggcatgatagaggacctttcattttttagctgaaattattttaatcattatagtggtattaaatgggctgttatcggggtgcttcttttagttagatggtgatggtgaaagaaaaacatggaccacaaatgtgatttaactgaggatcatctttacttggtgtggataagaacaaagaaaagaccaaacttgtgaacatacaagatcaccttacctggccctcctctgtcagtcacaggttaggtatgcaatagataatcctcagtactactactctgttccaggatggagaattaaggagaggggaggttggaggtgctgccagctctttttctttgtcttttctgtggttgtattatgtctctgtgctgtggtgggataatgaggaaatattatgagaataatgttctttctctgtgggaaaaaaagttgtatatatatatacatatatatgtttaccacttcagatgtattatttgaagagaggcaacttgatgtaatggaaggaccatgggctttgaagttatacagacacgaattcaaaaatcaaatcccacattaactattttttagtggatatgaccttgggaaattacttaacctctgtgaacttttcagatgtttcatccatgcaatgcagataatagtgcagatatgtgatcccctaggacagggcctagcacatagatgctcactaaatggtgcctatagtggtaactatgtaggcccctgatggtccttggccccaagtggcagctgcagtggaaattttaatcagaaggttagggggacttctttctaaaaccacggttagtttgtaaggctgctcacagccctctgttgcagttataacattcactgaatcacatagagggacctttggggaaagagagcactgcccaaggcatagcggactaaaggcctaaaggaaacttagacggggaatggggatttaaaactcaatgatttgattgtgggtagcccaaagagaatgtttaacttggattcaaactttgagtgtagactgtagaattgaatttaagaaagttttattatttaatcccctgctatgtggcaggtaccatgcaaagtagcttgcatacttaatttaatttactgttcatggtagctgtacaaggtaggtgggattattctcactttgaaaataagtaaaagaagctaaataatttgttgaaggtcacacagctagttgaaggtcacacagctagaagttgagggttcgcactcaacccagttctgtctgtttccaaattccacatttttcccaatatgcctcacggctaccagatctcatagcccacttgcttagtgcagtaatttctaatcatggcccttggatccctgaaggattcaaggggatccctgaagatagaaatgaattctatgtgccattttcattatttcaaaaactttaatggaaaatcttatatttagttgcaacaagtttatacttggtaacaaaaatggcatgtttctttgcttacagttaactgtttttctcccatggtgacctagtttgtcagttattgatgtatgtaataaaactaattaaacactcaaaaatgcttttggttagacaaagtctttcagattctgaagctcatggggagggtaaatgggtgttcttgatggtaaaaaatatatgaaatatagtcagatttgaagactgcaaattgatgggtcatcagccaattctggcctaaagatgcattttgtttggctaataaaatggtggtgttttttaatttataaattcctgacaaacatttaaaaattagaaaatgtcacatcaaaaagcagatgtttaagcttcttttcaaaattcaaaagttctggcattagtggatccacatttgtccatgacaataaccagctggaaccgggttgttacttagatgaaccacgtgctttttccagtttcccacagcctccacctgacccagttcattgatgtatattacctgtcaggctcagtaagcatgtgagtctgtgattcctgggctagctcagactcctcatcatcttgtttggctatggagtaaaacccattttccgtctgtgatcactcacatcttttgtactctgtacagctttgtgtcttgggacttttttcttatgttgttattttatgtctttcatgtaaataggtctgtttgacaagagccacattctcatcagttcacagttggcattgttttgggggctggaaatgcagaggagtcttatggtgctcgcaccctgagggaggtcacagtctagccttgtttctttttaatttacaaagcatccagcattctgatgtgcatgttcaggacttattagaatgtggagattaacagcatgggatttggtatcagaaagacctaggttagagtactgatgtagtttatgtaaactcttcagcttctgttttcttgtctttaaaagggggataattaatagtacttatgggatacagtgaggtttgaatgacccagtgattataaggggcttagttccaatccataacatttaataactgccaaatacctggtaactcttattactagggctggacatacagttggctctcaattgatgcttgttgaattaacaaataaattgaacaaattgagtgtaaggaattagatgtattcagacaaataactgcaatggatgatgtcaccaaaagtgtctccagcaggcctaaggactatgaatttatttattttttttataatttcaacttttattttaggttcaagaggtacacttgcttcatttgttacattaatatattgcatgatgctgaggtatggggtacaattgatcctatcacccaggtagtgagtgtagtacctaatagtttttcaacccttgccccactcccttccccgtctagtagtccctagtgtctattattgccatctttatgtctgtgtgtacccagtattcagctcccacttacaaatgagaatatgcagtatttggtttttgttcctgtgttaattcacttaggataatgaccttcagctgtatccatactgctgcaaaggacatggttttgttctttttatgactacatagtattccatggtgtctttgtatcatatttgctttatccagtgcactgctgatgggcacacaaggttgattccatgtctttgctattgggaatagtgctgtgatgaactaagagcgcatgtaactttttggtagaatgatttattttctattggatatatacccagtaatgggattgctgggttgaataataattctgttttaagctctttaactgctttccacagtggctaaactaatttacattcccatcaactgtgtataaacatttccttttctccatagcctcaccagcatctgttgttttttgaccttttaataatagcaattctgactggtgtgagatggtatctcattgtggttttgacttgcatttctctgaggattagtaatgttgaacatttttccatatgtttgttggccgcttggatgttgatatggtttagctctgtgtccccacccaaatctcatcttgaattctattcccataattaccatgtgttgtaggagggacccagtgggagataatttgaattatgggggcagtttcccccatactgttcttgtggtagcgaataagtctcacgagatctttcatctcattttctcttgccaccaccgtgtaagaggtaccttttgcctcctgccgtgaatctgaggcctccccagccatgtggaacgctaagcccaattaactctcttttttcttcccagtctcagttatgtctttatcagcagcgtgaaaatggactaatagagtaaattggtaccaatagagcggggcgttgctgaaaagatacctgaaaatgtggaagcgactttggaactgggtaacaagcagaggttggaacagtttggagggctcacaagaagacagggaaatgtgggaaagtttggaacttcctagagagttgttgaatggctttgacaaaaatgctgatagtgatatgaacaataaggtccagactgaggtggtctcatatggagatgaggaagttgttggaaactggcgcaaaggtgactcttgttatgttttcgcaaaaagactggtggcattttgcccctgccctagaaatttttggaactttgaacttgagagagatgatttagggtatctagtggaaaaaaatttctaagcagcaaagtgttcaaaaggtgacttgggtgccattaaaagcatttagttttggatgcgcacggtggctcatgcctgtaatcccggcactttgggaggccaaggtgggcggattatgaggtcaggagttggagactagcctggccaacatagtgaaacccccgtctctactaaaaatacaaaaattagctgggcttgttgtcagatgcctgtaatctcagctacttgggaggctgaagcaagagaatcgcttgaaggtgggagacagaggttgcagtgagccaagatcatgccactgctctccagccagggtgagagagcgagactctgtctcaaaaaagaaaaaaaaaaaaagcatttagttttaaaaggcaaacagaacatgaaagtttggaaaatttgcagcctcacaatgtgatagaaaagaaaaacccatttttctgaggagaaattcaagccgtctgcataaatttgcataaggggagccgaatgttaatccccaggacaatggggaaaatatctccaaggcttgtcagaggtcttcacagcagggcctcccatcacaggcccagaggtctaggagaacatggtttccttggtcagcccagtgtccctgtgctgtgtgcagcctaggaacttggtgccctgtgccccagccactccagccatggctgaaaggggccaacgtagagctcgggccttggcttcagagggtgtaagccgcaagccttgacagctgccacatggtgttgagcctgtgagtgcacagaagtcaagaactaaagtttgagaacctccacctagatttcagaagatgtattgaaatgcctggatgcccaggcataagtttgctgcaggggcggggtactcatggagaacctctgctaggcagtgcagaagagaaatgtggggttggagcccctacacagagtccctactggggcactgcctagtggagctgtgagaagagggccaccatcctccagaccccagaatggtagatcaccgacagcttgcaccatgcacttggaaaagtcacagacactcaatggcagcccatgaaggcagctggtagggaggctataccctgcaaagccacaagggcagagctgcccaagaccatgggaacccacctcttgcatcagcatgacccagatttgagacatggcatcaaaggacatcattttggagctttaagatttgactgccctgctggatttcagactttcatggggctggtagcccctttgttttggccaatttcccccatttggaatggctgtatttacccatgtcacacaggtagaactcagtgtgcctgtacccccattgtatctaggaagtaactaaattgcttttgattttacaggctcataggtggaagggacttgtcttgtctcagataagactttggactgtggacttctgcgttaatgctgaaataagttaagactttgggggactgttgggaaggcatgattggttttgaaatgtgaggacttgagatttaaaggggacaagggcagaaagatggtttggctctgtgtccccatgcaaatctcatcttgaattttactcgcataatcccatgtgttgtgggagggacctggtgggagataatttgaatcatggaggtggtttcccccatgctattctcatggtcgtgaataaggctcacaagatctgatggttttatcaggggtttccgctttggcatcttcctcattttctcttgctaccaccatgtaagaagtgccattgcctcccgccatgattctgaggcctccccagccatgtggaactgttaagtccaattaaacctctttttcttgccagtctcggttatgtctttgtcagcagtgtcaaaacagactaatacaggtgcctttttttttaagaagtatctattcatgtctttggcccactttttcatggagttacttgttctttgcttgttgaattgttcaagtttgttatcgattccagatgttagacctttgtcagatgcatagtttgcaaatattttctcccactttgcaggctgtttactcggtggatagtttattttgctgtacagaagctcttttttaattattatactttaagttctagggtacatgtgcataaggtacaggtttgttacatatatatacatgtgccatgttggtgtgctgcacccattaactcgtcatttacattagatatatctcccagtgctatccctcccctctccccctaccccacaacaggccccggtgtgtggtgttccccaccctgtgtccaagcattctcattgttcagttcctacctatgagtgagaacgtgcggtgtttggttttctgtccttgcgatagtttgctcagaatgatggtttccagcttcatccatgtccctacaaaggacaagaactcatccttttttatggctgcatagtatcccgtggtgtatatgtgccacattttctttattcagtctatcattgatggacatttgggttggttccaagtctttgctattgtgaatagtgccacaataaacatatgcgtgcatgtgtctttatggcagcatgatttataatcctttgggtatatacccagtaatgggatggctgggtcaaatggtatttctagttctaaatccttgaggaatcgccaaactgtcttccacaatggttgaactagtttacagtcccaccaacagtgtaaaagtgttcctatttctccacatcctctccagcacgtgttgtttcctgactttttaataattgccattctaactggtgtgagatggtatctcattgtagatttgatttgcatttctctcatagccggtgatgatgagcattttttcacgtgtctgttggctgcataaatgtcttcttctgaaaagtgtctgtcatatccttcacccactttttgatggggttgatttttttcttgtaaatttgtttaacttctttgtagattctagatattagcaccttgtcagatgggtagattgtaaaaattttctcccattctgtaggttgcctgttcactctgatggtagtttcttttgctgtgcagaagctctttagtttagttagatcccatttgtcaattttggcttttgttgccattgcttttggtgttttaatcatgaagtccttgcccctgcctatgtcctgaatggtattacctaggttttcttctagggttttttggttttaggtctaacatgtaagtctttaatccatcttgaattaatttttgtataaggtgtaaggaagggatccagcttcagcttcctacatatggctagctagttttcccagcaccatttattaaatagggaatcctttccccattgcttgtttttgtcagggttgtcaaagatcagatggttgtagatgtgtggtattatttcttagggttctgttctgttccattggtctatatctctgttttggtaccagtaccatgctgttttgcttactggagctttgtagtatagtttgaagtcaggtagcgtgatgcctccatcttcgttcttttggcttaggattgtcttggcaatgtgggctcttttttggttccatatgaactttaaagtagttttttccacttctgtgaagaaagtcattggtagcttgattggggatggcattgaatctataaattaccttgggcagtatggccattttcatgatattgattcttcctatgcatgagcatggaatgttcttccatttgtttgtgtcctcttttatttcattgagcagtggtttgtagttctccttgaagaggtccctcacatcccttgtaagttggattcctaggtattttattctctttgaagcaattgtgaatgggagttcactcatgatttggctctctgtttgtctgttattggtgtatagggatgcttgtgatttttacacattgattttgtatcctgagactttgctgaagttgcttatcagcttaaggagattttgggctgaaacaatgggattttctaaatatacaatcatattatctgcaaacagggacaatttgacttcctcttttgctaattgaatactctttatttctttctcctgcctaattgccctggccagaacttccagcactatgttgaataggagtggtgagagagggcatccctgtcttgtgccagttttcgaagggaatgcttccagtttttgcccattcagtatgatattggctgtgggtttgtgataaatagctcttaccattttgagatacatcccatcagtacctagtttatggagagtttttagcataaagtgctgttgaattttgtcaaaggccttttctgcatctattgagataatcatttggtttttgtctttggtgctgtttatatgctggattatgtttattgatttgcgtatgttgaaccagcctcacatcccagggatgaagcccacttgatcatggtggataagctttttgatgtgctgctggattcggtttgccagtattttattgaggatttttgcatcgatgttcatcaaggatattggtctaaaattctctttttttgttgtgtctctgccaggctttggtatcaggatgatgctggcctcataaaatgagttagagaggattccctctctttttattgattggaatagtttcagaaggactggtacagctcccctttgtacctctggtagattttggttgttaatccatctggtcctggactttttttggttggtaggctcttaattattgcctcaatttcagagcctgttattggtctattcagggattcaacttctagtcttgggagggtgtatgtgtccaggaatttatgcatttcttctagattttctagttatttgcgtggagttgtttatagtattctctgatggtagtttgtatttctgtgggatcagtggtgatatcctcttcatcattttttattgtgtctatttgattcttctgttttcttctgtattagtctttctagcggtctatcaattttgttgatgttttcaaaaaaccagctcctggattcattgatttttttgaagggttttttgtgtctctatctccttcagttctgttctgatcttagttatttcttgccttctgctagcttttgaatgtgcttgctcttgcttctttacttcttttaattgtgatgttagggtgtcaattttagatctttcctgctttctcttgtgggcatttagtgctataaatttccctctacacactgctttaaatgtgtcccagagattctggtatgttgtgtctttgttctcattggtttcaaagaacagctttctgccttcatttcgttgtgcacccagtagtcattcaggagcaggttgttcagtttccatatagttgagtggttttgagtgagtttcttaatcctgagttctagtttgattgcactgtggtctgagagacagtttgttacaatttctgttcttttacatttgctgaggaatgctttacttccacctatgtggtcaattttggaataagtgcgatgtggtgctgagaagaatgtatattctgttgatttgggggggagagttctgtagatatctattaggtctgcttggtgcagagctgagttcaagtcctggatatccttgttaaccttctgtctcgttgatctgtctaatgttgacagtggggtgttaaagtctcccattattattgtgagggagtctaagtctctttgtaggtctctaaggacttgctttatgaatctgggtgctcctgtattgggtgcatatatatttgggatagttagctcttcttgttgaattgatccctttaccattatgtagtggccttctttgtctcttttgatctttgttggtttaaagtctgttttatcagagactaggattgcaacccctgcttttttttgttttccgtttgcttagtagatcttcctccatccctttattttgagcctatgtgtgtctctgcatgtgagatgggtctcctgaatacagcacactgatgggtcttgactctatccagtttgccagtctgtgtcttttaattggaacatttagcccatttacatttaaggttaatattgttatgtgtgaatttgatcctgtcattatgatgttagctggttattttgctcgttagttgatgcatttcttcctagcatcgatggtctttacaatttggcatgtttttgcagtggctggtaccataggttgttcctttccatgtttaatgcttccttcaggagctcttgtaaggcaggcctggtggtgacaaaatctctcagcatttgcttctctgtaaaggattttatttctccttcacttatgaagcttagtttggctggatatgaaattctgggttgaaaattcttttcttttagaattttgaatattggcccccactctcttctggcttgtagggtttctgcccagagatccactgttagtctgatgggcttccctttgtgggtaacccgacctttctctctggctgcccttaacattttttccttcatttcagctttggtgagtctgacaattatgtgtcttggagttgctgttctcaaggagtatctttgtggcattctctgtatttcctgagtttgaatgttggcctgccttgctaggctggggaagttctcctggataaaatcctgaagagtgttttccaacttggttccattctccccatcactttgaggtacaccaatcagatgtagatttggtcttttcacatagtcccatatttcttggaggctttgttcgtttctttttactcttttttctctaaacttctcttct

SEQ ID NO: 12141 - DNA, 2900 bp, Homo sapiens; identical to SEQ ID NO: 12086

SEQ ID NO: 12142 - DNA, 4892 bp, Homo sapiens
gtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtaggtatgcggcgttatttctgagggctctgttctgttccattgatctatatctctgttttggtaccagtaccatgctgttttggttcctgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctataaattaccttgggcagtatggccattttcacgatattgattcttcctacccatgagcatgtaatgttcttccatttgtttgtatcctcttttatttccttgagcagtggtttgtagttctccttgaagaggtccttctcatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaagaagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcattaagggttgttgaattttgtcaaaggctttttctgcatctattgagataattatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccccaatttcagctcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcagtggtgatatcccctttatcattttttattgtgtctatttgattcttctctctttttttctttattagtcttgctagcagtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttccgccttcatttcattatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtccgcttggtacagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcctcttgttgaattgatccctttaccattatgtaatggccttctttgtctcttttgatctttgttggtttaaagtctgttttatcagagactaggattgcaacccctgcttttttttgttttccatttgcttggtagatcttcctccatccttttattttgagcctatgtgtgtctctgcacgtgagatgggtttcctgaatacagcacactgatgggtcttgactctttatccaacttgccagtctgtgtcttttaattggagcatttagtccatttacatttaaagttaatattgttatgtgtgaatttgatcctgtcattatgattttagctggtgattttgctcgttagttgatgcagtttcttcctagtctcgatggtctttacattttggcatgattttgcagcggctggtaccagttgttcctttccatgtttagcgcttccttcaggagctcttttaaggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtacggtttctgccgagatatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctgtgtatttcctgaatctgaatgttggcctgccttgctagattggggaagttctcctggataatatcctgtagagtgttttccaacttggttccattctccgcatcactttcaggtacaccaatcagacgtagatttggtcttttcacatagtcccatatttcttggaggctttgctcatttctttttattcttttttctctaaccttcccttctcggttcatttcattcatttcatcttccattgctgataccctttcttccagttgatcacatcggctcctgaggcttctgcattcttcacgtagttcttgagccttggttttcagctccatcagctcctttaagcacttctctgtattggttattctagttatacattcttctaaatttttttcaaagttttcaacttctttgcctttggtttgaatgtcttcccgtagctcagagtaatttgatcgtctgaagccttcttctctcagctcgtcaaagtcattctccatccagctttgttccgttgctggtgaggaactgcgttcctttggaggaggagaggcgctctgcgttttagagtttccagtttttctgttctgttttttccccatctttgtggttttatctacttttggtctttgatgatggtgatgtacagatgggtttttggtgtggatgtcctttctgtttgttagttttccttctaacagacagcaccctcagctgcaggtctgttggaataccctgccgtgtcaggtgtcagtgtgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggtcatttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggcgggcgcccctcccccagcctcgctgccgccttgcagtttgatctcagactgctgtgctagcaatcagcgagattccgtgggcgtaggaccctccgagccaggtgtgggatatagtctcgtgctgcgccgttttttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggctcgcgcccggtgcgcgcacccactggcctgcgcccactgtctggcactccctactgagatgaacccggtacctcagatggaaatgcagaaatcacccatcttctgcgtcgctcacgctgggagctgtagaccggagctgttcctattcggccatcttggctcct

SEQ ID NO: 12143 - DNA, 1759 bp, Homo sapiens
gagttctgtagatgtctattaggtccgcttggtgcagagctgagttcaattcctgggtgtccttgttaactttctgtctcgttgatctgtctaatgttgacagtggggtgttaaagtctcccattattaatgtgtgggagtctaagtctctttgtaggtcactcagggcttgctttatgaatctgggtgctcctgtatcgggtgcatatatatttaggatagttagctgttcttgttgaattgatccctttaccattatgtaatggccttctttgtctcttttgatctttgttggtttaaagtctgttttagcagagactaggattgcaacccctgcctttttttgttttccatttgcttcgtagatcttcctccatccctttattttgagcctatgtgtgtctctgcacatgagatgggtttcctgaatacagcacactgatgggtcttgactctttatccaatttgccagtctgtgtcttttaattggagcatttagtccatttacatttaaagttaatattgttatgtgtgaatttcatcctgtcattatgatgttagctggttattttgctcgttagttgatgcagtttcttcctagcctcgatggtctttacaatttggcatgattttgcagtggctggtaccagttgttcctttccacgtttagtgcttccttcaggagctcttttagggcaggcctggtggtgacaaaatctctcagcatttgcttgtctgtaaagtattttatttctccttcacttatgaagcttagtttggctggatatgaaattctaggttgaaaattcttttctttaagaatgttgaatattggcccccactctcctctggcttgtagagtttctgccgagagatccgctgttagtctgatgggcttccctttgtgggtaagctgacctttctctctggctgcccttaacattttttccttcatttcaactttggtgaatctgacaattatgtgtcttggagttgctcttctcgaggagtatctttgtggcattctctgtatttcctgaatctgaatgttggcctgccttgctagattggggaagttctcctggatagtatcttgcagagtgttttccaacttggttccattctccctgtcactttcaggtacaccaatcagacgtagatttggtcttttcacatagtcccatatttcttggaggctttgttcgtttctttttattcttttttctctaaacttcccttctcgcttcatttcattcatttcatcttccatgctgataccctttcttccagttgatcatatcggctcctgaggcttctgcattcttcacgtagttctcgagcctggctttcagctccatcagctcctttaagcacttctctgtattggttattctagttatacattcatctaaatttttttcaaagtttttaacttctttgcctttggtttgaatttcctcctgtagctcggagtagtttgatcctctgaagccttcttctctcaactcgtcaaagtcattctctgtccagctttgttccgttgctggtgaggaactgcattcctttggaggaggagaggggctctgctttttagagtttccagtttttctgctctgtttttttcccatctttgtggttttatctacttttggtatttgatgatggtgatgtacagatgggtttttggtgtggatgtcctttctgtttgttagttttccttctaacagacaggaccctcagctgcaggtctgttggagtt

SEQ ID NO: 12144 - DNA, 2030 bp, Homo sapiens
tttatagtattatctgatggtagtttgtatttcagtgggatcggtggtgatatcccctttgtcatttttttattgtgtctatttgattcttctctcgtttcttctttattagtcttgctagcagtctatcaattttgttgatcttttcaagaaaccagctcctggattcattaattttttgaagggttttttgtgtctctatttccttcagttctgctctgatcttagttatttcttgccttctgctagcttttgaatgtgtttgctcttgcttctctagttcttttaattgtgatgttagggtgtcaattttagaactctcctgctttctcttgtgggcatttagtgctataaatttccctctacacactgctttgaatgtgtcccagagattctggtatgttgtgtctttgttctcgttggtttcaaagaacatctttatttctgccttcatttcgttatgtacccagtagtcattcaggagcaggttgttcagtttccatgtagttgagcagttttcagtgagtttcttaatcctgagttctagtttgattgcactgtggtctgagagacagtttgttataatttctgttcttttacatttgctgaggtgtgctttacttccaactatgtggtaaattttggaataggtgtgatgtggtgttgaaaagaatgtatattctgttgatttggggtggagagttctgtagatgtcttttagatctgtttggtgcagagctgggttcaatttctggatatccttgttaactttctgtcttgttgatctgtctgatgttgacagtggggtgttaaagtctcccattattattgtgtggaagtctaagtctctttgtaggtcactaaggtcttgctttatgaatctgggtgctcctgtattgggtgcatatatatttaggatagttcttcttgttgaattgatccctttaccattatgtaatggccttctttgtctcttttgatctttgttggtttaaagtctgttttatccgagactaggattgcaacccctgcctttttttgttttccatttgcttggtagatcttcctccatccctttattttgagcctatgtgtgtctctgcatgtgagatgggtttcctgaatacagcacactgatgggtcttgactctttatccaatttgccagtctgtgtcttttaattggagcatttagcccatttacatttaaggttagtattgttatgtgtgaatttgatcctgtcattatgatgttagctggttattttgctcgttagttgatgcagtttcttcctagcctcgatggtctttacaatttggcatgattttgcagtggctggtaccggttgttcctttccatttttagtgcttccttcaggagctcttttagggcaggcctggtggtgacaaaatctctcagcatttacttgtctgtaaaggattttatttctccttcacttatgaagcttagtttggctggatatgaaattctgggttgaaaattcttttctttaagaatgttgaatattggcccccactctcttctggcttgtagggtttctgccaagagatcagctgttactctgatgggtttccctttgtgggtaacccgacctttctctctggctgcccttaacattttttccttgatttcaactttggtgaatctgacaattatgtgtgttggagttgctcttcttgaggagtatctttgtggtgttctctgtatttcctgaatttgaatgttggcctgccttgctagattggggaagttctcctggataatatcctgcagagtattttccaacttggttcaattctccacgtcactttcaggtacaccaatcagaggtagatttggtcttttcacatagtcccatatttcttggaggctttgttcgtttctttttattcttttttctctaaacttctcttcacacttcatttcattcatttcgtgttccattgctgataccctttcttccagttgatcgcatcggttactgaggcttgtgcgttcgtcacgtagtt

SEQ ID NO: 12145 - DNA, 1277 bp, Homo sapiens
aaagaacatctttatttctgccttcatttgttaatgtacacagtagtcattcaggagcaggttgttcagtttccatgtagttgagcagttttgagtaagtttcttaatcctgagttctagttttattgcactgtggtctgagagatagtttgttataatttctgttcttttacatttgctgaggagagctttacttccaactatgtggtcaattttggaataggtgtggtgtggtgctgaaaaaaatgtatattctgttgttatggggtggagagttctgtagatgtctattaggtccacttggtgcagagctgagttcaattcctgtgtatccttgttaactttctgtctctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttctttttgaattgatccctttaccattatgtaatggcctcctttgtctcttttgatctctgttggtttaaagtctgttttatcagagactaggattgcaacccctgcctttttttgttttccatttgcttggtagatcttcctccatccttttattttgagcctatgtgtgtctctgcatgtgagatgggtttcctgaatacagcacactgatgggtcttgactctttatccaatttgccagtctgtgtcttttaattggagcatttagtccatttacatttaaggttaatattgttatgtgtgaatttgatcctgtcattatgatgttagctggttattttgctcattagttgatgcagtttcttcctagtctcgatggtctttacattttggcatgattttgcagcggccggtacttgttgttcctttccatgtttagtgcttccttcaggagctcttttagggcaggcctggtggtgacaaaatctcttagcatttgcttgtctgtgaaggattttatttctccttcacttatgaagcttagtttggctggatatgaaattctggcttgaaaattctttaagcacgttgaatattggcccccactctcttctgggttgtagagtttctgctgagagatccgctgttagtctgatgggcttccctttgtgggtaacctgacctttctctctggctgcccttaaaattttttccttcatttcaactttggtgaatctgacaattatgtgtcttggagttgttcttctc

SEQ ID NO: 12146 - DNA, 4314 bp, Homo sapiens
gtctaacgtttaagtctttaatccatcttgaattaatttttgtataaggtgtaaggaagggatccagtttcagctttctacatatggctagccagttttcccagcaccatttattaaatagggaatcctttccccattgcttgtttttctcaggtttgtcaaagctcagatagttgtagataagtggcattatttctgagggctctgttctgttccattgatctatatctctgttttggtaccagtaccatgctgttttagttactgtaaccttgtagtatagtttgaagtcaggtagcgtgatgcctccagctttgttctttcggcttaggattgacttggcgatgtgggctcttttttggttccatatgaactttaaagtagttttttccaattctgtgaagaaagtcagtggtagcttgatggggatggcattgaatctataaattaccttggtcagtatggccattttcacgatattgattcttcctacccatgagcatggaatgttcttccatttgtttgtattctcttttatttcattgagcagtggtttgtagttctccttgaagaggtccttcacatcccttgtaagttggattcctaagtattttattctctttgaagcagttgtgaatgggcgttcactcatgatttggctctctgtttgtctgttattggtgtataagaatgcttgtgatttttgtacattgattttgtatcctgagactttcctgaagttgcttatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtcccatcaatacctaatttattgagagtttttagcatgaagggttgttgaattttgtcaaaggccttttctgcatctattgagataatcatgtggtttttgtctttggttctgtttatatgctggattacatttattggtttgtgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttttgtctctgcccggctttggtatcaggatgatgctggcctcataaaatgagttagggaggattcctctttttctattgattggaatagtttcagaaggaatggtaccagttcctccttgtacctctggtagaattcggctgtgaatcatctggtctggactctttttggttggtaagctattgattattgccacaatttcagatctgttattggtccattcagagattcaacttcttccctggttagtcttgggagagtgtatgtgtcgaggaatttatccatttcttctagattttctagtttatttgcgtagaggtgtttgtagtatcctctgatggtagtttgtatttctgtgggatcggtggtgatatcccatttatcatcttttattgcgtctatttgattcttttctctttttttctttattagtcttgctagcggtctatcaattttgttgatcctttcaaaaaaccagctcctggattcattaattttttgaagggttttttttgtctctatttccttcagctctgctctgattttagttatttcttgccttctgctagcttttgaatgtgtttgctcttgcttctctagttcttttaattgtgatgttagggtgtcaattttggatctttcctgctttctcttgtgggcatttagtgctataaatttccctctacacactgctttgaatgtgtcccagagattctggtatgttgtgcttttgttcttgttggtttcaaagaacatcttgatttctgccttcatttcattatgtacccagtagtcattcaggagcaggttgttcagtttccatttagttgagcggttttgagtgagtttcttaatcttgagttctagtttgattgcactgtggtctgagagacagtttgttataatttctgttcttttacatttgctgaggagagctttacttccaagtatgtggtcaattttggaataggtgtggtgtggtgctgaaaaaaatgtatattctgttgatttggggtggagagttctgtagatgtctattaggtctgcttggtgcagagctgagttcaattcctgggtatccttgttaactttctgtctcgttgatctgtctaatgttgacagtggggtgttaaagtctctcccattattattgtgtgggagtctaagtctctttctaggtctctaaggacttgctttatgcatctgggtgctcctgtattgggtgcatatatatttaggatagttagctcttcttgttgaattgatccctttaccattatgtaatggccttctttgtctcttttgatcttcgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaatttgccagtctgtgtcttttaattggagcatttagcctatttacatttaaggttaatattgttatgtgtgaatttgatcctgtcattatgatgatagctggttattttgcttgttagttgatgcagtttcttcctagtctcgatggtctttacattttggcatgattttgcagcggctggtactggttgttcctttccacgtttagtgcttccttcaggagctcttttagggcaggcctggtggtgacaaaaatctctcagcatttgcttgtctgtaaagtattgtatttctccttcacttatgaagcttagtttggctggatatgaaattctgggttgaaaattcttttctttaagaatgttgaatattggcccccactgtcttctggcttgtagagtttctggcgagagatccgctgttagtctgatgggcttccctttgtgggtaacccgacctttctctctggctgcccttaacattttttccttcatttcaacttcggtgaatctgacaattatgtgtcttggagttgctcttctcgaggagtatctttgtggcattctctgtatttcctgaatctgaatgttggcctgccttgctagattggggaagttctcctggataatatcctgcagagtgttttccaacttggttccattctccctgtcactttcaggtacaccaatcagacgtagatttggtcttttcaaatagtcccatatttcttggaggctttgttcgtttctttttattcttttttctctaaacttcccttcttgcttcatttcattcatttgatcttccatcattgataccctttcttccagttgatcgcatcggctcctgaggcttctgcattcttcatgtagttctcgagccttggttcagctccatcagctcctttaagcacttctctgtgttggttattctagttatacattcatctaaatttttttcaaagttttcaacttctttgcctttggtttgaatttcttcctgtagctcagagtagtttgatcatctgaagccttcttctctcaactcgtcaaagtcattctccgtccagctttgttctgttgctggtgaggaactgtgttcctttggaggaggagaggtgctctgctttttagagtttccagtttttctgctctgttttttccccatctttgtggttttatctacttttggtctttgatgatggtgatgtacagatgggtttttggtgtggatgtcctttctgtttgttagttttccttctaacagacaggaccctcagctgcagatctgttggagtttgctagaggtccactccagaccttgtttgcctgggtatcagcagcagtgtctgcagaactgcggatttttgtgatccgcaaatgctgctgtctgatcggtcctctggaagttttgtctcagaggagtacccggccgtgtgaggtgtcagtctgcccctactggggggggtgcctcccagttaggctgctcggggg

SEQ ID NO: 12147 - DNA, 2373 bp, Homo sapiens
gattttgtatcctgagactttgctgaagttgcttatcagcttaaggagattttgtgctgagacaatggggttttgtagatatacaatcatgtcgtctacaaacagggacaatttgacttcctcttttcctaattgaataccctttatttccttctcctgcctaattgccctggacagaacttccaacactatgttgaataggagtggtgagagagggcatccctgtcttgtgccagttttcaaagggaatgcttccagtttttgcccattcagtatgatattggttgtgggtttgtcatagatagctcttattattttgagatatgtcccatcaatacctaatttattgagagtttttagcatgaagagttgttgaattttgtcacaggccttttctgcatctattgagataatcatgtggtttttgtctttggttcatttattatgctggattacatttattgatttgcgtatattgaccagccttgcatcccagggatgaaacccacttgatcatggtggataagctttttgatgtgctgctggattcggtttgccagtattttattgaggatttttgcatcaatgttcatcaaggatattggtctaaaattctcttttttcgttgtgtctttgcccagctttggtatcaggatgatgttggcctcataaaatgagttagggaggattccctctttttctattgattggaatagtttcagaaggaatggtaccagttcctccttatacctctggtagaatttggctgtgaatccatctggtcctgaactctgtttttgttggtaagctattgattattgccacaacttcagttcctgttattggtctattcagagattcaacttattcctggtttagttttgggagggtgtatgtgtcgaggaatttatccatttcttctagattatctagtttatttgagtagagttgtttgtagtaatctctgatggtagtttgtatttctgtgggatcggtggtgatatcccctttatcattttttattgcgtctatttgattcttgtctcttttcttctttattagtcttgctagtggtctatcaattttgttgatcctttcaaaaaaccagctcctggattcattaattttttgaagggtttttttgtgtccctatttccttcagttctgctctgatcttagttattgcttgccttctgctagcttttgaatgtgtttgctcttgcttttctagttcttttaattgtgatattagggtgtcaattttggatctttcctactttctcttgtgggcatttagtgcaataaatttccctctacacactgctttgaatgtgtcccagagattctggtatgttgtgtctttgttctcgtgggtttcaaagaacatctttatttctgccttcatttcgttatgtacccagttgtcattcaggagcaggttgttcagtttccatgtagttgagcggttttgagtgagtttcttaatcctgagttctagtttgattgcactgtggtctgagagacagtttgttgtaatttctgttcttttacatttgctgaggagtgctttacttccaaatatgtggtcaattttggaataggtgtggtgctgaaaaaaatgtatattctgttgatttggggtggagagttctgtagatgtctattacgtccgcttggtgcagagctgagttcaattcctgggtatccttgttaactttctgtcttgttgatctgtctaatgttgacagtggggtgttaaagtctcccattattaatgtgtgggaatctaagtctctttgtaggtcactcaggacttgttttatgaatctgtgtgctcctgtattgggtgcatatatatttaggatagttaactcttcttgttgaattgatccctttaccattatgtaatggccttctttgtctcttttgatctttgttggtttaaagtctgttttatcagagactaggattgcaacccctgcctttttttgttttccattttcttggtagatcttcctccatccttttattttgagcctatgtgtgtctctgcatgtgagatgggtttcctgaatacagcacactgacgggtcttgactctttatccaatttgccagtctgtgtcttttaattggagcatttagtccatttacatttaaggttaatattgttatgtgtgaatttgatcctgtcattatgatgttagctggttattttgctccttagttgatgcagtttcttcctagtctcgatggtctttacattttggcatgattttgcagcggctggtactggttgttcctttccatgttcagtgcttccttcaggagctcttttagggcaggcctggtggtgacaaaatctctcagcatt

SEQ ID NO: 12148 - DNA, 28376 bp, Homo sapiens
gtcttacatttaggtctttaatccatcttgagttaatttttgcataaggtgtaaggaagggatccagtttcagttttctgcatatggctagccagttttcccagcaccatttatcaaatagggaatcctttccccattgcttgcttgtgtcaggtttgtcaaagatcagatagttgtagatgtgtgatgttatttctgaggcctctgttctgttccattggtctatatagctgttttggtaccagtaccatgctgttttggttactgtagccttgtagtatagtttgaagtcaggtagcgtgatgcctccagctttgttcttttggcttaggattgttttggctatgcaaggtcttttttggttccaaatgaagtttaaagtagttttttccaattctgtgaagaaagtcaatggtagcttgatggggatggcattgaatctataaattactttgggcagtatggccattttcacgatattgattcttcctatccatgagcatagaatgtttttccatttgtttgtgtcctctcatttccttgagtggtggtttgtagttctccttgaagaggtccttcacattgcttgtaagttggattcctaggtattttattctcttagtagcaattgtgaatgggagttcactcatgatttggctctctgtttgtctgttactggtgtatagaaatgctcgcgatttttgtacactgattttctatcccgagacactgctgaagttcttatcagcttaaggagattttggtctgagatgatggggttttttaaacatacaatcatgtcatctgcaaacaaagacaatttgacttcttcttttcctatttgaatacctttttttctttctcttgcttgattgccctggccagaatttccaacactatgtggaacaggagtggtgagagagggcatccttgtcttatgccggttttcaaagggaatgcttccagtttttgcccattcagtataatattggctgtgggtttgtcataaatagctcttattattttgagatacattccattgatacctagtttattgagagcttttagcatgaaggggtgttgaattttatcgaaggccttttctgtatctcttgagataatcatgtggtttttgtcattggttgtgtttatttgatggataacatttattgatttgcatatgttgaaccagccttgcatcccaggtattgagatggagtcttgctttttcacccaggctggagtgcagtggcatgatctcagctcactgcaacctccacctcctggttcaagcaattctcaagcttcagcctcccaagtagctgggattacaggggcccaccaccatgctcggctaatttgtgtgtgtgtgtgtgtgtgtgtgtgtgtgtgtttagtagagatggggtttcgccaagttggccaggctgttctcgaactcctgacctcacgtgatctatccgctttggcctcccaaagtgctgggattacaggtgtgcatcaccgtgcccggcctgtacagcatttttaaaatatgaaaaacattcttaccttcaggatggtacaaatacaggttacaggtcaattttaactggccggtcatagtttgcccattcctggaaagaaggggaagaaggaaccaaagagtctgagggcctgcaaaaagttttagttgagagatgaaagtaagggataagaagagacagatactgtagtatctatagggtgaaagacagagattgggattactacatctatagttgtaggttctaaatggatcctccttagatgtccttcaagttactggattgagtttctttgaaggaaaaaaagtgttaaatctgcggtctacatgtcctagtcttagttccttctaaactatatatatccacatgtctaatcttgtttcctcatctaaactatatagccttgagaacaattaagggaagggtagatcgccacctacgtggtatttggccttcagatcaatgcttagtctcattactaggtctcaaaggccatctatttccttttcttattgttgctactggttcctggctctgttatttatgctaatagaaaaggcttgtattgttcatcaattattacagctcttttagtttagtggttcatttaatattacagttctctatattgaaggccttgcatcagtttctgggccaatgacctgatgacgataacaacaacaacaatagtaatttaaaagtgggctttaccactgttccatatcatttattcccacaataaccctataaaggaagtattcctctagatgagaaaagtgaggctcaatgcatttaagtaacttatccaagggcagagctagtaaagggcagaactgtatatttaacagacacaatgcagtctcttaaaaacaaaatcccttaatgctcacaaaccagtaacccagatacagcccagacacttcaattctctccatcttggagtatggtcatggtctcattttccatcctcagtttccaagaaggctgaagtacccttatttatctaagttctgaattgggtttagggcaccagatctagggatgtttgggaacatcatatacttaaaatttcagaagtcctagggagagcaatcaggcaagagaaataagtaaaaggaatccagataggaaaagaagaagtcaaactatctctctttgctgacaatataattctatacataaagaatcctaaagactccaccagaaggctcccagaactgataaacaatttcagtaaagtttcaggctacaaaatcaatgtattaataaaaaaatcagtagcatttttatacagtaataacgttcaagctaagagtcaaatcaagaacacaatcccatttataatagccacacgaaaaataaaataggaatacatctaaccaagaagatgaaagatctctacaaggagcactataaaacactgctgaaagaaatcataggtgacacaaagggaaaaatattccatgctcatggattggaaaaatcggtattgttaaaatggccataaagcccaaagcgatctacagattcaatgctattcctatcaaacaccaaactatcaatgttgtttttcacagaattagaaaaaaactattctaatactcatatagaatgaaaaaataccccacatagccaaagcattcctaagcaaaaagaagaaagctagaggcatcacattacctgacttcaaactatgttataaagctacagtaaccaaaacagcatggtactggtacaaaaccagacacaaagaccaatagaacaaaatacagtaccccaaaataaagctgcacatcaacagtcgtctaatttttgacaaagttgacaaaaataatcaagaggaaaggactctattcaataaatggtgctgggatagctagctagccatatgcagaagaattcaactgaacccctacctttcaccatatataaaaattaactcaagatggattacagttttaaatgtaaaacctcaaactataagaatagaatcttagaagaaaacttaggcaacaccattctgaacaatgaccttgggaaataatttacaactaagttctcaatagcaattacaacaaaaaaattgacaagcatgacataattaaactaaagagcttttgtgcagcaaaagaaactctcaacagagtaaagagacaacctacagaatggaaaataaatatctgtaaactatgcctctgatgacagtctaatatccaggatctataaggaactgaaatcaacaagcaaaaaatatataaccttgttaaaaagtgggcaaaagacagaaacagacttttctcaaaagaagacatataagtggctgataaacatgaaaaaactgctcaacatcgctaatcatcagagagatgcaaatcaaaaccacaatgagataccatctcacaccagtcagaatggttattatcaaaaagtcaaaaaatgacagatgctggtgaggctgtagagaaaaggggatgctaatgcactgttagttcagtcactgtggaaagcagtttggagacttcccaaagaactaaaaatagacccagcaatcccattacatgccacatgttctcacctataagtggagctaaacatagtgtactcacggacataaagatggcaacaatagacactggggactactggcagggagggagagggcaagggttgaaaaactaactgttgagtactatgttcactacctgagtaacaatatcaatcataccccaaacctcagtatcacacaatatacccaggtaacaaacctgcacatgtaccccctgaatctaaaataaaagttaaaattattgaaaaaaataagatcatttctagtaactggtccaaccctcccctcatcttcctttcctcatctctaattgaccctttctccctgaggttttgcaggttatctgcacacgtgtgggtttgggaggtagagctggatgaaaaataggcataaatttatctctctgggcacctttgtctaaactgatcttaggaatatcttcaaatcatgacaaataaataaaatgatgatttttaaagtatgtgtattgccagattagaaactctttttcaaatgtaagtcctgcatgagacaaagaaaacacctttctttgggtaggaaggggtgggtggtctcacatttagttgaagcatatggctgcatttggagtataaattttttcaattttaaaatgtttactttttcctttataaaaagaacacatgcttgttatgtacaatttgaaaaatatgctgcaaataatttattgaattttttaaagatataaatttatggatattggaagaatctctccctatacagtgatcccactatgctttttctacagctgaaatcagaactggaagaggtcttagaaatcatctagtccgaccacctcctttgacagatgaggaagaacacatgttccgtatgattacattttgatgttctcttatagttggctcattccctaaggattttttaaaaagatttatctttttttaaaaacttgagatactattaaattggctaaaattcaaataaacacatcctccctacattctctctctccatctctgctctgactctcaaagatgcatatgctgcctcttagactgttcaacatatggggcctctgcattgatgccaaaagtccagcagtgtctggaactgccacagggcggcccaccgagagagagcattttgagacaaaggtccagctgcctcattcttgggcagtcactggaagcaagacagcaaaatagctgtggctttgctgaccttctcaggagacctatgggcttgaatctggcctctatctggggagaggtgtagagggactggaaaaagggaataggagaagggaaaagaaaatgagaactaccttggaaacaacagtattgaaagtggattaaccatcgctataaataaaaaacacataacgcacattaaatctcacaataggatttttctgtcatgtgcctacttttagattccaaaagtttttaagtatgacaagattcagagctctttttcaaaagatggaggatccacaggatgggcaggcaccatgagtggggtcaatcagtctttgcctctccattcttctcctttctggtgcataacctttgaaggaagaacatatgtggaagagctatgagtctggtttagcatacataaattctgaaaatatcgtgcttccagacacaactggcttcacatcagaaaaacctttccagggtaaacactttgtttaaatattaaacttaagtaaagccagacgcaagaatacagtctaaatagcaaagaaaggccataatgaccttaagtggaaaagaattaataaaagattccccaagctgacaagcctttctggcacagaatgacagctgcagataccaatgatccctgaagtttttcatttttcagatttgatgcactgccttcggttgtgacaaatacacactccagtttttttaaaccttagcctttgccttgatcgtaggaataagtactctgtttttgtaccttaagattttcttctctaatattttttcccggaattacaaaatcatcatcttaaaacaccattactatgaagtccttagatttcaatgctaatggggaagaagaaggtgcctaaaaacaaggagggaaaatcattcaagacatctccaggacagctccacaaatagaggtataacatttgattctgacctttttaatcttgtattttatttattcctctcagtaaagaaggtttgaaatgtggattaaattttaatccattttgtgtactatatattgcatgaatcaggtaaaagttaacattgtttgttggatgctccaatttactattaaccttcagtcagtcatcagtgtctgcccagtctctactggtcatcaggaaaatcctacagagggccagctggcctcattactgggaataaaatagcacaaatggctcacgaactaatcaattatgcaaatatccttgggtcagagaagatccttactggaagccaatttgatattcttcagcaccagggatttaagtgaaagaaaaacaactaattcagaaagctggagaacagaacctatgaggaaagctaaaataaacaaattagcctcggaaagataaggttgaagaatgttctgaaaaaggtcttcctgtatatatgaaaagcagaaaaggtggttggggaaaggaagaaagaaaaagaataaaatgagaccaatatggtgatgcaaggaatttaacactataactgggagctgagaaagggtgcattcattcactcatctgacattaccccaagagtgtactctcagccagacactagctgtgtgctgcctcagcggaggccaggtacccaccttcctgtgatgatttctgtgaggacttatctaaacacaaagggattgagagtcagcttatttaaaattatttacttcttttttgagggaagtagggcaaggtagagtggaacaggaaaagagcagtcatggaggaggctcagaggtaaaactgcccatgtgttatagctgttacatcccaggacagtctacatgtgggtttgggaagtggaggaggacaaaaaataggcatgaatttatctcttcgggcacatttgtctaaactgatcttagaagtttcttcaaatcacaacaaataaatgacgatttttaaagatgtgtattgccagatcagaaactctttttcaaatttatagtcctatgtaggtgaagtacacggctgcatttggagtatgattttttccattttaaaatgtttactttttcctttataaagagaacacatgaaattatatacagtttgcacaattgcacaatgtataatttgcagtgtattttacactgcaaataatttattgaattttaaagataaagataagagtttacggacattggaagggtctctccttatgtccacactcccctaagtctctcagaatgaaattctttcatttgactctctcctggagttagggtggaagttcacagttaaaataagaaactgagttggagagaaataacattaaatgttaccttattagcaccttaccttgaattagtttattaatttaagcctagagaatggacttgaggaacctgagaagcctcagaaagactcaggctgcagaagaatctctgggaggacaaaagtgaactccattagctgctgtggagttagctatgggcctcgccttggtggggacccgggagcttgaggtagttctttggcaaatatagctgcctttgactgatgtgatgcccccccaagcctggcagcatcatgaacagaaatgtgtgcgaaccccaggagataaaacattttggccaggaccatttgcttaacatgacccttacaggacccagcatgcttttgaagctatgtaacagatgttctcacagcatatgctacatgtagaaatgcttgtgaggtatttcagaatttccacttccctctttagagctgattttggatttcttttcataagcattttaaaacatgttccactcaaactgcctcttccatggtacacatgtacctacgtgctgagaaagtgtcactctccagagggaacagttctgttaatgcaccatcagcatcttcagtaaggtctccagaaggcaacttcttgaaatgctattacaaagcatttttacctttctattctggaagaggactcttagccttcattttattataaaaatgtattagcagaagggccttgtaggttgtaattcatcctttctgaagacagcccctaccctccttttttttcacccccattctctctctgacccacatcctttctgcttcttttattctaatgcatctttccttttccacaattgcatttttttttcttttctacactgccctaggctgtaactcagtttggtctctgtaagcagaattcaggaagtaaaataagaacccatagctggtggcataccgccaaccacacctataagatgctttatctcagtacaccctttcactacttcttcacactcctgagatgaagcccactacactagaaagctttcccttgctctgtactacaacaaaaggccctcagataaagcaagggatcttttaggaagagatgaagaaagaataacgatttagcaactagcattttaaattaaatctacagtttatccagaccatttgtttttattattgtactggtcaccatgacaaccctgagaggaaagcatgttttgtatcatctccatttcatggattaagaaaactgaggctgggtgcggtgactcatgcctgtaatcccagcactttgggaggccgaggcgggcggatcacctgagttcgggagttcaagaccagcctgaccaacatggagagacctcgtctctactaaaaatacaaaattagccaggcatggtggcgcatgcctgtaatcccagatactcaggaggctgaggcaggagaatcacttgaacctgggaggtggaggttgcacctttgcactccagcctgggcaacaagagtgaaactctgtctcaaaaaaagaaggaaggaaggagggaaggaaggaaaaactgaggcttggaataatcacatcacttgcccaagccacacaccaagtttttcaactatccactgctgtgtaacaaaccaatctaaaatttggtggcttaaaaaatcagtgtgtttaactactcatgattctgtgggttggctgggttagctgagcagtccttttgctctacatcatgtccaactgggagcctgcctaaggctggaatgatcaagatggcttcacccccatgtttggctgtaggcactggctgttggccagggcacttccgttctcctccacatgtcccgtcaatcctccaagagctctttcctcatgatttgtccagcaggatagcctagacttaatatgactggggcttccaagagggtgcaaatggaaactgccaggacactgaagcctcaggcctggaagtcacacaccatcacttccactgccttctattggtcaaggtagggtcaaccagattccagggggaggaaatagatctactttctagacaaggaagccacatgcatatataggaatgggaagaattgtgggcagctatatgctgtggtctcagtgtttgtgtcccccccaaattcatatgttaaaacttaatcaccaatgtgatggtattagaaggtgaggcctttgggaggtgatgaggtcatgagggtagagctctcacaaatgggattagtgcccttataaaggaggccccagagagctgccttgcccttctaccatatgaagagagtgaaagacagcaagccatctatgaaccaggaagcaggcccttaccagagactgaatctgtccacatcttgatcatgggcttcttggcaaccagaactgtgacacatttctgtcttttataagctacctgatttatggtattttgttacagcagcctaaacagactaagacactatatttgcagacaatctattaatgccacaccagaagggcatagttggaactcagaaagatcagtgataagccactattccagtaattctttaatgttcaagtctaagattatgatttcattgcaggtgcatgcacaggtgcaggatgttagttccccatttggtctcaggtgatgttggcaccactgccagtttgcctttatgtgtcctttatttgaaaggaagagattaacttaggcttgtatataattattgttaatttggcttaataatcagccttaataattagcctaaagcaaatgttctcaataagaactttaagagcagggtatgaggtgacaaagtatcaacaactggctgaataatgggtacttgctgattaatgttaatggcaaagaaccacttgtcagcagaaatcatgggaaggaggttgtttatgtgactgtctcagcagtcttattgagttttccagcgtgaacgcatgttcggtggtcacccaattaaaccctgtctttagacagatgcattgttacatctgagattcttttaggtctgaaactcctccaatgcctaactcatctaacacgtccacttctctgggccccagcttgtacacacacacaacacgtacacacacacacgggcacacatacagagagtcctaccaccaagaaatgttgtagaacagcttttttaaacaagtgaaaattaagttcaaaactttgttttccagattctcacaaatctcttgaagtgaccagagccctcctggagtgtcacagcctaggctgctgtcactggggcttcacagtcaccatgacacccatggcttcaactcctcctccacctccctcagcaaaggcaggcgccgtgattccctttctgattttgaaccaccatgaaaggtatttcactgctctgtgaaggcatgcctgctttctaagagactttacagctgactcccagctgtttatgtgtctccccattaagctgaatgggaagaagaaagtcacagaggaaaagatctctggggtaagggtgcagggactaggttcagggagaggacactctaaatcctgtttggtatttagtcactgaggcttaagtttagtttggttgtttaaaaaatgtactcatagtaacttaaaaattaaagtaatagccaggtgtggtggctcacgcctgtaatccctgcactttgggaggctgaggcgtgtggatcacctgaggttgggagttcgagaccaccctgaccaacatggagaaaccccatctctactaaaaatacaaaattagccgggtgtgatggcacatgattgtaatcccagctgttcggcaggctgaggcaggagaattgcttgaacccaggaggcggagtttgcggtggacggaatatcgcgctattgcactccagcctgggcaacaagagcgaaactctgtctcaaaaaaaaaaattaaagtaataaatgtacatttaaaaatatttgaaaaaatcctaagatcatagctcgatgcagccttgatctcctgggcttaagtgatcctcccgtctcagcctccttagtagctgggaccacaggcatttgccaccacatctggctaatttttatattttttgtagagacagggtcttactttgttgcccaggctcgtctacaactcttgggctcaagtgatcctcccgccttggcctcccaaaatgctggaattacaggcttgagccatggtgcctggcctgtgtttttgttttcatataatttagtaagtttgtagcagaattgagagcccaaggcagatggatgattgccttgaaaaggtgtcacttttctagttaaatgtcagtcataataaaaccctaagggaggctaattgggccattaatttttaatatcttaacaatgttaacagacttcaaagggagaatctacaacaaagattctaagaagagtgtataaattcaaaagatgttcccacattatcagcattaactgaaagtacttaatatttgctctataaggacagacttaaagaagtccatcaactataaaatttattagtagaaaaatcatattatatatggaggggaaaatcaatgaatacacatatacatcttgggagttttaaaaatattttgcctattttgttaaacctaatatagtactagaaaatgttcatctgggagaggaaatactacatgcatgcacacacagtcataaactgaataatattaaataaatagtaacagcctgaaatgaataattgcagctgaggagtcatgcacatgcacactcagagatgtcactttcattcttcactatctgaccccaggctccagggtaaaatccaagctctcccccaggacacaccaagcattttatgtgcactccctttccacctgtttgcttatcctcccaccgcaccaaagatccagtccaacctgacttcttgcagttttcaaaagtactgagatcccatttggctcagctgatgccccattcctggtcatcctcaacttggcagacccttcttcatgcccatcactcggctcagctgatgccccattcctggccggctccaggtcccttcttggccagccaaggctgaaaggccacctgcctgctagcccatattttctcatcttcatgtctgtcccttactagagtagggctccctgaagacaagagtggcatcttttatgctgcactcccccccaccatcaccaccaccaccccacctgcacttggcacacggcaggaattcaataaatatttattcagtgaataaggtcacgtctcaggggtctgtaacaactaacagcttatctgataggcatttgcaagagatggacgccatgtcaactcctcacagcagccctctgagatgggacatacaagtctaaagcccttttccaaatctcttggggatatatatgtttaggatttcagaaatttgtgtattttagaaaggcaatatgttgtattaaacagtatacaatagccccagaggaatttggggccataccaataatcaaacatgtataatgaaccaaacataatcagccccaaatatgagcaatcatactaaatggaataaagactataaatagactctggtcagttcaagttttattacctactgagtttgcagaaaacttgtgaaaaagccgtccattttacagctttctgtattcagaattgcagataaagaagaacggacctgcacaattatccctatatattttggaaataaagagaggtgccacagaaagggtaaataaactgaccaagatcatacagctaataaactagaatttaatgccttactccagaactctactcttttaaaaaggttaaattatgtaatatttgatatacacaatatatgtgacacatatgtaggttaatgcatagcaattaaaataataaaataaaaccgtacctgccaccttacttagagatatgagcccctgatcttaactcccaggcacaccacctcaggacaggctaagcctaacctatttatggctatgttacataggctgaattttaatggcttaggaatgccaccttcttaggtgggacccaggagatcacacagctatgacaccagtcagactctaccaggggaaattaaatccttttatatgggtcgagtatcttttatctaaaatgcttgagatcagaagtgtttcagactttgaactttttcagatttttgaacattttacattacatataccagttgagcattccaaatctgaaaatccaaaatccaaaatgctctgatgagcactaccctttttttttgagacagagcctcgctctgttgcccaggctggagtgcagtggtgtgatcttggctcactgcaagctctgcctcccaggttcacgccattctcctgcctcagcctctccaatagctgggactacagtcacccgccaccatgcccagctaatttttttttttttttttttttttttttttagtagagacgaggcttcaccatgttagccaggatggtctcgatctcctgacctcgtgatccacctgcctcggcctcccaaaatgctggtattacaggcgtgagccactgcgcccggccaatgagcactacttttttttttttaattatacttttaagttctagggtacatgtgcacaacgtgcactacttttgagtgtcatgtcagtgctcaaaaagttttagattttggaggatttcagattttcagatttggggtgcctaacctctatctcaaggcatctatgaagcagggaggggatgaaatcataatgagaggtgacagcgtgctggcagtcctcacagccctggctcgctctcaccgcctcctctgcctgggctcccactttggtggcacttgaggagcccttcagcccaccgctgcactgtgggagcccctttctgggctggccaaggccagagcccactccctcagcttgcagggaggtgtggagggagaggcgggagcgggaaccggggctgcctgcagcgcttgcgggccagctggagttccaggtgggcctgggcttggcgggccccacactcggagcagctggctgggcctgcaggccccaggcaatgagggacttagcacccgggccagcggctgcggagggtgtactgggtcccccagcagtgccagcccaccgttgctgctctggatttctcgccgggccttagctgccttcccgcggagcaggcctcgggactgcagcctgccatgcctgagcctacccccgcctccgtgggctcctgtgcagcccgagcctccctgatgagcacagccccctgctccacggcacccagtcccatcgatcacccaagcgctgaggagtgcgagcgcatggcgtgggactggcaggcagctccacctgcagcccaggtgcaggatccactgggtgaagccagctgggctcttgagtctggtggggccttggagaacctttatgtctagctcagggattgtaaatacaccaatcggcactctgtatctagctcaaggtttgtaaacacaccaatcagcaccctgtgtctagctcaggggttgtgagtgcaccaatggacactgtatctagctactctggtggggccttggagaacctttatgtctagctcagggattgtaaatacaccaatcggcactctgtatctagctcaaggtttgtaaacacaccaatcagcaccctgtgtctagctcagggtttgtgaatgcaccaatcgacactctgtatctagctactctggtggggccttgaagaacctttgtgtccacactctgtatctagctaatctagtggggacttggagaacctttgtgtctagctcagggattgtaaacgcaccaatcagcaccctgtcaaaacagaccactcggctctaccaatcagcgggatgtgggtggggccagataagagaataaaagcaggctgcccgagctagcagtggcaacccactacggtccccttccacactgtggaagctttgttcttttgctctttgcaataaatcttgctactgctcactctttgggtccacactgcctttatgagctgtaacactcactgcgaaggtctgcagcttcactcctgaagccagcgagaccatgagcccaccgggaggaaggaacaaactccagacgtgccgccttaagagctgtaacactcatggcgaaggtctgcagcttcactcctgagccagcgggaccacgaacccaccagaaggaagaaactccgaacacatccgaacatcagaaggaacaaactccagacgcgccaccttaagagctgtaacactcaccgcgagggtccatggcttcattcttgaagtcagtgagaccaagaacccaccaattccagacacaataatgcttcccagatgtaaaaatgatgcaaatgtgatataaattaacaagggctcttttaaaagcacaatggataaaaatgtaatagtgtgtaagaccaaaacatactgatgtgtgctgcttgtataggctagcataacaagagcactgggctactgacctgagctgctgagacaattaggagttgggaagaaagtgtgaggggttacacacagaaagagtgcttaaggccctgtatatggcatggttatctgcagataaggacaaaacccaaagtggtctgccttgtttaataagatctcccttttaggggcctccaattgaccagaggaatcttcaactcacctagagcaaaggttcagaagatgaaagggctttcacctcagcaaagtggaactgatattgtgggagagttattgagtaatagaccctcatcctcacatcaaacatccctaaccttgccagacaccagcctctcccagacagctcactgaagaagaggtccaaccaagaccatggctggaacctggatgctctgaacaggtgatggcaacaatgaggtctctggggaggagtaaggatatgtgtgtgtgtgtgtgtgtgtgtgtgtgtgtgtgtgtgtgtgtgtgaagtgggtgggggggggagagagagaatatgaatgaagactctggaaaaatataccttttgaaaaagccacaggccaggtgcggtggctcacacctgtaatcccagcactttgggagggaggccgaggcgggtggatcacgaggtcaggagatcgagaccatcttggctaacatgatgaaatgctgtctctcctaaaaatacaaaaaaattggccgggcgtggttgtgggtgcctgtagtcccagctactcgagaggctgagacaggacaatggcatgaacccaggaggtagagcttgcagtgagccgagatcccaccactgcactccagcttgggcaacagagtgagactccatctcaaaaaaaagaaaaagccagaattctgtgttcacagaatcttattttgcctctgaacactgttattccctgactggtggtggagtggcaatcctgatggaaggacctacaggaccagaaggagccatattcatgtgccacctcagaaacctctgtcgctgctcgcccattctacctttagctctccaatgtgatcactgacttaaaagtcaaagggcagacaaatgcttcaaataaaactagataacagatatcccttgcaaaaaggagtcctagaatcgctatggaaaacacacacacacacacacacacacacacacacaggcatgcatacatatgtgcacaccttagttgtattctgtggatatttagatagatatttaatagatacttaaagaaaggacaagtaaacatcctagggcaaggaatcaagctggaaacttgcttcatccacatgacattcagtgaaagctgagaaaaagggaaaataaactgaagcaacatgaagtaaagaggttgcctaagaagagtcccttgtatgaaaacagatgtttatacctaaacatataaagtgttaatacctaaactataaaaaacccaaaacctcccaagtgtttgcagctgaagtcatttccagcttttcatgactgtcatgggtagctttggggaatatcatacatgaagggaatcctctttccatgggaaattttgacaatttgtggacacaagaaaaagggtgaagcctgaggcatgtgacacatcatctgaggcaccttttcggtggggatttctctcaggaagaggtccagcagctctctgtttggatgtgactttgctcttttattcaactaatatttggattaatacatcttcttctgtgagttttcacatcagtattccctcctctttaccttgtcttttcccccaaacacacaccacacacattgtgagtcagtagctcacccccagtgggtcagagaactaacttccagcaatcatttctccccattacaagctgtggggaactgtgtgggcctgcagattgctcagggctcccctaacagccccacgctgtacgctgtgtgccttgtgctcacagagcatcaaaagatgctcacagagttcaaaagagagcatcatattgaagacctggctccttataaatgcagtctgtcatgtttgagcagagattctgagacagttgtagcttgttgccttatatttggctgctgctaaagtgtggcccatggacctgcagcatctgcaacacctgaccgtttgtcagaaacgtagaacctcaagcccacaacagaactgcagaatctaaatttgcaatttaacaatgtccccaaatgattttagctgcacatcaaaatttgagaagtactggtttatggcactttatcgcatttattttatttaagaaatagttgcattaattactataagccaagcactcttaaaaacacatttttcgactcaggaggctgaagcaggaagatggcttgaggccaggagtttgagaccagcctgggcaaaatagtgagatcccatctctaaaacagtttttaaaaaatcagtcaggcatggtggtgcacacctgcagtctcagctacgcaagaggctgacacaggaggactgcttgagctcaagagttcaaggctgcaatgagccatgatcatgtcactgtactcaagcctaggcaacagaccaagaccctgacttaaaaaaacaaacaataaaaaccacgtttttcaaataactcatttactcctaagaacagccccctttataattgtatggtcaatagatactattaagcttccattttacagatgaggaaaccaaggcatgaaagtgtgaagtttttgcccaaagttacatggccagtatggagtggagaggagattagaactccagaatccattgtatatgccacaactctatgctgcctaccccttggacacatacaagaaataattagaaggtccaggtatggtggctcatgcctgtaatcccagggctttggggaggccgagttgggaggactgcttgagcccaggagtctgagactacagtgagttatgatcatgccactgcactccagcctgagtgacagagtgggaccatgtttcttaaaaaaactgttttaattttttaaaaaagaaataattagaatggattttaaggatgaacaacttgcaccagtaaaaaaaaaaaaaaaaaaaaaaaattctgacaggtgtttacaacaataattgtggaagctacagattatagtagagatgttctactccaaagggactattcactgagggaggcatgtaagaagtgaaaggttttcccatcccatgccatcgagcacccaggaaaagcaggagtgacaatttgctaaatagaggacacactaggttaaaaattattacatatgaatatgtctttaggacactgtgaatgtaagtctgactggtaaagtaaaagggtttaacctgcatgcctgagaaccttagcctgttaatgcccacaaaaaaaattagaaactgaggagaaaagaaagattttaaaaatggtattttcttgctttacttttcaaagtcaggtcaaaatactttaaaactagttgcagaccactggtagagctaggcctctggccttctggaaccatccatgtggggatgtgactctggctaacccagccattcacccactttctacttttgtttctgggccttgcctccttttaaaacacctcatgcacaactctgatctccaatttgtccacagacttggattttccgggctgcttgtttcatagttcccagggcagcattcaacagaaacactgggaaatagcacctcaggctgccatattttcctgaagcctccagaaagtggatttcattccagtcgaaacaacacttttaacacatttagaaatgtcattaacagtattgtatagctatcagcctagaatctgtgaatttactcaatcttgagtccagatggcatgcacaaaggacagagggcagttatatcagattccgacaatgtgagaaaaaccccaacagcaatttgttctccagtaactccagaaaaagcctagaaacccctcaaaaaataactttttatgttcatgaaaatacactgcttctgcaaatttaaagaaatgtactagtaagccaattatgcaaaaaaggcaacattttgggttaattctaagaagcaaaaggacttcattgattctttccacaaatatttactgaatagtaacaatgtgccaggttactgtgctaggcctggggattcaatggtgaataaagagggacacagtctctgctctcatggagctcaaggttgggtgggccaaaaagatattaaccaacaattcccacgaatgaacatatcattacaaatggagataagtaacacaagaaatacttagaagataatattaaaagaaagaagataataataaaagaaagatgagagggccagggaaggctgaaaaagtgtcccctgagctgagtttacagtttgagaacagctggatgtatccagtgcacaggagctagatagggagtgagagcagaacacactggagaaactgaaattcagaaaagaagagagtggttgatgtacagagagcctagaggagagagggcaagatgaggtaggagaggaagcctttttggccctgcatggttaagaattatgactcacttgaagggttgtaagcaggggcaaggtgagcagattagcacttcaaaaagatctctctaggtacagtgtggaggactgcattggagggaggccaaaggagagatgggaaggccagttaggaatatttgaagtgctccaagtgagacaattagggtaatcataagggagatggaaagaagtagacagatttgagagagatttaaaaggtaaaataataggacttggtgatgaaatcaacatgggagttcatggaaaaggagagctcaaggatctttccaagtttgttctggcttcccgtaagtgggtgtacatggtcacattcactgagagagcaagcctggaagattagttttgtgggaagaatcctgaatccattgttggacttgtggagtttaaaatgccttacaaatacctggcaggagatgatttataggcagttgggtcaattagttatgcaagtctgagatgcagaaaagaggaccgagctggacatttactaagggagtcactgtcacatacaaagagaactgaagctgaaacgtaaataagagacgaaacgtaaatacctagagagaatgtctgaggttaaaagagaagtgagcaaaaattgatgccttaaaatattctaacactcaatagctaggtagaggaggataagcctgcaaaggagatagaaaggaatgagccaaagaggtgggagaacagcaagaagactgtggggtcttggcagccaggaaaaggggatgcgtccagaggcaggcaatgggcaacacagtcaatggctgaaaggtgatacaggcaaggggaaaacaccctttttatttactgacaaggtcactagtgaccttagcattgattcaatgaagtgacaatagggcaccatgaagtgacaaatgccagaactcagtgggttgaggagtttatgagaagcaagaaaatggagacagtaaatataggcaatcaaacagaatcaagcaggaaactcaattagactaaaagccaaagtcctcacaataatctgcaaggccataaaatctgccccctcactacttctcttctactactcttcttttctcactccagccacactggcctgcttattctttgaatgcaccagcttccacctcatggcttttgcctttgctgttcctttaatcaggaactttcttccttcacagaaataaatggctgctccctagccctcaggtctttgcccccaaaattattctctcatcaaggtctctcctaactacttcatttaatattaaaattagcctctcacccctgaactcccttcactattcccttccctgcctttatttggtatttcttactctctaacatatcatgctttgtttttgtttatttatctcacctcctgtcccatgtaagtttcttaaggttggctattttgttcactgctatattctcaatgcttagaagagtcactagtacatagtatgcactcaataaatgtatgttgaataaaatatttgaataaattaaataactttaatatatactatcaaatagcaacaagaaaaaaaaaaggctaaaaaagctccactcatggcagcaataaaatgtagggggaaaattagagaaacaaaataaaatgaaaaataaagcataagttgattgtattaggaaaacttcactgactgacataaaaaagacttgaataaatgtagagacatataatccctcttaacaaaaaattggcttgcagagatatcaattctctttacatcaatttagaaacgtatcctatttccaattaaaattcaatggaattttaaagtccttttgggaggaaaaatatgcctgaaaatagccaagatttttttttttgtggggcggagggagacaatgaggaagggaggccacataaaatattaaaccatgttataaagcaacagtattgagctaagaacaggtagatcaagaaaaaaaaaaaagatccataatgagatgcaaatatatgtttttcaaagttgtacacacattaaattatgtattttcaagtcagtagagattcatcacatggaagtaggaaaaatggttaaccatttgggggaaaattatgttttctatcatgtgctaaaaattcatatacacaaaaattcctgaggcattagatatttaactccaaaataaacccataaaatacttataagaaaataatgtcaatatttatctactgagctcagtagagagagttttaacatacgcaaaaggaaaaagtgaagaaaaagattgacagtgatagatttggctgcataaccatataaagcttatattttgcaaaaggtattacaaaatttaaaacaagacgaacattttaggaaaatatttgcaacctgacaaaagattaggatctctaatatacgaagacctcttagaaatcaaaagaaaaatacaaattcctaacagaagaaagtgagcaaaaagaaaattcacaaattagaaatacagatagtcaataaataaatgaaaaagatgtccaaactcactaggattcaaagaattgtaaagttaaataatgttataccatattcagatgttagatgatggagatttagaaaggttataatagttaatgttactgaatagataagaaaatgggcactcttatagactgctgatgttaaactctgaaaagcaattaggaatacattaacccacattttttttttttttagatggagtctcgttccatcgctcaggctggagtgcggtggcgcgatctcggctcactgcaacctctgcctctagggttcaagcgattcccctgcctcagcctcctgggtagatgggactatagggaacagtgtgagccatagctagagtcaatctggctggaagcaaagaaagaggctgagatctaggagggtaggtgaagttgagtagccattcttttttttttttaattttattattattatactttaagttttagggtacatgtgcacaacgtgcaggtttgttacatatgtatacatgtgccatgctggtgtgctgcacccaccaactcgtcatttagcattaggtatatctcctaatgctatccctcccccctccccccaccccacaacacttcccgatgtgtgatgttccccttcctgtgtccatgtgttctcattgttcaattcccacctatgagtgagaacatgtggtgtttggttttttgtccttgccatagtttgctgagaatgatggtttccagtttcatccatgtccctacaaaggacacaaactcatcattttttatggctgcatagtattccatggtgtatatgtgccacattttcttaatccagtctatcattgttggacatttaggttggttccaagtctttgctattgtgaatagtgctgctataaacatacgtgtgcatgtgtctttatagcagcatgatttataatcctttgggtatatacccagtaatggaatggctgggtcaaatggtatttctagttctagatccctgaggaatcgccacactgacttccacaatggttgaacgagtttacagtcccaccaacagtgtaaaagtgttcctatttctccacatcctctccagcacctgttgtttcctgactttttaatgatcgccattctaactggtgtgagatggtatctcactgtggttttgatttgcatttctctgatggccagtgatgatgagcactttttcatgtgttttttggctgcataaatgtcttcttttgagaagtgtctgttcatatcctttgcccactttttgatggggttgtttgtttttttcttgtaaatttgtttgagttcattgtagattctggatattagccctttgtcagatgagtaggttgcaaaaattttctcccattctgtaggttgcctgttcactctgatggtagtttcttttgctgtgcagaagctcttcagtttaattagatcccatttgtcaattttggtttttgttgccattgcttttggtgttttagacatgaagtccttgcccatgcctatgtcctgaatggtattgcctaggttttcttctagggtttttatggttttaggtctaacatgtaagtctttaatccatcctgaattaatttttgtataaggtgtaaggaagggatccagtttcaactttctacatatggctagccagttttcccagcaccatttattaaatagggaatcctttcccattgcttgtttttgtcaggtttatgaaagatcagatagttgtagatatgcagcattatttctgagggctctgttctgttccattggtctatatctctgttttggtaccagtaccacgctgttttggttactgtagccttgtagtatagtttgaagtcaggtagcgtgatgcttccagctttgttcttttggcttaggattgacttggcgacacgggctcttttttgtttccatatgaagtttaaagtagttttttccaattttgtgaagaaagtcattggtagcttgatggggatggcactgaatctataaattaccttgggcagtatggccattttcacgatattgattcttcctacccatgagcatggaatgttcttgcatttctttgtatcctcttttatttcattgagcagtggtttgtagttctccttgaagaggtccttcacatcccttgtaagttggattcctaggtattttattctctttgaagcaattgtgaatgggagttcactcatgatttggctgtttgtctgttattggtgtataggaatgcttgtgattttttgcacattgattttgtatcctgagactttgctgaagttgcttatcagcttgaggagattttgggctgagacaatggggttttctagatatacaatcatgtcatctgcaaacagggacaatctgacttcctcttttcctaattgaatacactttatttccttctcctgcctgactgccctggccagaacttccaacactatgttgaataggagtggtgagagagggcatccctgtcttgtgccagttttcaaagggaatgcttccagtttttgcccattcagtataatattggctgtgggtttgtcatagatagctcttattattttgagatacataccatcaatacctaatttattgagagtttttagcatgaaaggttgttgaactttgtcaaaggccttttctgcatctattgagataagcatgtggtttttgtctttggttctgtttacatgttggattacatttattgatttgcgtatgttgaaccagccttgcatcccagggatgaagcccacttgatcatggtggataagctttttgatgtgctgctggattcggtttgccagtattttattgaggatttttgcatcgatgttcatcaaggatattggtctaaaattctcttttttggttgtgtctctgcccggctttggtatcaagatgatgctggcctcataaaatgagttagggaggattccctctttttctattgattggaatagtttcagaaggaatggtaccagctcctctttgtacctctggtagaattcggctgtgaatccttctggtcctggactttttttggttggtaagctattgattattgcctcaatttcagatcctgttattggtctattcagagattcaacttcttcctggtttagtcttgggagggtgtatgtgtcgaggaatttatccatttcttctagattttctagtttatttgcatagaggtgtttatagtactctctgatggtagtttgtacttctgtgggatcggtggtgatatcccctttaacattttttattgtgtctatttgattcttctctcttttcttctttattagtcttgctagaagtctatcaattttgttgaccttttcaaaaaaccagctcctggattcattaattttttgaagggttttttgtgtctctatttccctcagttctgctctgatcttagttatttcttgccttatgctagcttttgaatgtgtttgctcttgcttttctagttcttttaattgtgatgttagggtgtcgattttagatctttcctgctttctcttgtgggcgtttagtgctagaaatttccctctacacactgctttgaatgtgtcccagagattctggtatgttgtgtctttgttctcgttggtttcaaagaacatctttatttctgccttcattttactatttacccagtagtcattcaggagcaggttgttcagtttccatgtagttgtgcggttttgagtgagtttctcaatcctgagttctagtttgattgcactgtggtctgagagacagtttgttataatttctgttcttttacatttgctgaggagtgctttacttccaactatgtggtcaattttggagtaggtgtggtgtggtgctgaaaagaatgtatattctgttgatttggggtggagagttctgtagatgtctattaggtcacttggtgcagagctgagttcaattcctgggtatccttgttaactttctgtctcgttgatctgtctaatgttgacagtggggtgttaaagtctcccattattattgtgtgggagtctaagcctctttgtaggtcactaaggacttgctttatgaatctgggtgctcctgtattgggtgcatatatatttaggatagttagctcttcttgttgaattgatccctttaccattatgtaatggccttctttgtctcttttgatctttgttgtttaaactctgttttatcagagactaggattgcaacctctgcctttttttgttttccatttgcttggtagatcttcctccatccctttattttgagcctatgtgtgtctctgcacatgagatgggtttcctgaatacagcacactgatgggtcttgactctttatccaatttgccagtctgtgtcttttaattggagcatttagcccatttacatttaaagttaatattgttatgtgtgaatttgatcctgtctttatgatgttagctggttattttgctcgttagttgatgcagtttcttcctagccttgatcgtctttacaatttggcatgtttttgcagtggctggtaccagttgttcctttccatgtttagtgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattcgtccccactctcttctggcttgtagagtttctgccgagagatcagctgttagtctgatgggcttccctttgtgggtaacctgacctttccctctggctgcccttaacattttttccttcatttcaactctggtgaatctgagaattatgtgtcttggagttgctcttctcgaggagtatctttgtggcattctctgtatttcctgaatttgaatattggcctgccttgctagattggggaagttctcctggataatatcctgcagtgttttccaacttggttccattctccctgtcactttcaggtataccaatcagatgtagatttggtcttttcacatagtcccatatttcttggagactttgttcgtttctttttattcttttttctctaaacttctcttctcacttcatttcattcatttcgtcttccatcactgataccctttcttccagttgattgcatcggctactaaggcttctgccttcgtcacgtagct

SEQ ID NO: 12149 - DNA, 3499 bp, Homo sapiens
gtttcagctttctacatatggctagccagttttcccaacaccatgtattaaatagggaatccttttcccgtttcttgtttttgtcaggtttgtcaaagatcagatggttgtagatgtgtggtattatttctgagggctctattctgttccattggtctatatctgtgttttggtaccagtaccatgctgttttggttactgtagacttgtagtatagtttgaagtcaggtagcatgatgcctccagctttgttcttttggcttaggattgtcttggcaatgtgggctcttttttggttccatatgaactttaaagtagttttttccaattctgtgaagaaagtcattggtagcttgatggggatggcattgaatctataaattaccttgggcagtatggccatttccatgatattgattcttcctatccataagcatagaatgttccttcatttgtttgtgtcctcttttatttcactgagaatggtttgtagctctccttgaagaggtccttcacatcccttgtaagttggattcctaggtattttattctctttgaagcaattgtgaatgggagttcactcatgatttggctctctgtttgtctgttattggtatataggaatgcttgtgatttttgcacattgattttgtatcctgagactttgctgaagttgcttatcagcttaaggagattttgggctgagacgatggggttttctaaatatacaatcatgtcatctgcaaacggggacaatttgacttcctcttttcctaattggataccctttatttctttctcctgcctgattgccctggccagaacttccaacactatgttgaataagagtggtgacagttttcaaagggaatgcttccagtttttgcccattcaggatgatattggctgtgggtttgtcataaatagctcttattattttgagatacgtcccattgatacctaatttattgagagtttttagcatgaagggctgttgaattttgtcaaaggccttttctgcgtctattgagataatcatgtggtttttgtctttggttctgtttatatgatggattacgcttattgatttgtgtatgttgaaccagccttgcatcccagggatgaaaccaacttgatcatggtggataaactttttgatgtgctgctggattcggtttgccagtatttcactgaagatttttgcatcgatgttcatcagggctattggtctaaaattctctttttttgttgtgtctctgccaggctttggtatcaggatgatgctggcctcataaaatgaattagggaggattccctctttttcttttgattggaaaagtttcagaaggaatggtaccagctcctccttgtacctctggtagaattcggctgtgaatcagtctggtcctggacttcttttggttggtagcctcttaattattgcctcaatttcagagcctgttattggactattcagggattcaacttcttcctggtttagtcttgggagggcatatgtgtccaggaatttatccatttcttctagattttctagttgatttgcatagaggtttttatagtattctctgatggtagtttgtatttctgagggattggtggtgatagcccctttatcattttttattgtgtctatttgattcttctctcttttttcgttattagtcttcctagtggtctatcaattttgttgatcttttcaaaaaaccagctcctggattcattgattttttgaagggttttttgtgtctccatctccttcagttctgctctgatcttagttatttcttgccttctgctagcttttgaatgtgtttgctctggcttctctagttcttttaattgtgatgttagggtgtcaattttagatctttcctgctttctcttgtgggcatttagtgctataaatttccctctacacacgctttaagtgtgtcccagagattctggtatgttgtgtctttgttctcattggtttcaaagaacatctttatttctgccttcatttctttatgtacccagtagtcattcaggagcaggttgttcagtttccatgtagttgagcggttttgagtgagtttcttaatcctgagttctagtttgattgcactgtggtctgagagacagtttgttataatttctgtccttttacatttgatggggagtgctttacttccaactatgtggtcaatattgaaataagtgcaatgtggtgctgagaggaatgtatattctgttgatttggggtggagagttctgtagatgtctattaggtctgcttggtgcagagctcagttcaattcctggaaatctttgttaactttctgtctcgtggatctgtctaatgttgacagtggggtgttaaagtctcccattattattgtgtgggagtctaagtgtctttgtaggtctctaaggacttgctttatgaatctgggtgctcctgtattgggtgcatatatatttaggatagttagctcttcttgttgaatggatccctttaccattacgtaatggccttctttgtctcttctgatctttgttggtttaaagtctgttttatcagagactaggattgcaacccctgcctttttttgtgttttccatttgctttgtagatcttcctccatccctttattttgagcctatgtgtgtctctgcacgtgagatgggtttcctgaatacagcacactgatgggtcttgactctttatccaatttgccagtctgtgtcttttaattggagcatttagcccatttacatttaaggttaatattgttatgtgtgaatttgatcctgtcattatgatgttagctggttattttgctcgttagttgatgcagtttcttcctagccttgatggtctttacaatttggcatgtttttgcagtggctggtaccagttgttcctttccatgtttagtgcttccttcaggatttcttgtaaggtaggcctggtggtgacaaaatctctcagcatttgcttgtctgtaaaggattttatttgtccttcacttatgaagcttagtttggctggatatgaaattctgggttgaaaattcttttctttaagaatgttgaatattggcccccactctcttctggcttgtggagtttctgccgagagatcagctgttagtctgatgggcttccctttgtgggtaacccgacctttctctctggctgcccttaacattttttccttcatttaaactttggtgaatctgacaattacgtgtcttggagttgctcttctcgaggtatgtctttgtggcattctctgtatttcctgaatttgagtgttggcctgccttgctagattggggaagttctcccggataatatcctgcagagtgttttccaacttggttccattctccccgtcactttcaggtacaacaatcagacgtagatttggtcgtttcacgtagtcccatatttcttggaggctttgttcatttctttttactcttttttctct

SEQ ID NO: 12150 - DNA, 3013 bp, Homo sapiens
gactgacttggtgatgtgggctcttttttggttccatatgaactttaaagtagttttttccaattctgtgaagaaagtcattggtagcttgatggggatggcattgaatctataaattaccttgggcagtgtggccattttaacgatactgattcttcctacccatgagcatggaatgttcttccatttgtttgtaccctcttttatttcattgagcagttgtttgtagttctccttgaagaggtccttcacatcccttgtaagttggattcctaggtattttattctctttgaagcaattgtgaatgggagttcactcatgatttggctgtttgtctgttattggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtcccatcaatgcctaatttattgagagtttttagcatgaagggttgttgaattttgtcaaaggccttttctgcatctattgagataatcatgtggtttttgtctttggttctgtttatatgctggattacatttcttgatttgcgtatattgaaccagccttgcatcccagggatgaagcccacttgatcatggtagataagctttttgatgtgatgctggattcggtttgccagtattttattgaggatttttgcatcaatgttcatcaaggatattggtctaaaattctcttttttggttgtgtctctgcccggctttggtatcaggatgatgctggcctcataaaatgagttagggaggattccctctttttctattgattggaatagtttcagaaggaatggtaccagttccgccttgtacctctggtagaattcggctgtgaatccatctggtcctggactctttttggttggtaagctattgattattgccacaatttcagagcctgttattggtctattcagagattcaacttcttcctggtttagtcttgggagggtgtatgtgtcgaggaatttatccatttcttctagattttctagtttatttgcgtagaggtttttgtagtattctctgatggtagtttgtatttctgtgggatcggtggtgatatcccctttatcattttttattgtgtctatttgattcttctctcttttcttctttattagtcttgctagcagtctatcaattttgttgatcctttcaaaaaaccagctcttggattcactaatttttggaagggttttttgtgtctctatttccttcagttctgctctgatttcagttatttcttgccttctgctagcttttgaatgtgtttgctcttgcttttctagttcttttaattgtgatgttagggtgtcaattttggatccttcctgctttctcttgtgggcatttagtgctataaatttccctctacacactgctttgaatgtgtcccagagattctggtatgttgtgtctttgttcttgttggtttcaaagaacatctttatttctgccttcatttcattatgtacccagtagtcattcaggagcaggttgttcagtttccatgtagttgagcggttttgagtgagtttcttaatcctgagttctagtttgattgcactgttgtctgagagacagtttgttataatttctgatcttttacatttgctgaggagagctttacttccaagtatgtggtcaattttcgaataggtgtggtgtggtgctgaaaaaattgtatattctgttgatttggggtggagagttctgtagatgtctattaggtctgcttggtgcagagctgagttcaattcctgggtatccttattaactttctgtctcgttgatctgtctaatgttgacagtggggtgttaaagtctcccattattattgtgtgggagtctaagtctctttgtaggtcactcaggacttgctttatgaatctgggtgctcctgtttgggtgcatatatatttaggatagttagttcttcttgttgaattgatccctttaccattatgtaatggccttctttgtctcttttgatctttgttggtttaaagtctgttttatcagagacaaggattgcaacccctgcctttttttgttttccatttgcttggtagatcttcctccatccttttattttgagcctatgtgtgtctctgcacgtaagatgggtttcctgaatacagcacactgatgggtcttgactctttatccaatttgccagtctgtgtcttttaattggagcatttagtccatttacatttaaagttaatattgttatatgtgaatttgatcctgtcattatgatgttagctggttattttgctcgttagttgatgcagtttcttcctagccttgatggtctttacaatttggcatgattttgcagtggctggtaccagttgttcctttccatgtttagtgcttccttcaggagctcttttagggcaggcctggtggtgacaaaatctctcagcatttgcttgtctgtacacttatgaagcttagtttggctggatatgaaattctgggttgaaaattcttttctttaagaatgttgaatattggcccccactctcttctggcttgtagagtttctgctgagagatcagctgttagtctgatgggcttccctttgtggataacccaacctttctctttggctgcccttaacattttttccttcatttgaactttggtgaatctgacaattacgtgtcttggagttgctcttctcgag

SEQ ID NO: 12151 - DNA, 1817 bp, Homo sapiens
gttattggtctattcagggattcgacttcttcctggtttagtcttgggagggtgtatatgtccaggaatttatccatttcttctagattttctagtttatttgcatagaggtgtttatagtattctctgatgatagtttgtaattctgtgggatcagtggtgataactcctttatcattttttattgtatctatttgattcttctctcctttcttctttgttagtcttgctagcggtctatcaattttgttgatcttttcaaaaaaccagctcctggattcattgattttttgaagggttttttgtgtctctatctccttcagttctgctctgatcttagttatttcttgccttctgctagcttttgaatgtgtttgctcttgcttctctagttcttttaattgtgatgttagagtgtcaattttagatcttttctgctttctcttgtgggcatttagtgctataaatttccctctatgcactgctttgaatgtgtcccagagattctggtatgttgtgtctttgttctcattggtttcaaagaacatctttatttctgccttcatttcattatgtacccagtagtcattcaggagcaggttgttcagtttccatgtagttgagcagttttgagtgagtttcttaatcctgagttctaatttgattgcactgtggtctgagacagagtttgttatagtttctgttcttttacatttgctgaggagtgctttacttccaactatgtggtcaattttggaataagtatgatgtggtgctgagaagaatgtatatgctgctgatttgtagtggagagttctgtagatgtctattaggtccacttggtgcagagctgagttcaagtcctggatatccttgttaactttctgtcttgttgatctgtctaatgttgacagtggggtgttaaaatctcccattatgattctgtgggagtctaagtctctttgtttctaggtctttaaggacttgctttatgaatttgggtgctcctgtattgggtgcatatatatttaggatagttagctcttcttgttgaattgatccctttaccattatgtaatggccttctttgtctcttttgatccttgctggtttaaagtctgttttatcagagactaggattgcaacccctgcctttttttgttttccatttgcttggtggatcttcctccatccctttattttgagcctatgtgtgtctctgcacatgagatgggtctcctgaatacagcacactgatgggtcttgactctttatccaacttgccagtctgtgtcttttaattggagcatttagcccatttacatttaaggttaatattgttacatgtgaatttgatcctgtcattatgatgttagctggttattttgctcattagttgatgcagtttcttcctagcatcgatggtgtttacaatttggcatgtttttgcagtggctgatactggtttttcctttccatgtttagcacttccttcaggagctcttgtagggcaggcctggtggtgacaaaatctctcagcatttgcttgtctgtaaaggattttatttctccttcacttatgaagcttagtttggctggatatgaaattctgggttaaaaattcttttctttaagaacgttgaatattggcctttactctcttctggcttgtaaagtttctgctgagagatccgctattaggctgatgggcttccctttgtgggtaacctgacctttctctctggctacccttaacgttttttcctttatttcaaccttggtgaatctgacaattatgtgtcttggggttgctcttc

SEQ ID NO: 12152 - DNA, 7359 bp, Homo sapiens
  misc_feature (5757)..(5757): n equals a,t,g, or c
tcccaaagtgctgggattacagatgtgagccaccacgcccggcttaattttcttataatccgaattatcatctgctggtttggaagcaatacatattaatattcattttagtatccattcttattcttaataattcttttgtttgaatgattttatttaaaaatttgttatttagtatttctaacttctttaacaaaggaacttgttgaataactcccattttagtctttttatctaaaaacaatattgttaaacacagaaattatattattttaatatggctattttcctttttttttttttttttgagacagacaggatcatgcactggcatgacctcagctcactgcagcctcaacctccctcagctcaagtgatcctcccactttagcctccccagtagctgggactacagatgcgagcccccacgtcctgctaatttttctgctttttgtacaaaaagtgcaagaagagatggggttttgatatgttgcccaggcttgtctttaactcctgggctcaagcaatctttctgcctcggcctcccaaaatgctggtattataggtgtgagccactgtgcccagctaactattttttattgttaattaaatttagtgatgttttattcatccctgtgcttagcattgtattttgaatcccacaacttctctcttggtttattttactttggactgaaatacaactttgtaattgatcttttttttttcttttagagacagactctcactctgttgcccagattgaagtgcagtggtatgattatagcttatgcagcctcgaactcctggactcaagtgatcctcctgcctcagcctccagagtagctgggactacaaggacctgttactacacccgtctacctttaaaaattttttttgtagtgaaggggtcttgctatgttgctgaagctggtctcgaactcctggcctcaaacaatctacccaccttgtaatcgtgttttttattttctgatgcttttacatctctggacattgctaaccctggagggactgcccctcccagggccaaccaatttgtagagttagtaaacaactcccccgagaataggctttctgtatgcaaaccaaccaatgaagagcccatttcccaatcacaggccctaatcaccctatggcccggtaccagataattcaggacatttccattccccatgaggattaaaagcctgctgaaaccattcaagctagccactcgtaagcctgcttcccctcctttgtccttttcttcccatagaaactgtaataaaaaggctcttacccacatttcctcctcactccctctgcccctgacccaccgtgccatgcctggcatgtggtacctccagtttctatctagctatgagtaaaacaaacttctttcttcatgacagccatttctgtgtttgtgtgtcttaccacacctgattaaagcaaaacccagtggcccttaaaacaaaccatgcctttagtgagaatctatcggtggtgagccctcttagttttttggttataaaaacttttattactcctcataaatgatagtttatgtggcataaaattctaagttgacagtttttttaccctcagtcctttggaagctgttcctccattttcttggctctcattttgctgatgaaaagtcttccatcagtttagttgttgcgctcttagcaatttatatttcctttctggtagcttttaacattttattttattttattatcttttattatactttaagttttagggtacatgtgcacaatgtgcaggtttgttacatatgtatacatgtcccatgttggtgtgctgcacctattaactcgtcatttaacattaggtatatctcctaatgctatccctcccccttcccccgacccgacaacaggcccatgtgtgaaatgttccccttcctgtgtccatgtgttctcactgttcaattcccacctatgagtgagaacatgtggtgtttggttttttgtccttgcgatagtttgctgagaatgatggtttccagcttcatccatgtccctacaaaggacatgaactcatcattttttgtggctgcatagtattccgtgatgtatatgtgacacattttcttaatccagtctatcattgttggacatttgggttggttccaagtctttgctattgtgaacagtgccgcaataagcatacgtgtgcatgtgtctttatagcagcatgatttataatcctttgggtatatacccagtaataggatggctgggtcaaatggtatttctagttctagacccctgaggaatcgccacactgacttccacaatggttgaactagtttacagtcccaccaacagtgtaaaatgttcctatttctccacatcctctccagcacctgttgtttcctgactttttaatgatcgccattctaactggtgtgagatagtatctcattgtggttttgatttgcatttctctgatggccagtgatgatgagcatattttcatgtgtcttttggctgcataaatgtcttcttttgagaagtgtctgttcatatcctttgcccactttttgatggggttgtttgtttttttcttgtaaatttgtttgagttcattgtagattctggatattagccctttgtcagatgagtagattgcaaaaattttctcctattctgtaggttgcctgttcactctgatggtagtttcttttgctgcgcagaagctctttagtttaattggatcccatttgtcaattttggcttttgttgccattgcttttggtgttttagtcatgaagtccttgcccatgcctatggcctgaatggtattgcctaggttttcttctaggatttttatggttttaggtctaacatttaagtctttaatccatcttgaattaatttttgtataaggtgtaaggaagggatccagtttcagctttctccatatggctagccagttttcccagcaccatttattaaatagggaatcctttccctatttcttgtttttgtcaggtttgtcaaagatcagacagttgtagatatgtggcattatttctgagggctctgttctgttccattggtctatatctctgttttggtaccagtaccatgctgttttggttactgtagccttgcagtacagtttgaagtcaggtagcatgatgcctccagctttgttcttttggcttaggattgacttggcaatgcgggctcttttttggttccatatgagctttaaagtagttttttccaattctgtgaaaaaagtcattggtagcttgatggggatggcattgaatctttaaattaccttgggcagtatggtcattttcaactacccatgagcatggaatgttcttccatttgtttgtatcctcttttatttcattgagcagtggtttgtagttctccttgaagaggtccttcacatcccttgtaaggtggattcctaggtattttattctctttgaagcaattgtgaatgggagttcactcctgatttggctctctgtttgtctgttattggtgtataggaatgcttgtgatttttgtacattgactttgtatcctgagactttcctgaagttgcttatcagcttaaggagattttgggctgagacgatggggttttctagatatacaatcatgtcatctgcaaacagggacagtttgacttcctcttttcctaattgaataccgtttatttccttctcctgcctaattgccctggccagaacttccaacactatgttgaataggagtggtgagagagggcatccctgtcttgtgccagttttcaaagggaatgcttccagtttttgcccattgagtatgatactggctgtgtgtttgtcgtagatagctcttactattttgagatatgtcccatcaatacctaatttatggagagtttttagcacaaagcttgttgaattttgtcaaaggccttttctgcatctattgagataatcatgtggtttttgtcattggttctttttatatgctggattacgtttattgatttgcgtatattgaaccagccttgcaccccagggatgaagcccacttgatcatggtggataagctttttgatgtgctgctggatttggtttgccggtattttattgaggatttttgcatcgatgttcatcagggatattggtctaaaattctctttttttgttgtgtctctgccaggctttggtatcaggatgatgctggcctcataaaatgagttagggaggattccctctttttctattgattggaatagtttcagaaggaatggtaccagctcctctttgtacctctggtagaatttggctgtgaatccatctggtcctggactttttttggttggtaagctattaattattgcctcaatttcagagcctgttattggtctattcagagattcagcttcttcctggtttagtcttgggagggtgtttgtgtctaggaatttattcatttcttctagattttctagtttatttgtgtagaggtgtttatagtattctctgatggtagtttttatttctgtgggatcggtggtgatatctgctttatcattttttattgtgtctatttgattcttctctcttttcttctttattagtcttgctagcggtctaccaattttgttgatcttttcaaaaaaccagctcctggattcactgattttttgaagggtttttgtgtccctatttccttcagttctgctctgatcttagttatttcttgccttctgctagcttttgaatgtgtttgctcttggttttctagttcttttaatggtgatgttagggtgtcaattttggatctttcctgctttctcttgtgtgccgtagtgctataaatttccctctacacactgctttgaatgtgtcctagagattctggtatgttcgtatctttattctcattggtttcaaagaacatctttatttctgccttcatttcgttatgtacccagcagtcattcaggagcaggttgttcagtttccatgcagttgactggctttgagtgagtttcttaatcctgagttctagtttcattgcactgtggtctgagagacagtttgttgtaatttctgttcttttacatttgctgaggagtgctttacttccaactatgtggtcagttttggaacaggtgtggtgtggtcctgaaaagaatgtatattctgttgctttggggtggagagttctgtagatgtctattaggtccacttggtgcagagctgagttcaattcctggatatccttgttaactttctgtctcgttgaactgtctaatgttgacagtggggtgttaaaatctcccattattattgtgtgggagtctaagtctctttgtaggtctctaaggacttgctttatgaatctgggtgctcctgtattgggtgcatatatatttaggatagttagctcttcttgtttaattgatccctttaccattatgtaatggccttctttgtctcttttgatctgtgttggtttaaagtctgttttatcagagactaggattgcaacccctgcctttttttgttttccatttgcttggtagatcttcctccatccctttattttgagcctatgtgtgtctctgcacatgagatgggtttcctgaatacagcacactgatgggtcttgactctttatccaatttgccagtctgtgtcttttaattggagcatttagttcatttacatttaaggttaatattgttatgtgtgaatttgantcctgtcattatgatgttagctggttattttgctcgttagttgatgcagtttcttcctagccttgatggtctttacaatttggcatgtttttgccgtggctggtactgagtgttcctttccatgtttagtgcttccttcaggagctcttgtagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagagtttctgccgagagatcagctgttagtctgatgggcttccctttgtgggtaacccgaggtttctctctggctgcccttaacattttttccttcatttcaactttggtgaatctgacaattatgtgtcttggagttgctcttctcgaggagtatctttgtggtgttctctgtatttcctgaatctgaatgttggcctgccttggtaggttgggaaagttctcctggataataacctgcagagtgttttccaacttggttccattctccccgtcactttcaggtacaccaatcagacgtagatttggtcttttcacatagtccaatatttcctggaggctttgttcatttctttttattcttttttctctaaacttctcttctcgcttcatttcattcatttgatcttccatcacgataccctttcttccagttgatcgaatcggttattgaggcttgtgcattcgtcacgtatttcttgtgccatggttttcagctccatcaggtcctttaaggacttctctgcattggttattctagttagccattcgtctaatattttttcaaggtttttaacttctttgccatgggttagaacttcctcctttagctcggagtagtttgatcatctgaagccttcttctctcaacttgtcaaagtcattctccatccagctttgttccattgctggtgaggagctgcgttcctttggaggaggagaggtgctctgatttttagaattttcagtttttctgctctgttttttccccatctttgtggttttatctacctttggactttgatgatggtgacgtacagatggggttttggtgtggatgtcctttctatttgttagttgtccttctaacagtcaggaccctcagctgcaggtctgttggagtttgctggaggtccactccagaccctgtttgcctgggtatcagcagtggaggctgcagaacagcggatattggtgaacagcaaatgctgcctgatcgttcctctggaagttttgtctcagaggagtacccggtcgtgtgaggtgtcagtctgcccctacttaggggtgcctcccagttaggctactcgggggtcagggacccacttgaggaggcagtctgtccattgtcagatctccagctgcgtgctgggagaaccactactctcttcaaagctgtcagacagggacatttaagcctgcagaggttactgctgccttttatttggctatgccatgcccccagaggtggagtctacagaggtaggcaggcctccttcagctgcgg

SEQ ID NO: 12153 - DNA, 666 bp, Homo sapiens; identical to SEQ ID NO: 12098

SEQ ID NO: 12154 - DNA, 4806 bp, Homo sapiens
ggctagcccagttgtccccagcaccatgttattaaatagggaatccgtttccccattgcttgtttttctcaggtttctcaaagatcagacagttgtagatatgagtgttatttctgagggctctgttctgttccactcatctatatctctgttttggcaccagtaccatgttgttttgcttactgtagccttgtagtatagtttgaagtcaggtagcgtgatggctccagctttgttcttttggcttaggattgacttggtgatgcaggctcttttttggttccatatgaactttaaagtagttttttccaattctgtgaagaaagtcattggtagcttgatggggatggcattgaatctataaattaccttgggcagtatggccattttcatgatattgattcttcctacccatgagcatggaaggttcttccatttctttgtatcctcttttatttcattgagcagtggtttgtagttctccttgaagaggtccctcacgtcccttgtaagttggattcctaggtattttattttctttgaagcaattgtgaatgggagttcacccatgatttggctctctgtttgtctgttattggtgtataagaatgcttgtgattttttacattgattttgtatcctgagactttgctgaagttgcttatcagcttaaggagattttgggctgagacaatggggttttctagatatacaatcatgtcatctacaaacagggacaatttgacttcctcttttcctaattgaatactctttatttccttctcctgcctaatttccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatatgtcccatcaataccttatttagtgagagtttttagcatgaaggttgttgaaatttgtcaaagccttttctgcatctattgagataatcatgtggttattgtctttggttctgtttatatgctggattacttttattgatttgcgtatattgaaccagccttgcatcccagagatgaagcccacttgatcatggtggataagctttttgatgtgctgctggattcgctttgccagtattttattaaggatttttgcatcaatgttcatcaaggatattcgtctaaaattctcttttttggttgtgtctctgcccggctttggtatcaggatgatgctggcatcataaaatgagttagggaggattccctctttttctattgattggaatagtttcagaaggaatggtaccagttcctccttgtacctctggtagaatttggctgtgattccatctggtcccagactctttttggttggtaagctattgattattgccacaatttcagagcctgttattgatctattcagagattcaacttcttcctggtttagtcttgggagggtgtatgtgttgatgaatttatccatttcttctagattttctagtttatttgcatagaggtgtttgtagtattctctgatggtggtttgtatttctgtgggatcggtggtgatatcccctttatcattttttattgcatctatttgattcttctcactttttttctttattagtctcattagcggtctatcaattttgttgatcctttcaaaaaaccagttcctggattcattaatttttggagggttttttgtgtctctatttccttcagttctgctctgattttagttatttcttgccttctgctagcttttgaatgtgtttgctcttgcttttctagttcttttaattgtgatgttagggtgtgaagtttggatctttcctgctttctcttgtgggcatttagtgctataaatttccctctacacactgctttgaatgtgtcccagagattctggtatggtgtgtctttgttctcattggtttcaaacaacatctttatttctgccttcattttgttatgtacccattagtcattcaggagcaggttgttcagtttccatgtagttgagcagttttgagtcagtttcttaatcctgagttctagtttgattgcactgtggtctgagagacagtttgttataatttctgtttttttacatttgctgaggagagctttacttccaactatgtggtcaattttggaataggtgtggtgtggtgctgaaaaaaatgtatattctcttgatttctggtggtgagttctgtagatgtctattaggtctgcttggtgcagagctgagtttaattcctgggtatccttgttaactttctgtcttgttgatctgtctaatgttgacagtggggtgttaacgtctcccattgttattgtgtgggagtctaagtctctttgtacgtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttgctcgttagttgatgcagtttcttcctagtctcgatggtctttacattttggcatgattttgcagcggctggtaccagtttttcctttccatgtttagcgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctctaagaatgttgaatattggcccccactctcttctggcttgtagggtttctgccaagaaatccgctgttagtctgatgggcttccctttgagggtaagccgacctttctccctggctgcccttaacattttttccttcatttcaactttggtgaatctgacaattatgtgtcttggagttgctcttctcgaggagtaactttgtggcattctctgtatttcctgaatctgaacattggcctgccttgctagattggggaagttctcctggataatatcctgcagagtgttttccaacttggttccattctccccatcactttcaggtacaccaatcagatgtagatttggtcttttcacatagtcccatatttcttggaggctttgctcatttctttttattcttttttctctaaacttcccttctcgcttcatttcattcatttcatcttccattgctgataccctttcttccagttgattgcatcggctcctgaggcttctgcattcttcacgtagttctcgagccttggttttcagctccatcagctcctttaagcacttctctgtattggttattctagttatacattcttctaaatttttttcaaagttttcaacttctctgcctttggtttaaatgtcctcccatagctcagagttaatttgatcgtctgaatccttcttctctcagctcgtcaaagtcattctccatccagctttgttccattgctggtgaggaactgcgttcctttggaggaggagaggtgctctgctttttagagtttccagtttttctgttctgttttttccccatctttgtggttttatctacttttggtctttgatgatggtgatgtacagatgggtttttggtgtggatgtcctttctgtttgttagttttccttctaacatacaggaccctcagctgcaggtctgttggaataccctgccgtgtgaagttcagtgtgcccctgctggggggtgcctcccagttaggctgctcgggggtcaggggtcagggacctacttgaggaggcagtctgccctttctcagatctccagctgggtgcttggagaaccactactctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcctggctgctttgtttacctaagcaagcctgggcaatggtgggcgcccctcccccagcctcgctaccgccttgcagtttgatctcagactgctgtgctagcaatcagtgagactccgtgtgtgtaggaccctcccagccaggtgcaggatataatctcgtggtgcaccggtttttaagccggtcagaaaagcgcagtattctggtgggagtgacccgattttccaggtgcgtccgtcacccctttctttgactgggaaagggaactccctgaccccttgagcttcccaagtgaggcaatgcctcgccctgcttcggctcgcacatggtgcacacacccactgacctgcacccactgtctggcactccctagtgagatgaacctggtacctcagatgcaaatgcagaaatcacccgtcttctgcgtcgctcacgctgggagctgtagaccggagctgttcctattcggccatcttggctcct

SEQ ID NO: 12155 - DNA, 1181 bp, Homo sapiens
tctctttttttctttattagtcttgctagcggtctatcaattttgttgatcctttcaaaaaaccagctcctggattcattaattttttgaagagttttttgtgtctctatttccttcagttctgctctgattttagttatttcttgccttctgctagcttttgaatgtgtttgctcttgcttttgtagttcttttaattgtgatgttagggtgtcaattttggatctttcctgctttctgctgtgggcatttagtgctataaattttcctctacacactgctttgaatgtgtcccagagattctggtatgttgtgtctttgttctcgttggtttcaaagaacatctttatttctgccttcatttcgttatgtacccagtagtattcaggagcaggttgttcagtttccatgtatttgagcggttttgagtgagtttcttaatcctgagttctagtttgattgcactgtggtctgagagacagtttgttataatttctgttcttctacatttgctgaggagagctttacttccaactatgtggtcaattttggaataggtgtggtgctgaaaaaaatgtatattctgttgatttggggtggagagttctgtagatgtctattaagtccacttggtgcagagctgagtacaattcctgggtatccttgttaactttctgtctcgttgatctgtctaatgttgacagtggggtgttaaagtctcccattattattgtgtgggagtctaagtctctttataggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagaggctaggattgcaacccctgcctttttttgttttccatttgcttggtagatcttcctccatccttttattttgagcctatgtgtgtctctgcatgtgagatgggtttcctgaatacagcacactgatgggtcttgactctttatccaatttgccagtctgtgtcttttaattggagcatttagtccatttacatttaaagttaatattgttatgtgtgaatttgatccctgtcattatgatgttagctggttatttgctcatga

SEQ ID NO: 12156 - DNA, 2503 bp, Homo sapiens
gattgccttggcgatgcaggctcttttttggttccatatgaactttaaagtagttttttccaattctgtgaagaaagtcattggtagcttgatggggatggcattgaatctataaattaccttgggcagtatggccattttcacgatactgattcttcctacccctgagcatggaatgttcttccatttgtttgtatcctcttttatttcattgagcagtggtttgtagttctccttgaagaggtccttcacgtcccttgtaagttggattcctaggtattttattctctttgaagcaattgtgaatgggagttcactcatgatttggctctccgtttgtctgttattggtgtataagaatgcttgtgatttttgtacattgattttgtatcctgagactttgctgaagttgctattcagcttaaggagattttgggctgagacaatggggttttctagaaatacaatcatgtcatctgcaaacagggacaatttgacttcttcttttcctaattgaataccctttatttccttctcctacctaattgccctggccagaacttccaacgctatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaaggttattggattttgtcaaaggccttttctgcatctattgagataatcatgtggtttttgtcgttggttctgtttatatgctggattacatttattgatttgcatatattgaaccaggcttgcatcccagggatgaagcccacttgatcgtggtggataagctttttgatgtgctgctggattcagtttgccagtattttattgaggatttttgcatcaatgttcatcaaggatattggtctaaaattctcttttttggttgtgtctctgcccagctttggtatcaggatgatgctggcctcataaaatgagttagggaggattccctctttttctattgattggaatagtttcagaaggaatggtaccaattcctccttgtacctctggtagaattcggctgtgaatccatctggtcctggactttttttggttggtaagctattgattattgccacaatttcagcgcctgtttttggtctattcagagattcaacttcttcctgctttagtcttgggagggtgtatgtgtcgaggaatttatccatttcttctagattttctagtttatttgcatagagctgtttgtagtattctctgatggtagtttgtatttctgtgggattggtggtgatatcccctttatcattttttattgcgtctatttaattcttctctcttttcttctttattagtcttgctagcggtctatcaattttgttgatcctttcaaaaagccagctcctggattcattaatttttttgaagggttttttgtgtctctatttccttcagttctgctctgatcttagttatttcttgccttctgctagcttttgaatgtgtttgctcttgtttttctagttcttttaattgtgatgttaggttgtcaattttggatcgttcctgctttctcttgtgggcatttagtgctataaatttccctctacacactgctttgaatgtgtcccagagattctggtatgttgtatctttgttctccttggtttcaaagaacatctttatttctgccttcatttcgttatgtacccagtagtcattaaggagcaggttgttcagtttccatgtagttgagcggttttgagtgagtttcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagtcctgtagatgtctatcaggtccgcttggtgcagagccgagttcaattcctggatatccttgttaactttctgtctcattgatctgtctaatgttgacagtggggtgttaaagtctcccattattattgtgtgggagtctaagtctctttgtaggtcactcaggacttgctttatgaaactgggtgctcctgtattgggtgcatatatatttaggatagttagctcttcttgttgaattgatccctttatcattatgtaatggccttctttgtctcttttgatctttgttgttttaaagtctgttttatcagagactaggattgcaacccctgcctttttttgttttccatttgcttggtagatcttcctccatccttttattttgagcctatgtgtgtctctgcacgtgagatgggtttcctgaatacagcgcactgatgggtcttgactctttatccaatttgccagt

SEQ ID NO: 12157 - DNA, 2060 bp, Homo sapiens
attttctagtttatttgcatagaggtgtttgtagtattctctgatggtagtttgtatttctgtgggatcggtggtgatatcccctttatcattttttattgcgcctatttgattcttctgtcttttcttctttattagtcttgctagcggtctatcaattttgttgatcctttcaaaaaaccagctcctggattcattaattttttgaaagtttttttgtgtccctatttccttcagttctgctctgattttagttatttcttgccttctgctagcttttgaatgtgtttgctcttgcttttctagttctttcaattgtgatgttagggtgtcaattttggatctttcctgctttctcttgtgggcatttcgtgctataaatttccctctacacactgctttgaatgcgtcccagagattctggtatgttgtgtctttgttctcgttagtttcaaagaacatctttatttctgccttcatttcgttatgtacccagtagtcattcaggagcaggttgttcagtttccatgtagttgagcggttttgagtgagattcttaatcctgagttctagtttgattgcactgtggtctgagagatagtttgttataatttctgttcttttacatttgctgaggagagctttacttccaagtatgtggccaattttggaataggtgtggtgtggtgctgaaaaaaatgtatattctgttgatttggggtgcagagttctgtagatgtctattaggtccacttggtgcagagctgagttcaatccctgggtatccttgttgactttctgtctcattgatctgtctaatgttgacagtggggtgttaaagtttcccattattaatgtgtgggagtctaagtctctttgtaggtcactcaggacttgctttatgaatctgggtgctcctgtattgggtgcatatatatttaggatagttagttcttcttgttgaattgatccctttaccattaagtaatggccttctttgtctcttttgatctttgttggtttaaagtctgttttatcagagactaggattgcaacatctgcctttttttgttttccatttgcttggtagatcttcctccatccttttattttgagcctatgtgtgtctctgcccgtgagatgggtttcctgaatacagcacactgatgggtcttgactctttatccaatttgccagtctgtgtcttttaattggagcatttagtccacttacatttaaagttaatattgttatgtgtgaatttgatcctgtcattatgatgttagctggttattttgctcgttagttgatgcagtttcttcctggtttcgatggtctttacattttggcatgattttgcagcggctggtaccagttgttcctttccatgtttagtgcttccttcaggagctcttttagggcaggcctggtggtgacaaaatctctcagcatttgcttgtctgtaaaggattttatttctccttcacttatgaagcttagtttggctggatatgaaattctgggttgaaaattcttttctttaagaatgttgaatattggcccccactctcttctggcttgtagagtttctgctgagagatctgctgttagtctgatgggcttccctttgagggtaacccgacctttctctctggctgcccttaacattttttccttcatttcaactttggtgaatctgacaattatgtgtcttggtgttgctcttctcaaggagtatctttgtggcgttctctgtatttcctgaatctgaatgttggcctgccttgctagattggggaagttctcctggataatatcctgcagaatgttttccaacttggttccgttctccccgtcactttcaggtacaccaatcagatgaagatttggtcttttcacatagtcccatatttcttggaggctttgctcgtttctttttattcttttttctctaaacttcccttctcgattcatttcattcatttcatcttccatcgctgataccctttcttccagttgatcgcatcggctcctgaggcttctgcattcttcacgtagtt

SEQ ID NO: 12158 - DNA, 4120 bp, Homo sapiens
gtctaacgtttaagtctttaatccatcttgaattgatttttgtataaggtgtaaggaagggatccagtttcagctttctacatatggctagccagttttcccagcaccatttaataaatagggaatcctttccccattgcttgtttttctcaggtttgtcaaagatcagatagttgtagatatgcagcgttatttctgagggctgtgttctgttccattgatctatatctctgttttggtaccagtaccatgctgttttggttactgtagccttgtagtatagtttgaagtcaggtagtgtgatgcctccagctttgttcttttggcttaggattgactttgtgatgcgggctcttttttggttccatatgaactttaaagtagttttttccaattctgtgaagaaaggcattggtagcttgatggggatggcattgaatctgtaaattaccttgggcagtatggccattttcacgatattgattcttcctacccatgagcatggaatgttcttccatttgtttgtaacctcttttatttccttgagcagtggtttgtagttctccttgaagaggtccttcacatcccttgtaagttggattcctaggtatttcattctctttgaagtaattgtgaatgggagttcactcatgatttggctctctgtttgtctgttgttggtgtataagaatgcctgtgatttttgcacattgattttgtatcccgagactttgctgaagttgcttatcagcttaaggagattttgggctgagacaatggggttttctagatctacaatcatgtcgtctgcacacagggacaatttgacttcctcttttcctaattgaataccctttatttacttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgtgtatattgaaccagccttgcatcccagggatgaagcccacttgatcatggtggataagctttttgatgtgctgctggattcgttttgccagtattttactgaggatttttgcatcaatgttcatcaaggatattggtctaaaattctctttttttgttgtgtctctgcctggctttggtatcagaatgatgctggcctcataaaatgagttagggaggattccctctttttctattgattggaagagtttcagaaggaatggtaccagttcctccttgtacctctggtagaattcggctgtgaatccatctggtcctggactctttttggttggtaagctattgattatttccacaatttcagctcctgttattggtctattcagagattcaacttcttcctggtttagtcttgggagagtgtatatgtccaggaatttatccatttcgtctagattttctagtttatttgcgtagaggtgtttgtagtattctctgatggtagtttgtatttctgtggaatcagtggtgatatcccctttatcattttttattgcgtctatttgattcttctctctttttttctttattagtcttgctagcggtctatcaattttgttgaccctttcaaaaaaccacctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttctcattggtttcaaagaacatctttatttctgccttcatttcgttatgtacccagtagtcattcaggagcaggttgttcagtttccatgtagttgagcggttttgagtgagattcttaatcctgagttctagtttgattgcactgtggtctgagagatagtttgttataatttctgttcttttgcatttgctgaggagagctttacttcccagtatgtggtcaattttggaataggtgtggtgtggtgctgaaaaaaatgtatattctattgatttggggtggagagttctgtagatgtctattaggtccccttggtgcagagccgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatcttggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgtgtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttgctcgttagttgatgcagtttcttcctagtctcgatggtctttacattttggcatgattttgcagcggctggtaccggttgttcctttccatgtttagtgcttccttcaggagctcttgtaaggcaggcctggtggtgacaaaatctctcagcatttgcttgtctgtaaagtattttatttctccttcactcatgaagcttagtttggctggatatgaaattctgggttgaaaattcttttctttaagaatgttgaatattggcccccactctcttctggcttgtagggtttctgccgacagatccgctgttagtctgatgggcttccctttgagggtaacccgacctttctctctggctgcccttaacattttttccttcatttcaactttggtgaatctgacaattatgtgtcttggagttgctcttttcgaggagtatctttgtggcgttctctgtatttcctgaatctgaacgttggcctgccttgctagattggggaagttctcctggataatatcccgcagagtgttttccaacttggttccattctccccgtcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttcatcgctttggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcatctgaagccttcttctctcagctcgtcaaagtcattctccatccagctttgttctgttgctggtgaggaactgcgttcctttggaggaggagaggcgctctgctttttagagtttccagtttttctgttctgttttttccccatctttgtggttttatctactttggtctttgatgatggtgatgtacagatgggtttttggtgtggatgtcatttctgtttgttagttttccttctaacagacaggaccctcagctgcaggtctgttggagt

SEQ ID NO: 12159 - DNA, 3581 bp, Homo sapiens
gtctaatatgtaagtctttaatccatcttgaattaatttttgtctaaggtataaggaagggatccagtttcagctttctccatatggctagccagttttcccagcaccatttattaaatagggaatcatttccccatttcttgtttttctcaggtttgtcaaagatcagatggttgtagatacgtggtattatttctgagggctctgttctgttccattggtctatatctctgttttggtaccagtaccatgctgttttgcttactatagccttgtatatagtttgaagtcaggtagcgtgatgcctccagctttgttcttttggcttaggattctgttggaaatgtgggctctgttttggttccatatgaactttaaagtagttgtttccaattctgtgaagaaagtcattggtagcttgatggggatggcattgaatctataaattaccttgtgcagtatggccattttcaagatattgattcttcctacgcatgagcatggaatgttcttccatttgtttgcatcctcttttattcggttgagcagtggtttgtagttctccttgaagaggtccttcacattccttgtaagttggattcctaggtattttattctctttgaagcaattgtgaatgggagttcactcatgatttggctctctatttgtctgttattggtgtataagaatgcttgtgatttttgcacattgattttgtatcctgagactgctgaagttgcttatcagcttaaggagattttgggctgagacgatggggttatctaaatatacagtcatgtcatctgcaaacagggacaatttgacttcctcttttcctaattgaatgcctttatttctttctcctgcctgattgccctggccagaacttccaacactatgttgaataggagtggtgagagagggcatcaatgtcttctgccagttttcaaagagaatgtttccagtttttgcccattcagtatgatattggctgtgggtttgtcataaatagctcctattattttgagatacgtcccatcaatactgaatttattgagagtttgtagcatgaaggttgttgaattttgtcaaaggccttttctgtatctattgagataatcatgtggtttttgtctttggttctgtttatatgctggattatgtttattgatttgcatatgttgaagcaggcttgcatcccagggatgaagcccactttatcatggtggataagctttttgatgtgctgctggatttggtttgccagtattttattgaggatttttgcatcgatgttcatcagggatattggtctaaaattctctttttttgttgtgtctctgccaggctttggtatcaggatgaggctggcctcataaaatgagttagggaggattccctctttttctattgattggaatagtttcagaaggaatggtaccagctcctccttgtacctctggtagaattcagctgtgaatccatctggtcctggacttgttttggttggtaagctattaattattgcctcaatttcagagcctgttattggtctattcagggattcaagttcttcctggtttagtcttgggagggtgtatgtatccaggaaattatccatttcttctagattttctagtttatttgcatagaggtgtttatagtattctctgatagtagtttgtatttccgtgggatccgtggtggtatgccctttatcattttttattgcatctatttgattcttctctcttttcttctttattagtcttgctagcaatctatcaattttgttgatctttccaaaaaaccagctcctggattcattgattttttcgaagggttttttgtgtctctatctccttcagttctgctctgatcttagttatttcttaccttctgctagcttttgaatgtgtttgctcttgcttctctagttcttttaattgtgatgttagggtgtcaattttagatctttcctgctttctcttgtgggcatttagtgctataaatttccctctacacactggtttaaatgtgtcccggagattctggtatgttgtgtctttgttctcattggtttcaaagaacatctttatttctgccttcatttcattatgtacctagtagtcattcaggagtaggttgttcagtttccatgtagttgagtagttttgagtgagtttcttaatcctgtgtactagtttgattgcactgtggtctgagagacagtttgttataatttctgttcttttacatttgctgaggagtgctttacttccaactatgtggtcatttttggaataagtgcgatgtggtgctgagaagaatgtatactctgttaatatggggtggagagttctgtagatgtctgttaggtccacttggtgcagagctgagttcaattcctgggtatctgtgttaactttctgtcttgttgatctgtctaatgttgacagtggggtgttaaagtcccccattattattgtgtgggagtctaagtctctttgtaggtcactcaggacttgctttatgaatctgggtgctcctgtattaggtgcatatatatttaagatagttagctcttcttgttgaattgatccctttaccattatgtaatggccttgtctcttttgatcttggttggtttaaagtctgttttatccaagactaggattgcaacccctgcctttttttattttccatttgcttggtagatcttcctccatccctttattttgagcctatgtgtgtctctgcatgtgagatgggtctcctgaatacagcacactgatgggtcttgactctttatccaatttgccagtctgtgtcttttaattggagcatttagcccatttacatttaaggttaatattgttatgtgtgaatttgatcctgtcattatgatgttagctggttattttgctcattagttgatgcagtttcttcctagccttgatggtctttacaatttggcatgtttttgcagtggctggtaccggttgttcctttccatgtttagtgcttccttcaggagctcttgtagggtaggcctggtggtgacaaaatctctcagcatttgcttgtctgtaaaggattttatttctccttgacctatgaagcttagtctggctggttatgaaattctgggtagaaaattcttttatttaagaatgttgaatattggcccccactgtcttctggcttatagagtttctgccaagagatcagctgttagtctgatgggtttccctttgtgggtaacctgacctttctctctggctgcccttaacattttttccctcatttcaactttggtgaatttgacaattatgtgtcttggagttgctcttctcgaggagtatctttgtggtgttctctgtatttcctgaatttgaatattagcctgtcttgctaggttggggaagttctcctggatactatcctgcagagtgttttccaacttggttccattctccccgtcactttcaggtacaccaatcagacgtagatttggtctttacacatagtctcatattttttggaggctttgttcatttctttttactcttttttctct

SEQ ID NO: 12160 - DNA, 4067 bp, Homo sapiens
tttttttttattatactgtaaagtctagggtacatgtgcacaatgcgcaagtttgttacatatgtatacatgcgccatgttggtgtgctgctcccattaactcgtcatttacattagatatatctcctaatgctatcctcctcatcccctcaccccaacacaggccccagtgtgtgatgtaccccttccagtgtccaagtgttctcattgttcaattcccacctataagtgagaacatgcggtgtttggttttttgtccttgcgatagtttgctttcccttcatccatgtccctacaaaggacatgaactcatccttttttatggctgcatagtattccatggtgtagatgtgccacgtttgcttaatccaatctatcactgatggacatttgggttgcttccaagtctttgctattgtgaatagtgccgcaataaacatacgtgtgcatgtgtctttatagcagcatgatttataatcctttgggtatatacccagtaatgggatggctgggtcaaatggtatttctagttctagacccttgaggaatcaccacactgtcttccacgatggctgaactagtttacactcccaccaacagtgtaaaaatgttcctatttctccacatcctctccagcacctgttgtttcctgactttttaatgatcgccattctaactagtgtgagatggtatttcattgtggttttgatttgcatttctctgatggccagtgatggtgagcattttttcatgtgtctgttgtctgcataaatgtcttctttttgagaagtgtctgttcatatccttcaccactttttgatggggttgtttgtattttttcttgtaaatttgtttgagttctttatagattctggatattagccctttgtcagatgagtagattgcaaaaattttctcctattctgtaggttgcctgttcactctgatggtagtttcttttgctgtgcagaagctctttagtttaattagatcccatttgtcaattctggcttttgttgccattgcttttggtgtttcagacatgaagtccttgcccatgcctatgttctcaatggtattgcctaggttttcttctagggtttttatggttttaggtctaacatttaagtctttaatccatcttgaattaattttggtataaggtgtaaggaagggatccagtttcagctttctacatatgaccagccagttttcccagcaccatttattaaatagggaatcctttccccatttctggtttttgtcaagtttgtcaaagatcagatgggtgtagatgtgtggtattatttctgtcagctctgctctgttccattggtctatatctctgttttggtaccaataccatgctgttttggttactgtagccttgtggtatagtttgaagtcaggtagcatgatgcctccagctttgttcttttggcttaggattgatttggcaatgcgggctcattttggttccatatgaactttaaagtaggtttttccaattctgcgaagagagtcattggtagcttgatggggatggcattgaatctataaattaccttgggcagtatggccattttcacaatattgattcttcctatccatgagcatggaatgttcttccatttgtttgtgtcctcttttattttgttgagcagtggtttgtagttctccttgaagaggtccttcacatcccttgtaagtttgattcctaggtattttattctctttgaagcaattgtgaatgggagttcactcatgatttggctctctgtttgtctgttattggtgtataagaatgcttgtgatttttgtacattgattttgtatcctgagactttgctgaagttgcttatcagcttaagtagattttgggctgagatgatggggttttctaaatatacaatcatgtcatctgcaaacagggacaatttgacttcctcttttcctaattgaatgccctttatttctttctcctgcctgattgccctggccagaacttccaacactatgctgaataggagtggtgagagagggcattcctgtcttgtgccagttttcaaagggaatgcttccagtttttgcccattcagtatgttattggctgtgggtttgtcataaatagctcttattattttgagatacatcccatcaatacctaatttattgagagtttttagcatgaagggctgctgaattttgtcaaaggccttttctgtatctactgagataatcatgtggtttttgtctttggttctgtttatatgctggattacatttattgatttgtgtatgttgaaccagccttgcatcccagggatgaagccaacttgatcatggtggataagctttttgatcttctgctggatttggtttgccagtattttattgaggatttttgcatcgatgttcatcagggatattggtctaaaattctttttttgttgtgtctctgccaggcttttgtatcaggatgatgctggcctcataaaatgagttagggaggattccctcttcttctattgattggaatagtttcagaaggaatggtaccagctcctccttgtacctctggtagaattcagctgtgaagctgtctggttctggacttttttttggttggtaggctattaattattgccccaacttcagagcctgttattggtctattcagggattcaacatcttcctggtttagtcttgggagggtgtatgtgtccaggaatttatccatttcttctagatattctagtttatttgtgtagaggtgtttatagtattctctgatggtagtttatatttctgtgggatcggtggtaatatcccctttatcattttttattgtgtctatttgattcttctctcttttcttctttattagtcttgctagtggtctatcaattttgttgatgttttcaaaacaccagctcctggattcatttattgtttgaagggtattttgtctctatctccttcagttctgctctgatcttagttatttcttgccttctgctagcttttgaatgtgtttgctcttgcttctctagttctttgaattgtgatgttagggtgtcaattttagatctttcctgttttctcttatgggcatttagtgctataaatttccctctacacactgctttaaatgtgtcccagagattgtggtatgttgtgtctttgttctcattcgtttcaaagaacatctttatttctgccttcatttcgttatctacccagtagtcattcaggagcaggttgttcagtttccatgtagttgagcggttttgagtgagtttcttaatcctgagttctagtttgattgcactgtggtctgagagacagtttgttataatttctcttcttttcaatttgctgaggaatgctttacttccaactatgtggtcaattgtggaataagtgtaatatggtgctgagaaaaatgtatattctgttgatttagagtggagagttctgtagatgtctatcaggtctgcttggggcagagctgagttcaattcctggatatccttgttaactttctgtctctttgatctgtctgatgttgacagtggagtgctaaagtctcccattattattgtgtgggagtctaagtctgtttgtaggactctaaggaattgctttataaatctgggtgtgcctgtattgggtgcatatatatttaggatagttagctcttcctgttgaattcatccctttaccattatgtaatggtcttctttgtctcttttgatctttgttggtttaaagtctgttttatcagagactgggattgcaaaccctgcctttttttgttttccatttgcctactagatcttcctccatccctttattttgagcctatgtgtgtctctgcaagtgagatgggtctcctgaatacagcacactgatgggtcttgactctttatccaatttgccagtttgtgtcttttaattggagcatttagcccatttacatttaaggttaatattgttatgtgtgaatttgatcctgtcattatgatgttagctagttattttgctcgttagttgatgcagtttct

SEQ ID NO: 12161 - DNA, 3612 bp, Homo sapiens
catatggctagccagttttcccagcaccatttattaaatagggaatccttttctcatttcttgtttttgtcaggtttgtcaaagatcaggtagtgatagatatgtggcattatttctgagggctctgttcttttccattgatctatatctctgttttggtaccagtaccatgctgttttggttactgtagccttgtagtatagtttgaagtcaggtagagtgatgcctccagctttgttcttttggctcaggattgacttggcaatatgggctcttttttggttccatatgaactttaaagtagttttttccaattctgtgaagaaagtcattggtagcttgatggagacggcattgaatctataaattaccttgggcagtatggccattttcacgatattgattcttcctacccatgagcatggaatgttcttccatttgtttatatcctcttttatttctttgagtagtggtttgtagttctccttgaagaggtccttcacttcccctgtaagttggattcctaggtattttattctctttgaagcaattgtgaatgggagttcactcatgagttggctctctgtctgttattggtgtataagaatgcttgtgatttttgtacattgattttgtatcctgagactttgctgaagttgcctatcagcttaaggagatttttgggctgagacgatggggttttctagatacataatcatgtcatctgcaaacagggacaatttgacttcctcttttcctaattgaataccctttatttccttctcctgactgattgtcctggccagaacttccaacactatgttgaatagcagaggtgagagagggcatccctgtcttgtgccagttgtcaaagggaatgcttccagtttttgcccattcagtatgatattggctgtgggtttgtcatagatagctctgattattttgagatatgtcccatcaatacctaatttattgagagttattagcatgaagggttgtcgaattttgtctaaggccttgtctgcacctattgagataatcatgtggtttttgtcattggttctttttatattctggattacgtttattgatttgcatatgttgaaccagccttgcatcccagggatgaagcccacttgatcatggtggataagctttttgatgtgttgctggattcactttgccagtattttattgaggatttttgcattaatgttcatcagggatattggcctaaaattctctttttttgttgtgtctctgccaggatttggtatcaggatgatgctggcctcataaaatgacttagggaggattccctctttttctattgattgaaatagtatcagaaggaatggtaccaactgctccttgtacttctggtagaatttggctgtgaatccatctggtcctggactttttttggttggtaagctattaattattgcctcaatttcagagcctgtttttggtcaatcagatagtcagcttcttcctgttttagtcttgggagggtgtatatgtcgaggaatttatccatttcttctagattttccagtttatttgcatagaggtgtttatagtattctccgatggtagtttgtgtttctgtgggatcggtggtgatatcccctttatcattttttattgcgtctatttgattcttctctcttttcttctttattagtcttactagtggtctaccaattttgttgatcttttcaaaaaaccagctcctggaatcactgattttttgaagggttttttgtgtctctatttccttcagttctgctctgatcttagttatttcttgccttttgctagcttttgaatgtgttcgctcttgcttctcaagttcctttaatagtgatgttagggtgtcaattttagatctttcctgctttctcttgtgggcatttagtgctataaatttccctctacacactgctttgaatgtgtcccagagattctggtatgttgtgtctttgttctcgttggtttcaaagaacatctttatttctgccttcatttcattatgtacccagtagtcattcaggagtagattgttcattttccatgtagttgagtggttttgagtgagtttattaatcctgagttctaatttgattgcactgtggtctaagagacagtttgttataatttcttttcttttacatttgctgaggagtgctttacttccaagtatttggtcaattttggaataggtgtggtgtggtgctgaaaataatgtatattctgttgatttggggttgagagttctgtagatgtctactaggtccacttggtgcagagctgagttcagttcctgggtatccttgttgactttctgtctcattgatctgtctaatgttgacagtggagtgttaaagtctcccattattattgtgtgggagtctaagtctctttgtaggtctctaaggacttgctttatgaatctgagtgctcttgtattgggtgcatatatatttaggatagttagctcttcttgttgaattgatccctttaccattatgtaatggtcttctttgtctcttttgatctttgttagtttaaagtctgttttatcagagactaggattgcaacccctgcctttttttgttttccattggcttggtagatcttcctccatccctttattttgagcctatgtgtgtctctgcatgtgagatgggtttcctgaatacagcacactgatgggtcttgactctttatccaatttgccagtctgtgtcttttaattggagcatttagcccatttacatttaaggttaatattgttatgtgtgaatttgatcctgtcattatgatgttagctggttattttgctcgttagttgatgcagtttcttcctagccttgatggtctttacaatttggcatggttttgcagtggctggtaccagttgttcctttccatgtttagcgcttccttcaggagctcttttagggcaggcctggtggtgacaaaatctctcagcatttgcttgtctgtaaaggattttatttctccttcagttatgaagcttagtttggctggatatgaaattctgggttggaaattcttttctttaagaatgttgaatattggccccaactttcttctggcttgtagagtttctgctgagagatcagctgttagtctgatgggcttccctttgtgggtaatccaacctttctctctggctgcccttaacattttttccttcatttcaactttggtaaatctgacaattatgtgtcttggagttgctcttctcaaggagtatctttgtggcattctctgtatttcctgaatttgaacgttggcctgccttgctagattggggaagttctcctggataatatcctgcagagtgttttccaactttgttccattctccccctcactttcaggtacgctaatcagatgtagatttggtcttttcacatagtcccatatttcttggagggtttgttcatttctttttattcttttgtctctcaacttcccttctcacttcatttcattcatttgatcttccatcactgataccttttattccagttgattgaatcggctactgaggcttgtgcattcatcacgtagtt

SEQ ID NO: 12162 - DNA, 4426 bp, Homo sapiens
tttttctatggaattctctatttcttttttttattttattattacactttaagttttagggtacatgtgcacaatgtgcaggtttgttacatatgtatacatgtgccatgttggtgtgctgcacccattaactcatcatttagcattaggtatatctcctaatgctatccctcccccatcccccaccccacaacagtccccagtgtgtgatgttccccttcctgtgtccacgtgttctcattgttcaattcccacctatgagtgagaacatgcggtgtttggttttttgtccttgtgatagtttgctgagaatgatggtttccagcttcatccatgtccctacaaaggacatgaactcatccttttttatggctgcatagtattccatggtgtatatgtgccacattttcttaatccagtctatcattgttggacatttggattggttccaagtctttgctattgtgaatagtgccataataaacatacgtgtgcatgtgtctttatagcagcatgatttataatcctttgggtatatacccagtaatgggatggctgtgtcaaatggtatttctagttctagatccctgaggaatcgccacactgacttccacaatggttgaactagtttaccctcccaccaacagtgtaaaagtgttcttatttctccacatcctctccagcacctgttgtttcctgactttttaatgatcgccattctaactggtatgagatagtatctcattgtggttttgatttgcatttctctgatggccagtgatgatgagcattttttcatgtgtcttttggctgcataaatgtcctcttttgagaagtctctgctcatatccttcgcccactttttgatggggttgtttgtttttttcttgtaaatttgtttgagttcattgtagattctggatattaggcctttgtcagatgagtaggttgcaaaaattttctcccattctgtaggttgcccattcagtgtgatggtagtttgttttgctgtgcagaagctctttcgtttaattagatcccatttgtcaattttggcttttgttgccattgcttttggttttttagacatgaagtccttgcccatgcttatgtcctgaatggcattgcctaggttttcttctagggtttttatggttttaggtctaacatgtaagtctttaatccatcttgaattaatttttgtataaggtgtaaggaagggatccagtttcagctttctacatatggctagccagttttcccagcaccgtttattaaatagggaattgtttccccatttcttgtttttgtcaggtttgtcaaagatcagatagttgtagatatgcagcattatttctgagggctctgttctgttccattgatctatatctctgttttggtaccagtaccatgctgttttggttactgtagccttgtagtatagtctgaagtcaggtagcatgatgcctccagctttgttcttttggcttaggattgacttggcaatgagggctcttttttggttccatatgaactttacagtagttttttccaattctgtgaagaaagtcattggtagcttgatggggatggcattgaatctataaattaccttgggcagtatggccattttcatgatattgattcttcctacccatgagcatggaatgttcttccatttgtttgtatcctcttttatttcattgagcagcggtttgtagttctccttgaagaggtccttcacatcccttgtaagttggattcctaggtattttattctctttgaagcaattgtgaatgggaattcactcatgatttggctctctgtttgtctgttattggtgtataagaatgcttgtgatttttgcacattgattttgtatcctgagactttgctgaagttgtttatcagcttaaggagattttgggctgagacgatggggttttctcaatatacagtcatgtcatctgcaaacagggacaatttgacttcctcttttcctaattgaatgccctttatttccttctcctgccggattgccctggccagaacttccaacactatgttgaataggagtggtgagagagggcatccctgtcttgtgccagttttcaaagggaatgcttccagtttttgtccattctgtaggatattggctgtgggtttgtcatagatagctcttactattttgagatacatcccatcaatacctaatttatttagagtttttagcatgaaggttgttgaattttgtcaaaggccttttctgcatctgttgacataatcatgtggtttttgtctttggttctgtttatatgctggattatgtttattgattttcatatgttgaaccagcctttcatcccagtgatgaagcccacttgatcatggtggataagctttttgatatgttgctggattcggcttgccagtattttattgagaatttttgcattgatgatcattaaggatattggtttaaaattctctttttttgttgtgtctctgccaggctttgatatcaggatgatgctggcctcataaaatgagttagggaggattccctctttttctgtcgattggaatgatttcagaaggaatggtaccagctcctccttatacctctgctagaattcggctgtgaatccatctggtcctggactttttttggttggtaagctattaattattgcctcaatttcagagcctgttactggtctattcagagattcaacttcttcctggtttagtcttgggagggtgtatgtgtcgaggaatttatccatttcttctagattttctagtttatttgtgtagaggtgtttatagtattttctgatggtagtttctatttctgtgggatcggtggtgatatcccctttatcattttttattgcgtctatttgattcttctctcttttcttctttattagtcttgctagcggtctatcaattttgttgatcttttcagaaagccagctcctggattcattgattttttgaagggttttttatgtctctatttccttcagttctgctctgatcttagttgtttcttgccttctgctagcttttgaatgtgtttgctcttgcttctctagttcttttaattgtgatgttagggtgtcaattttatatctttcctgctttctcttgtgggcatttattgctataaatttccctctacacactgctttgaatgtgtcccatacattctggtatgttgtgtctttgttctcgttggtttcaaaaaacatctttatttctgccttcatttctttatgtacccagtagtcattcaggagcagattgttcagtttccatgtagttgagtggttttgagtgagtttcttgatcctgagttctagtttgattgcagtgtggtctgagagacagtttgttataatttctgttcttttacatttgctgaggagtgctttacttccaactatgtggtcaattttggaacaggtgtggtgtggtgctgaaaagaatgtatattctgttgatttggggtggagagttctgtagatgtctattaggtccgcttggtgcagagctgagttcaattcctggatatccttgttaactttctgtctcattgatctgtctaatgttgacagtggggtgttaaattctcccattattattgtgtgggagtctaagtctcttcgtaggtcactaaggacttgctttatgaatctgggtgctcctgtattgggtgcatgtatatttcagatagttagctcttcttgttgaattgatccctttaccattatgtaatggccttctttgtctcttttgatttttgttggtttaaagtctgttttatcagagactaggattgcaactcctgccttttttttgttttccatttgcttggtagatcttcctccatccctttattttgagcctatgtgtgtctctgcacatgagatgggactcctgaatacagcacactgatgtcttgactctttatccaatttgccagtctgtgtcttttaattggagcatttagcccatttacatttaaggttaatattgttatgtgtgaatttgatcctgtcattatgatgttagctgattattttgctcattagttgatgcagtttcttcctagcttcgatggtctttacaatttggcatgtttttgcagtagctggtgccagttgttcctttccatgtttagtgcttccttcaggagctcttttagggcaggtctggtggtgacaaaatttctcagcatttgcttgtctgtaaagtattttatttctccttctcttatgaagcttaatttggctggatatgaaattctgggttgaaaatccttttctttaagaatgttgaatattggcccccactctcttctggcttgtagagtttctgccgagggatcagctgttagtctgatgggcttccctttgt

SEQ ID NO: 12163 - DNA, 2984 bp, Homo sapiens
gaaagtcattggtagcttgatggggatggcatggaatctataaattaccttgggcagtatggccattttcacaatattgattctttctacccatgagcatggactgttcttccatttgtttgtatcctcttttatttcattgagcagtggtttgtagttctccttgaagaggtccttcacatcccttgtaagttggattcctaggtattttattctctttgtagtgattgtgaatgggacttcactcatgatttggctctctgtttgttatcggtgtataagaatgcttctgatttttgtacattgattttgtatcccgagactttgctgaagttgcttatcggcttaaggagattttgggctgagatgatggggttttctagatatacaatcatgtcatctgcaaacagggacaatttgacttcctcttttcctaattgaataccctttatttccttctcctgcctgattgccctggccagaacttccaacactatgttgaataggagtggtgagagagggcatccctgccttctgccagttttcaaagggaatgcttccagtttttgcccattcagtatcatattggctgtggatttgtcatagatacctctgattattttgagatacatcccatcaatacctagtttattgagagtttttagcatgaagcattgctgaattttggcaaaggccttttctgcatctattgagataataatgtggtttttgtctttggttctgtttatatgttggattacatttattgatttgcatatgttgaaccagccttgcaccccaggggtgaagcccacttgatcatggtggataagctttttgatgtgctgctggatttggtttgccagtattttattgaggatttttgcatcgatgttcatcaaagatattggtctaaaattctctttttttttgttgtgtctctgccaggctttggtatcaggatgatgctggcctcataaaatgagttagggaggattccctgtttttctattgattggaatagtttcagaaggaatggtaccagttcctccttgtacctctggtagaattcgcctgtgaatccatctggtcctggactttttttggttggtaagctattgattattgcctcaatttcagatcctgttattggtctattcagagattcaacttcttcctggtttagtcttgggaggatgtatgtgtcgaggaatttatccctttcttctagattttctagtttatttgcgtagagatgtttgtagtattctctgatggtagtttgcatttctgtgggatcggtggtgatatccccttcatcatttttcattgcgtctatttgattcttctctcttttcttctttattagtcttgctagcggtctatcaattttgttgatcttttcaaaaaaaccaactcctggattcattaattttttaagggttttttgtgtctctatttccttcagttctgctctgatcttagttatttcttgccttctgctagcttttgaatgtgtttgctcttgctgttctagttcttttacttgtgatgttagggtgtcaattttagatcttttctgctttctcttgtggggatttagtgctataaatttccctctacacactgctttgaatgcgtcccagagattctggtatgttgtgtctttgttctcgttggtttcaaagaatatctttatttatgccttcacttcattatttacccagtagtcattcaggagcaggttgttcagttaccatgtagttgagcggttttgagtgagtttcttaatcctgagttctagtttgattgcactgtggtctgagagacagtttgctataatttctgttcttttacatttgctgaggagtgctttacttacaactatgtggtcagttttggagtaggtgtggtgtggtgctgaaaagaatgtatattctgttgatttggggtggagagttctgtagatgtctattaggtctgcttggtgcagagctgagttcaattcctggatatccctgttaactttctgtctcgttgacctgtctaatgttgacagtggggtgttaaagtctcccattattattgtgtgataataatcacttattatccttaggtccttagtccttaggtcactaaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagtctaggattgcaacccctgcctttttttgttttccatttgcttggtagatcttcctccatccttttattttgagcctatgtgtgtctgtgcacgtgagatgggtctcctgaatacagcacactgatgggtcttgactctttatccaatttgccagtctgtgtcttttaattggagcatttagcccatttacatttaaagttaatattgttattatgtgtgaatttgatcctgtcattatgatgttagctggttattttgctcattagttgatgcagtctcttcctagcctcgatggtctttacaatttggcatgtttttgcagtggctggtaccggttattcctttccatgtttagtgcttccttcatgagctcttttagggtaggcctggtggtgacaaaatctctcagcatttgcttgtctgtaaaggattttatttctccttcacttatgaagcttagtttggctggatatgaaattctgggttgaaaattcttttctttaagaatgttgaatattggtccccactctcttctggcttgtagagtttctgctgagagatcagctgttagtctgatgggcttccctttgtgggtaacccgacctttctctctggctgcccttaacattttttccttcatttcaactttggtgaatctgacaattatgtgtcttggagttgctcttctcgag

SEQ ID NO: 12164 - DNA, 5753 bp, Homo sapiens
taaacagaaagtttattacagcatattacaggcttgtgtcagtactaaattgatcaataaacagattctagcctgcactttcaggaatgcacccaaagctactcctcagatctagagtagcatgggaactgcttgctgctcctgcacaattttttttttattatactttaagttctagggtacatgtgcacaatgtgcaggtttgttacataagtatacatatgccacgttggtgtgctgcacccattaactcgtcatttacattagatatatctcctaatgctatccctcccccctcccccaactccacaacaggccttggtgtgtgatgttccccaccctgtgtccaagtgttcttattgttcaattcccacctatgagggagaacatgtggtgtttggttttttgtccttgcgatagtttgctcagaatgatggtttccagcttcatccatgtccctataaaggacatgaactcatgcttctttatggctgcatagtattccatggtgtatatgtgccacattttcttaatccagtctatcattgttggacatttgggttggttccaggtctttgctattgtgaatagtgccacaatacacatacatgtgcatatgtctttatagcagcatgatttataatcctttgggtatatacccagtaatgggatggctacgtcaaatgggatttctagttctagaaccttgaggaatcgccacactgtcttccacaatggttgaactagtttacagtcccaccaacagtgtaaaagtgttcctatttctccacatcttctccagtacctgttgtttcctgacttttttaatgatcaccattctaactggtgtgagatggtatctcattgtgattttgatttgcatttctctgatggccagtgatgatgagcattttttcatgtgtctgttggctgcataaatgtcttcttttgagaagtgtctgtttatatgcttcgcccactttttgatggggttgattttttcttataactttgtttaagttctttgtagattctggatattagccctttgtcagatgggtagattgcaaaaattttctcccattctgtaggttgcctgttcactctgatggtggtttcttttgctgtgcagaagctctttagtttaattagatcccatttgtctattttggcttttgttgccattgcttttggtgttttagtcatgaagtccttgcccatgcctatgtcctgaagggtattgcctaggttttcttctagggtttttatggttttaggtctaacatttaagtctttaatccatcttgagttaacttttttataaggtgtaaggaagggatccagtttcagctttctacctatggctagccagttttcccagcaccatttataaaatagggaatcctttccccatttcttgtttttgtcaggtttgtcaaagatcagattgttgtagatgtgtggtattatttctgaaggctctgttctgttccattggtctatatctctgttttggtaccaataccatgctgttttggttactgcagccttgtagtatagtttgaagtcaggtagcgtgatgcctccagctttgttcttttggcttaggattgtcttggcaatgcaggctcttttttggttccatatggactttaaagtagttttttccaattctgtgaagaaagtcattggtggtttgatggggatggcactgagtctataaattaccttgggcagtatggccattttcacgatactgagtcttcctatccaagagcatgaaatgttcttccatttgtttgtgtcctcttttatttcattgagcagtggtttgtagttctccttgaagaggtccttcacatcccttgtaagttggatttctaggtattttattctctttgaagcaattgtgaatgggagttcactcatgatttggctctctgattgtctattattggtgtataggaatgcttgtgatttttgcacattgattttgtatcctgagactgctgaagttgcttatcagcttaaggagattttgggctaagacagtggggttttctaaatatacaatcatgtcacctgcaaacagggacaatttgactttctcgtttcctaattgaataccctttatttctttctcctgcctgattgccctggccagaacttctaacactatgttgaataggagtggtgagaaagggcatccctgtcttgcaccagttttcgaaaggaatgcttccagtttctgcccattcagtatgatattggctgtgggtttgtcataaatagctcttattattttgagatacgtcccatcaatatctagtttattgagagtttttagcatgaagggctgttgaattttgtcaaaggccttttctgcatctgttgaggtaatcatgtggtttttatctttggttctgtttatatgatggattatgtttattgatttacgtatgttgaaccagccttgcctcccagggatgaagccaacttgatcttgggggataagctttttgatgtgctgctggattcggtttgccagtattttattgaggattcttgcatcgatgttcatcagggatagtggtctaaaattctctttttttgttgtgtctctgccaggctttggtatcaggatgatgctggcctcataaaatgagttagggaggattccctctttttctattgattggaatagtttcagaaggaatggtaccagctcctctttgtacctctggtagaattcggctgtgaatccatctggtcttggactttttatggttggtatgctattattgcctcaatttcagaggtgctattggtctattcaggggttcaaattcttcctggtttggtcttgggagggtgtatgtgtccaggaatttatccatttcttctacattttctagtttaattgtattgaggtgtttacagtagtctctgatggaagtttgtatttctgtgggatcggtggtgatatgccctttatcattttttattgtgtctatttgattcttctctcttttcttctttattagtcttgccagcggtctatcaaattttgttgatcttttcaaaaaaccagctcctggattcattgattttttgaagggttttttgtgtctctatctccttcagttctgctctgatcttagttatttcttgccttctgctagcttttgaatgtttgctcttgcttctctagttcttttaattgtgatgttagggtgtcaattttggatctttcctgctttctcttgtgggcatttagtgctataaatttccctctccacactgctttgaatgtgtcccagagattctggtatgttgtgtctttgttctcattggtttcaaagaacatctttatttctgccttcatttcattatgtacccagtagtcattcagcagcaggttgttcagtttccatgtagttgagcagttctgagtgagtttcttaatcctgagttctaatttgattgcactgtggtctgacagacagtttgttataatttctgttcttttacatttgctgaggagtgctttacttccaactatgtggtcaattttggaataagtgtgatgtggtgctaagaagaatgtatattctgttgatttggggtgaagagttctgtagatgtctattaggtctgcttggtgcagagctgagttcaagtcctggatatcctttttaactttctgtctcgttgatctctctaatgttgacagtggggtgttaaagtctcccattattattgtgtgggagtctaagtctctctgtaggtctctaaggacttgctttatgaatctcggtgctcctgtattgggtgcatatatatttaagatagctcttcctgttgaattgatccctttaccattatgtaatggccttgtctcttttgatctttgttggtttaaagtctgttttatcagagactaggattgcaacccctgcttttttttgttttccatttgcttggtagatcttcctccatccctttattttgagcctatgtgtgtctctgcacctgagatgggtctcctgaatatcgcacactgatgggtcttgactctttatccaatttgccagtctgtgtctttttaattggagcatttagcccatttacatttaaggttaatactgttatgtgtgaatttgatcctgtcattatgatgttagctggttattttgctcgttagttgatgcagtttcttcctagcatcgatggtctttaaatttggcatgtttttgcagtggctggtatcggttgttcctttccatgtttagtgcttctttcaggagctcttgtaaggcaggcctggtggtgacaaaatctctcagcatttgcgtgtctgtaaaggattttatttctccttcacttatgaagcttagtttggctggatacgaaattctgggttgaaaattcttttctttaagactgttgaatattggcccccacgctcttctggcttgcagagtttctgccgagagatctgctgttagtctgatgggcttccctttgtgggtaacccgacctttctctctggctgcccttagcattttttccttcatttcaactttgggaatctgacaattatgtatttcagagttgctcttctcaaggagtatctttgtggcgttctctgtattccctgaatttgaatgtcggcctgccttgctaggttggggaagttctcctgtataatatcccgaagagtgttttccaacttggttccattctccccgtcactttcaggtacaccaatcagacatagatttggtcttttcacatagtcccatatttctttgaggatttgtttgtttctttttactcttttttctctgaacttctcttctcacttcatttcattcatttgatcttcaatcactgataccctttcttccacttgattgaatcagctactgaagcttgtgcacgcgtcacatagttcttatgccatggttttcagctccatcaggtcgtttaaggtcttctctatgctgtttattctagttagccattcgtctaatcttttttcaaggtttttagcttctttgcgatgggttcgaacatcctcctttagctcagagtttgttattaccgatcgtctgaagccttcttctctcaactcgtcaaagtcattctccgtccagctttgttctgttgctggtgaggagctgcgttcctttggaggagaagaggcactctgatttttagaattttcagcttttctgctctggtttctccccatctttgtggttttatctacctttggtctttgatgatggtgacatacagatggggtattggtgtggatgtcctttctgttagttttccttctaacagtcaggaccctcagctgcaggtctgttggagtttgctggaggtccactccagaccctgtttgcctgggtatcaccagtggaggctgcagaacagcaaatattgcagaacggcaaatgttgctgcctgatcctttctctggaagcttcatctcagaggggcacccggctgtataagatgtcagtcagcccctactgggaggtgtctcccaattaggctactcgggggtcagggacccacttgaggaggcagtctgtccgttctcagatctcaaaccgcgtgctgggagaaccactactctcttcaaagctgtcagacagggacgtttaagtctgcagaagttcctgctaccttttgttcagctatgccctgccgccagaggtggagtctacagaggcaggcag

SEQ ID NO: 12165 - DNA, 1907 bp, Homo sapiens
aatgtctctgtatccttgttaactttctgtctcgttgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaaatgatccctttaccattatgtaatggccttctttgtctcttttgatctttgtttgcttaaagtctgttttatcagagactaggattgcaacccctgccttttttttgttttccatttgcttggtagatcttcctccatccttttattttgagcctatgtgtgtctctgcatgtgagatgggtttcctgaatacagcacactgatgggtcttgactctttatccaatttgccagtctgtgtcttttaattggagcatttagtccatttacctttaaagttaatattgttatgtgtgaagttgatcctgtcattatgatgttagctggttattttgctcgttagttgatgcagtttcttcctagcctcgatggtctttacaatttggcatgattttgcagtggctggtaccggttgttcctttccatgtttagtgcttccttcaggagctcttttagggcaggcctggtggtgacaaaaactctcagcatttgcttgtctgtaaaggattttatttctccttcacttatgaagcttagtttggctggatatgaaattctgggttgaaaattcttttctttaagaatgttgaatattggcccccactgcttctggcttgtagagtttctgccgagagatccgctgttagtctgatgggcttccctttgtgggtaacccgacctttctctctggctgcccttaacattttttccttcatttcaactttggtgaatctgacaattatgtgtcttggagttgctcttctcaaggagtatctttgtggcattctctgtatttcctgaatctgaacgttggcctgccttgctagattggggaagttctcttggataatatcctgccgagtgttttccaacttggttccattctccccatcactttcaggtacaccaatcagatgtagatttggtcttttcacatagtcccatatttcttggaggctttgttcgtttctttttattcttttttctctaaacttcccttcttgcttcatttcattcatttcatcttccatcgctgataccctttcttccagttgatcgcatcggctcctgaggcttctgcattcttcacgtagttctcgagccttggctttcagctccatcagttcctttaagcacttctctgtattggttattctagttatacattcgtctaaatttttttcaaagttttcaacttctttgcctttggtttgaatttcctcctatagctcagagtagtttgatcgtctgaagccttcttctctcaactcgtcaaagtcattctccgtccagctttgttccgttgccgatgaggagctgcgttcctttggaggaggagaggcgctctgctttttagagtttccagtttttctgctctgttttttccccatctttgtggttttatctacttttggtctttgatgatggtgatgtacagatgggtttttggtgtggatgtcctttctgtttattagttttccttctaacagtcaggaccctcagctgcaggtctgttggagtttgctagaggtccactccagaccctgtttgcctgggtaccagcagcggtggctgcagaacagcagattttcatgaactgcaaatgctgctgtctgctcgttcctctggaagttttgtctcagaggagtacccggccgtgtgaggtgtcagtctgcccctactggggggtgcctcccagttaggctgctcggggg

SEQ ID NO: 12166 - DNA, 4959 bp, Homo sapiens
tattggtctaaaattctctttttttgtatctctgccaggtttttgtatcaggatgatgctggcctcataaaatgagttagggaggattccctctttttctattgattggaatagtttcagaaggaatggtaccagcccctctttgcacctctggtagaattcagctgtgaatctgtctggtcctggactttttttggttggtaggctattaattattgcctcaatttcatagcctgttattggtctatctagggattcaacttcttcctggtttagtctcaggagggtgtatgtgcccaggaatttatccatttcttctacattttctagtttatttgcatagaggtgtttatagtattctctgatggtagtttgtatttctgtgggattggtggtgatatcccctttatcattttttattgcatctatttgattcttctctcttttcttattagtcttgctagtggtctatcaattttgttgatcttttcaaaaaaccagctcctggattcattgatttttttgaagggttttgtgtatctctatctccttcagttctgctctgaccttagttatttcttaccttcttctagcttttgaatgtgtttgctcttgcttctctagttcttttaattgtgatgttagggtgtcaattttagatctttcttgctttctcttgtgggcatttagtgctataaatttccctctacacactgctttaaatgtgtcacagaaattctggtatgttgtgtctttgttctcattggtttcaaagaacatctttatttctgccttcatttcattacatacccagtagtcattcaggagcaggttgttcagtttccatgtagttgagtggttttgagtgagtttcttaatcctgagttctaatttgattgcactgtggtctgagagacagtatgttataatttctgttctttcacatttgctgaggggtgctttacttccaactatatggtcaattttggagtaagtgtgatgtggtgctgagaaaaatgtatattctgttgatttggggtggagagttctgcagatgtctattaggtccacttggtgcagagctgagttcaattcctggatatccttgttaactttctgtctcatcgatctgtctaatgttgagagtggggtgttaaagtctccccttattaatctgggtccttctgtattgggtgcatatatatttaggatagttagctcttcttgttgaattcattccttcaccattatgtaatggctttctttgtctcttttgagctttgttggtttaaagtctgttttatcaaagaccaggattgcgatccctgcttttttttgttttccatttgcttggtagatcttcctccatccctttattttgagcctatgtgtgtctctgcacatgagatgggtctcctgaatacagcacactgatgggtcttgactctttatccaatttgccagtctgtgtcttttaattggagcatttagcccatttacatctaaggctaatattgttatgtgtgaatttgatcctgtcattatgatgttagctggttattttgcttgttagtttatgcagtttcttcctagcatcgatggtctttacaatttggcatgtttttgctgtggctggtaccagttgttcctttccatgtttagtgcttccttcaggagctcttgaaaggcaggcctggtggtgacaaaatctctcagcatttgtttgtctgtaaaggattttatttctccctcacttatgaagcttagtttggctggatatgaaattctgggttgaaaattcttttaagaatattgaatattggcccccactttcatctggtttgtagagtttctgctgagagatctgctgttagtctaatggacttccctttgtgagtaacccaacctttccctctggctgcctttaacattttttccttcatttcaactttggtgaatctgacaattacatgccttagagttgctcttcttgaggagtatctttggggcattctctgtatttcttgaatttgaatgttggcctgccttgctaggttggggaaattctcctgccttgctaggttggggaagttctcctggataatatcctgaagtgcgttttccaacttggttccattcttccaatcaccttcaggtaaaccaatcagacatagatttggtcttttcacataatcccatgtttcttggaagctttgtttctctttactcttttttctctaaacttctcttctcacttcatttcattcatttgatcttcaatcactgataccctttcttccacttgatcgaatcagctactgaagttgcgcatgtgtcatgtagttctcgtgccatggttttcatctccatcaggtaatttaaggtcttctctatgctgtttattctagttagccattcatctaatcttttttcaaggtttttagctgctttgcgatggggtcaaacatcctcatttaacttggagaagtttgttattatcgatcgtctgaagccttcttctctcaactcacatcgatgcaaaaatcctcaataaaatactgtcaaaccaaatccagcagtacatcaaaaagcttatccaccatgatcaagttggcttcatccctgggatgcaaggctggttcaacatatgcaaatcaataaacgtaacccatcatatcaacagaaccaaactattgattatctcaatagatgcagaaaaggcctttgacaaaattaaacagtgcttcatgctgaaaactctcaataaactaggtattgatgggacatatctcaaaataataagagctatttatgacaaacccacagccaatatcatactgaatgggcaaaaactggaagcattccctttgaaaactggcacaagatagggatgccctctctcaccactcctattcaacatactgttggaacttccggccaaggcaatcagggaggagaaagaaataaagggtattcaattaggaaaagaggaagtcaaattgtccctgtttgcagatgacatgattgtatatttggaaaaccccatcatctcagcccaaaatctccctaagctgataagcaacttcagcaaagtctcaggatacaaaatcgatgtgcaaaaatcacaagcattcctgtacaccaataacagacaaacagagagccaaatcatgagtgaactcccattcacaattgcttcaaagagaataaaatacctaggaatccaacttacaagggatgtgaacgacctcttcaaggagaactacaaaccactgctcaacaaaataaaagaagacacaaacaaatggaagaacattccatgctcatggataggaagaatcaatattgtgaaaatgaccatacagcccaaagtaatttatagattcagtaccaaccccatcaagctaccagtgactttcttcacagatttggagaaaaactactttaaagttcatatggaaccaaaaaagagcccacattgccaagacaatcctaagccaaaagaacaaagctggaggcatcacgctacctgaattcaagctatactacaaggctacagtaaccaaaacagcatggtacttgtaccaaaacagagatatagaccaatggaacagaacagagccctcagaaataacaccacacgtctacaaccatctgatctttgatgaacctaacaaaaacaagcaatggggaaaggattccctatttaataaacggtgctgggaaaactgtctagccgtatgtagaaagctgaaactggatcccttccttacaccttatacaaaaattaattcaagatggattaaagacttaaatgttagacctaaaaccataaaaaccctagaagaaaacctaggcaataccattcaggacataggcatgggcaaagacttcatgactaaaacaccaaaggcaatgtcaacaaaagccaaaattaacaaatgggacctaattaaactaaagagcttctgcacagcaaaagaaactaccatcagagtgaacaggcaacctacagaatgggagaaaatttttacaatctatccatctgacaaagggctaatatccagaatctacaaagaacttaaacaaatttacaagaaaaaatcaaacaaccccatcaaaaagtgggcgaaggatatggacagatacttctcaaaagaagacatttatgcagccaacagacacatgaaaaaatgcttatcatcactggtcatcagagaaatgcaaatcaaaaccacaatgagatactatctcacaccagttagaatggcaatcattaaaaagtcaggaaacaacaggtgctggagaggatgtggagaaataggaacacttttacactgttggtgggactgtaaactaattcaaccattgtggaagacagtgtggcaattcctcaaggatctagaactagaaataccatttgacccagtcatcccattactgggtgtatacccaaagaattataaatcatgctgctataaagacacatgaacacgtatgtttattgcagcactattcacaatagcaaagacttggaaccaacccaaatgtccaacaatgataggctggattaagaaaatgtggcacatatacaccatggaatactatgcagccataaaaaaggatgagttcatgtcctttgtagggacataggtgaagctggaaaccatcattctgagcaaactatcacaaggatagaaaaccaaacaccacatgttctcagtcacaggtgggaattgaacaatgaaaacacttggacacagggtggggaacatcacacactggggcctgttgtggagtggggggaggggggagggatagcattaggagacattcctaatgtaaatgacaagttaatgggtgcaacacaccaacatggcacatgcatacatatgtaacaaacctttacattgtgcacatgtaccctagaacttaaagtataataattaaaaaaaaaaa

SEQ ID NO: 12167 - DNA, 4060 bp, Homo sapiens
tttattatactttaagttttagggtacatgtgcacattgtgcaggttagttacatatgtatacatgtgccatgctggtgcgctgcacccactaactcgtcatctagcattaggtatatctcccaatgttgcccctcccccctccccccaccccaccacagtccccagagtgtgatattccccttcctgtgaccatgtgatctcattgttcaattcccacctatgagtgagaatatgcggtgtttggttttttgttcttgcgatagtttactgagaatgatggtttccagtttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacaatgacttccacaatggttgaactagtttacagtcccaccaacagtgtaaaagtgttcctatttctccacatcctctccagcacctgttgtttcctgactttttaatgattgccattctaactggtgtgagatggtatctcatagtggttttgatttgcatttctctgatggccagtgatgatgagcattttttcatgtattttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggttttatgtctaacgtttaaatctttaatccatcttgaattgatttttgtataaggtgtaaggaagggatccagtttcagctttctacatgtggctagccagttttcccagcaccatttattaaatagggaatcctttccccattgcttgtttttctcaggtttgtcaaagatcagatagttgtaggtatgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgagttggcgatgtgggctcttttttggttccatatgaactttcaagtagtttttccaattctgtgaagaaagtcattggtagcttgatggggatggcattgaatctgtaaattaccttgggcagtatggccattttcacaatattgattcttcctacccatgagcatggaatgttcttccatttgtttgtatcctctcttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgcggtttttgtctttggctctgtttatatgctggattacatttattgatttgcgtatattgaaccagccttgcatcccagggatgaagcccacttgatcatggtgtataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacttctggtagaattcggctgtgaatccatctggtcctggactctttttggttggtaaactattgattattgccacaatttcagctcctgttattggtctattcagagattcaacttcttcctggtttagtcttgggagagtgtatgtgtcaaggaatgtatccatttcttctagattttctagtttatttgcgtagaggtgtttgtagtattctctgatggtagtttgtatttctgtgggatcggtggtgatatcccctttatcattttttattgtgtctatttgattctcctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttgctttcaaagaacatctttatttctgccttcatttcgttatgtacccagtagtcattcaggagcaggttgttcagtttccatgtagttgagcggctttgagtgagattcttaatcctgagttctagtttgattgcactgtagtctgagagatagtttgttataatttctgttcttttacatttgctgaggagagctttacttccaactatgtggtcaattttggaataggtgtggtgtggtgctgaaaaaaacgtatattctgttgatttggggtggagagttctgtagatgtctattaggtccgcttggtgcagagatgagttcaattcctgggtatccttgttgactttctgtctcgttgatctgtctaatgttgacagtggggtgttaaagtctcccattattaatgtgtgggagtctaagtctctttgtaggtcactcaggacttcctttatgaatctgggtgctcctgtattgggtgcatatatatttaggatagttagctcctcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaacttgccagtctgtgtcttttaattggagaatttagtccatttacatttaaagttaatattgttatgtgtgaatttgatcctgtcattatgatgttagctggtgattttgct

SEQ ID NO: 12168 - DNA, 4056 bp, Homo sapiens
ataatttttttttaaatttattataatactttaagttttagggtacatgtgcacaatgtgcaggttacatatgtatacatgtgccatgctggtgcgctgcacccactaactcgtcatctagcattaggtatatctcccaatgctatccctcccccctccccccaccccacaacagtccccagagtgcgatgttcctcttcctgtgtccatgtgttctcattgttcaattcccacctatgagtgagaatatgcagtgtttggttttttgttcttgcgatagtttactgagaatgatgatttccaatttcatccatgtccctacaaaggacatgaactcatcacattttatggctccatagtattccatggtgtatacgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccctgaggaatcgccacactgacttccacaatggttgaactagtttacagtgccaccaacagtgtaaaagtgttcctatttctcgacatcctctccagcacctgttgtttcctgactttttaatgattgccattctaactggtgtgagatggtatctcattgtggttttgatttgcatttctctaatggccagtgatggtgagcattttttcatgtgttttttggctgcataaatgtcttcttttgagaagtgtctgttcatgtcctttgcccactttttaatggggttgtttgtttttttcttgtaaatttgtttgagttcattgtagattctggatattagccctttgtcagatgagtaggttgtgaaaattttctcccattttgtaggttgcctgttcactctgatggtagtttcttttgctgtgcagaagctctttagtttaattagatcccatttgtccattttgccttttgttgccattgcttttggtgttttagacatgaagtccttgcccatgcctatgtcctgaatggtaatgcctaggttttcttctagggtttttatggttttaggtctaatgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatacgcggcgttatttctgagggctctgttctgttccattgatctatatctctgttttggtagcagtaccatgctgttttggttactgtagccttgtagtatagtttgaagtcaggtcgcgtgatgcctccagctttgttcttttggcttaggattgacttggtgatgcaggctcttttttggttccatatgaactttaaagtagttttttccaattctgtgaagaaagtcattggtagcttgatgaggatggcactgaatctgtaaattaccttgtgcagtatggccattttcacgatattgattcttcctacccatgagcatggaatgttcttccatttgtttgtatcctcttttatttcattgagcagtggtttgtagttctccttgaagaggtccttcacatccttgtaagttggattcctaggtattttattctctttgaagcaattgtgaatgggagttcactcatgatttgtttctctgtttgtctgttgttggtgtataagaatgcttgtgatttttgtacactgattttgtatcctgagactttgctgaatttgcttatcagcttaaggagattttgggctaagacaatggggttttctagatatacaatcatgtcgtctgcaaacagggacaatttgacttcctcttttcctaattgaataccctttatttccttctcctgcctgattgccctggccagaacttccaacactatgttgaataggagtggtgagagagggcatccctgtcttgtgccagttttcaaagggaatgcttccaatttttgcccattcagtatgatattggctgtgggtttttcatagatagctcttattattttgagatacgtcccatcaatacctaatttattgagagtttttagcatgaagtgttgttgaattttgtcaaaggccttttctgcatctattgagataatcatgtggtttttgtcttctgttctgtttatatgctggattacatttattgatttgcatatattgaaccagccttgcatcccagggatgaagtccacttgatcatgggggataagctgtttgatgtgctgctggattcgttttgccagtattttattgaggatttttgcatcaatgttcatcaaggatattggtctaaagttctctttttcagttgtgtctctgcccagctttggtatcaggatgatgctggcctcataaaatgagttagggaggattccctctttttctattgattggaatagtttcagatggaatggtaccagttcctccttgtacctctggtagaattcggctgtgaatccatctggtcctggactctttttggttggtaagctattgattattgccacaatttcagctcctgttattggtctattcagagattcaacttcttcctggtatagtcttgggagagtgtatgtgtcgaggaatttatccatttcttctgtattttctagtttatttgcatagagttgtttgtagtattctctgatggtagtttgtatttctgtgggatcggtggtgatatcccctttatcattttttattgcttctatttgattcttctctctttttttctttattagtcttgctagcggtctatctattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgagtcccagagattctggtatgttgtgtctttgttctcgttggtttcaaagaacatctttatttctgccttcatttcgttacgtacccagtagtcattcaggagcaggttgttcagtttccatgtagttgagcggttttgagtgagattcttaatcctgagttctagtttgattgcactgtggtctgagagatagtttgttataatttctgttcttttacatttgctgaggagagctttacttccaactatgtggtcaattttggaacaggtgtggtgtggtgctgaaaaaattgtatattctggtgatttggggtggagagttctgtagatgtctactaggtctgcttggtgcagagctgagttcaattcctgggtatccttgttgactttctgtctcgttgatctgtctaatgttgacagtggggtgttaaagtctcccattattaatgtgtgggagtctaagtctctgtgtaggtcactcaggacttgctttatgaatctgggtgctcctgtattgggtgcatatatatttaggatagttagctcttcttgttgaattgatccgtttaccattatgtaatggccttcttcgtctcttttgatctttgttggtttaaagtctgttttatcagagactaggactgcaacccctgcctttttttgttttccatttgcttggtagatcttcctccatccttttattttgagcctatgtgtgtctctgcacgtgagatgggtttcctgaatacagcacactgatgggtcttgactctttatccagtttgccagtctgtgtcttttaattggagcatttagtccatttacatttaaagttaatattgttatgtgtgaattagatcctgtcattatgat

SEQ ID NO: 12169 - DNA, 5567 bp, Homo sapiens
aatttaattttattattattattatactttaagttttagggtacatgtgcacaacatgcaggtttgttacatatgtgtacatgtgccatgttggtgtgctgcacccattaactcatcatttagcattaggtatatctcctaatgctatccctcacccctccccccaccccacaacagtccccggtgtgtgatattccccttcctgtgtccatgtgttctcattgttcaattcccacctatgagtgagaacatgcggtgtttggttttttgtccttgcgatagtttgctgagaatgatggtttccagtttcatccatgtccctacaaaggacacaaactcatcatctttatggctgcatagtattccacggtgtatatgtgccacattttcttaatccagtctatcgttgggcatttgggttggttccaagtctttgctattgtgaatagtgctgctataaacatacgtgtgcatgtgtctttatagcagcatgatttatagtcctttgggaatatacccagtaataggatggctgggtcaaatggtatttctagttctagatccctgaggaatcgccacactgacttccacaatggttgaattagtttacagtcccaccaacagtgtaaaagtgttcctatttctccacatcctctccggcacctgttgtttcctgactttttaatgatcgccattctaactggtgtgagatggtatctcattgtggttttgatttgcatttctctgatggccagtgatggtgagcattttttcatgtgttttttggctgcataaatgtcttcttttgagaagtgtttgttcatatccttcgcccactttttgatggggttgtttgtttttttcttgtaaatgtgtttgagttcattgtagattctggatattcgccctttgtcagatgagtaggttgcaaaaattttctcccattctgtaggttgcctgttcactctgatggtagtttcttttgctgtgcagaagctctttagttgaattagatcccatttgtcaattgtggcttttgttgccattgcttttggtgttttagacatgaagtccttgcccatgcctatgtcctgaatggtattgcctaggttttcttctagggtttttatggttttaggtctaacatttaagtctttaatccatcttgaattactttttgtataaggtgtaaggaagggatccagtttcagctttctacatatggctagccagttttcccagcaccatttattaaatagggaatcctttccccattgcttgtttttgtcaggtttgtcaaggatcagatagttgtagatatgtggcattatttctgagggctctgttctgttccattggtctgtatctctgttttggtaccagtaccatgctgttttggttactgtagccttgtagtatagtttgaagtcaggtagtgtgatgcctccagctttgttcttttggcttaggattgacttggtgatgcaggctcttttttggttccatatgaactttaaagtagttttttccaattctgtgaagaacgtcattggtagcttgatgcggatggcttgaatctctaaattaccttgggcagtatggccattttcacgatattgattcttcctacccatgagcatggaatgttcttccatttgtttgtatcctcttttatttcattgagcagtggtttgtagttcttgaagaggtccttcacatcccttataagttggattcctaggtattttattctctttgaagcaattgtgaatgggagttcactcatgatttggctctctgtttgtctgttattggtgtataagaatgcttattatttttatacattgattttgtatcctgagactttgctgaagttccttatcatcttgaggagattttgggctgagacaatggggttttcaagatataaatcatgtcatctgcaaacagggacaatttgacttcctcttttcctaattgaataccctttatttccttctcctgcctgattgccctggccagaacttccaacattatgttgaataggaggtgagagaggacatccctgtcttgtgcccgttttcaaagggaatgcttccagtttttgcccattcaatatgatattggctgtgggtttgtcatagatagctcttattattttgagatatgtcccatcaatacctaatttattgagagtttttagcatgaagcgttgttggattttgtcaaaggccttttctgcatctattgagataatcatgtggtttttgcctttggttctgtttatatgctggattacatttattgatttgtgtatgttgaaccagccttgcatcccagggatgaagcccacttgatcatggtggataagctttttgatgtgctgctggattcggtttgccagtattttattgagtatttttacatcaatgttcatcaaggatattggtctaaaattctcttttttggttgtgtctctgccaggctttggtatcaggatgatgctggcctcatcaaatgagttagggagtattccctctttttctattgattggaataatttcagaaggaatggtaccagctcctctttgtacctctggtagaatttggctgtgaatccatctggtcctggactctttttggttggtaagctattgattattgcctcaatttcagatcctgttatttgtctattcagagattcaacttcttcctggtttagtcttgggagggtgtatgtgtcgaggaatttatccatttcttctagattttctagtttatttgcaaagaggtgtttatagtattctctgatggtagtttgtatttctgtgggatcggtggtgatatcccctttatcattttttactgcgtctgtttgattcttctctcttttcttctttgttagtcttgctagcggtctatcaattttgttgatcttttcaaaaaaccagctcctggattcattaattttttgaagggttttttgtgtttctgtttccttcagttctgctctgatcttagttatttcttgccttctgctagcttttgaatgtgtttgctcttgcttctctagttcttttagttgtgatgttagggtgtcaattttggatctttcctgctttctcttgtgggcatttagtgctataaatttccctctacacactgctttgaatgtgtcccagagattctggtatgttgtgtctttgttcttgctggtttcaaagaacatctttatttctgccttcatttcattatttacccagtagtcattcaggagcaggttgttcagtttccatgtagttgagcggttttgagtgagtttcttaatcctgagttctagtttgattgcactgtggtctgagagacagtttgttataatttctgttcttttacatttgctgaggagtgctttactgccaactatgtggtcaattttggaataggtgtggtgtggtgctgaaaagaatgtatattctgttgatttggggtggagagttctgtagatgtctgttaggtctgcttggtgcagagctgaggtcaattcctcggtatccttgttgactttctgtctcactgatctgtctaatgttgacagtggggtgttaaagtctcccattattattgtgtgggagtctaagtctctttgtaggtcactaaggacttgctttatgaatctgggtgctcctgtattgggtgcatatatatttaggatagttagctcttcttgttgaattgatccctttaccattatgtaatggccttctttgtctcttttgatctttgttggttgaaagtctgtttcatcagagactaggattgcaacccctgcctttttttgttttccatttgcttggtagatcttcctccatccctttattttgagcctatgtgtgtctctgcacgtgagatgggtttcctgaatacagcacactgatgggtcttgactctttatccaatttgccagtctgtgtcttttaattggagcatttagcccatttacatttaatttaatattgttatgtgtgaatttgatcctgtcattatgatgttagctggttattttgctggttagttgatgcagtttcttcctagcttggatggtctttacaatttggcatgtttttgcagtggctggtactggttgttcctttccatgtttggtgcttccttcaggagctcttgtagggcaggcctggtggtgacaaaatctctcagcatttgcttgtctgtaaaggactttatttctccttcacttatgaagcttagtttggctggatatgaaattctgcattgaaaattctttcctttcagaatgttgaatattggcccccactctcttctggcttgtagagtttctgccaagagatcagctcttagtctgataggcttccctttgtgggtaacccgacctttctctctggctgcccttaacatttttcccttcatttcaactttggtgaatctgacaattatgtgtcttggaattgcttttctcaaggagtatctttgtggcgttctctgtattttctgaatttcagtgttggcctgccttgctagaatgggggacttctcctggataatatcctgcagagtgttttccaacttggttccattctccctgtcactttcaggtacaccaatcagacgtagatttggtcttttcacatagtcccatatttcttggaggctttgtttgttgctttttattcttttttctgtaaacttctcttctcacttcatttcattcatttcatcttccatcactgatacccttttttccagttggtcacatcggctactgaggcttctgcattcatcacgtagctcttttgccttggttttcagctccatcaggtccttttaggacttctttgcattggttattctagttatccattcgtctatttttttttcaaagcttttaacttctttgccattggtttgaatttcctcctgtagctcagagtagtttgatcgtctgaagccttcttctctcaactcatcaaagtcattctccatccagctttgttccattgctggtgaggagctgcgttcctttgcaggaggagaggcactctcatttttagagtttccagtttttctgctctgtttttttcccatctttgtgtttttatctacctttggtctttgatgatggtgacgtacagatgggtttttggtgtggatgtcctttctgtttgttagttttccttctaacagacaggaccctcagctgcaggtctgttggagtttgctagaggtccactccagacgctgtttgcctgggtatcagcagcggtggctacagagcagtggatattggtgaaccgcaaatgctgctgcctgattgttcctctggaagttttgtgtcagaggagtacctggctgtgtgaggtgtcagtctgcccctactggggggtgcctcccagttgggctactcgggggtcagggacccacttgaggaggcagtctgcccgttctcagatctgaagctgtgtgctgggagaaccactcctctcttcaaagctgtcagagagggacatttaagtctgcagaggtaactgctg

SEQ ID NO: 12170 - DNA, 28257 bp, Homo sapiens
  misc_feature (10735)..(10735): n equals a,t,g, or c
gtttctttttttaaatttaattttattattattatactttaagttttagggtacatgtgcacaatgtgcaggttagttacatatgtatacatgtgtcatgctggtgtgctgcacccattaactcgtcatttagcattaggtgtatctcctaatgctgtccctccccccttcccctaccccacaacagtccccagagtgtgatgttccccttcctgtgtccatgtgttctcattgttcaattcccacctatgagtgagaacatgcagtgtttggttttttgtccttgcgatagtttactgagaatgatgatttccaatttcatccatgtccctacaaaggacacgaactcatcattttttatggctgcatagtattccatggtgtatatgtgccacattttcttaatccagtctatcattgttggacatttgggttggttccaagtctttgctactgtgaatagtgctgcaataaacatacgtgtgcatgtgtctttatagcagcatgatttatagtcctttgggtatatacctagtaatgggatggtcaaatggtatttctagttctagatccctgaggaattgccacactgacttccacaatggttgaactagtttacagtcccaccaacagtgtaaaagtgttcctatttctccacatcctctccagcacctattgtttcctgactttttaatgattgccattctaactggtgtgagatggtatctcattgtgggtttgatttgcatttctctgatggccagtgatggtgagcattttttcatgtgttttttggctgcataaatgtcttcttttgagaagtgtctgttcatgtccttcacccactttttgatggggttgtttttttcttgtaaatttgtttgagttcattgtagattctggatattagccctttgtcagatgagtaggctgtgaaaatgttctcccattttgtaggttgcctgttcactctgatggtagtttcttttgctgtgcagaagctctttagtttaattagatccatttgtcaattctggcttttgttgccattgcttttggtgttttagacatgaagtccttgcccatgcctatgtcttgaatggtaatgcctaggtttttttctagggtttttatggttttaggtctaacgtttaagtctttaatccatcttgaattaatttttgtataaggtgtaaggaagtgatccagtttcagctttctacatatggctagccagttttcccagcaccatttattaaatagggaatcctttccccattgcttgtttttctcaggtttgtcaaagatcagatagttgtagatatgtggcgttatttctgagggctctgttctgttccattgatctatatctctgttttggtaccagtaccatgctgttttggttactgtagccttgtagtatagtttgaagtcaggtagcatgatgcctccagctttgttcttttggtttaggactgacttggcgatgcaggctcttttttggttccatatgaactttaaggtagttttttccaattctgtgaagaaagtctttggtagcttgatggggaaggcattgaatatataaattaccttgggcagtatggccattttcatgatatcgattcttcctacccatgagcatggaatgttcttccatttgtttgtatcctcttttatttcattgagcagtggtttctagttcttgaagaggtccttcacgtcccttgtaagttggattcctaagtattttattctctttgaagcaattgtgaatgggagttcactcatgatttggctctctgtttgtctgttattggtgtataagaatgcctgtgatttttgtacattgattttgctcctaatcatgtttctaatatgacaaactgatggatacttcactgctctcttcttattctatttctcaacagtatttatcatgatcatcaatcaatctggacctgaagccctcaactcgcctggcttctgaaactccacactcttggttttctttctattcctctgatcctgcctctactgggtctttcttctctaccctttcttggcttaatctggagcctctttccttttctcttgtttcctggcacagcttcattaagcaatctcatctagttccatggattaaaatggtctctttatgctgatgactactagactccaagaattatcctctgtcttgaccagtggttcttaaagtgggaaccctggaccagtagcatcagcatcacctggaaacttgttagaactgcaaattctctgactccacccagcccttcttaatcagaaactctgaaggtagggcccagcagtctgtatgttaacgagctctccagctgattgtgatgcacattgaagttgaagaacaactgctctagactaacatatttaatggcctcatttccatctctccttgtatgtctcacggaaatataaatcttcacacatccagtttcatgtcttttttctctctcaacttcctcagcccacatctaatccattagtaaatattgctaattctatctccaatttatataaaaaagtaccagtttctccacaattctatcaccaccactataattagaagcaccatcttactttttcatgcaagaccaatgcaacattttctacttattcccaacttgtccccctccaaccccaatctccatactgcaagcaagcaaggtcttttaaaaatgtaatttggctcctccatcctaaaacactctaagtggttttcccttagacctagaataggatccaaactccataccatggtctccaaggccctacccgatttgagtcaggtccattcctccattacttcacctagtggcagcctctccctctcctactgcatcccagatgcactggttttctctcttagttccctggagaagccagctgctttctgcctcagagactatgcccttttctttggaactttccttctcatcctgtgaatggctggctcagccgctcagccccgcagtctcagcttaaatgtcacttccttttatgtgctttttaccacctatattttcctccacaacccactattctcaatcatcacctttttatttccttcctagcatgtccacaatttggaatattttctttttttttttttttgaggcagagtctcactctgtcatccagactggagtgcaatggcgcgatgtctgctcactgcaacttctgtctcccaggctcaagtgactctcctgcctcagcctcccaagtagctgggattacaggcatgtgccaccatgctcggctaatttttgtatttttagtagagggagggtttcaccatgctggtcaggctggtctcgaactcctcacctcaaatgatccacccacctcggcctcccaaagtgctgggattacaagcgtgagccactgcacccagcccacaacttataaatgttctattcagtcacctactcacttgatgttggttttattttgtttgtctctgttcttctcttcctaccacactgaatgtgaactcatgagagaaggagactcatatatctccatcactgtcagtgtctggcacagtggcgggcacagggtaggtagttgttgatgtaatcactcttattagcatgtgaaaaggaggtgggggagacaccctgtcaggccttttggagctcctaggtgctggatcctaaatcacaagaagtcaaagcctcacttaagttttgtgttcctgtgtgcacagccctgagctaataggaggcaaccactgtccgcaaggagcatcccttctagatgggaacacaaggtgagacatacatgcgtgcaaacactggagagcaagtgaagacagacacaatcagaggtaagactaattggtccaaaatctaaatatcatgggaattttggggcaggaccgataacagggcactaggataggtgagaaaaatgagaaattggcaatagggcaatttcctcatgtgagctcctcatgggcatgagatatgtctttttgttattctgttaaatacctgttttgttttgcttaagggcataacttcaagtagataaagaatgtgtccatccctaaggaaatcagggccaccagtctagctaggaagcctcctttctttttctaaggaaacagtctgcaagcagcatagtcagctgtgaggatgagggcaaggacagcattgtgtataacacagtgtagcctttttactcaggtggctaatgcaatccacagaagaacttaaaagattcagaaatgacaaagctagcttatgacaaaaacagtcaagaactttcctcgcttcctctccttcttccccctgtttgggccctacatagcaatctgaaagagaagggagaatactacacaggtaagagggaaagggacatgatcgcttttcaccagaagggccagcctaaagcagaactcactgggagagaagagacgacttaccaggacacatgttcaaagtttgattcttacataggactggacaattaattacttaactaattaatagagggtgtgattatgacataaagtgactgtaggatttttgtttcctaagctaatggtgaagtaatgggacctacttgaatttttatccagaatgtgggagtggggctagctctgatgaatgaatgttaaaactttatgtgtcctgcttgagtaaaatactaaagaatgaaaaaataacaaatatatgaatgaataaaccaaagcacaaaaatcccacaggtgaagatgtctaagatggtggagacaattccagatgctggatcttccctcttgtctgttctacctgctaaaggagctcagaggtaaagccaggggaacacctaagaagagcatggatttattttattaattatttagccaaaagctatgatggtagaacaacttttgaagtaaagaagccaggtaactataacaacaaccctcttcttcaatattccagtccaactacccttccaagagatgacctggagtcagtagtttggcctataagcttctagtgcttcactatacttttatacacatatatagacatgaagccacatatattatggagtgtgtttgcatttttaatgggttcataatacatgttattcaatatttgttttcactgaacatgtgttttgcttttcactgaatgtacattattccacaacagtgatggctcataatttagccaaccacaattctactgatagacatttaagttgtgtttaatttttaccaatgtgatgccatgggatttttaacatatctttttacatgtgcaaacatttcttcaacacagatttctaaaaatgaaagttttagatcagagatttaaatgtatgtattttaacttttattttatagagatgggggtctcactatattgcccaggagggatggtcttgaactcctgaactcaagcaatcctcccaccttggcctcccaaagtgctggaattacaggcatgagccactgcacctggccttattttggatttagatggatacctatcaagactgactgagggtttcactcccccacacacttgctaatgctggatattaacaagctataaattttttccaatctcctgagtagaaactgataactcagtgttgtttttatttgtattcccctcactaggagcaaggctgaccatcttttcatgtttgtggaccatttgtacttttcagctgttcatattctttacccatttttccattggattgttcatcttttaaacatcatgggtaggatgtttttatgttggatactagttgtgagttacatgcttgacaaatgttttttcccagcttatcatttacgctttctttttaacttttaagacagcatcttttattgaggagaaatgtatgtggaaaaaagtgatattttttcctttatgtattatagattttgtatgctgcttaagaagaccttaccccaatgaaatatttcctcatctttccatctaatactcttgcaattttgtttttcaagttgaagtttttaattcatttgaaatttatcgtagtataaagtaggtatctgtatttttccaaaaacttccaacaccatttattgatagttcacacttttctgtctggttagaaatgccatttttattataaaccaaattgcaattcatgtattagtctgtttgaagaatttctgttctgttcaattgataactttatataggagctaacagcgcattaattactacagctttttagaatactttgatgttggataggtcaagttccatttcatttatcttcactcatttaaaaaaatctggtatgttgagaatcaggttttcaaatttcataaaaatgagaatttcatcaactttcttaatttgggaatgatatgagagctttacagtgttaagccttcccacccagaagacttccacaatttccatctttacttattgagatcttttatgtctttgggtagagttctcaagtattctttatataggttttgcacatttcttaacaggtttactgctggtattttatagtttatgctgccattgctattacatttcttaactgctggtgtagagattctacaaatatcttgtatccagacattttattacacactcctttaactgattcttttgcttctctaggcagaattcattagtatgactgatattttgacttcagagtgaaagatgcgagagatatgcagatgatctttaagtatctataagattctgtgtacaaccagagagaaagactacgtaaataattcagaattcaatcaggcagtaaagagattagttgaacagagttatcagctacctcagtggaaggctgtagacttaaatcagatggaagaattgggtaacttgtaatttgaacccaggagaaatgaaccccatttgaagggtttatacttggagtccctgttgtcacggcaactatgaaaggagctcatagtttctattgctgacaaggggagaatcatgctggatatacagctcccaggttcagatttcttaacctctggtctctcaagatgataaaacccagcttgctagcagtggtaaaactgtactctttgcaagtagtatgtttccaatctcatagaattttagaatgtaatatattctaaagaaaataaaactaatattattgatacttgtgtgttacatttaggataatttaggtcaatctggattctacattgacatattaggctatttggcagattagccttgtgatttcaatttggaatgtgtatgaataattgaattttagaatgagagctttattttgagatgtgtaagataatttgaccaaatctgaaaatagtattagaatgtttaaataaggtgagctacactatatttataggtttaacttactagatttgtaagaattgtgaaagtaacagaaagggttttcttattaagataggcattttttaaggctttgaagaaaattaaatttttaaaatttataagtggattttatttcctttaagagaatataagttgtaaatagggctagtttttaaagagtttagtctataaaacttaagttactcaaataattttttacaaagtaaaatgattgttcttattttctacacatataaaaagaaaacaaagatttgtaagttgcacttaacggcttggagagaattaaattttaaaatttttcgccataataaattgatattcatttttaaatacattgtttctctgtacacaaattattttcgctgtacagagattatttccttagattgtctaggtagatgatcatttcatatgaaataatgtcagttttgtcattgatatgtcatttatgccttttgtcagttttgtcatttatactttttacacctgcttcttgtttgtacactggccaaaacctgagtggtaatggtggctgtccatgttttattcctgattatggtaatatttcaccattaagtatgaggtatgctatcagttcttgaatataagttttgcctcatcaaagatatttttctatttctagtttaaacaacttttaaaatcataaacaaatattgattttgaaatacacttttttcagcctctgttgaaaagaccaaaatctttttcactttaatctgctaacagagaattacattaatacattttctcatactgaaactttagtaaagtaaatcctaacaggtcataatatattaacataccattgaattttacttggaaattaaaattttttttacatttatgttcataaatgaaatcagtctataattgtatcatatgttatctctggatttttctttttcatttttaatgaactttatttttcagagtgggctaaggttcacagcaaaattgagcagaaagtacagagagtttccatgtactctctgtctgcacatatgcacaacctcccctacgactgacaccttgcaccacagtggtacatttgttacaatcagtgaacctaggttgacatgtaactgtcacgcaaagtccatagtttacattagggtttactcttggtgttgtacattctatggattttgacaactgtataatgacatgtatccaccattgtagtatcatacagaatagtttcactgttctaaaattccgtgctctgcctactaatccctccctcccctctaacgcctggcaatcattaatctttttactgtctctgtacttttgtgttttccagaatgtcatatagtagaatgatacagtatgtagcccttccatattgacttctttcacttagtaatatacacttaagtttcctccatatcttttcatggcttgatagctcatttctttttagtgctgaataatattcaattgtccgaatgttccacagtttttttaatccattcacctactgaaggacatcttggttgtttccaagttttggcaattatgtataaggctgttataaacatctatgtttaggtttttctaaacatgttttcaattcatttgggtaaataccaaggagtaaaattactggatcatatgataagagtacgtttagttttctgagaaactgccaaactatctttcagagtggctatagcatttttcattcccaactgcaatgaatgagagttcctgttgctccatattcttggcagcatttggtgttgtcagtgttttggattcagaccattctaatgggtatgtagtggtatctcattattgttttaactagcaattctctagtgacacatgctgttgagcatcttttcatacgcttgcttgccatctgtctatcttctttggtgggatatctattcgggtcttttgcccattttttaattgggttgtttgtgttcttattgttgagtttttgttttattttgttttttttgagacggagttttgctcttgtcacccaggctggggtgtaatggtgcaatctcagctcactgcaacctccacctcctgggttcaagtgattatctagccttgcctcttgagtagctgggattacaggcatgtgccaccatgcccagctaatttttgtatttttagtagagatgaggtttcatcatgttggccaggctggtcttgaactcctgacgtaaggtgatccacccgcctcagcctcccaagggattacaggcatgagccaccacacccagcttattgttgagttttaagagtgctttgtatatttcagataacaaaccattaacagatgtgtcttttgcaaatgtattctccctgtctatggcttgtcatttcattctcttgacactgtcttccccagagaaaaaggatttaattttaatgaagcttagcttattaattatttctttcatggatcatgctttaggcgtatgaaaaagatcattgctatatccaaggtcatccaaattttctcctgtattatcttctaggagctttatagttttgcattttatattcaggtctatgatccgttttgagttaattcttataaggggtataaggtgtattctagattcttttttttgagggggggatgtccagttcttccagcattgtatgtagaaaagactttcactgcttcattgtattggcttcattcttttgtcaaaaatcagtttacaatatttatgtgggtgagggtctatttctggcctctctattttgttccattgatctatttggctatttttttcactaataccacaccctcttgattaatgtagctttataagaagttttgaattcaagtaatgtcagtcctccaactttataattctatttcaatattatgttggctattctgggtcttttgcctcttgatataaatattataatcagtttttcaatacccagaaaataacttgctgggattttgaccaggattgtgttgaatccagagatcaagttgggaagaacagacattttgacaatattgactctttctatccataaaatatggaatatttctccattcatttagttctttgctatcttttatcagaattttttagttttcttcatacagatcttgtacatactttgttagatttacaccttagtattcccttttttgagggtgctactagagatgataatgtgttgttaattccaaactccacttgtttattgctgtatatagaaaagcaattgacttttatatattagccttgtaccctgcaaccttgtaataatcacttattagttccagaaggtggtggtggttgtggcagcggtggtggtggcancggtggtggtggtggtggtggtggtggtgatggtgacggtgttattgattcttttggattttctatatggacaatcatgttacctgtgaacaaagagagtattacttcattcccaatctgtttcatttccttttcttgttttattggcttagctagaactttcagtatgatgttgaaaagcagtggtgagagaggaaggacatccttgcctttctcctgatcttactggaaaagccttgagtttgtcaacatgatgtatgatgttaaccgcagggtttttaaaaaatgttttctaaaatcaggttgaggtagttcccttcaattactagtttgctgagagtattactctatcatgaatgagtgttagattttgttaaatgctttttctgtatctattggtatgttcatgccatatttcttctttagcttatcattgtgataaattacgttaactgatttttgaatgttgaacgaaccttgcatacctgggttaaacctcaattagttgtggtgtttaattctttttatacaccattgaattagatttgctaatattttgttaataatttttgcgtctatgttcatgagaaatattggtctgtaacttttttgtagtgtctttatctggccttggtattacattaatgctgggatcatagaataaaacactgctcaaagaaatcagcaatgacacaaacaaatggaaaaacattccatgctcatgaatagaaagaatcaaaaacaaacagaatatacattcctctcatctgcacatggcacatgctctaaaactgaccacacagtgagacataaaacaatcctcagcaaaaattttaaaaacaaatttttattttattttattttatttatttatttatttgagatggtgtctcactgtgttgcctgggctggagtgcagtggcatgatcttggctcactgtaacctctgcctccctggttcaagcaattctcctacttcagcctcccaagtagctgggattacatgtgtgcaccaccacgcccagctaatttttgtatttttagtagagacagggtttcaccatgttggccgggctggtcttgaactccttacctcaggtgatccacccagctcagcctcctacagtgctgggattacaggcatgagccactgcacccagccccaaaattttaaaaagcaaaatcgtaccacactcttggaccacagagcaataaaaatagaaaccgatactaagaaaatcactcaaaatcacacaagtacatggaaattaaacaacctgcttctaaatgactgtggggtaaataatgaaattaaggcagaaatgaagtttttctttgaaactaaagagaacacagacacaacataccagatctccggacacagccaaagcagtgttaaggaggaaggaagtttatagcactatacaccaacatcacaaaattagaaagtctcaaattaacaatataatatcgcaactagaggaactagagaaacaagagcaaaccaatcccaaaactagcagaagacaagaaataactaaaatcaaagctgagctgaaggaaactgagacatcaaaaaccatgtggaagaacaaagaatccaggaatttattctttgaaaaaagttaatatagactgctagccagactaataaaaaagcagaagatccaaataaacacaatcagaaatgacaaaggggacactaccacggacccgaaagaaatacaaaaacccctcagagactactgtgaacagctgtatgcacacaagctagaaaacctaaaagaaatggataaattcctgcaaacatacagtcttccaagactgaaccacaaagaaattgaatcctcaaacagaccaataatgagttctaaaactgaaccagtaataaaaagcctaccaaccagtggttcaggcctccaatcctagcactttgggaggctgaaggtgggcagatttcctgagctcaggagtttgagaccagcctgggcaacatggttaaaccccgtctctactaaaatacaaaaaattagccaggtgtggtggagtgcaccagtagtcctagctacttgggaggctgaggcacaagaattgcttgaacctgggaggtgacaaagtgagactctgtctccaaaaaaagaagagctggtgccattcctaatgagactactccaaaaaattgaagaggagggactcctccccaattcattctatgtggacagcatcatgctgataccaaaacctggcagagatacaacaaaaaaagaaaagttcaggccaatatcctctatgaacatagataaaaaattctcaacaaaatactagcaaactgaatccaggagcacatacaaaagacaattcaccacaatcaagtaggctttatctctaggatgcaaggttggttcaacatatgcaaatcaataaatgtaattcatcacataaacagaactaaaaacaaaaaaatgcctatttcaatagatacagaaaagacttttgataaaatttaacattgcttaatgttaaaaaccctcaacaaagtgggcactgaataaacatacttcaaaataataagagctatctataataaacctacagctaacatgatactggataggcaaaagctggaaacattccccttaaaaactggcacaagacaaagatgccctctctcatcactcctactcatgtagtactggaagtcctggccagagcaatcaggcaagagaaagaaataaaaggcattcaaatgtaaagagaggaagtcaaactgttgctatttgcagacaatatgattctatatcagaaaaccccatagtctctgcccaaaggctccttgatctgatgaacaacttcagcaaagtttcaggacataaaatcaatgtacaaaaatgaatagcattcctatacaacaacaatattcaagctgagagctaaatcatgaacacaatcccattcacaatagccacaaaaagaataaaatacctgggaatacaggtaatcaggaagatgaaagatctctacaataaaaattataaaactctgctcaaagaaattagagatgacacaaacaaatggaaaaatattccatgcttggggactggaagaatcaatatcattaaaatggccatactacccaaagcaatttacacattcaatgctatttctataaaactaccaatgacattcttcatagaattaggaaaaactatttaaaatttcatatggaacaaaaaaagagcctgaagagcaaaggtaatcttaagcaaaaggaacaaagctggaggcatcacattacccaacttcaaactatactacaagcttacagtaaccaaaatagcatggtactgatacaaaacagacatatagaccaatgggacagaatagagagaccagaaataatgacacacacctacaaccatctgaccttgacaaaatcaacaaaaacaagcaatggggaaaggactccctatttaataaatggcgctgggctaactggctagccatttgcagaaaattgaaactggaccccttcctcacatcatatacaaaaattaactcaagatggattaaagacttaaacataaaaccaaaactgtaaaaaccctgaaagataacctaggaaataccattctggacagaacatttggcaaagatttcatgagtaagatgccaaaaccaattgcaacaaaaacaaaaactgacaaatgagatacagttaaacaagagcttccaaacagctaaagaaactatcaacagagcaaacagacaacatacagaatgggagaaaatatttcaaattatgcatccaacaaaggtctaatctccagaatctataaggaatttaaacaagttaacaagcaaaaacaaccccattaaaaagtgggtaaaggacatgaacagaagacgaaagaagacatacatgcagccaacaaccatatgaaaaaatgccaaatacttaaagccaactgatcttcgacaaagcatgcaagcacataaattggggaaaggacatcctattcaataatggtgctgggaagactggcaagccacatttagaagaatgaaactgaatcctcatctttcaccttatacaaaaatcaactcaagatgcatcatagacttaaatctaagacctgaaaccataaaaattctagaagataatatcagaaaaactcttctagacattggcttaggcaaataattcatgattaagatgtcaaaagcaaattcaacaaaaccaaaaataaataaaatgagttctaattaaactaaaaggcttctgcacagcaaataataataataataatcagcagagtaaacagacagctcacagagtgtgagaaaatattcacaaattatgcatctgacaaaggactaatatccaggatctacaaagaactcaaatgaatcagcaagaaaaaaaaaccacaaataatcccatcaaaaagtggcaaaggacataaatagacaatatcaaaagaagatatatgaacagccaacgaacatatgaaaaaatgctcaatatcagtaattatcagggaaataaaaattaaaatcacagtgagataccaccgtactcctgcaggactggccataattaaaaagtcaaaaaataatagatgttggcgtggatgtggtataaagggaagacttttacactgctggtgggaatgtaaactagtacaaccactatggaaaacagtacggagattccttaaagaactaaaaagagaactaccattcgatccagcaatcccactactgggtatctacccaaatgaaaagaagtcattatataaaaaagacacacgcacacacatgtttatagcagcacaatttgctattgcaaaaacatggaaccaacctaagtgcccatcaaccaatgagtggataaagcaaatgtggtatatatacagcatggactactactcagccagaaaaaggaataaaataacctcttttgcagcaacttggacggatttggaggccattcccttttttttatttggttctttttttttctgagatggaatctcactttgttgcccaggctggagtgcagtggcacaatcttggctcactgtaacctccgcctcccagattcaagcgattcttctgcctcagcctcctgagtagctgggattacaggcacgtgctaccacgcctggctaatttctgtatttttagtacagatgtggtttcatcatgttggccaggcttgtctcaaacttctgacctcaggtgatctgcctgctttggcatcccaaagtgctgggattacaggtgtgagccaccacgcctggtggagggcattattccaagtgaagtaactcaggaagggaaactcaaatatcatttgttttcacttacaagtgggagctaagctacaatgatgcagaggcataagaatgatataatggaccttgaggactcgagggggaagcctgagagggggatgagggatcaaagactacatattgggtactgtgtacactgctcaggtgatgggtgcatcaaaatctcagaaatcaccactaaagaacttctcatgtaaccaaaaaccacctgtatcccaaaaactattgaaattgaaaaaaaaatattcaaaatcactaattattagggaaatgcaaatcaaaaccacagtgagataccatttcatatcagtcagaatggctattatgaaaaagtcaaaaaaataaaagacgctgacaaggttgtggaggaaagggaatgcttgtatactgctggtgggaatgtaaattagttcagccattgtggaaagcagtttggcaatctgtcaaagaactcaaagcagaattaccattcaacccagcaatcccatgattgggtatatatacccaggagaatatcaattgttctaccctaaagacacacacacacacatgttcatcacagcaatattcacaatagcaaagacatggaatcaacctaaatgcctatcagcagttgactggataaagaaaatgtggtatatatatatacaccatggaacactatgcagccacaaaaaagaatgacatcatgtcctttgcagcaacatggaggccattatcctaagcgaactaacaaaggaacagaaaaccaaatactgcatgttctgacttacaagtgggagctaaacattgagcatataaggacacaaagaagggaacaacagacactggggcctactttagggtggtgggagagaggagccagaggttcatttttctacctattgggtactacgcatattacctgggggatgaaataatctgtacatcaaacctccatgacacgcaaattatctatacaaaaaatctgcacatgtaccccgaacctaaaataaaagtttgaagaaaaaaagaaattgttttttctacttctaacttctaagagagattgcagagaaattgtaagatttcttccttacacagtggaattcaacagtgaattcatttgggctggtgctttctgttttgaaagcttattaattattcattaaatttctttgatataagcctgctcagattgtctatttcttcttgggtaggttttaacagatggtgtcttccaaagatttgtcgatttcatgtaggatattaaattcatgggcatgtagtagtccatagtattcctttattgtcattttaatgtccatgggatctgtccttttcccttctttcatttccataatttgtggtctctctcttatcttcttagaagttgcacataattcttgcctttgctcttcaaggggggttaagtgtttattacctctggcttctttcaagatcttttctttaactttgatttctgaagtttgaatataatatgcctagatgtcaggtttctttggccatttatcccgttcagtgctctctaagcttccttggcctgtgatttggcgtctgacattaatttgggggaaactctcactgattattgcttcacctattacatctgtccctttctctgcttctccttcttgtactcacattatacagagttaacatcttttgtagttgggccacagttcttggatattctgttttgtttcttttcccaatctttcttttctttacttctcagttttggaagtttctattgttacttcctcaagttcagggattctttcatcaagctggtaatgagcctatcaaaggcattcttcatttctgatacaatgttttgatctctagcatttcttttttattccttctaatatatatgcttaaattatctatctgtttttgcattttaaaacagtttgaattagtgacagttttccactaaagcccttggcatactaatcagagttttaaaaaaattcctgatcagataactccaacatttttaccataacgtacttctcattctgatgcttgtttggtctcttcaatctggttttttaaaaaatcttttatgattattattattatctttagagacagggtctcactatgttgcctagtctggccttgaactcctggactcaagtgatcctcccacctcagcctcttaagtagctgggaatacaggcacgcaccattgccccttgctttaccttttagtatgccttgtacttttttattgaaaggtagacctgctgtattgagtaaaaggaactgcagtaaataggctgttagtaatgtagtggcaaggggaagcattctacagtcttataatcaggtctcagtctttgggtgagcctctgcccctggactgtgaatttcagcagtgtttctcaattttgttttttccaccttaggtgggacaggatggctaaagggaattggcattgggtattttccttcccctacatggaaagctagagttggctacaactctatggatatttgtattcccccaggttggttactctgataatatgccagcagactggctctgataaaatagcttctcttcagggaaggccttgctaaaaagagcagaatgcactggcatattttaaaatggtttcttgtctccttccccagcggaaacacgagaggctttttctctgatattcactgttaggacctggtagagttcctggaggcagaacaaaattgtgagaacctttcctcacaaccccactgcaccctctcccccggaagattggaagtcccctagagtttgtaattttcacagttgtccacattgggcctctggtaatgcttcactttcagtgtatgttttcctacactggtactcgttgccacagaggtgtatgctcacaggtttctgttcacacaagctgtgattttctgtatccacctgtcagtcactctaatttggggaggctgcagttagtcctgtgacctcacttctctgatgggtctcagattgctgctgatttttcagtttattcagacttttacttattattaggacagagtggtgaacttctaagctccttacatgctggaccagaaacagaaagtcccttgactagttttatatcagagttttgccagccacatagtattttttcatttaattttttaaaagaatattcaaatttatttaaataggcagataaaattctatgtatttattatttacaatataatgttctgaagtatacacacattgtgagatgataaaatctagctaattaacatatgcattacctcatacttaacatttttgcagtaagaacacttaccatccactctcttagcatttttcaagaatacaatatatcgtcattaactatagtcatcatgctgtacaatagatcttttgaacttattctgcctatctaactgtacttttgtatcctttgacaaacatctccgcaacttccccaccagccacctcaacgtctggcaaccaccattctactcgctgtttctgcaagaccaacttttttagattccatatatgagtgagaccatgtggtgtttgtgtttctgtgcctggcttatttcacttaacataatgtcctccaggtttatccatgtggttggaaatgacaggatttccttctttttacagccgaataatatttatatatatatatgatatatctgatatctgatatatataagatattcatatatacatatgacatatatatcacattttctttatccattcatctgttaatggacatgggttgattccatatcttgactattgtgaacaggggtaaaataaacatgggagtgcttagatgtctccccaacatactaactttatttcctttggatatatacccaacagtgggattattaaatcatatggtagtcttatttttaattttctgaggaaactatatactgtcttccataatggctgtactaatttgcattcccttagtgtgcaaggattcccttttctctacattagtgttctcatcaacacttatcttttgtcgttttgataatagccattctaacaggagtgaagtgatatatcactgtggtttttttttatttgcatttccatgatgattaatgatgcattttttcatatgcctattggtcatttgcatgtcttttgcctatttttaaattgggttgtttttttgctattgagttgtttgaattccctatatatttaggatattaacccttgtattagaagtataatttgcaaatattttccactattctgtagactgtctcttactctgtttcctttgctgtctttctagtttgatgtaatctcatttgtctatttttgcttttgtatcctgtgttgtcgaggtcatatccaaaaagagcatttcccaggccaatattgtggggattttcccctatttttttttttttagtagttctatggttttgggttttacattaatccattttgagttgatctttgtatatggtgtgaggtaagggtctaatttcattcttctgtatttggatatccagttttcaccactgtgtgttcttggcacctttgtcaaaaatcaactaggtgtaaatgtcatttagtttatatggcctaggaattatctaatatttaagaatgtggtacaatttgcacgtaagactatctgaacctggtgccttttttcagagtggtaggccttttactatctttttttattttattccttttattagcctatttcagatttttttttacctcctttagttaattttgataatttgcagttacctagaaaattatcgatttaatcaagattttcaagtctattgatatacacttacagacagattcttctcttttttttgagacagagtctcactctgtcacgaggctggagtgcagtggcgtgatctcagctcactgcaacctccacctcccatgttcaagtgattctcctgcctcagcctcccaagtagctggaactacaggcacacaccaccgtgcccagctaatttttttgtatttttaatagaggcagggtttcaccatgttggccaggatggtctcgatctcttgactccgtgatctgcccacctcggcatcccaaaatgctgagattacaggcgtgaaccaccacacccagcctaaagacagattcttaaataatttttcctatctaccattttgttgcctttctcattccaaatatttatttgccattctctctgtattaatctattagtggaatagcaatagtttttgtctatttcataagtcttttcaatttatgacctataggttttattgttaaaatcttttttgtggttgttgtagtttaaaagtatttctgtttttgtctctattatgcctctcttcaatttcgtttatttatcttttctagttttatgagttgagtgctttaaggaagacaatttcatataagactgtttattccagtaaggttaattcctaccccctgccaacaataaaagtccaatatcattattctgccaccaggtggctggccagtgatactgatttatggtgacatagcagggctcagtgttaatctctgatgttggcaaagtagacacacagcagtgaaagaagccatatcccacatatataattttcatccttcccaccacactttcaataagctcactgagcaatcactggagtggccaaggaaagtggctgctgacttacatccctgaactggccatctggtccatcctttgccatctgattgagaaagtccttagttttgagggccattggtgagcattcataaggcaccaatactgacacactctggacctaaggtggggaaatgggagtggttcaacaggtgcaggtgataagaagtgcattgttggcagataatttaaataataataataataatggcaactacgatttaatcttcttcttcttagcaccatctgctagcaattccaaacaatgccagttcacaatactccctctcaaaaaactttctgctggtctaagttctaaaaagttgcttgtacctggggcaagccactcctaccacccacccttggtataatagaggtttccatccacttaccctgcccctagatcctctcattatcaatcctcagtattgttcttctctagtccctgatgacccagacaagtattagccactgattataagtcattttagactcgtaatgcaggacaactttctttccaggatatgtgaagaaaagatattccacatataattctgcctattacagagaggatttctcttcatcattgtccttgtcatcacacacaattgaggttaatgagaacagtctgcatatagcacagtatcacctaaaaatcaagtttaatgttttgcttctttaatcaactggtcatagggtactcctcccacccatgaagctatgtaagcaggtagaaggtgatgtggctatgcatcaacagtaggaacactgagaatgtgagccgcttgctcacacaactcactggtacatttaaggcctgcttaaactcagtcttatgtcacttgcttagccttgttgagtaagtgctgctaggcaacccaattttatgacttgataagtaagataatacccattcatgataggcagtcttgcagcaaactagatagaacccacatctaggataggagctgattggagttactattactacctaactaattttacaataatcgactgatattctccaaaattacttgttattactaggtaacttgtcatgaagataggaggattcaccactcctttgtctttcaactttgtgatgatgttaataatttctgcaatacctccaggtataaagtattgcttctgatgtattgttcatctgtgttcttgaagttatttgcataaaattgttcatactacccctttactatccttttaatgcctctaggatcagtagtgatgacctctctttcattcctgacaactgtgacttgtacattctcttttttctctgtcttactatattttaatcaattttattaacattttcaaagaacaaacttttgactttgttacttttctctattttctgtcccttttctatgtaaattgcttttcattcttgtatgtatcattttcatatttcttcttaattttggttcaatttcctcctttttctgtcatcttcaagtagaagtgtagatcatttattttaagcattttttctaaaataaacacttaaaagtataaatgtccttctatgcactgctttagctgtttcctacaaatatgaaataccttcattatcatgtagttcaaaatacctttttctcaagttgagaattcttttatttatttatttacttattttttaaattatactttaagttctagggtacatgtgcacaacgtgcaggtttgttacatatgtatacatgtgccatgttggtgtgctgcacccattaactcgtcatttacgttaggtatatctcctaatgctatccttcgccccttcccccaccccacgacaggcccccagtgtgtgatgttccccatcctgtgtccaagtgttctcattgttcaattcccacctatgagtgagaacaagcagtgtttggttttctgtccttgcgatagtttgctcagaatgatggtttccagcttcatccatgtccctgtaaaggacatgaactcatccttttttatggctgcatagtattccatggtgtatatgtgccacattttcttaatccagtctatcattgttggacatttgggttggttccaagtctttgctattgtgaatagtgccacaataaacatatgtgtgcatctgtctttatagcagcatgatttataatcctttgggtatatacccagtaatgggatggttgggtcaaatggtatttctagttctagatccttgaggaatcaccacactgtcttccacaatggttgaactagtttacagtcccaccaacagtgtaaaagtgttcctatttctccacatcctctccagcacctgttgtctcctgactttttaatgattgccattctaactgatgtgagaagttacctcattgtggttttgatttgcatttctctgatggccagtgatgatgagcattttttcatgtgtctgttggctgcataaatgtcttcttttgagaagtgtctgctcatatccttcacccactttttgatggggatgtttgattttttcttgtcaatttatttaagttctttgtagattctggatattagccctttgtcagatgggtagattgtaaaagttttctcccattctgtaggttgcctcttcactctgatgatagtttcttttgctgtgcagaagctctttagtttaattagatcccatttgtcaattttggcttttgttgccattgcttttggtgttttagacatgaagtccttgcccatgcctatgtcctgaatggtatggcctaggttttcttctagggtttttatggttttaggtctaacatttaagtctttaatccatcttgaattaatttttgtataaggtgtaaggaagggatccagtttcagctttctacatatggctagccagttttcccagcaccatttattaaatagagaatcctttccccatttcttgttcttgtttttgtcagatttgtcaaagatcagatggttgtagatgtgtggtattatttctgagggctctgttctgttccattggtctatatctgttttggtaccagtaccatgctgttttgattacagtagccttgtagtgtagtttgaagtcaggcagcgtgatgcctccagctttgttcttttggcttaggattgtcttggcaatgcgggctccttttggttccatatgaattttaaagtagttttttccaattctgtgaagaaagtctttggtagcttgatggggatggcattgaatctataaattaccttgggcagtatggccattttcacgatattgattcttcctctccattagcatggaatgtttttccatttgtttgtgtcctcttttattttgttgagcagtggtttgtagttctccttgaagaggtccttcacatcccttgtaaattggattcctaggtattttattctctttgaagcaattgtgaatgggagttcactcatgatttggctctctgtttgtctgttattggtgtataggaatgcttgtggtttttgcacattgattttgtatcctgagactttgctgaagttgcttatcagcttaaggagtttttgggctgagacaatgaggttttctaaacatacaatcatgtcgtctgcaaacagggccaatttgacttcctcttttcctatttgaataccctttatttctttcccctgcctgattgccctggccagaaattccaacactatgttgaataggagtggtgagagagggcatccctgtcttgtgccagttttcaaagggaatgcttccagtttttgcccattcagtatgataatggctgtgggtttgtcctaaataggtcttatcattttgagatatgttccatcaatacgtagtttattcagtttttagcatgaagggctgctgaattttgtcaaaggccttttctacatctattgagataatcatgtggttgtctttggttctgtttatatgatggattgcctttattgatttgcatatgttaaaccaccgttgcatcccaaggatgaagccaacctgatcatggtcgataagcttttgatgtgctgctggatttggtttgccagtattttattgaggatttttgcatcgatgttcatcagggatattggtctaaaattctctttttttgttgtgtctctgccaggctttggtatcaggatgacgctggcctcataaaatgagttagggaggattccctctttttctattgattggaatagtttcagaaggaatggtatcagctcctctttgtacctctggtagaattcggctgtgaatccatctggtcctggacattttttggttggtaggctattcattattgcctcaatttcagagcctgttattggtctgttcagggattcaacttcttcctggtttagtcttgggagggtatatgtatccaggaatttatccatttcttctagattttctaatctatttgcatagagatgtttatagtattctctgacggtagtgtgtatttctgtgggattggtggtgatatcccctttatcattttttattgcatctatttgattcttctctcttttgttctttattagtcttgctagtggtctgtcaattttgttgatcttttcaaaaaaccagctcctggattcattgattttttgaagggttttttgtgtctgtatctccttcagttctgctctgatcatagttatttcctgccttctgctaccttttgaatgtgtttgctcttgcttttctagttcttttaattgtgatgttagggtgtcaatattagatctttcctgctttctcttgtgggcatttagtgctataaattttcctctacacactgctttaaatgtgccccagagagtctggtatgttgtgtctttgttctcattagtttcaaagaacatctttatgtctaccttcatttcgttatgtacccagtagtcattcaggagcaggtggctcagttttcatgtagttgagcagttttgagtgaatttattaatcctgagttctagtttgattgcactgtggtctgagagacagtttgttataatttctgttcttttacatttgctgaggagtgttttccttccgtcaattttggaataagtgtgatgtggtgctgagaagaatgtatattctgttgatttggggtggagagttctgtagatgtctgttaggtctgcttggtgcagagccaagttcaattcctggatatccttgttaactttctgtctctttgatctgtctaatgttgacagtggggtgttaaagtctcccattattattgtgtgggagtctaagtctctttgtaggtctctaaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagaataggactgcaacccctgcttttttttgttttccatttgcttggtggatcttcctccatccctttattttgagcctatgtgtgtctctgcatgtgagatgggtctcctgaatacagcacactgatgggtcttgactctttatccaatttgccagtctgtgtcttttaattggagcatttacccatttacatttaaggttaatattgttatgtgtgaatctgatcctgtcattatgatgttagctggttattttgctcgttagttgatgcagtttcttcctagcctcaatgatctttacaatttggcatgtttttgcagtggctggtaccagttgttcctttccatgtttagtgcttccttcaggagctcttgtaaggcaggcctggtggtgacaaaatctctcagcatttgcttgtttgtaaaggattttatttctccttcacttatgaagcttagtttggctggatatgaaattctgggttgaaaattcttttctttaagaacgttgaatactggcccccactctcttctggcttgtagagtttctaccgagagatctgctgttagtctgatgcgcttccctttgtgagtaacccgacctttctctctggctgcccttaacattttttccctcatttcaactttggtgaacctgacaattatgtgtcttggagttgctcttcttgaggagtatctttgtgacgttctctgtatttcctgaatttgaatgttggcctgcgttgctaggttggggaagttctcctggatagttctcctgtagagtgttttccaacttggttccattctccccatcactttcaggtacaccaatcagatgtagatttggccttttcacatagttccatatttcttggaggctttgttcatttctttttactcttttttctttaaacttctcttgtcacttcatttcattcatttgatcttcaatcactgataccctttcttccactttatcgaattggctactgaagcttgtgtatgtgtcacgtagttctcg

SEQ ID NO: 12171 - DNA, 3628 bp, Homo sapiens
gtttcagctttctacatatggctagccagtttccccagcaccatttattaaatagggaatcctttccccattgcttatttttctcaggtttgtcaaagatcagatagttgtagatatgcagcattatttctgagggctctgttctgttccattgatctatatctctgttttggtgccagtaccatgctgttttggttactgtagccttgtagtatagtttgaagtcaggtagtgtgatgcctccagctttgttcttttggcttaggattgacttggcaatgtgggctcttttttggttccatatgaactttaaagtacttttttccaattctgtgaagaaagtcattggtagcttgatggggatggcattgaatctataaattaccttgggcagtatggccattttcatgatattgattcttcttacccatgagcatggaatgttcttccatttgtttgtatcctcttttatttcattgagcagtggtttgtagttctccttgaagaggtccttcacgtcccttgtaagttagattcctaggtattttattctctttgaaataattgtgaatgggagtttgctcatgatttggctctctgtttgtctgttgttggtgtataagaatgcttgtgatttttgtacattgattttgtatcctgagactttgctgaagttgcttatcaacttaaggagattttgggctgagacaatggggttttctagatatacaatcatgtcatctgcaaacagggacaatttgacgtcctctttcctaattgaataccctttatttccttctcctgcctaattgccctggccagaacttccaacactatgttgaataggagtggtgagagagggcatccctgtcttgtgccagttttcaaagggaatgcttccagttattgcccattcagcatgatattggctgtgggtttgtcatagatagctcttattattttgagatacgtcccatcaatacctaatttattgagagattttagcatgaagggttgttgaattttgtcaaaggccttttctgcatctattgagataatcatgtggtttttgtctttggttctgtttatatgctggattacatttattgatttgcgtatattgaaccagccttccatcctggggatgaagcccacttgatcatggtggataaggtttttgatgtgctgctggattcggtttgccagtattttattgaggatttttgcatcaatgttcatcaaggatattggtctaaaattctttttttcggttgtgtctctgcctggctttggtatcaggatgatgctggcctcataaaatgagttagggaggattccctctttttctattgattggaatagtttcagaaggaatggtaccagctcctccttatacctctggtagaattcagctgtgaatccatctggtcctggactctttttggttggtaagctattgattattgccacaatttcagagcctgttattggtctattcagagattcaacttcttcctggtttagtcttgggagggtgtatgtgtcgaggaatttatccatttcttctagattttctagtttacttgtgtagaggtgtttgtagtattctctgatggtagtttgtatttctgtgggattggtggtgatatcccctttatcattttttattgcgtctatttgattcttctctcttttcttctttattagtcttgctagcggtctatcaattttgttgatcctttcaaaaaacaagctcctggattcattaattttttgaagggttttttgtgtctctatttccttcagttctgctctgattttagttatttcttgccttctgctagcttttgaatgtgtttgctcttgcttttctaattcttttaattgtgatgttagggtgtcaattttggatctttcctgctttctcttgtgggcatttagtgctataaatttccgtctacacactgctttgaatgtgttccagagattctggtatgttgtgtctttgttctcgttggtttcaaagaacatctttatttctgccttcatttcgttatgtacccagtagtcattcaggagcaggttgttcagtttccatgtagttgagtggttttgagtgagtttcttaatactgagttctagtttgattgcactgtggtctgagagatagtttgttataatttctgttcttttacatgtgctgaggagagctttacttcgaactatgtggtcaattttggaataggtgtggtgtggtgctgaaaaaaatgtatattctgttgatttggggtggagaattctgtagatgtctattaggtccacttggtgcagagctgagttgaattcctgggtatccttgttaactttctgtctcgttgatctgtctaatgttgacagtggggtgttaaagtctcccattattattgtgtgggagtctaagtctctttgtaggtcactaaggacttgctttatgaatctggatgctcctgtattgggtgcacatgtatttaggatagttaattcttcttgttgaattgatacctttaccattatgtaatggccttctttgtctcttttgatctttgttggtttaaaatctgttttatcagaggctaggattgcaacccctgcctttttttgttttccatttgcttggtagatcttcctccatccttttattttgagcctatgtgtgtctctgcacatgagatgggtttcctgaatacagcacactgatgggtcttgactctttatccaatttgccagtctgtgtcttttaattgaagcatttagtccatttacatttaaagttaatattgttatgtgtgaatttgatcctgtcattatgatgttagctggttattttgcttgttagttgatgcagtttcttcctagcctcaatggtctttacaatttggcctgattttgcagtggctgataccggtttttcctttccatgtttagtgcttccttcaggagctcttttagggcaggcctggtggtgacaaaatctctcagcatttgcttgtctgtaaagtattttatttctccttcacttatgaagtttagttggctcaatatgaaattctgggttgaaaattcttttctttaagaatgttgaatattggcccccactctcttttggcttgcagagtttctgccgagagatctgctgttagtctgatgggcttccctttgtgggtaacctgacctttctctctggctgcccttaacattttttccttcatttcaactttggtgaatctgacaattatgtgtcttggagttgctcttctcgaggagtatctttgtggcattctctgtatttcctgaatctgaatgttggcctgccttgctagattggggaagttctcctggataatatcctgcagagtgttttccaacttggttccattctccccgtcactttcaggtacaccaatcagacgtagatttggtcttttcacatagtcccatatttcttggaggctttgttcgtttctttttattcttttttctctaaacttcccttctcgcttcatttcattcatttcatcttccatcactgataccctttcttccagttgatcacatcggcccctgaggcctctgcattcttcatgtagtt

SEQ ID NO: 12172 - DNA, 1907 bp, Homo sapiens
aatgtctctgtatccttgttaactttctgtctcgttgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaaatgatccctttaccattatgtaatggccttctttgtctcttttgatctttgtttgcttaaagtctgttttatcagagactaggattgcaacccctgccttttttttgttttccatttgcttggtagatcttcctccatccttttattttgagcctatgtgtgtctctgcatgtgagatgggtttcctgaatacagcacactgatgggtcttgactctttatccaatttgccagtctgtgtcttttaattggagcatttagtccatttacctttaaagttaatattgttatgtgtgaagttgatcctgtcattatgatgttagctggttattttgctcgttagttgatgcagtttcttcctagcctcgatggtctttacaatttggcatgattttgcagtggctggtaccggttgttcctttccatgtttagtgcttccttcaggagctcttttagggcaggcctggtggtgacaaaaactctcagcatttgcttgtctgtaaaggattttatttctccttcacttatgaagcttagtttggctggatatgaaattctgggttgaaaattcttttctttaagaatgttgaatattggcccccactgcttctggcttgtagagtttctgccgagagatccgctgttagtctgatgggcttccctttgtgggtaacccgacctttctctctggctgcccttaacattttttccttcatttcaactttggtgaatctgacaattatgtgtcttggagttgctcttctcaaggagtatctttgtggcattctctgtatttcctgaatctgaacgttggcctgccttgctagattggggaagttctcttggataatatcctgccgagtgttttccaacttggttccattctccccatcactttcaggtacaccaatcagatgtagatttggtcttttcacatagtcccatatttcttggaggctttgttcgtttctttttattcttttttctctaaacttcccttcttgcttcatttcattcatttcatcttccatcgctgataccctttcttccagttgatcgcattggctcctgaggcttctgcattcttcacgtagttctcgagccttggctttcagctccatcagttcctttaagcacttctctgtattggttattctagttatacattcgtctaaatttttttcaaagttttcaacttctttgcctttggtttgaatttcctcctatagctcagagtagtttgatcgtctgaagccttcttctctcaactcgtcaaagtcattctccgtccagctttgttccgttgccgatgaggagctgcgttcctttggaggaggagaggcgctctgctttttagagtttccagtttttctgctctgttttttccccatctttgtggttgtatctacttttggtctttgatgatggtgatgtacagatgggtttttggtgtggatgtcctttctgtttattagttttccttataacagtcaggaccctcagctgcaggtctgttggagtttgctagaggtccactccagaccctgtttgcctgggtaccagcagcggtggctgcagaacagcagattttcatgacctgcaaatgctgctgtctgctcgttcctctggaagttttgtctcagaggagtacccggccgtgtgaggtgtcagtctgcccctactggggggtgcctcccagttaggctgctcggggg

SEQ ID NO: 12173 - DNA, 36631 bp, Homo sapiens
ctacaaaggacatgaactcatcattttttatggctgcatagtattccatggtgtatatgtgccacgttttcttaatccagtctatcactgatggacatttgggttggttccaagtctttgctattgtgaatagtgccacaataaacatatgtgtgcatgtgtctttatagcagcacgatttataatcctttgggtatatagcaagtaatgggatggcttggtgaaatggtatttctagttctagatccttgaggaatcgccacactgacttccacaatggttgaactagtttatggtcccaccaaccatgtaaaagtattcctatttctccacatcctctgcagcacctgtactttcttgacattttgatgattgccattctaactggtgtgagatggtatctctttgtggttttgatttgcatttctctgatggccaatgatgatgagcattttttcatgtgtctgttggctacataaagatcttcttttgagaagtgtctgttcatatccttcgcccactttttgatggggttgtttgtttttttcttgtaaatttgtttgagttcattgtcgattctggatattagccctttgtcagatgagtagattgcaaaaattttctcccattctgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaacatgtaagtctttagtccatcttgaattgatttttgtataaggtgtaaggaagggatccagtttcagctttctacatatggctagacagttttcccagagccatttattaaatagagaatcctttccccatttcttgtttttgtcagctttgtcaaaggtcagatggttgtagatgtgtggtattatttctgagggctctgttctgttccattggtctatgtctttgttttggtgccagtaccatgctgttttggttattgtagccttgtagcatactttgaagtaaggtagcatgatgcctccagcttttttctattggcttaggattgtcttggcaatgcgggctcttctttagttccatatgaactttaaagtagttctttccaattctgtgaagaaagtcactcgtagtttgatgaggatggcattgaatctataaattaccttgggcagtatggccattttcatgatattgattcttcctacccatgagcatgaaatgttcttccatttgtttgtgtcctcttttatttcattgagcagtgttttgaagttcttcttgaagaggtccttcacatcctttgtaagttgaattcctaggtattttattctctttgaagcaattgtgaatgggagttcactcatgaattgactctctgtttgtctgttattggtgtataggaatgcttgtgatttttgcacattgattttgtatcctgagactttgctgaatgtccttatcagcttaaggatattttgggctgagaagatggggttttctaaatatacgatcatgtcatctgcaaacaggaacaatttgacttcctcttttcctaatggaataccctttgtttctttctcctgcctgattgccctggccagaacttccaatactatgttgaataggagtggtgaaagagggcatccctgtcttgtgacagttttcaaagggaatgcttccaatttttgcccattcaatatgatgttggctgtgggtttgtcataaatagcttttattattttgagatacatcccataaatacctagtttattgagagtttttagcatgaagggctgttgaattttgtcaaaggccttttctgcatctattgagataatcatgtggtttttttctttagttctgtttatatgctggattacaattattaatttgcatatgttgaaccagccttgcaccccggggaagaagcccacttgatcgtggtggataaactttttggtgtgctgctggatttggtttgccagtattttattgaggatttttgcatcgatgttcatcaaaggtattggtctaaaattctcttttttggttgtgtctctgccaggttttggtatctggatgatgctggcctcataaaatgagttagagaggattccctctttttctattgattggaatagtttcagaaggaatggtagcagctccgctttgtacctctggtacaactcggctgtgaatccgtcaggtcctggactttctttggtcagtaagctattaattattgcctcaatttcagagcctgttattggtaggttcagagattcaacttcttcctgatttagtcttgggaggttgtatgtgtccaggaatttatccatttcttctagattttctagtttatttgcgtagaggtgtttatagtattctctgatggcagtttatatttctgtgggattggtggtgatatcccctttttcattttttattgcatctatttgattcttctctattttcctctttattagtcttgctagcgttctatcaattttgttgatcttttccaaaaacaagctcctggattcattgattttttgaaggtttttttgtgtctccatctccttcagttctgctccgatcttagttatttcttgccttctgctagcttttgaatgtgtttgctcttgcttctctagttcttttaattgtgaaattaggatgtcaattttagatctttcttgctttctcttgtgggcatttagtgctataaatttccctctacaggctgctttaaatgtttcccagagattctggtatgttgtgtgtttgttctcattggtttcaaagaacatctttatttctgccttcatttcattaggtacccagtagtcactcaggagccagttgttcaatttccatgtagttgagtggttttgagtgagtttcttaacactgagttctagtttgattgcactgtgatctgagagacagtttgtaacaatttctgttcttttacatttgctgaggagacctttacttccaactatgtggtcaattttggaataagtgtgatgtggtgctgagaagaatgtatattctgttggtttggggcagatagttctgtagatgccgattaggtccacttggtgcagagctgagttcaattcctggatatctttgttaactttctctcttgttaatctgtctaatgtctacagtggggtgttaaagtctcccattattattgtgtgggagtctaagtctctttgtaggtctctaaggacttgctttatgaatctgggtgctcctgtattgggtgcatatatatttaggataattagctgttcttgttaaattgacccctttaccattatgtaatggccttctttgtctcttttgatctttcttggcttaaagtctgttttatccgagactaggattgcaacccctgccttttttttgttttccatttgcttggtagatcttcccccatccctttattttgagcccatgtgtgtctctgtatgtgagatgggtctcctgaatacagcacactgatgggtcttgactctttatccaatttccagtctgtgtcttttaattggagcatttagcccatttacatttaaggttaatattgttatgtgtgaatttgatcctgtcattatgatgttagctggttattttactcgttagttgatgcagtttcttcctagcatcgatggtctttacaatttggcatgtttttgcgtggctggtaccagttgttcctttccatgtttagtgcttccttcaggagctcatgtagggcaggcctggtggtgacaaaatctctcagcatttgcttgtctataaaggattttatttctccttcacttatgaaccttagtttggctggatatgaaattctgggttgaaaattattttctttaagaatgttgaatattggcccccactctcttctggcttgcagagtttctgccaacagatcagctgttagtctgatgggcttccctttgtgggtaacctgacctttctctctggctgcccttaacattttttccttcatttcaactttggtgaatctgaaaattatgtgtcttggggttgctcttctcaaggagtatctttgtggcattatctgtatttcctgaatgtgaatgttggcctgccttgctaggttggggaagttctcctggataatatcttgcagattgttttccaacttggttccactgtccccatcactttcaggtacaccagttagacatagatttggtcttttcacatcatcccatatttcttggaggcttcattcatttctttttattcttttttctctaaatttctcttcttgctttgtttcattcattggatcttccatcactgatatcctttcttccagttgatcaaatcagctactgaagcttgtgcattcgtcatgtagttctcgtgccatggttttcagctccatcaggtcatttaagggcttctctaaactggttattctagttagccattcatctaatcttttttcaaggattttagcttctttgtgatgggttccaacttcctcctttagctctgagaagtttgatcatctgaagccttcttctctcaacttgtcaaagtcattctctgtccagctttgttccattgctgttgaggagctgtgttcctttggagggagagaggtgctctgaattttagagtttccagtttttctgctctgttttttccccatctttgtggttttatctacctttgatctttgatgatggtgatgtacagatggggcttttatgtggatgtcctttcttttgttagttttcattctaacagtcaggaccctcagctgcaggttgattggagtttgctggaggtccactccagaccctgtttgcctggatatcagcagcagaggctggagaacagcagatattgctgaacagcaaatgttgctgcctgatcgttcctctggaagcttcatctcagaggaatacccagccgtgtgaggtgtcagtctgcccctgctggggggtgcctcccagttaggctactcgggggtcagagacccacttgaggaggcagtctgaccattctcagatctcaaactccgtgctgggagaaccactactctcttcaaagctgtcagacagggacatttaagtctgcagaggtttctgctgccttttgttcagctatgccccgcccccagaggtggagtctctagaggcaggcaggcctccttgagctgcggtgggccacacccagttcgagcttcctggccactttgtttacctacccaagcctcagcaatggcaggtgcctctcccccatccttgcttcagccttgcagttcgatctcagactgctgtgctagcaatgagtgaggctccatgggcatgggaccctctgagccaggcgcaggatgtaatctcctggtgtgccgtttgctaagtattggaaaagctcagtattagggcgggagtgacccgattttccaggtgccatctgtcacagcttcccttggcttgaaaagggaattccctgaccccttgcacttccctggtgaggtgatgcctcaccctgtttcgtctcatgcttggtgggctacacccactgtcctgcacccactgtctgacaagccccagtgagatgaaccgggtaccacagttggaaacgcagaaatcaccctcttctgcgtcactcacgctgggagctatagactggagctgttcctcttcagccatcttggaaccacctaacctcttaaaaaatcttatctgggccaggtgcggtggctcacgcctgtaatcccagcactttgggaggccaacacaggtggatcacctgaggtcaggagtttgagaccagcttatccaacatagtgaaaccccgtctctactaaaaatacaaaaaaaatagccacacatggtagcagatgcctgtaatgtcagctacttgggaggctgaggcaggagacttgcttgaacccaggaggtggaggtcgcagtgagctgacatcgcaccattgcactccagcctgagtgacagagcaagactctgtttaaaaaaaaaaagtagctatcaataattctatttatcattttactggaggtcataggccagggaaaatgggcaaaaaatataataaaaggtataacaattgaaaaaaatctaatgaaactttcatatttagagatatcattagaaaatccaaaaggatctatagataaaatattaaatgtaataagttaatttaacatggatactggtagcaaggtcaaaatatttttttatttataatatacagtagacccctccttaattcatggttttgttttccacagttttagttacccatggtcaatggcagtctgaaaatattaaatgggcaattccagaaataaataatctataagttttcaattgtgcaccattctaagtagtatgatgaaatttcaggccagcctacttcatctggacaaggatgcaaatcaccccttaattatcatatctccactgtatatgctacccaacccttagtcacttagtagctggctcagttatcagatcagctgtcctggtctccagtgcttgtgttcaagtaacccttattttacttaataacagccccaaagcacagaagtagtgatgcttgtaattcaaatatgccaaagagaagccattaagtgcttcctttaaatgaaaaggtgttaagtttttgacttaataaggaaagaaacaaaatatgctgatgttgctatgttctacagtaaaaaggaatcttctttccataaaattgtgatggggaaaagggaattgtacaaattttaccatcacacctcaaattgcaaaggttatgatcagagtgtgtggtaagtgcttagttaagatcttaaaaagccatcaaatttgtgggtggaggacatgaacagaaaggggctccaattggcagcaatcaggttcagcactatttgtggttttgggcatccaccagaagtcttggaatgtatcctctgcaattcagaagggactactcatcggctactttgtattctttgacctacatctcctcatttcctcccaccaccacctgcttcctgcccctggtaatcactgttttattctctatttctgtgtactcaactcttttaagattccacatataagtgagattatgcaatcaatatctgagaaaacctgtgtcttgatgagcttatcagaagtgtacatggtctttaggcccataggagagtatgagttagaagcatcaattaaagcttcgatttagaagtgtgcacatgttgattttttaatttgaaacaaatattgggactagggataatctttccctagaagacaggtttcatatgtcaagcaacaatggtactaatgcagagtggaaatacaaaccatgccatagagctggacaagcatagtcacagtgtagtatggaaatgtgtgacattgctatgtggacactgtggacactgccatgtccatttctgtacttttgaaacagaaaggaaatatgaaatactggatatgatatgtgagaaagaatgtaacttgaaaacctggttaatttctagacctttcaaactatctcaattgctccacttttcagggaaaagacagtgtataaagtaaatttttccctcaaatatgacatttgaagaattacaaaattttcattttgtctggcgattttcctaactaaatttaaatttacagtcatcttcttgcaaatgttgccagaaacaaaacggagtcactaaggaaaaaaaaaaaaaactggcagagctagggaagactatgcagagagggttctcacacttgtatacctaataagaacaactaccacgaaagactctgcaaaaaccacaaccttgaaaaggccatcacaaccttacatgaaaaatgcctcaaagacatctgccctgccagcaactgtctgtttaacctctgactggtgtcaccgttgttattgatatttgtaggcaaggataattatttcaaaacaaatatgtaattctcttaattttttttctttaaaaaatttgccttcctttacctccctgagtatgcacatcgtttactattgcatatatattcccattgcaatgctctattctcaaataaatatctttttcttttagagagcctctttttctgtttgttatttaggtagacattctgcacatatttggcaaaaacttacacgctgttgaaactgaaaccaagacctcttcctctatcttccatctctcaggcacaactcaatttctaactcagtctttggcaatactaatattcctttctggtaacataattttgactggattactgttctcatgttttaggcctaacttgtttaaaaatttgatgagtggccgggcgtggtggatcatgcctgtaatcctggcactttgggaggctgaggtgggcagatcacaaggtcaggagatcaagaccatcctggccaacatggtgaaacacagtctctactaaaaatacaaacattagctgggcatagtggcacatgcctacagttccagctacttaggaggctgaggcaggagaatcacttgaacccaagaggcagaggctgcagtgagccgagatcatgccactgcactccagcctgggcaacagagcaagactctgtctcaagaaaaaaaaaagtttgatgagtgtggggctagtgttgtgatagtctcctgtgccctgccaactcttttggattattttttaaaatgaggaacatttcagatttagtttgtagcaattcaactttgggagtcttgcaagaactcacttattttaatggaaaatagcccaggttgtctaccagcttttcctgagctctgttttgggtgttctacccaaaataaaaaacgtataaacacaaaaatagtaatgttcatgtctgtgacagccaatgttaagtctctgctgttgtctatggctgttatccaaaaagtagattcaattctgtcatgtattggagtctgggaatgttgttaagagatacatacattgaaatttggagagctgctctgtatttatcaattaggcagtaataatcttggatgaaggctagtcttattaatgttgtgaaccagtcttattaatgttgtgaaccagtagtgtccccaggaatagagaacactacactactcactttgcattttcttatccacataatagaattagttagtgataaccctctttactcggaatcgattgctgccacatttctgcatgatacatagatctctgcaaatatgtgatttttttcctaaatggagaaaatccaaaaattcttcttaaaatttttcatgggcatacaagaagataggaggtgacatcttaaaacaagtatctctgaactttttgtataaaaaaaagcaacctctttgctctattattaataccacatgtggtgatatgaatgcccaaatgtagacagcagttatgagatattacaagagaagaaaaaagctctgccgcttatggcaacttacccaaaaagttatctttgacttaggctggaggtgcacatagcatagctcctagagttctgtttatgtcatgaatatttgttactcaaaactccataggccaagagctcctgaagagaaggtcacatgctagcagcaattgtcattttttccctcaaatattgctatagtataattttgtttgaattataaacttcagtctttattatatttgattctggcattttggtttgtagtgctatagtacaggaaatgttttaaatgctttgcctttatgtaagtgaatatcggtacacacacatacacatacacacacagacacagacacacacacacacacactcacagccagtttagaatgtggggtaaggaacaccagacaaagagggcaatataagaaagagaagacattgaaaacattgggaagaggcagtaacagagtgccagagaagataaggcagctgggagggggagaaactaagtgaggtggataaactaaaagcatccttctgggttaaagcagactaaaagcttagcaattgcttaatatcaccatcttatcctatagatgtgggaataaaggctaaggaaggagaaatgaaaatgcagaatcatatgggggcttttccaaggaggtatgaaggaaggtgaggacagggagagcggctggaagtcagggggtaagagaaactctaaaaatcagggcttgagggaaataaaaggtgaggtaagaggctcagggctgtgggaggcacatttttctctgaaaagcagtttggatgaggaagagatttggcagttggaagagagaagaagtcactacagggtactgaggaaaagctttgctgaaattggagatcaaataccagctctgccagtaagaagttgcatctcccagtgaaatgctgctgctgccatttcaactgttagctgttctctttcctggtggtaacagtgaacatggtaagagtcactctggcagctcccagcactggtgcaggggtttggattttaaaaagcaagcagggctttcctaggtgcaattggacactaagggtctgggtctttctgtctcccgccctcttcaaccattctggtggttgggactagaacctgaagccttaaggcagtcaaatgtgtcagacttcctgtgttctttagactctaggttcttgttttctaaatcattttcattcccattcttcctaattgtctcctgcttctctctttatcttcaccatcttgcttttccactcttcacagccttccaggggccgacctcctttcatgttatccagacctcgtcctttaccaatagtacctgggcacaaactcaaggctcaggctggttggatgatttgcagattcatggctgggatagcgactcaggcactgccatattcctgaagccttggtctaaaggtaactttagtgataaggaggttgctgagttagaggagatattccgagtctacatctttggattcgctcgagaagtacaagactttgccggtgatttccagatgaaatgtgagtctagtccaccgaactgggaagagtctcaaggactctcttttctctcttttttgcaaagtgttgctctctctgatgcttctcccttcctttctattttacccaaatgcacgcacatgcttttcttgagtagtctctcactccagcttcacaccatcacacctcatatttcagattcttgctgcctctgcactcttctcttactctcagactgtcttccactttgtaaccagctgctggtttgtcttatgtgaaacttctcctcaagggcccttacttctcctaccctgtgcctgagtgatctaacgtgtggctttctcccctaatccatcttttcaatcatctcctccccgcaccctcctcttgctgggaacctccactcactctggaatgctgcactcctgactgcaccacgctctgcctcacctctcctttcatactcactgtactcctttatcacatacctttgtcttcatggcatgcacatttttctcaatgctcttgtttctgaaaatgtctaaatgttatcattagtttttagctcatcatcattttacaccaaataactttatccccaccaaaatctaaaatcctaggttcttttctcatgcctttttttcttatttgtgtttaataacttgctctcttttccctctacatagacccctttgagatccagggcatagcaggctgtgagctacattctggaggtgccatagtaagcttcctgaggggagctctaggaggattggatttcctgagtgtcaagaatgcttcatgtgtgccttccccagaaggtggcagcagggcacagaaattctgtgcactaatcatacaatatcaaggtatcatggaaactgtgagaattctcctctatgaaacctgcccccgatatctcttgggcgtcctcaatgcaggaaaagcagatctgcaaagacaaggttagtcctgctgttatttcacttcccaccacctcctctaagatcaagagtaggaagatatcaaaggataggagcttaaataacaagttatttggttcccaaaggagtgaatggggtcgctgtccaagcttgtaggtttctgagttcataacctctgaactcgagttataacatgacacttttttttctccttcctgccttagtgaagcctgaggcctggctgtccagtggccccagtcctggacctggccgtctgcagcttgtgtgccatgtctcaggattctacccaaagcccgtgtgggtgatgtggatgcggggtgagcaggagcagcagggcactcagctaggggacatcctgcccaatgctaactggacatggtatctccgagcaaccctggatgtggcagatggggaggcggctggcctgtcctgtcgggtgaagcacagcagtttagagggccaggacatcatcctctactggagtaagaaatagcagggacccaggctggaaatgccaggaagtgatcttcaggcatagagggaggcactggggaaggatagagcttgagagatgaaagagggagagattgattgattgatttccctgaccccaatcccaacaggagtaaaaatagataatccaagttatcaaaaatgtaggaattaaggacctgtaaactgggtagaggggatcaaaggatggatatatggtggccaggaatatgagagaggaagttggaaatgaccatacattggaagtaggtgggcaaaggaaggccaaggaattctgtgtatagtatctgaagtgacatccttttgtcctctctcaattgccaggaaaccccacctccattggctcaattgttttggcaataatagtgccttccttgctccttttgctatgccttgcattatggtatatgaggcgccggtgagttgtgggtggtgttgtttttttttttaatatgtcttttctgttcacccttccactgttttttaccattttatctatttaaaaattgtttatcctcaatcctttcaccatatcctttccccaaactcccattcgttttatgtggacttaaaaaaaattctgttaaaatacacataacataaggtttaccatctttaccatttttaagtgtacagttcagtggtgttaagtgtgttcacattgttgtgcaagcaatcttcaaaactcttctgtcttgcaagactgaaactctattcctattacgctgcaagttcccatttcccctcttctccaggccctggttaggacagctctacattctgtctctatgaattctactattctaggtaccttatataagtggaattgtaaatatttgtctttttgtgacttatttcatttagcgtaatatcctcattgtagcatatgaaagggcttccttccttttttgaaactgaacaatattccaccatatgcgtataacacattttgttcatccattcgtctatctatggacacttgggttgctttcacttttaactatcatgaataatattactatgagcatgggtgtacaaacatcttttatgtggagctcttttgttcttctgtttttaacaggtcatatcagaatatcccatgagccatcatcatgtctcctctcccattcgcaataagtaccaagaagcccaagatatcagcccaaaagtcaatcttatcatatttcaaatgattttcaaatttgatgaaatcagagttttcatgtattttaaaataaattattatttaaacatcagcaaaaaagtacttaaaactgtaaatttattatgagactgtactaacagtgtgattcaccctgattttacacacattaaaatgttagaaaaaatgtgtctcaaaataaatgaaatataatacatatgacttaatggtgactccctttggcttcctaatttaaaacttttctttttctgcttctggttaaatatcatttgtcaaagaaaaccaaatataattatgccagaatcactgtatttgcagagatgcagagccttttggatgtaatttcttctctgtctctgcctggatgaatttctagccctgaaggctcagctgagatgtttcttcctcaggaagactttcctagtgctataataaaaggaactatgcagagatccactttacactttactcacagcattggagttatttttgtttttcctccccttctctttgtaagttccttgaggacagtgttccctatttgtagatctctggcaagatctcttagctgcaaattcattttctcagtaaaaactatctgagttgctgtaactgccaagttaagtgttttctttcagagtcatctactttcttccatttttttttctttttagttgatattgtagattctcctcatcttgctaaaatagtttccacttagccaaaaaatattatgttttctttatttctgttccaaactcctttggagaaaaccacccttggcttactacagctatagtctagcttttaaagggtcatagtgagaggtgaagccagctgcactccctgggttgagtggggactcctataacttttctgtagctagcaagagttttgtaaaatgcaccaatcaatgctctgtaaaaacacaccaatcagtgctctgtagctagcaagaggtttgtaaaatgcaccaatcagtgctctgtaaaatagaccaatctgcactctgtaaaatggaccagccagcgctggtccattaattaataattttataggggccaagcgtggtggctcacgcctgtaatcccagcactttgggaggccgaggcaggtggatcacctgaggtcaggagtttgagaccaggctgaccaacatggcaaaaatctgtctctactaaaaatacaaaaattagccgggcatggtggtgcatggctgtagtcccagctacttggaaggctgaggcaggagaatcacttgaacccagcaagtggaggttgcagtgagccaagattgtgccactgcactccagcctgggtgacagagcaagaccctgtctccaaaaataataataataataataataattttatatgtgcaaacataaagcagtataaaaactatcctttgctcattagacagttttgaaaaaattatcaactcatgattaaaataaattttagatattgtatcatttcatccttaactatttcaacatgtctttctgtaacatatagacttttttaacatatagccgaaattacattatgacatccccaaataaaagatttcttaatatcattaaatatatagttgttcagcattcaaattttttccaattgtctcatgaattgtttttacagtttattcattaaattggaataaaaataagattcatgcattaaaattagttgatgtttcataaaccgtttttaatctgtaggattcttctctcatttttatcctagaatttgttttttaagaaatttcatcattcttcttgtaaaatcatccacagtttggattttgctgattacatagctataatgtcatttaacatgcccctttgttctctttatttactatatataaatagatttgtgggccgggcatggtggctcacgcctgtaatcccagcactttgggaggccgaggcgggcggatcacgaggtcagttgattgagaccatcctggctaacacggtgaaaccccatctctactaaaactacaaaaaaaattagccgggcatgatggtgggcacctgtagtcccagctactcagggaggctgaggcaggagaatggcatgaacccgggaggcggagcttgcagtgagccgagatcgcgccactgcactccagcttgggcaacagagcaagactccgtctcaagaaaaaataaaaaataaataaatagatttgtgatgtgctcagattcaggttttattatactatgtatatctcacaagaggcatataatgcttaatggtcttcattcattactagattaataggtctcaactcttacacattttacatatgtacaagttatattgaaggtggcacaacagtgtgaatgtacttaataacacagaattgtacacttaaaaatggcaaaatggtaaatcttatatatgtgtattttaccacaataaaaaaagattgagatcaccagaaaagcttttctctgtgtgatggaaattgtgtgtgtgcgtgtgtgtgtgtgtgtgtgtgtgtataaaatgtatgtccagacagatagctagatatatcttagaagtaaaaactaataaactaataattaaaatatttataaacttctctacaattaaacatggattacatatcaacaaaaattacatctttatttttaaatgtttttcaaaaatgtagtgagaagcgtggctttacagctgcatctatttatttatttatttagtattttggcaattctctttaatgtctggcttaataagaaaacagctacattttcatatctgctttggcatccaatctgatgcaatatcatattccatgtagtctctggagaacaacataaaatcatgagaagaatagaattaaaaatttaacctggtagtattgttaggatttattgggaactatggaccctcagaaaaggagtcagggacctcaaagtgccctgggtcatatcttatgaatgaatggcctaggggtgaaagaaaaatatattaaacattcttcacttattacttagaatattcctaaagagacattatcttcagtaactatcttattaccttgatggaatcaaggtaataagatagttattctttctatttatttgcccgttctcaagagaatgaatgctttatatggcattctccacaagtgatcaatatttttttgcataattgtatactcatgaatttcagcttatttgaaatgcttgtatctatcatagtagttgttttattgaagctcaaattgtcctatctgtgacaatgagattcttttcaagtcaattcttcctgagctccatcaatacacctctgtcatcaagactgtattacttcctgatgtggcaaagttgctcaaggttcttgccgaaacttcttgccctacactagaaattagcaaggatctctggtccttgttagttggaaaaaatgtgatacggaaattactgggttaatcctagtttctaggccttctaagggggaaaacctaaaaaaaaattagcctgtggaaatttttttgaggataaatatcatcacaagctcatatttacactttcacttcaaattcaaaactatgtgtttaactcatcagtctcacttctacttctcttttctcccacacggaaaatcttggtttccgatgaatcaatgtaattatgtattcatctaatcccactatatatgttatagtcagaatagaaatacaaacactatgtcagaaagatggtggaataggaggtaacccactcatatcccccaactccaagaattatctactcatccacagacaaaagtctctctgtagaagcctcaggaatcagggagtaatctgtgaaaattcagtggaatcaaggccctaggtaggcagctttgggattgcagaccagcacctggatagcagacccaccaatgatactgcaggtttcaaacttggagacatccttgttaacaaaaggcttggctacactccaattttgtcttgagtcttgaaccaaaaacatctaccaatgtgtctaggaggaatcatgcacactaataacttggcagaaaatctcttctgtccgttaaatgttggcagtgaatctgaaacttaccctgtaatttggctccagacccactcagctgtgatctgagtttattactgctcacacaaggatacctagagaaagacttacccttatctcatagccaggcaatcacccatttttctgaaactccttggtgggaccaccagcctttgtcccaaagcagatcctgaggggacccagtctcagctccagctcctcccacatctgagccaatgagacaggctcctggacttaggtccctggccagcttcctcacacagcttgggcaccctccttgggtcttcaccacgtccttctacataagggctccatgccaacctgacagccctcatgagactcacagtgaacctaggcttagagtttcctctagtgctgaaatggctgcagcagtcatgcgatctaacattaggtttgcttaaattctggagaggcccagtgaagaaaaacaggcacaaacaaagccagactgtgaagactgaaataaataccttttttcagagcaaatacatcaatgtacatacacaagcatcaagaacaaccagggaattttgacctcaccaaacagacaaaacacgatgccagtgacaaaccctaaagtgatgcagaagtattatctctcaaggaattcagaatagcttgttaaggaagcttagtgaatttcagtaaaacacagagaaaagcagttcagaaatttatcagagaagtttaacagggactaaagtaatgaaaaatctaacagaaatcctagagctaaaagatacaattaatgaaataagaaatgcaatacgagcattaacagcagaattaatcaagcagaagaaaaaaaaatcagtgaaatctaagatagactatttgaaatatggccaaagtgggaaaaagaataaaaaaaaagaaacaagtgaagttcatggagtctatgggatactattgaaagagcaaatacttgggtcattggagttcaagagggtacagaaaaagacaaggaaatagacggcttattcacagaaatcataaaagaaaattttacaatcctggaaaaagatgtaaatgctcaagtaaaggaaggtcaaaggccatcaatcatattcaacacaaatggaactacctcaagacataccctttgactctcgaaataaaaacagagcattctaaaagcagtaatagaaaagaagcaaataacatgtaagggaatgttgatatgcctggcagcagacttttcagcagaaaccttgcaggccaaaaagtgtagggcaatatattcagaatgctgaaagaaaaagaatgccaaccaagaataaagtaactggcaaatatgtccttcagaaatgaaggagagataaaggctcttccagacaaacaaaagccaagtaaatgcaacaccaccagatctgtcttacaagaaataacaaaggaagttcttcaacttgaaagaaaaaaaatgctaatgtgtaacaagaaaatatcaaaaggtataaaactcactggtaaaggtaagtatacaggccaggcatggtagctcatggctgtaaccccaccactttagaaagctgaggcaagtggattgactaaaaaacccaaggatttgagttcagcctgggcaacatggcaaaaccgcatcttacgagaaaacacacacacacaaaaaaaaaaaaacagaaaaaaaataaatagccagccatggtggcttgtgtctgtagtcccagctattcaagaggctgaaataggataattccttgagcctaggaggcagaggttgcagtgagccaagattgagtcacagcactccagcctgggtgatagagtaagaccctgcctttaaataaatgaataaatgtaggaatacagataaatttgggatatctaacattgtaattatggtatgtaaaccacttataactttagtatgaatacaaaaatacaaagctcttaaaaatgataactaaaatactttattaaaagataaaccatacaaaagatgtaaattgggacatgaaaattcaaaatacttgagaagaaaggagttagagtgtacaatatttttgtttcctttcttttctgattaaaattaagttcctattagcttaaaataacttgttatacatggacacatggtggggagcaacacacactggggcctgagtgtggtggatgagaggagggagaagatcaggaagaatagctaatggatgctggggttaatacctgggtaatgggatgatctgtgcagtaaaccaccatggcacacgttttcctatgtaataagcctatacatcctgcacatgtacccctggacttaaaataaaagtaggaaatttaaaataaaataaaacaacttgatgtaaacaaaatatgtatttcaaagcctcatgataaccacaaagtaaaaacctataatagatacactaaagataaacagcagtgaatcaaagcataatgttggagaatatcacttaaccacaaaaggatatagcaagagtggtagaaaagaaggaaggatctacaaaataactaggaaagaagtaacaaaatgtcagtagtacctccttacctattggtagttaccttgaatgtaaatggattaaattttcctattaaacaacataaagtagctaaattgatttttttaaagactcaactatatgctgcctataagagcctcactttacgcagaagaacacaaatagactgaaagtgaagggatagaaaaagatattccatgcaaatggagagcaaaatggagcagaagtagctatacttatatcagacataatagactttaagccaaaaaaactgtaaaaaaagacaaatatgctaattaaaaactgatacaggggtaaatacagaaagagaatataacaattataaatatgcatgtacccaacaattgaacatacaaatatataaagcaaatgctaataggcctacagggagatatagcgtacaatacaacaatagtataacacttgaacatcttatcttcagtgataaacagataatccagacagaatatcaacaaaaaatgagagttaaactgaactcctgaccaaatgaacctaacagatgcttaaagaacattctatccagtagttgcagaatatacattcttctccacagtacatggaacattctccaggatatatcttatgttaagctgcaataaaagtcttaacatattaaaaaattaaaaatcaaaaaatgtttttttcaacaataatggtatagaactagaaatcaataagaggaggaactttggaaactacaaatacatggaaattagacaacatacagctgaacaaccagtggttcagtgaaaaaaatcaaaaagaaaatttcaatatttcttgaaaaaatggaaatgggaacacaacacacaaaaacctatggagggggaggagccaagatggccaaataggaagagctccggtctacagctcccagcctgagtgacgcagaagatgggtgatttctgcatttccatctgaggtaccgggttcgtctcactagggagtgccagacagtgggtgcaggtcagtgggtgcgcacaccgtgtgccagctgaagcggggtgaggcattgcctcactcgggaagtgcaaggggtcagggagttccctttcctagtcaaagaaaggggtgacggacggcacctggaaaatcgggtcactcccacccgaatactgcgcttttccaacggacttaaaaaacggcacaccatgagattatatcccacacctgcttcggagggtcctacgcccacagagtctagctgattgctagcaccgcagtctgagatcaaactgcaaggcggcagtgaggctgaggcaggggcgcccaccattgcccaggcttgcttaggtaaacaaagcagccaggaagctcgaactgggtggagcccaccacagctcaaggaggcctgcctgcctctgtaggctccacctctgggggcagggcacagacaaacaaaaagctgtaacctctgcagacttaaatgtccctgtctgacagctttgaagagagcagtggttctcccagtacgcagctggagatctgagaacgggcagactgcctcctcaagcgggtccctgacccctgactcccgagcagcctaactgggaggcaccccccagcaggggcacactgacacctcacacggcagggtactccaacagacctgcagctgagggtcctgtctgttagaaggaaaactaacaaacagaaaggacatccacatcaaaaactcatctgtacatcaccatcatcaaagaccaaaatagataaaaccacaaagatggggaaaaaacagaacagaaaaactggaaactctaaaaagcagagcgcctctcctcctccaaaggaacgcagttcctcaccagcaatggaacaaagctggacagagaacgactttgacgagctgagagaagaaggcttcagacgatcaaattactctgagctacaggaggacattcaaaccaaaggcaaagaagttgaaaacttggaaaaaaatttagaagaatgtataactagaataaccaacacagagaagtgcttaaaggagtgatggagctgacaaccaaggctcaagaactacgtgaagaatgcagaagcctcaggagctgatgcgatcaactggaagaaagggtatcattgatggaagatgaaatgaatgaaatgaagtgagaagggaagtttagagaaaaaagaataaaaagaaatcaacaaagcctccaagaaatatgggactatgtgaaaagaccaaatctacgtctgattggtgtacctgaaagtgacggggagaatggaaccaagttggaaaacactctgcaggatattatccaggagaacttccccaatctagcaaggcaggccaacgttcagattcaggaaatacagagaacaccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagcggatctcttggcagaaaccctacaagccagaagagagtgggggccaatattcaacattcttaaagaaaagaattttcaacccagaattaaatatccagccaaactaagcttcataagtgaaggagaaataaaataccttacagacaagcaaatgctgaaagattttgtcaccaacaggcctgccctaaaagagctcctgaaggaagcgctaaacatggaaaggaacaaccggtacaagctgctgcaaaatcatgccaaaatgtaaagaccatcaagactaggaagaaactgcatcaactaatgaacaaaataaccacctaacatcataatgacaggatcaaattcacacataacaatattaactttaaatgtaaatggactaaatgctccaattagaagacacagactggcaaattggataaagagtcaagacccatcagtgtgctgtattcaggaaacccatctcacgtgcagagacacacacaggctaaaaataaaaggatggaggaagatctaccaagcaaatggaaaacaaaaaaaggcagggattgcaatcctagtctctgataaaaccgactttaaactaataaagatcaaaagagacaaagaagaccattacagaatggtaaagggatcaattcaacaagaagagttaactatcctaaatatatatgcacccaatacaggagcacccagatccataaagcaagtcctgagtgacctacaaagagacttagactcccacacattaataatgggagactttaacaccccactgtcaagattagacagatcaacaagacagaaagtcaacaaggatacccaggaattgaactcagctctgccccaagcggacctaatagacatctacagaactctccaccccaaatcaacagaatatacatttttttcagcaccacaccacacctattccaaaattgatcacatagttggcagtaaagctctcctcagcaaatgtaaaggaacagaaattataacaaactatctctcagaccacagtgcaatcaaattagaactcagaattaagaatctcactcaaaaccgcacaactacatggaaactgaacaacctgcttctgaatgactactgggtacataatgaaatgaaggcagaaataaagatgttctttgaaatgaacaagaacaaacacacaacataccagaatctctgggacgcattcaaagcagtgtgtagagggaaatttatagcactaaatgcccacaagagaaagcaggaaacatccaaaattgacatcctaacatcacagttaaaagaactagaaaagcaagagcaaacacattcaaaagctagcagaaggcaagagataactaaaatcagagcagaactgaaggaaatagagacacaaaaacccttcaaaaaattaatgaatccaggagctggttttttgaaaggatcaacaaaatagatagaccactagcaagactaataaagaaaaaaagagagaagaatcaaatagacacaataaaaaaatgataaaggggatatcaccaccgatcccacggaaatacaaactaccatcagagaatactacaaacacctctacgcaaataaactagaaaatcaagaagaaatggataaattcctcgacacatacactctcccaagactaaaccaggaagaagttgaatctctgaatagaccaataacaggatatgaaattgtggcaataatcaataccttaccaacaaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatcaatatccttgatgaacattgatgcaaaaatcctcaataaaatactgccaaaccaaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaagacctttgacaaaattcaacaacccttcatgctcaaaactctcaataaattaggtattgatgggacgtatttcaaaataataagagctatctatgacaaacccacagccaatatcatactgaatgggcaaaaactggaagtattcactttgaaaactggcacaagacaaggatgccctctctcaccactcctattcaacatagtgttggaagttctggccagggcaattaggcaggagaaggaaataaagggtattcaattaggaaaagaggaagtcaaattgtccctgtttgcagacgacatgattgtatatctagaaaaccccattgtctcagcccaaaatctccttaagcagataagcaacttcagcaaaatctcaggatacaaaatcaatgtacaaaaatcacaagcattcttatacaccaacaacagacaaacagagagccaaatcatgagtgaaatcccattcacaattgctttaaagagaataaaatacctaggaatccaacttacaagggatgtgaaggacctcttcaaggagaactacaaaccactgctcaatgaaataaaagaggataaaaacaaatggaagaacattccatgctcatgggtaggaagaatcaatatcatgaaaatggccatactgcccaaggtaatttacagattcaatgccatccccatcaagctaccaatgcctttcttcacagaattggaaaaaactatttttagttcatatggaaccaaaaaagagcccgcattgccaagtcaatcgtaagccaaaagaacaaagctggaggcatcacactacctgacttcaaactatactacaaggctacagtaaccaaaacagcatggtactggaaccaaaacagagatatagatcaatggaacagaacagagccctcaaaattaatgccacatatctacaactatctgatctttgacaaacctgagaaaaaccagcaatggggaaaggattccccatttaataaatggtgctgggataattggctagccatatgtagaaagctgaaactggatcccttccttacacctcatacaaaaattaattcaagatggattaaagacttaaacgttagagctaaaaccataaaaaccctacaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaatttttgcaacctactcatctgacaaagggctaatatcgagaatctacaatgaactcaaacaaatttacaagaaaaaaacaaacaaccccatcaaaaagtgggcaaaggacatgaacagacacttctcaaaagaagacctttatgcagccaaaaaacacattaaaaaatgctcatcatcactggccatcagagaaatgcaaatcaaaaccacaatgagataccatctcacaccagttagaatggcaatcattaaaaagtcaggaaacaacaggtgctggggaggatgtggagaaataggaacacttttacactgttgatgggactgtaaactagttcagccattgtggaagtcagtgtggcgattcctcagggatctagaactagaaataccatttgacccagccatcccattactgagtatatacccaaaggattataaatcatgctgctataaagacacatgcacacgtgtgtttattgcggcattattcacaatagcaaagacttggaaccaacccaaatgtccaacaatgatagactggattaagaaaatgtggcatatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaaagagatcacatggacacaggaaggggaacatcacactctggggactgttgtggggtggggggagggggtagggatagcattgggagatatacctaatgctagatgacgagttagtgggtgccgcgcaccagcatggcacatgtatacatacgtaactaacatgcacaatgtgcacattaccctaaaacttaaagtataataataaaaaaataaaaaaataaaaaaaacaaaacaaaacctatggaatacagcaaaagcatttctaagagggaagtctacagcaataaaggcttacatttaaaaagtagaaagatttcagataacctcatgttgctcaaggaactagaaaaacaagaacaacatcaagccaaaactagtagaagagaagcaacgataaatgtaaaaacagaaataaattaaatagagccttaaaaaacaacacaaaagaataacaaagaagacttcgttttttcaaaatataaaacacttggccaggcacggtggctcaccacttaatcccagcactttgggaggccgaggagggtggatcacttgttaagagttcaacaccagcctgagcaacatggtgaaaccccatctctactaaaaatacaaaaattagctgattgtggtggcaggcccctgtaattccagccactagggaggctgaatcaggagaatcacttgaacctgggaggcagaggttgcagtgagcagagatcgtgccactgcactccagcctgggcaatggagctagactctgtctcaaaaatcaaaaacaaaacctgacaaacttttaactagacaaattaagaaaaaaagaggagtcaaaaaaataaaatcatagatataaaaggagactttacaaataatataatataaatacaaaggaccataagagaccattatgaacaactatatgaaaacaaattgtaaaacttagaagaaataggtaaatgcctggactcatacaaccacaagattgaatcatgaagaaacagaaaattcaaacaggccaataatgagtaacaagattgaaacaatagtttaaagtctcccattaaagaaagcacaggagctgatgacctcactgctgaattctaccaaatattttaaaaataactaatgcctgttcttctcaaactgcccccaaaaaaactgaatgagagtaaatttgtccagacttattatttgagactagcattcattagcccgatataaaaactagatgacacaacaaaaacaaaaaagaaaattacaggacagaagtggttgctcatgcctgtaatcctagcactttgggaagccaaggagggtggatcacttgagcccaggagttcaagaccagcctgtcaacatgatgaaaccttgtctctaaaaaaagtacaaatattagccaaaaatggtggtgggcgcctgtagtcctagctactcaggaggctgaggttggaggatcacccaagcccaggaggttgaggctgtggtgagatgtgattgtgccactgcactccagcttgggtgacagagtgagacactttctcaaaaaaataaaataaaataggaaaaactacaggccaatatccctaatgaaacgcatgcaaaaatcctcaagaaaatgctagcaaactaaatttaacagaatacttaaaagaccagcctttaaaatcaagtggcattcattccagggatgcaaggatgattcaaagtattcagattaataaatgtactgcatcacattaatagaataaaggacaaaagcacgtaatcatttcaatagaaacagagaaagcatttgatagaattcaacatcccactatgataaaagttatcaataaattaggtatataaggaacgtacctaaacacaataaaagccacatatgagaaacccacagctaatataaaacaaaatggggaaaagatgaaagaaatttctctaaaatctggaactaagcaaagatgtccactttcactacttctagtcaacattgtactggaactcctagccagggtaattaggcaagagaaagaaatacggggcatacaattaaaaagaaggaagtcaaattatccctgtttgtggagatcacaactttatatacagaaaatactaattacttcatcaaaaagccatgagcactaataaattcagtaaaatttcaggatattaaatgcatatacaaaaagcagtaatatttccttcaccaacatcaaaatatctgaaaaataaatcaagaaaacaattccatgtacaatagctacaaaatataagatacttaagaataaatgtaacaaaggaggtaaaaactctacaaaaaaatctataaaacactgatgaaagaaattgaaaaggacaaaaattattggaaaggtattttgtactagttcattttcgtcctgctaataaagacatatctgagactagataatttacaaaagaaagaggtttatttggactcacagttccacgtagctggggtggcctcacagtcatggcagaaggtaaaaggcacttctttcacagcagcagcaagagagaagagagtttgtgcatggaaactactgtttttaaaactatcatatctcatgagactcattcactaacatgagaacagcacaggaaagacttgtccccatgattcaattatctcccactaggtccctcccacaacatatgggaattatggtggctacaagatgagatttgggtggggacacagggccaaatcatatcgtattttatgttcacagattgaaataattggcattgttaaaatgcccatactacccaaagcaatctacagattcaatgtaatctctatcaaaataccaatgacatacttcatagaaatagaaaagatgattctaaattaatattgaaccatcaaagaccccaaaagccaaagtaatcttgagcaaaaagggcaaatctgtagaaatcacactacctgatttcaaaatatactacaaaactatagtaaccaaaacagcatggtactggtataaaaacagatacatagatcagcggaacagaatatataacccagaaataaatccatgcctttacagccaacctatttttaacaaaagtgccaagacacacattggggacagaacagtctcttcaataaatagtgctgggaaaactgaatatccatatgcagaagaacaaaactagagccctatatctcaccatatacaaaatcaaatgaagatgggttaaagacttaaatgtaagacccaaaattgtgaaactacaagaagaaaatataggggaatgcttcatgttggtctgggaaaagattttcgataagacctcaaaagcactggtaatacaaaacaaaatagacaaatgaaattttatctaactaacaagctctgcacagcaaaggaaataagctacagaatggtagaaaatatctgcaaactacgtatccaaagggattaagatccagaatatataaggaactcaaagagctcaatggcaaaaaagtaagttatttaaattttaaagggcaaaagacctgattagacaactctgaaaagaagacatacgaatgaccaataggtaaatataatatgctcaacatgactaatcagtagggaaatgcaaatcaaaaccacaatgagatatcacttcaccccagtttgaattagtctaagcaggtaactaaacaaaagcaaacaaacaaaaaacacattaaaaacaaaacaaacaaaaatagattttatttaaaaagtctcaaactaaaaatatactacatacccattaaagaccagatagatttttaaaaattatttttttccacctcttattttaggttcggcagctacatttgaaggtttgttacatgggtaaattgcatgttgtgggggcttggtgtacagaatgtttcgtcacacaggtaatgagcatagtacccataggtagtttttaagttctgttttaagttctttgagaaatcaccaaactgcccttcacagtggctgaactaatttacattcccaccagcagagtgtaagtattctcttttctctgcaaccttgctagaatctgttacttttttgacattttaataatagccattctgactggtgtgagatggtatctcattgtggttttgatttgcatttctctgatgattagtgatgttgagaatttttaaatatgcttgttggctatgtatatgtcttcttttgagaagtgtctgttgatattctttgcctattttttaaggaggttgtggttttttgcttgttaatttaagttccttatagatgctgggtattagatctttgtcatacacatagtttgcaagtattttcttccattctgtaagttgtctgtttattctgttgacaattttgtttgctgtgcagaaactctttagtttaattaagttccatttaatttttgtttacattgcagtttcttttgaagtcttcatcatgaaatccttgccagggcctatgtccagaatggaatttcacaggttttcttccaagatttctgtagttttaggttttacatttaagtctttaatccatcttgaattaacttttgtatgtggtgaaaggaagatgtaaattttcaatattctgcatatggctagccagttagcacaacaccatttattgaataggaagtcttcaccccattgcttcttactgttgacattgtcaaagatcagatggttgtaaggtgtgcagatttatttctgggttctctaacctgttcatttatctatgtgtttgtttttctactagtaccatgctgttttggttactgtagccttgtactatagtttgaagtcagatagtgtggtgcttccagctttgttctttttgcttaagattgctttgggtgttcagactcttttttttttattattatacgttaagttttagggtatatgtgcacaatgtgcaggttagttacatatgtatacatgtgccatgttgttgtgctgcagccattgactcgttatttaatattaggtatatctcctaatgctatccctcccccttccccccaccccacaacagtccccggtgtgtgatgttccccttcctgtgtccatgtgttctcattgttcaattcccaccggtgagtgagaacatgcagtgttttgttttttgtccttgcaatagtttgctgagaaaggtggtttccagtttcatccatgtccctacaaaggacatgaactcatcattttttatggctgcatagtattccatggtgtatatgtgccacattttcttaatccagtctatcattgttagacatttgggttggttccaagtctttgctattgtgaatagtgcctcaataaacatatgtgtgcatgtgtctttatagcagcatgatttataatcctttgggtatataaccagtaatgggatggctgggtcaaatggtatttctagttctagatccctgaggaatcgccacactgacctccacaatggctgaactagtttacagtcccaccaacagtgtaaaagtgttcctatttctccacatcctctccacacctcttgtttcctgaccttttaatgatcgccattctaaaggctgtgagatggtatctcattgtggttttgatttgcatttctctgatggccagtgatgatgaccgttttttcatgtgtcctttggctgcataaaggtcttcttttgagaagtgtctgttcatatcctttgcccactttttgatggggttgtttgtttttttcttgtaaatttgtttgagttcatagtagattctggatattagccctttgtcagatgagtaggttgcaaaagttttctcccattctgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttacggtttcaggtctaacatgtaagtctttaatccatcttgaattgatttttgtataaggtgtaaggaagggatccagtttcagctttctacatatggctaaccagttttcccagcaccatttattaaatagggaatcctttccccattgctggtttttgtcagctttgtcaaagatcagatggttatagatatgtggcgttatttctgagggctctgttctgttccattgttctatatctctgttttggtaccagtaccatgctgttttggttactgtagccttgtagtatagtttgaagtcaggtagtgtgatgcctccagctttattcttttggcttaggattgacttggcaatgcgggctctttttggttccatatgaactttaaagtagttttttccaattctgtgaagaaagtcattggtaacttgatggagatggcattgaatctacaaattaccttgggcagtatggccattttcatgatattgattcttcctacccatgagcatggaatgttcttccatttgtttgtatcttcttttatttcactgagcagtggtttgtagttctccttgaagaggtccttcacatcccttgtaagttggattcctaggtattttattctttttgaagcaattgtgaatgggagttcactcatggtttggctctctgtctgttactggtgtgtaagaatgcttgtgatttttgcacattgactttgtatcctgagactttgctgaagttgcctatcagcttaaggagatttggggctgagacgatggggttttctagatatacaatcatgtcatctgcaaacagggacaatttgacttcctcttttcctaattcaataccctttatttccttctcctgcctaattgccctggccagaacttccaacactatgttgaataggagtggtgagagagggcatccctgtcttgtgccagttttccaagggaatgcttccaggttttgcccattcagtatgatattgcctgtgggtttgtcataaatagctcttattattttgagatacatcccatcaatacctaatttattgagagtttttagcatgaagggttgttgaattttgtcaaaggacttttcaagatgaagcccactttatcagggtggataaggtttttgatatgctgctgaattcggtttgccagtattttattgagaatttctgcatcgatgttcgtcagggatattggtctaaaattgtctttttttgttatgtctctgccaggttttggtatcaggataatgctggcctcataaaatgagttaggtaggattccctctttttctattgattggaataatttcagaaggaatggtaccagctcctccttgtacttctggtagaatttggcagtgaatccattgggtcctggactttttttgattggtaagctattaattattgcctcaatttcagagcctgttattggtctattcagggattcaaattcttcctgatttagtcttgggggggtgtacgtgtcgaggaatttatccatttcttctagactttctagtttatttgcgtagaggtatttatagtattattctctgatggtagtctgtatttctgtgggatcagtggtgatatcccctttatcatcttttattgcgtctatttgattctgctctcttttcttctgtattagtcttgctagcagtctgtcaattttgttgatcttttcaaaaaagcagctcctggattcattgattttttgaagggtttttgtgtctcttatttccttcagttcagctctgatcttagttatttcttgccttctgctagcttttgaatgtgtttgctcttgcttctctagttcttttaattgtgatgttatggtgtcaattttagatctttcctgctttctctagtgggcatttagtgctataaatttccctctacacactgccttgaatgtgtcccagagattctggtatgttgtgtctttgttctcgttggtttcaaagaacatctttatttctgccttcatttcattatgtacccagtagtcattcaggagcaggttgctcggtttccatgtagttgagcggctttgagtgaatttctttatgctgaatcctagtttcattgcactgtggtctgagagacagtttgttataatttctgttcttttacatttgctaaggagacctttacttccaactatgtggtcaattttggaataagtgcggtgtggtgctgagaagaatgtctattctgttgatttggggtggagagttctgtagatgtctattaggtccacttggtgcagagctgagttcagttcctggatatccttgttaactttctgtctcgttgacctgtctaatgttgacagtggggtgttaaaatctcccattattattgtgtgggagtctaagtctctttctaggcctctaatcacttgctttatgaatctgggtgctcctgtattgggtggataaatatttaggatagttagctcttcttgctgaattgatccctttaccattatgtaatggctttctttgtctcttttgatctttgttggtttaaagtctgttttatcagagactaggtttgcaaccactgcctttttttgttttccatttgcttattaggtcttcctccatccctttattttgagcctatgtgtgtctctgcacttgctatgggtttcctgaatacagcacactgatgggtcttgactctatccaatttgccagtatgtgtcttttaattggagcatttagcccatttacatttaaagttaatattgttatgtgtgaatttgatcctgtcattatgatgttaggtggttattttgctcattagttgatgcagtttcttcctagcctcgacagtctttacaatttggcatgtttttgcagtggctggtaccacttgttccttttcatgtttagtgcttccttcgggagctcttgtagggcaggcctggtgatgacaaaatctctcagcatttgcttgtctgtaaactattttatttctccttcacttatgaagcttagtttggctacatatgaaattctggtttgaaaattcttttctttaagaatgttgaatattggcccccactctcttctggcttgtagagtttctgctgagagatcagctgttagtctgatgggcttccctttgtgggtaaccccacctttctctctggctgcccttaacattttttccttcatttcaactttggtgaatctgacaattatgtgtcttggagttgctcttcttgaggagtatctttgtggcattctctgtatttcctgagtttgaatgttggcctgccttgctagattggggaagttctcctggataatatcctgcagagtgttttccaacttggttccattctccctgtcactttcaggtacaccaatcagacatagatttggtcttttcacatagtcccatatttcttggaggctttgttaatttctttttattctttttcgtctaaacttctcacttcgtttcattcatttgatcttccatcactgataccctttcttccacttgatcccatcggctactgaggctt

SEQ ID NO: 12174 - DNA, 1060 bp, Homo sapiens
  misc_feature (1055)..(1055): n equals a,t,g, or c
gatcttagttatttcttgccttctgctagcttttcaatgtgtttgctcttgcttctctagttctttaaattgtgatgatagggtgtcaattttagatcttgcctgctttctcttgtgggcatttagtgctataaatttccctctacacactgctttaaatgtgtcccagagattctggtatgttgtgtctttgttctcattggtttcaaagaacatctttatttctgctttcattttgttatgtacccagtagtcattcaggagcaggttgttcagtttccatgcagttgagcggttttgagtgagtttcttattcctgagttctagtttgattgcactgtagtctgagagacagtttgttataatttctgttcttttacatttgctgaggagttctttacttccaactatgtggtcaattttggaataagtgtgatgtggtgctgagaagaatgtatattctgttgatttggggtggagagctctgtagatgtctattaggtccacttggtgtagagctgagttcaattcctggatatccttgtgaactttctgtctcgttgatctgtctaatgttgatagtgaggtgttaaagtctcccattattactgtgtgggagtctaagcctctttgtaggtctctaaggacttgctttatgaatctgggtgctcctgtattgggtgcatatatatttaggatagttagctcttcttgttgaattgatccctttaccattatgtaatggccttctttgactcttttgatctttgttggttgaaagtctgttttatcagagactaggattgcaacatctgcctttttttgttttccattttcttggtagatcttcctccatccctttattttgagcctatgtgtgtctctgcacgtgagatgggtctcctgaatacagcacactgatgggtcttgactctttatccaatttgccagtctgtgtcttttaattggagcatttagcccatttacatttaaggttaatattgttatgtgtgaatttgatcctgtcattatgatattagctggttattttgacncgtag

SEQ ID NO: 12175 - DNA, 7975 bp, Homo sapiens
atggtaaatttcttttttttttattgcactttaagttttagggtacatgtgcaaaacgtgcaggtttgttacatatgtgtacatgtgccatgttggtgtgctgcacccactaactcgtcatttaacattaggtatatctcctaatgctatccctccccactcccctcaccccacaacaggccccggtgtgtgatgttccccttcctgtgtccaagtgtcctcattgttcaattcccacctatgagtgagaacatgcggtgtttggttttttgtccttgcgatagtttgctgagaatcatggtttccagcttcatccatgtccctacaaaggacatgaactcatccttttttatggctgcatagtattccatggtgtatatgtgccacattttcttaatccagtctatcattgttggacatttgggttggttccaagtcttcgctattgtgaatagtgccactataaacatacatgtgcctgtgtctttatagcagcatgatttataatcctttgagtatatacccagtaatgggatggctgggtcaaatggtatttctagttctagatccttgaggaatcaccacactgtcttccacaatggttgaattagttgacagtcccaccaacagtgtaaaagcgttcctatttctccacatcctctccagcacctgttgtttcctgactttttaatgatcgccattctaactggtgtgagatggtatctcattgtggttttgatttgcatttctctaatggccagtgatgatgagcattttttcatgtgtctgttggctgcataaatgtctccttttgagaagtgtctgttcgtatcctttgcccacttgttgatggagttgtttgtttttttcttgtaaatttgtttgagttcattgtagattctggatattagccctttgtccgatgagtagactgcaaaaattttctcccattctgtaggttgcctgttcactctgatggtagtttcttttgctgtgcagaagctctttagtttaattagatcccatttgtcaattttggcttttgttgccattgcttttgctgttttagacttgaagtccttggccatgcctatgtcctgaatggtattgcctaggttttcttatagggtttttgtggtatgaggtctaacacgtaagtctttaatccatcttgaattaatttttgtataaggtgtaaggaagggatccagtttcagctttctacatatggctagccagttttcccagcaccatttattaagtagggaatcctttccccatttcttgtttttgtcaggtttgtcaaagatcaggtggttgtagatacgtggaattatttctgagggctctgttctgttacattggtctatatctatgttttggtaccagtaccatgctgttttggatactgtagccttgtagtatagtttgaagtcaggtagcgtgatgcctccagctttgctcttttggcttaggattgacttggcgatgcaggctcttttttggttccatatgaactttaaggtagttttttccaattctgtgaagaaagtcattggtagcttgatgggggtggccttgaatctataaattaccttgggcagtatggccattttcacgatattgattcttcctacccatgagcatggaatgttcttccatttctttgtatcctcttttatttcattgagcagtggtttgtagttctccttgaagaggtccttcacatgccttgtaagttggattcctaggtattttattctctttgaagcaattgtgactgggagttcactcatgatttggctctctgtttgtctgttattggtgtataagaatgcttgtgatttttgcatattgattttgtatcctgaggcttttctgaagttgcttatcagcttaaggaggttttgagctgagatgatggggttttctaaatattcaatcatgtcatttgcaaatagggacaatttgacttcctcttttcctaattgaataccgtttattcctttctcctgcctgattgccctggccagagcttccaccactatgttgaataggagtagtgagagagggtgcccttgtcttgtgccaattttcaaatggaatgcttccagtttttgcccattcagtatgatattgtctgtgggtctgtcataaatagctcttattatttttatatatattccatcaatacttagtttattaagagtttttagcatgaagggctgttgaattttgctgaaggccttttctgcatctattgagataatcatgtggtttttgttgttggctctgtttgtatgctggattatgtttattgatttgcgtatgttgaagcagccttgcatcccggggatgaagcacacttgatcatggtcgataagctttttgaggtgctgctggattcggtttgccagtattttattgaggattttcgcatcaatgtttatcagggatattggtctaaaattctctttttttgttgtgtctctgccaggctttggtatcaggatgatgctggcctcataaaatgagttagggaggattccttctttttctattgatgggaatagtttcagaaggaatggtaccagctcctccttgtacctctggtagaattcggctgtgaatccatctggtcttggactttttttggttggtaagctattaattattgcctcaatttcagggcctgttattggtctattcagagattcaacttcttcctggcttagtcttgggagggtgtatgtgtccaggaatttatccatttcttctagattttctagtttatttgcatagaggtgtttatagtattctctgatggtagtttgtatttctgtgggatcggtggtgatatcccctttatcattttttattatgtctatttgagtcttctctcttttcttctttattagtcttactagtggtctatcaattttgctcatcttttcaaaaaaccagctcctggattcattgattttttgaagggctttttgtatctctatttccttcaattctgctctgatcttagttatttcttgccttctgctagcttttgaatgtgtttgctcttgcttctctagttcttttaattgtgatgttagggtgtcaattttagatctttcctgctttctcttgtgggcatttagtgctataaatttccctctacacactgctttgaatgtgtcccagagattctggtatgttgtatctttgttctcgttggtttcaaaggacatctttatttctgccttcatttcgttatgtacccagtagtcattcaggagcaggttgttcagtttccatgtagttgagtggttttgagtgagtttcttaatcctaagttctagtttgattgcactgtggtctgagagacagtttgttataatttctgttcttttacatttgctgaggagtgttttacttccaactatgtggtcagttttggaataggtgtggtgtggtgctgaaaagaatgtatattctgttgatttggggtggagatttctgtagatgtctattaggtccacttggtgcagagctaagttcgattcctggatatccttgttagctttctgtctctttgatctgtctaatgttgacagtgggatgttaaagtctcccattattactgtatgggagtctaagtctcttttttttttttttattgtccccctggcaaatctttttttcttttttcttttttttgtatttatttatttattttattgatcattcttgggtgtttctcgcagagggggatttggcagggtcataggacaatagtggagggaatgtcagcagataaacaagtgaacaaaggtctctggttttcctaggcagaggaccctgcggcctttcgcagtgtttgtgtccctgggtacttaaggttagggagtggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaagaatttttcttagtacagaacaaaatgaaaagtctcccatgtctacttctctctacacagacacggcaaccatccgatttctcaatcttttccccacctttcccgtctttctattccacaaaaccgccattgtcatcttggcctgttctcaatgagctgttgggtacacctcccagacggggtcgtggccgggcagaggggctcctcaattcccagtaggggtggctgggcagaggcgcccctcgcctcccggacagggcggctggccgggcggggggctgacccccccacctccctcccggacggggtggctggctgggcagaggggctcctcacttcccagtaggggcagccgggcagaggcgcccctcacctcctggacagggcggctggccaggcaaggggctgaccccccccccacccacctccctcccggacggggcggctggccgggcggggggctgaacccccacctccctcccggacggggcggctggccgggcagaggggctcctcaattcccagtaggggtggccgggcagaggcgcccctcgcctcccggacggggcggctggccggatggggtggctggccgggcggggggctgacccccccacctccctcccggacggggcggctggccgggcagaggggctcctcacttcccagtaggggcggccaggcagaggcgcccctcacctcccggacagggcggctggccgggcggggggctgacccccccccacctccctcccagacggggcggctggccgggcagaggggctcctcacttcccagtaggggcggccgggcagaggcgcccctcacctcccgtccgggaggctggccgggtggggggctgacccccccacctccctcccggacggggcggctggcctggcgggggctgacccccacctccctcccggacggggtggctgccaggcagagatgctcctcacctcccagaccgggtggctgccggacggaggggctcctcacctctcagacagggcggttgccaggcagagggtctcctcacttatcagacggggcagccgggcagagacgctcctcacctcccagacggggtcgcggccgggcagaggtgctcctcacataccagacggggcggcggggcagaggcgctccccacatcccagacgatgggcggccgggcagagacgctcctcacttcctagatgggatggcgggggggaagaggcgctcctcatttcctagatgggatggcggccgggcagagacgctcctcactttccagactgggcagccaggcagaggggctcctcacatcccagacgatgggcggccaggcagagacgctcctcacttcccagacggggtggcggctgggcagaggctgcaatctccgctctttgggaggccaaggcaggcggctgggaggtggttgtagcaagccgagatcacgccactgaactccagcctgggcaccattgagcactgagtgaacgagactccgtctgcaatcccggcacctcgggaggccgaggctggcggatcactcgcggttaggagctggagaccagcccggccaacacagcgaaaccccgtctccaccaaaaaaatacgaaaaccagtcaggcgtggcggcgcgcgcctgcaatcgcaggcactcggcaggctgaggcaggagaatcaggcagggaggttgcagtgagccgagatggcagcagtacagtccagctttggctcggcatcagagggagtacagtccagctttggctcagcatcagagggagaccgtggaaagagagggagagggagaccgtggggagagggagagggagagggagaggtctaagtctctttgtagctttctaaggacttgatttatgaatctgggtgctcctgtattgggtgcatatatatttaggatagttagctcttcttgttgaattgatccctttaccattatgtaatggcctggtttgtctcttttgatctttgttggtttaaagtctgctttatcagagactaggattgcaacccctgcctttttttgttttccatttgcttggtagatcttcctccatccctttattttgagcctatgtgtgtctctgcacgtgagagggtttcctgagtacagcacactgatgggtcttgactctttatccaatttgccagtctgtgtcttttaattggagcatttagcccatttacatttaaggttaatattgttatgtgtgaatctgatcctgtcattatgatgttagctggttattttgcttgttagttgatgcagtttcttcctacccttgatggtctttacaatttggcatgtttttgcagtggctggtaccagttattcctttccatgtttagcgcttccttcaggagctcctgtagggcaggcctggtggtgacaaaatctctcagcatttgcttgtctgtacagtattttatttctccttcccttttgaagcttagtttggctggatatgaaattctgggttgaaaattcttttctttaagaatgttgaatattggcccccactctcttctggcttgtagagtttctgccaagagatcagctgttagtctgatgggcttccttggtgggtaacccgacctttctctctggctgcccttaatattttttccttcatttcaactttggtgaatctgacaattatgtgtcttggagttgctcttctcgaggagtatctttgtggcattctctgtatttcctgaatttgaatgttggcctgccttgctaggttggggaagttctcctggataatatcctgcagagtgttttccagcttgattccattctccctgtcactttcaggtacaccaatcagacatagatttggtcttttcacatagtcccatatttcttggaggctttgttcatttctttttattcttttttctctaaacttctcttctcgcttcatttcattgatttgatcttccatcactgataccctttcttccagttgatcaaatcagctactgaggcttctgcatttgccacgtagttctcgtgccatggtgttcagctccatcaggtcctttaaggacttctctgcattggttattctagttagccattcgtctaatcttttttcaaggtttttaacttctttgccatgggttcgaacttcctcctttacctcagagtagtttgatcatctgaagccttcttctctcaactcgtcaaagtcattttccatccagctttgttctgttgctggtgaggagctgtgttcctttggagaaggagaggcattctgatttttagaattttcagtttttctgctctgttttttaccccatctttgtggttttatctacctttggtctttgatgatggtgatgtacagatggggttttggtgtggatgtcctttccgttttttagttttccttctaacagtcaggactctcagctgcaggtctgttggagtttgctggcggtccactccataccctgtttgcctgggtatcagcatcagagtctgcagaacagtggatattggtgaacagcaaatgttgctgcctgatcgttcctctggaagttttgtctcagaggagtacctggccgtgtgaggtgtcagtctgcccctacttggggggtgcctcccagttgggctactcaggggtcagggacccacttggggaggcagtctgtctgttctcagatctccagctgtgtgctgggagaaccactactctcttcaaagctgtcagacggggacatttaagtctgcagaggtttctgctgccttttgtttggctatgccctgcccccagaggtggagtctacagaggcaggcaggcctccttgagctgcagtgggctccgcccagttcaagcttcccagccactttatttacctactcaagcctcagcaatggcgggcg

SEQ ID NO: 12176 - DNA, 1687 bp, Homo sapiens
tagcttttgaagtgtttgctcttgcttctctagttcttttaattgtgatgttagggtgtcaattttagatctttcctgctttctcttgtgggcatttagtgctataaatttccctctgcacactgctttgaatgtgtcccagacattctggtatgttgtgtctttgttctcgttggtttcaaagaacatctttatttctgccttcatttcgttatgtacccagtagtcattcaggagcagggttgttcagtttccatgtagttgagcagttttgagtgagtttcttaatcctgagttctagtttgattgcactgtggtctgagagacagtttgttataatttctgttcttttacatttgctgaggagtgctttacgtccaactatgtggtcaattttggaataggtgtggtgtggtactgaaaagaatgtatattctgttgatttggggtggagattcctgtagatgtctattaggtccgcttggtgcagagctgagttcaattcctgggtatccttgttaactttctgtctcgttgatctgtctaatgttgacagtggggtgttaaagtctcccatcattattgtgtgggagtctaagtctctttgtaggtctctaaggacttgctttatgaatgtgggtgctcctgtattgggtgcatatatatttaggatagttagctcttcttgttgaattgatccctttaccattatgtaatggccttctttgtcccttttgatctttgttggtttaaagtctgttttatccgagactaggattgcaacacctgcctttttctgttttccatttgcttggtagatcttcctccatccctttattttgagcctatatgtgtgtctgcacgtgagatgggtttcctgaatacagcacactgatgggtcttgactctttatccaatttgccagtctgtgtcttttaattggagcatttagcccatttacatttaaagttaatattgttatgtgtgaatttgatcctgtcattatgatgttagctggttattttgctcgttagttgatgcagtttcttcctagcctcgatggtctttacaatttggcatgattttgcagtggctggtaccggttgttcctttccatgtttagtgcttccttcaggagctcttttagggcaggcctggtggtgacaaaatctctcagcatttgcttgtgtgtaaagtattttatttctccttcacttatgacgcttagtttggctggatatgaaattctggattgaaaattcttttctttaagaatgttgaatattggcccccactctcttctggcttgtagagtttctgccgagagatccgttgttagtcttatgggcttccctttgtgggtaacctgacctttctctctggctgcccttaacattttttccttcatttcaagtttggtgaatctgacaattatgtgtcttggagttgctcttctcaaggagtatctttgtggcggttctctgtatttcctgaatttgaatgttggcctgccttgctagattggggaagttcttctggataatatcttgcagagtgttttcctatttggttccattctccccgtcagtttcaggtacaccaatcagacataaatttggtcttttcacatagtcccatatttcttggaggctttgttcgtttctttttattcttttttctctatact

SEQ ID NO: 12177 - DNA, 3692 bp, Homo sapiens
gtctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcagcattatttctgagggctctgttctgttccattgatctatatctctgttttggtaccagtaccatgctgttttggttactgtagccttgtagtatagtttgaagtcaggtagtgtgatgcctccagctttgttcttttggcttaggattcacttggcgaagcgggctcttctttggttccatatgaactttgaagtagttttttcaattctgtgaagaaagtcattggtagcttgatggggatggcattgaatctgtaaattaccttgggcagtgtggccattttcacgatattgattcttcctgcccatgagcatggaatattcttccatttgtttgtatcttcttttatttccttgagcagtggtttgtagttctccttgaagaggtccttcacatcccttgtaagttggactcctaggtattttattctctttgaagcaattgtgaatgggaattcactcatgatttggctctctgtttgtctgttattggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctattgaataccctttatttccttctcctacctaattgccctggccagaacttccaacactatgttgaataggagtggtgagcgagggcatccctgtcttatgccagttttcaaagggaatgcttccagtttttgcccattcagtatgatattggctgtgggtttgtcatagatacctcttattattttgaaatacgtcccatcaatacctaatttattgagagtttttagcatgaagggttgttgaattttgtcaaaggccttttctgcatctattgagataatcatgtggtttttgtctttggttctgcttatatgctggattacatttattgatttgcatatattgaaccagccttgcatcccagggatgaagccctcttgatcatggtggataagctttttgatgtgctgctggattcgttttgccagtattttattgaggatttttgcatcaatgttcatcaaggatattggtctgaaattctcttttttggttgtgtctctgcccggctttggtatcaggatgatgctggcctcataaaatgagttagggaggattccctctttttctgttgattggaatagtttcagaaggaatggtaccagttcctccttgtacctctggtagaattccgctgtgaatccttctggtcctggactctttttggttggtaagctattgattattgccacaatttcagatcctgttattggtctattcagagattcaatttcttcctggtttagtcttgggagagtgtatgtgttgaggaatttatccatttcttctagattttctagtttatttgcatagaggtggttgtagtattctctgatggtagtttgtatttctgtgggatcagtggtgatatcccctttatcattttttattgcatctatttgattcttctctctttttttctttattagtcttgctagtggtctatcaattttgttgatcctttcagaaaaccagctcctggattcattaattttttgaagggttttttgtgtctctatttccttcagttctgttgattttagttatttcttgccttcttctagcttttgaatgtgttttctcttgcttttctagttcttttaattgtgatgttagggtgtcaattttggatctttcctgctttctcttgtgggcatttagtgctataagtttccctctacacactgctttgaatgcgtcccagagattctggtatgttttgtctttgttctcaatggtttcaaagaacatctttatttctgccttcatttcgttatgtacccagtagtcattcaggagcaggttgttcagtttccatgtagttgagcggttttgagtgagattcttaatcctgagttctagtttgattgcactgtggtctgagagatagtttgttataatttctgttcttttacatttgctgaggagagctttacttccaagtatgtggtcaatttttgaataggtgtggtgtggtgctgaaaaaaatgtatattctgttgatttggggtggagagttctgtagatgtctattaggtccgcttggtgcagagctgagttcaattcctgggtatccttgttgactttctgtctcattgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttgttgttgaattgatccctttaccattatgtaatggtcttctttgtctcttttgatctttgttggtttaaagcctgttttatcagagactaggattgcaacccctgcctttttttgttttctatttgcttggtagatcttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttgctcgttagttgatgcagtttcttcctagtctcgatggtctttacattttggcatgattttgcagcagctggtaccagttgttcctttccatgtttagtgcttccttcaggagctcttttagggcaggcctggtggtgacaaaatctctcagcatttgcttgtttgtaaagtattttatttctctttcacttatgaagcttagcttggctggatatgaaattctgggtttaaaattcttttctttaagaacgttgaatattggcccccactctcttctggcttgtagagtttctgccgatagatctgctgttagtctgatgggcttccctttgagggtaacctgacctttctctcttgctgcctttaacattttttccttcatttcaactttgatgaatctgacaattgtgtgtcttggagttgctcttctcaaggagtatctttgtgacattctctgtatttcctgaatctgaatgttggcctgccttgctagattggggaagttctcctggataatatcctgcagagtgttctccaacttggttccattctccctgtcactttcaggtacaccaatcagacgtagatttggtcttttcacatagtcccatatttcttggaggctttgctcgtttctttttattcttttttctctaaacttcccttctgtcttcatttcattcatttcaccttccatcgctgataccctttcttccagttgatctcatcagctccggaggcttctgcattcttcacgtagtt

SEQ ID NO: 12178 - DNA, 3735 bp, Homo sapiens
tgcccatgcctatgtcctgaatggtattgcctagttttcttctaggtttttatggttttagtctaacatttaagtctttaatccatcttgaattaatatttgtataaggtgtaaggaagggatccagtttcagctttctacatatggctagccagttttcccagcaccatttattaaatagggaatcctttccccatttcttgtttttgtcaggtttgtcaaagatcagatggttgtagatgtgtgttgttatttctgaggcctcttttctgttccattagtctatctctctgttttggtaccactaccatgctgttttggttactgtagccttgtagtatagtttgaagtcaggtagcatgatgcctccagctttgttcttttggcttaggattgtcttggctatgtgggcccttttttggttccatatgaactttaaagtagatttctccaattctgtgaagaaagtcattggtagcttgatggggatggcattgaatctataaattactttgggcactatggccattttcaggatattgattcttcctatccatgagcatggaatgttcttccatttgtttgtgtcctcttatttcgttgagcagtggtttgtagttctccttgaagaggtccttcacatcccttgtaagttggattcctaggtattttattctctttgtagcaattgtgaatgggagttcactcatgatttggctgttattggtgaataggaatgcttgtgatttttgcacattgattttgtatctggagactttgcagaagttgcttatcagcttaaggagattttgggctgagacaatggggttttctaaatatacaatcatgtcatctgcaaacagggacaatttgacttcctgttttcctaattgaataccctttatttctttctcttgccttattgccctggccagaacttccaacactatgttgaataggagtggtgagggagggtatccttgtcttgtgccggatttcaaacagtgcttccagtttttgcccattcagtatgatattggctgtgggtttgtcataaatagctcttattattttgagatatgttccatcaatacctagtttattgagagtttttagcatgaagggctgttgaattttgtcaaaggccttttctgcatctattgagatactgatgtggtttttgtcattggttctgtttatgtgatggattacgtttattgatttgcgtatttatttatttttttgagatggagtctcactctgttgcccaggctggagtgcagtggtgcgatctcagctcactgcaagctccgcctcccatgttcacgccattctcctgcctcagcctcctgagtagctgggactacacgcgcccgccaccacgcctggctaatattttctatttttagtagagacggggtttcaccgtgttagccaggatggtgtccatctcttgacctcgtgatccacccacctcagcctcccaaagtgctgggattacaggcgtgagccaccgcgcccggcaatttgcgtatgttgaaccagccttgcatcccaaggatgaagctgacttgatcgtggtggataagctttttgatgtgctgttggattcagtttgccagtattttattgaggatttttgcattgatgttcatcagggatattggtctaaaattctgtttttttgttgtgtctctgccaggctttggtatcaggatgatgttggcctcataaaatgagttaggggaggattccctctttttctattgattagaatagtttcagaaggaagggtactagctcctctttctacctctggaagaattcggctgtgaatccttctggtcccggactttttttggttggtaggctattaattattgcctcaatttcagagcctgttattggtctattcagagattcaactgcttcctggtttagtcttgggagggtgtgtgtgtccaggaatttatccatttcttctagattttgtagttatttgcgtagcagtgtttataacattctctgatggtagtctgtatttctgtgggatcggtggtgatatcccctttatcattttttattgtgtctatttgattcttctctcttttcttctttattagtcttgctagctgtctatcaattttgttgatcttttcaaaaaaaaaaaaccagctcctggattcattgatttttttgaagggttttttgtgtctctatctctttcagttctgatctgatcttagttatttcttgccttctgctagcttttgaatgtgtttgctcttgcttctcttgttcttttagttgtgatgttagggtgtcgattttaaatctttcttgctttctcttgtgggcatttagtgctataaattttcctctacacactgctttaaatgtgtcccagagattctggtacattgtgtctttgttctcattggtttcaaagaacatgtttatttctgccttcatttcgttatgtacccagtagtcattcaggagcaagttgttcagtttccatgtagttgagtggttttgagtgagtttcttaatcctgagttctaatttgattgcactgtggtctgagagacagattgttgtgatttctgttctttaacatttgctgaggagtgctttacttccaattatgtggtcaattttagaataagtgtgatgtgctgagaagaatgtatattctgttgatttagggtggagagatctgtagatgtctattaggtccgcttggtgcagagctgagttcaagtcctggatatccttgttaaccttctgtctcattgatctgtctaatattgacagtggggtgttaaagtctcccattattattgtgtgggagtttaggtctctttgtaggtctctaaggacttgctttatgaatctgggtgcccctgtattgggtgcatatatacatgtttaggatagttagctcttcttgttgaattgatccctttaccattatgtaatgatcatctttgtctcttttgatctttgttggtttaaagtctgttttgtcagagactaggattgcaaccactggttttttttttttgtttttttttttttttttttctttccatttgcttggtagatttcctccatccctttattttgagcctatgtgcatctttgcacatgagatgggtctcctgaatacagcacactgatgggtcttgactctttatccaatttgccagtctgtgtctttcaattggggcatttagcccatttacatttaaggttaatattgttatgtgtgaatttgatcctgtcattatgatgttagctggttattttgcccgttaattgatgttttttcttcatagcatcaatggtctttacaatttggcatgtttttgcagtggctggtgctggttgtttctttccatgtttagtgctttcttcaggagctcttgtaaggcaggcctggtggtgacaaaatctctcagcatttgcttgtctgtaaaggattttatttctccttcacttacgaagcttagtttgtctggatatgaaattctgggttgaaaattcttttaagaatgctgaatattggcccccactctcttccagcttgtagggtttctgctgagagatccactgttagtctaatgggcttccctttgtgggtaacccgacctttctctctggctgcccttaacactttttctttcatttcaaccttggtgaatctggcaattatgtgtcttggagttgctc

SEQ ID NO: 12179 - DNA, 1581 bp, Homo sapiens
atattggtataaaattctcttttttggttgtgtctctgcccggctttggtatcagaatgatgctggcctcataaaatgagttagggaggattccctctttttctattgattggagtagtttcagaaggaatggtaccagttcctccttgtacctctggtagaattcggctgtgaatccatctggtcctggaatctttttggttggtaaactattgattattgccacaatttcagatcctgttattggtctattcagagattcaacttcttcctggtttagtctcgggagagtgtatgtgttgaggaatttatccatttcttctagattttctagtttatttccgtagaggtgtttgtagtattctctgatggtagtttgtatttctgtgggatctgtggtgataccccctttatcattttttattgtgtctatttgattcttctctctttttttctttattagtcttgctagcagtctatcaattttgttgatcctttcaaaaaaccagctcctggattccttgattttttgaagggttttttgtgtctctatttccttcagttctgctctgattttagttatttcttgccttctgctagcttttgaatgtgtttgcttttgcttttctagttcttttaattgtgatgttagggtgtcaattttggatctttcctgctttctcttgtgggcatttagtgctctaaatttccctctacacactgctttgaatgtgtcccagagattctggtatgttgtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatctctgttcttttacatttgctgaggagagctttacttccaagtatgtggtcaattttggaataggtgtggtggtgctgaaaaaaatgtatattctgttgatttggggtggagagttctgtagatgtctattaggtccacttggtggagagctgagttcaattcctgggtatccttgttgactttctgtctcattgatctgtctaatgttgacagtggggtgttaaagtctaccattattaatgtgtgggagtctacgtctctttgtaggtcactcaggacttgctttatgaatctgggtgctcctgtattgggtgcatatatatttaggatagttagctcttcttgttgaattgatccctttaccattatgtaatggccttctttgtctcttttgatgtttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgt

SEQ ID NO: 12180 - DNA, 2879 bp, Homo sapiens
gagtgactgagctggaaattaagaagaactcagaaagtgtcctttcctaccatctggtctaaccctgttacccactctcaagggtggtgatatccccttgatcattttttattgcatctatttgattcttctctcttttcttctttattagtcttgctagcagtctatcaattttgttgatcttttcaaaaaaccagctcctggattcactgattttttgaatggttttttgtgtctctatctccttcagttctgctctgatcttagttatttcttgccttctgctagcttttgaatgtgtttgctcttgcttctctagttcttttaattgtgatgttagggtgtcaattttagatctttcctgctttctcttgtgggcatttagtgctataaatttccctctacacactgctttgaatgtgtcccagagattctggtatgttgtgtctttgttctcgttggtttcaaagaacatctttatttctgccttcatttcgttatgtacccagtagtcattcaggagcgggttgttcagttgccatgtagttgagcggttttgagtgagtttcttaatcctgagttctagtttgatcgcactgtggtctgagagacagtttgttgtaatttctattcttttacatttgctgaggagtgctttacttccacctatgaggtcaattatggaataagtgcgatgtggtgctgagaagaatgtatattctgttgatttggggtggagagttctgtagatgtctattaggtctgcttggtgcagagctgagttcaattcctggatatccttgttaactttctgtctcgttgatctgtctgatgttgacagtggggtgttaaagtctcccgtcattattgtgtgggagtctaagtctctttgcaggtcactcaggacttgctttatgaatctgggtgctcctgtattgggtgcatatatttttaggatagttagctcttcttgttgaattgatccctttaccattatgtaatggccttctttgtctcttttgatctttgttggtttaaagtctgttttatcagagactaggattgcaacccctgccttttttttgttttccatttccttggtagatcttcctccatccctttattttgagcctatgtgtgtccctgcacgtgagacaggtttcctgaatacagcacactgatgggtcttgactctatccaatttgccatctgtgtcttttaattggagcatttagcccatttacatttaaggttaatattgttatgtgtgaatttgatcctgtcattatgatgttagctggttattttgctcggtagttgatgcagtttcttcctagcatcaatggtctttacaatttggcatgtttttgcagaggctggtactggctgttcctttccatgtttagtgcttccttcaggagcacttttagggcaggcctggtggtgacaaaatctctcagcatttgcttgtctgtaaaggattttatttctccttcactgatgaagcttagtttggctggatatgaagttctggattgaaaattcttttctttaagaatgttgaatattggcccccactctcttctggcttgtagagtttctgccaagagatccgctattagtctgatgggcttccctttgtgggtaacctgacctttctctctggctgcccttaacattttttccttcatttcgactttggtgaatctgacaattatgtgtcttggagttgctcttctcgaggactatctttgtggcattctctgtatttcctgaatttgaatgttggcctgccttgctaggctggggaagttctcctggataatatcctgcagagtgttttccaacttggttccattctccccgtcactttcaggtacaccaatcagacgtagatttggtcttttcacatagtcccttatttcttggaggctttgttcgtttcttttcattcttttttctctaaacttctcttcttgcttcatttcattcatttgatcttccatcacaggtaccctttcttccagctgatcgaattggctactgaagcttgtgccttcgtcatgtagttctcgtgccatggttttcagctccatcaggtcatttaaggacttctctacattggttagtctagttagccatttgtctaaccttttttcaaggttttcaacttctttgggatgggttcgaacttcctcctttagctcggagaagtttggtcatctgaagccttcttctctcaactcatcaaagtcattctccatccagctttttccattgctggtgaggaggtgcgttcctttggaggaggagaggtgctctgatttttagaattttcagtttttctgctctattttttccccatatctgtggttttatctacctttggtctttgatgatggtgacgtacagatggggttttggtgtggatgtcctttctgtttgttagtgttccttctaacagtcaggaccctcagctgcaggtctgctggagtttgctggaggtccactccagaccctgtttgcctgggtttcagcagcggaggctgcaaaacagcaaatattgctgaacagcaaatgttgctgcctgatcgttcctctggaagttttgtctcagaggggtacctggctgtgtgaggtgtcagtctgcccctactggggggtacctcccagttaggctactcgggggtcagggaaccacttgaggagggagtctgtccattctcagatctcaaactccgtgctgggggaaacactattctcttcaaagctgtcagacagggacatttaagtctgcagaggtttctgctgccttttgtttggctatgccctgcccccagagggcaaggaggcaggcaggcctccttgagctgcagtgg

SEQ ID NO: 12181 - DNA, 4569 bp, Homo sapiens
acaggctctggtgtgtgatgttccccgccctgtgaccaagtgttctcattgttcaattcccacctatgagtgagaacatgcagtgtttggtgttatgtccttgtgatagtttgctgagaatgatggtttccagcttcatccatgtccctgcaaaggacatggactcatccttttttatggctgcataatattccatggtgtatatgtgccacattttcttaatccagtctatcattgatggacattttggttggttccaagtctttgctcttgtgaatagtgccacaataaacatacgtgtgcatgtgtctttatagtagcatggtttataatcctttgggtatatacccagtaatggaattgctgggtcaaatggtctttcaggttctgtatccttgaggaatcaccacactgtcttccacaatggttgaactaatttacactcccaccaacagtgtaaaagtgttcctatttctccacatcctctcctgcaactgttgtttcctgactttttaatgatcacccttctaactggtgtgagatggtatctcattgtggttttgatttgcatttctctgatgaccagtgatgatcatgttgatgtgtctgttagctgcataaatgtcttttgagaagtgtctgttcatatctgttgcccactttttgatggggtcgtttttttcttgtaaatttgtttgagttctttgtagattctggatattagccctttgtcagatgggtagattgcagaaatgttcttccattctgtatgttgcctgttcactctgatggtagtttcttttgctgtgcagaagctctttagtttaattagatcccatttgtcaagtttgtcttttgttgccattgcttttggtgttttagtcatgaagtccttgcccacgcctgtcttctgaatggtattgcctaggttttcttctagggattttatggttttaggtctaacatttaagtctttaatccatcttgaattaatttttgtgtaaggtgtaaggaatggatccagtttcagctttctacatatgcctagccagttttcccagcaccatttattaaatagggaatcctttccccattgcttgtttttctccggtttgtcaaagatcacatgattgtacatgtgtggtgttatttctgaggtctctgttctgttccattggtctatatatctgttttggtaccagtaccatgctgttttggttactgtagccttgtagtatagtttgaagtcaggtagtgtgacacctccagcattgttctttttgcttaggattgtcttggcaatgcgggctcttttttggttccatatgaactttacagttttttctaattctgtgaagaaggtcattggtagcttgaaggggatggcattgaatctatgaattaccttgggcagtatggccattttcacgacattgattcttcctgtccacgagcatggaatgttcttccatttgtttgtgtcctccgttacttcgttgagcagtggtttatagttctccttgaagaggtccttcacatcccttgtaagttggattcctaggtattttattctctttgcagcaattgtgaatgggacttcactcatgttttggctctctttgttttggtgtataggaacgcttgtaatttttgcacattgattttgtaccctgagattttgctgaagttgcttatcagcctaaggagattttgggctgagacaatacggttttctaaatatacaatcatgtcatgtgcaaacagggacaatttgacttcctcttttcctaattgaataccctttatttctttctcttgcctgattgccctggccagaacttccaacactgtgttgaataggagtggtgagagagggcatccttgtcttctgccggttttcaaagagaagacttccagtttttacccattcagtatgatattggctgtgggtttatcataaatagctcttattattttgagatatgttccatcaatacctactttattgagagtttttagcatgaagggctgaattttgtcaaaggccttttctgcatctattgagataatcatgtgatttttgtcattggtttttcttatgtgatggattatgtttattgatttgtgtatgttgaaccagccttgcatcccagggatgaagccaacttggttgtgttggataagctttttgatgtgctgctggattcagtttgccagtattttactgaggattttcacatcgatgttcatcaaggatactggtctaaaattctctgtttttgttgtgtctctgccagactttggcatcaggatgaagctggcctcataaaatgagttagggaggattccctctttttctattgattggaatagtttcagaaggaatgataccagctcttcttgtacctctggtagaattcagctgtgaatccatctgatcctggacttttttttgttggtaggctattaattattgcctcaatttcagagcctgttattggtctattcagagattcaacttcttcctggttcagtcttgggaagggtgtatgtgtccaggaatttatccatttcttctagattttctagtttatttgtgtagaggtgtttatagtattctctgattgtagtttgtatttctgtgggaccagtggtgatattccctttatcatttttttattgcgtctatttgattcttctctcttttcttctttattagtcttgctagcagtctatcaattttgttgatcttttcaaaaaaccagctcctggattcattgtttttttgaggggttttttgtgtctctatcatctccttcagttctgttctgatcttagttatttcctgccttctgctagcttttgaatgtgtttgctctttcttctctagttcttttcattgtgatgttagggtgtcaattttagatctttcctgctttctcatgtgggcatttaatgctataaatttccctctacacactgctttaaatgtgtcccagagattctggtacgttgtgtgtttgttctcattggtttcaaaaaacatctttattttctgccttcatttcgttatttatccagtagtcattcaggagcaggttgttcagtttccatgtagttgtgtggttttgagtgagtttttgtcctgagttctaatttgattgcactgtggtctgagagacagtttgttgtgatttctgttcttttacatttgctgaggagtgcttaacttccaattatatggtcaattttggcataagtgctatgtggcgctgagaagaatgtatattctgttgatttggggtggagagttctgtagatgtctattaggtctgattggtgcagagctgagttcaagtcctggatatccttgttaaccttctgtctcattgatatgtctaatattgacagtggggtgttaaagtctcccatgattattgtgtgggagtctaagtctttgtaggtctctaaggacttgctttatgaatctgggtgctcctgtattaggtgcatatatatttaggatagttagctcttcttgttgaattgatccctttaccattatgtaatggcctcctttgtctcttttcatctttgttggtttaaagtctgttttatcagagactaggattgcgatccctgctttttttgctttccatttgcttggtagatcttcctccatccttttattttgagtctatgtgtttctctgcacgtgagatgggtctcccaacagcacactgatgggtcttgactctttatccaatttgccagtctgtgtcttttaattggggcatttagcccatttacatttaaggttaatattgttatgtgtgaatttgatcctgtcattatgatgttagctggttattttgcctgttaattgatatagtttcttcctagcatcgatggtctttacaatttggcatgtttttgcagtggctggtactggttgttcctttccatgtttagtgcttccttcaagagctcttgtaaggcaggcctggtggtgacaaaatctctcagcatttgcttgtctgtaaaggattttatttctccttcacttatgaagcttagtttggctggatatgaaattctgggttgtaaattcttttctttaagaacgttgaatattggcccccactctcttctggcttgtagggtttctgtagagagatccactgttagtctgatgggcttccctttgtgggtaacccgacctttctctctggctgcccttaacatttttcccttcatttcaaccttggtgaatctgacaattatgtgtcttggggttgctcttctcgaggagtatctttgtggtggtctctgtatttcctgaatttgaatgttggcctgccttgctagattggggaagttctcctggataatatcctgaagagtgttttccaacttggtttcattctccccgtcactttcaggtacaccaattagacatagatttggtcttttcacatagtcccatatttcttggaggctttgtttctttttactctttttttctccttgctttatttcattaatttgatcttcaatcactgatacact

SEQ ID NO: 12182 - DNA, 5707 bp, Homo sapiens
ttttttgtttgtttgtttgtttttgttttttgttttttgttttttttattatactttaagttttagggtacatgtgcacattgtgcaggttagttacatatgtatgtatacatgtgccatgctggtgcgctgcacccactaacttgtcatctagcattaggtatatctcccaatgctatccctcccccctccccccaccccaccacagtccccagagtgtgatattccccttcctgtgtccatgtgatctcattgttcaattcccacctatgagtgagaatatgccatgtttggttttttgttcttgtgatagtttactgagaatgatgatttccaatttcatccatgtccctacaaagaacacgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttccagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtcctttgcccactttttgatggggttgtttgtttttttcttgtaaatttgtttgagttcattgtagattccggatattagccctttgtcagatgagtaggttgcgaaaattttctcccattttgtaggttgcctgttcactctgatggtagtttcttttgctgtgcagaagctctttagtttaattagatcccatttgtcaattttgtcttttgttgccattgcttttggtgttttggacatgaagtccttgcccatgcctatgtcctgaatggtagtgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtaggtaggcggcgttatttctgagggctctgttctgttgcattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaggaaagtcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcgtctattgagataatcatgtggtttttgtctttggctctgtttatatgctggattacatttattgatttgcgtatattgaaccagccttgcatcccagggatgaagcccacttgatcatggtggataagctttttgatgtgctgctggattcgttttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactatcgattattgccacaatttcagctccttttattggtctattcagagattcaacttcttcctggtttagtcttgggagagtgtatgtgtcgaggaatgtatccatttcttctagattttctagtttatttgcgcagaggtgtttgtggtattctctgatggtagtttgtatttctgtgggatcggtggtgatatcccctttatcattttttattgtgtctatttgattcttctctctttttttctttattagtcttgctagtggtctatcaattttgttgatcctttcaaaaaaccagctcctggattcattgagtttttgaagggttttttgtgtctctatttccttcagttctgctctgattttagttatttcttgccttctgctagcttttgaatgtgtttgctcttgcttttctagttcgtttaattgtgatgttagggtgtgaattttggatctttcctgctttctcttgtgggcatttagtgctataaatttccctctacacactgttttgaatgtgtcccagagattctggtatgttgtgtctttgttctcgttggttttaaagaacatctttatttctgccttcatttcgttacgtacccagtagtcattcaggagcaggttgttcagtttccatgtagttgagcagctttgagtgagattcttaatcctgagttctagtttgattgcactgtgatctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcattgatctgtctaatgttgacagtggggtgttaaagtctcccattattaatgtgtgggagtctaagtctctttgtaggtcactcaggacttgctttataaatcttggtgctcctgtattgggtgcatatatatttaggatagttagctcttcttgttgaattgatccctttaccattatgtaatggccttctttgtctcttttgatctttgttggtttaaagtctgttttatcagatactaggattgcaacccctgcctttttttgttttccatttgcttggtagatcttcctccatccttttattttgaacctatgtgtgtctctgcacgtgagatgggtttcctgaatacagcacactgatgggtcttgactctttatccaatttgccagtctgtgtcttttaattggagaatttagtccatttacatttaaagttaatattgttatgtgtgaatttgatcctgtcattatgatgttagctggtgattttgctcgttagttgatgcagtttcttcctagcctcgatggtctttacattttggcatgattttgcagcagctggtaccggttgttcctttccatgtttagcgcttccttcaggagctcttatagggcagtcctggtggtgacaaaatctgtcagcatttgcttgtctgtaaagtattttatttctccttcacttatgaagcttagtttggctggacatgaaattctgggttgaaaattcttttctttaagaatgttgaatattggccccactctcttctggcttgtagggtttctgccgagagatccgctgttagtctgatgggcttccctttgagggtaacccgacctttctctctggctgcccttaacattttttccttcatttcaactttggtgaatctgacaattatgtgtcttggagttgctcttcttgaggagtatctttgtggcgttctctgtatttcctgaatctgaacgttggcctgccttgctagattgcggaagttctcctggataatatcctgcagagtgttttccaacttggttccattctccccatcactttcaggtacaccaatgagatgtagatttggtcttttcacatagtcccatatttcttggaggctttgctcatttctttttattcttttttctctaaccttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgccttggtttgaatgtcctcccgtagctcagagtaatttgatcgtctgaagccttcttctctcagctcatcaaagtcattctccatccactttgtccgttgctggtgaggaactgcgttcctttggtaggaggagaggcgctctgcgttttagagtttccagtttttctgttctgttttttccccatctttgtggttttatctacttttggtctttgatgatggtgatgtacagatgggttttcggtgtggatgtcctttctgtttgttagttttccttctaacagacaggaccctcagctgcaggtctgttggaataccctgccgtgtgaggtgtcagtgtgcccctgctggggggtgcctccagttaggctgctcgggggtcaggggtcaagggacccacttgaggaggcagtctgcccgttctcagatctccagctgtgtgctgggagaaccactgctctcttcaaagctgtcagacagggacacttaagtctgcagaggtttctgctgtctctttgtttgtctgtgccctgcccccagaggtggagcctacagaggcaggcaggcctccttgagctgtggtgggctccacccagttggagcttcccggctgctttgtttacctaagcaagcctgggcaatggcgggcgcccctcccccagcctcgctgccgccttgcagtttgatctcagactgctgtgctagaaatcagcgagactccgtgggcgtag

SEQ ID NO: 12183 - DNA, 2879 bp, Homo sapiens; identical to SEQ ID NO: 12180

SEQ ID NO: 12184 - DNA, 4615 bp, Homo sapiens
tttatatatatatattttattatactttcagttctaggttacgtgtgcacaagttgcaggtttgttacatgtgtatacatgtgccatgttggtgtgctgcacccattaacttgtcatttacattaggtatatctcctaatgctatccctccccactccccccaccccacaacaggccccagtgtgtgatgttcccctttctgtgtccaagtgttctcattgttcaatttccacctgtgagtgagaacatgtggtgtttggttttttgtccttatgatagtttgctgagaatgatggtttccagcttcatccatgtccctacaaaggacatgaactcatccttttttatgactgcatagtattccatggtgtatatgtgccacattttcttaatccagtctatcattgttggacatttgggttggttccaagtctttgctattgtgaatggtgctgcaataaacatacgtgtgcatgtgtctttatagcagcataatttatattcctttgggtatatacccagtaatgggatgactgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatcgccattctaactggtgtgagatgatatctcattgtggttttgatttgcatttctctgatggccagtgatgatgagcatcttttcatgtgtctgttggctgcataaatatcttcttttgagaagtgtctgttcatatcctttgcccacttgttgatggggttgtttgttttttcttgtaaatgtgtttgagttctttgtagattctggatatgagccctttgtcagatgaatagattgcaaaaattttctcccattctgtagatcactctgatggtagtttcttttgctgtgcagaagctctttagtttacttagatcctatttgtcaattttgactttttgttgccattgcttttggtgctttagccatgaagtccttgccccatgcctttgtcctgaatggtattgcctaggttttcttctagggtttttatggttttaggtctaacatttaagtctttaatccaccttgaattaatttttgtataaggtgtaaggaagggatccagtttcagctttctacatatggctagccagttttcccagcaccatttgttaaatagggaatcctttccccatttcttgtttttgtcaggtttgtcaaagatcagatagttgtagatgtgtggtattatttctgagggctctgttctgttccattggtctatatctctgttttggtaccagtaccatgctgttttggttactgtagccttgtagtatagtttgaagtcaggtagcgtgatgcctccagctttgttcttttggcttaggattgacttgggaatgtgggctcttttttggatccatatgaactttaaagaatttttttccaattctgtgaagaaagtcattggtagcttgatggggtggcattgaatctataaattacctcgggcagtatgaccattttcacaatattgattcttcctatccatgagcatggaatgttcttgcatttgtttgtttcctcttttatttcattgagcagtggtttgtagttctccttgaagagttcctccacatcccttgtgagttggattcctaggtattttattctctttgaagcaattgtgaatgggagttcactcatgatttggctctctgtttgtctgttattggtgtataagaatgcttgtgatttttgcacattgattttgtatcctgagactttgctgaagttgcttatcagcttaaggagattttgggctgagacgatggggttttctaaatatacaatcatgtcatctgcaaacagggacaatttgacttcctcttttcccaattgaataccctttatttctttctcctgcctgattgccctggccagaacttccaacactgtgttgaataggagtggtgagagagggcatccctgtcttgtgccagttttgaaagggaatgcttccaatttttgcccattcagtatgatattgtctgtgggtttgtcataaatagctcttattattttgacatatgtcctatcaatacctaatttattgagagtttttagcatgaagggttgttgaattttgtcaaaggccttttctgcatctattgagataatcatgtggcttttgtctttggttctgtttatatgctggattatgttattgatttgtgtatgttgaaccacccttgcatcccagggatgaagcccacttgatcatggtggataagctttttgatgtgctgctggattcggtttgccagtattttattgaggatttttgcatcgatgttcatcagggatattggtctaaaattctctttttttgttgtgtctctgccaggctttggtatcaggatgatgctggcctcataaaatgagttagggaggattccctcttttcctattgattggaatagtttcagaaggtatggtaccagctcctccttgtacctctggtagaattcggctgtgaatccgtctggtcctggactttttttggttggtaagctattaattattgcctcaatttcagagcctgttattggtctattcagagattcaacttcttcctagtttagtcttgggagggtgtatgtgtccaggaatttatccatttcttctagattttctagtttatttgcgcagaggtgtttatagtattctctgatggtagttcgtatttctgtgggatcggtggtgatatcccctttatcattttttattgcatctatttgattcttctctcttttcttctttattagtcttgctagtggtctatcaattttgttgatgttttcaaaaaaccagctcctggattcattgattttttgaagggttttttgtgtctctatctccttcagttctgctctgatcttagttatttcttgccttctgctagcttttgaatgtgtttgctcttgcttctctagttcttttaattgggatgttagggtgtcaattttagatctttcctgctttctcctgtgggcatttattgctatacatttccctctacacactgctttaaatgtgccccagagattctggtatgttgtgtctttattttcattggtttcaaagaacatctttatttctgccttcatttcgttatgtacccagtagtcattcaggagtaggttgttcagtttccatgtagttcagtggttttgagtgagtttcttattcctgagttctagtttgattgcactgtggtctgagaggcagtttgttataatttctgttcttttacatttgctgaggagtgctttacttccaactatgtggtcagttttggaataggtgccgtgtggtgctgagaagaatgtatattctgttgatttggggtggagagttctgtagatgtctattaggtccgcttggtgcagagctgagttcaattcctggatatccttgttaactttctgtcttgttgatctgtctaatgttgacagtggggtgttaaagtctcccattgttattgtgtgggaatctaagtctctttgtaggtctctaaggacttgctttatgaatctgggtgctcctgtattgggtgcatatatatttaggatagttagctcttcttgttgaattgatccctttactattatctaatggccttctttgtctcttttgatctttgttggtttaaagtctgttttatcagagactaggattgcaacccctgcctttttttgttttccatttgcttggtagatcttcctccatccctttattctgagcctatgtgtgtctctgcacgtgagatgggtttcctgaatacagcacactgatgggtcttgactctttatccaatttgccagtctgtgtcttctatttggagcatttagcccatttacatttaaggttaatattgttatgcgtgaatttgatcctgtcattatgatgttagctggttattttgctcattagttgatgcagtttcttcctagcatcaatggtctttacaatttggcatgtttttgcagtggctggtaccggttgttcctttccatgtttagtgcttccttcaggagctcttgtagggcagtcctggtggtgacaaaatctctcagcatttgcttgtctgtaaagtattttatttcttcttcacttatgaagcttagtttggctggatacgaaattctggattgaaaattcttttctctaagaacgttgaatattggcccccactctcttccggcttgtagagtttctgctgagagatcagctgttagtctgatgggcttccctttgtgggtaacccgacctttctgtctggctgcccttaacattttttccttcgtttcaaccttggtgaatctcacaattatgtgtcttggagttgctcttctcaaggagtatctttgtggagttctctgtatttcctgaatttgaatgttggcctgccttgctaggttggggaagttctcctggataatattctgcagagtgttttccaacttggttccattc

SEQ ID NO: 12185 - DNA, 3899 bp, Homo sapiens
atccggagactttgctgaagttgcttatcagcttaaggagatttggggctgagacaatggggttttctagatatacaatcatgtcatctgcaaacaggaacaatttgacttgctcttttcctaattgaataccctttatttccttctcctgcctaattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgagatacgtcccatcaatacctaattgattgagagtttttagcatgaaggttgttgtattttgtcaaaggccttttctgcatctattgagataatcatgtggtttttgtctttggttctgtttatatgctggattacatttattgatttgcgtatattgaaccagccttgcatcccagggatgaagcccacttgatcatggtggataagctttttgatgtgctgctggattcggtttgccagtattttattgaggatttttgcatcgatgttcatcaaggatattggtctaaaattctctttttttgttgtgtctctgcccagctttggtatcagaatgatgctggcctcataaaatgagttagggaggattccctctttttctattgactggaatagtttcagaaggaatggtaccagttcctccttgtacctctggtagaattcggctgtgaatccatctggtcctggactctttttggttggtaagctattgattattgccacaatttcagctcctgttattggtctattaagagattcaacttcttcctggtttagtcttgggagagtgtatgtgtcgaggaatttatccatttcttctagattttctagtttatttgcgtagaggtgtttgtagtattctctgatggtagtttgtatttctgtgggatcggtggtgatatcccctttgtcattttttattgtgtctatttgattcttctctctttttttctttattagtcttgctagcggtctatcaattttgttgatcctttcaaaaaaccagctcctggattcactgattttttgaagggttttttgtgtctctatttccttcagttctgctctgattttagttatttcttgccttctgctagcttttgaatgtgtttgctcttgcttttctagttcttctaattgtgatgttagggtgtcaattttggatcgttcctgctttctcttgtgggcatttagtgctataaatttccctctacacactgctttgaatgcatcccagagattctggtatgttgtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttcgaagtatgtggtcaattttggaataggtgtggtgtggtgctgaaaaaaatgtatattctgttgatttagggtggagagttctgtagatgtctattaggtccacttggtgcagagctgagttcaattcctgggtatccttgttgactttctgtctcgttgatctgtctaatgttgacagtggggtgttaaagtctcccataattattgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatgttcctccatccttttattttgagcctatgtgtgtctctgcacgtgagatgggtttcctgaatacagcacactgatgggtcttgactctttatccaacttgccagtctgtgtcttttaattggagcatttagcccatttacatttaaagttaatattgttatgtgtgaatttgatcctgtcattatgatgttagctggtgattttgctcgttagttgatgcagtttcttcctagtctcgatggtctttacattttggcatgattttgcagcggctggtactggttgttcctttccatgtttagcgcttccttcaggagctcttttagggcaggtctggtggtgacaaaatctctcagcatttgcttgtctgaaaagtattttatttctccttcacttatgaagcttagcttggctggatatgaaattctgggttgaaaattcttttctttaagaatgttgaatattggcccccactctcttctggcttgtagggtttctgccgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcattctctgtatttcctgaatctgaacgttggcctgccttgctagattggggaagttctcctggataatatcctgcagagtgttttccaacttggttccattctccccatcactttcaggtacaccaatcagacgtagatttggtcttttcacatagtcccatatttcttggaggctttgctcatttctttttattcttttttctctaaacttcccttctcgcttcacttcattcatttcgtcttccattgctgacaccctttcttccagttgatcgcatcggctcctgaggcttctgcattcttcacgtagttctcgagccttggttttcagctccatcagctcctttaagcacttctctgtattggttattctagttatacgttcttctaaatttttttcaaagttttcaacttctttgcctttggtttgaatgtcctcccgtagctcagagtaatttgatcgtctgaagccttcttctctcagctcgtcaaagtcattctccatccagctttgttctgttgctggtgaggagctgcgttcctttggaggaggagaggcgctctgatttttagagcttccagtttttctgttctgttttttccccatctttgtggttttatctacttttggtctttgatgatggtgatgtacagatgggtttttggtgtggatgtcctttctgtttgttagttttccttctaacagacaggaccctcagctgcaggtctgttggaataccctgccgtgtgaggtgtcagtgtgcccctgctggggggtgcctcccagttaggctgctctggggtcaggggtcagggacccacttgaagaggcagtctgccggttctcagatctccagctgcatgctgggagaaccactgctcccttcaaagctgtcagacagggacatttaagtctgcagaggttactgctgtctttttgtttgtctgtgccctgcccccagaggtggagcctacagaggcaggcaggcctccttgagctgtgttgggctccacccagttcgagcttcctggctgctttgtttacctaagcaagcctgggcaatggcgggcgcccctcccccagcctcgctgccgccttgcagtttgatcacagactgctgtgctagcaatcagcgagattccgtgggcgtaggaccctcagagccaggtgtgggatatagtctcgtggggcgccgttttttaagccggtctgaaagcgcaatattccggtgggag

SEQ ID NO: 12186 - DNA, 81306 bp, Homo sapiens
tagattcggtttgccagtattttattgaagatttttggatcaatgtccatcagggatattggcctgaaattttcttttttgttgtgtctctgccaggctttggtatcagcatgatgctggcctcataaaatgagttagggagaattccctctttttctgttgtttggaatagtttcagaaggaatggtaccagctcctctttgtacctctggtagaattcagctgtgaatccatctggtcctggactttttttggttggtaagctattgattattgccacaatttcagatcctgttattggtctattaagagattcaacttcttcctggtttaatcttgggagagtgtatgtgttgaggaattcatccatttcatctagattttctagattatttacatagacatgtttatagtattctctgatggtagtttgtatttctgtgggattggtggtgatatcctctttctcattttttatttcatctatttgattcttctctcttttcttctttattagtcttgttagccgtcgatcaattttgttgatcttttcaaaaaaacagctcctggattcattaattttttgaagggctttttgtgtctctatttcgttcagttctgctctgatcgtagttatttcttgccttctgttagcttttgaatgtgtttgctcttgcttttctagttcttttagttgttatgttagggtgtcaattttagatctttcctgctttctcttgtgggcatttagtgctataaatttccctctacacactgctttgaatgtgtcccagagattcttgtatgttgtgtctttgttctcattggtttcaaagaacatcttgatttctgccttcatttcattatttacccagtagtcattcaggagcaggttgtttagtttacatgtagttgagtggttttgagtgagtttcttaatcctgagttctagtttgattgcactgtggtctgagagactgtttattataatttctgttcttttacatttgctgaggagagctttacttccaagtatgtggtcaattttgtaataggtgtggtgtggtgctgaaaagaatgtatattctgttgatttggggtggagagttctgtagatgtctattacgtccgcttggtgcagagctgagttcaattcctggatatccttgttaactttctgtctcgttgatctgtctaatgttgacagtggtgtgttaacgtctcccattattattgtgtgggagtctaagtctctttgtaggtctctaaggacttgctttgtgaatctgggtgctcttgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggcagatcttcctccatccttttattttgagcctatgtgtgtctctgcatgtgagatgggtttcctgaatacagaacactgatgggtcttgactctttatccaatttgccagtctgtgtcttttaattggagtatttagtccatttacatttaaagttaatattgttatgtgtgaatttgatcctgtcattatgatattagctggttactttgctcattatttgatgcagtttcttcctagtcttgatgggctttacattttggcatgattttggagtggctggtaccagttgttcctttccatgtttagtgcttccttcaggagctcttttagggcaggcctggtgatgacaaaatctctgagcatttgcttgtctgtaaaggattttttttctccttcacttatgaagcttagtttggctggatatgaaattctgggttgaaaattcttttctttaagaatgttgaatattggcccccactctcttctggcttgtagagtttctgctgagagagctgctgttagtctgatgggcttctctttgtgggtaacccgacctttctctctggctgcccttaacatcttttccttcatttcaactttggtgaatctgataattatgtgtcttggaggtgctcttctcgaggagtatctttgtggcattcgctgtatttcctgaatctgaatgttggcctgccttgctaggttggggaagttctcctggataatatcctgcagagtgttttccaacttggttccattctccctgtcactttcaggtacactaatcagacgtagatttggtcttttcacatagtcccatatttcttggaggctttgttcatttccttttatacttttttctctaaacttcccttctcacttcgtttcattcatttgaccttccatcactgataccctttcttccagttgatcacatcggctcctgaggcttctgcattcttcacgtagttctcgagccttggctttcagctccatcagctcctttaagcacttctctgtattggttattctagttacacattcgtctaaatttttttcaaagttttcaacttctttgcctttggtttgaatttcctcttgtagcttggagtagtttgatcgtctgaagccttcttctctcaactcatcaaagtcattctccgtccagctttgttccattgctggtgaggaactgtgttcctttggaggagaagaggtgctctgctttttagagtttccagtttttctgctctgttttccccccatctttgtggttttaactacttttggtctttgatgatggtgatgtacagatgggtttttggtgtggatgtcctttctgtttgttagttttccttctaacagacaggactctctgctgcaggtctgttggaatttgctagaggtccactccagaccctgtttgcctgggtatcagcagtggtggctgcagaacagcagattttcgtgaaccgcgaatgctgctgtctgatcgttcctctggaagttttgtctcagaggagttcccggccttgtgaggtgtcagttctcccctactggggggtgcctcccagttaggctgctcaggggtcaggggtcagggacccacttgaggaggcagtctgcccattctcagatctccagctgcgtgctgggagaaccacttctctcttcaaagctgtcagacagggacatttaagtctgcagaggttactgctgtctctttgtttgtctgtgtcctgcccccagaggtggggccttcagaggcaggtaggccttcttgagctctggtgggctccacccagttcgagcttcctggctgctttgtttacctaagcaagcctgggcaatggcaagtgcccctcccccagccttgttgccatcttgcagtttgatctcagagtgctgtgctagcaatcagtgagactctgtgggtgtaggaccctccaagccaggtgcgggatataatctcctggtgcaccgttttttaagcccattggaaaagtgcagtattcaggtgggagtgacccaattttccaggtgccatctgtcacccctttctttgactaggaaagggaactccctgaccccttgcacttcctcagtgaggcaatgccttgccctgcttcagcttacacacagtgtgctgcacccactgtcctgtgcccactgtctgtcactccttagtgagatgaacccggtacctcagatggaaatgcagaaatcacccgtcttctgtgtcactcacgctgggagctgtagactggagctgttcctatttggtcatcttggctcctcctcctaattcttgaagatttcattggctaaagtaaaacaaaaattctgctcaaaatgaagccaaaatattttgagtatttgcaaaacaatgttgatactatgagtggagttcttaatgttgttgtgttcaaatacaatgtgtgaaacataatgaagctcagtaactttcgtgtgtaacttttggattagaataataaatatcaatataagcccataaggttttatattatttttatttttcttttcttttttttttatggcttggatgacactttattttcagatccaatactagaagttgtttccatgttcacattttccttcctggtttaaaaaaaagagttgtatttttttttttttgctttttttaaattatactttaagttttagggtacatgtgcacaacgtgcaggttagctacatatgtatacatgtgccatgttggcgtgctgcatccagtaactcgtcatttaacattaggtatatctccaaatgctatccttccccccattgtatttttcatagcttaaaaatcattgacatagaataattccagctaaagtacgtattaaatccctggaaaataaattttgtcttaacaaggtaagttgtgaaaagatgttttgtcacaggaaaaaggaaatcctccatttaaaaccctccatgctgaaataaaggaggagtcccatctttcagtcattccacttcaggcttttgatataactaatctcttttcttcttctttccttttttggcaagctttcggaaacaaaacaggcaaaattttgtgatgataaatatcacagttgccacgcaggccagcaggaatgctatcacatccaaagagtggtactggatccaggtgaggttgtgagctgcgactcgaaggtgcttggctcctttgtggcgcatgacaaactcaatccagaagactgctcgatccaggggcttcattggttggtcatgatgaattcttgataatttcatgacattctctttatagctgaaggataaatataaagatatcaacattaaaagtaaatttattgcttaagcatatcaagtctatggatggtctttgaaaagtgtcacacaaatgattgaaagtaagtgtcactgaattggcatgaaatttcaatgttttaattcatgtcattacagaaagtttggtttttaaattggagttttatcactgacaaatacctttaaaaatgaaaaatggaattttcggtgggaaagttaatgttttctggagcagaaaatattatgagccattctaagtgctataagtaagatagtggaaatggaatttgagaatgatctttttgatctttttaatttttttttattttttgagacaggcttttgctccattacacaggctgagtgcagtcacatgatcatggctcagttcagcctttctctttcggtctcaagtaatcctacatctcagtctcatgagaagctaggactacaactgcacaccaccatgcctggctatatttttttattttttacacttttagatatgaggtgttgctgtagtgcccatactggtctggaactcctgtagtcaagtcattctcctgcctctgcctcccaaagtgttggccctacagacatgaaccactgtgcccagcccattttgacgtatttaaagaagaattgtgacacaactggtgaaatgcctcctaactagtttctcagcttctactctaatcttttgtcttctaccatattttccttctagtagccagaatattttccaaattaatatcaaattatgacactcacctgttaagatttccatctggtttcttgttacattaagaataaattccaaatctgtctttggtctagagaactctacacaggcacctacttgtcctagccctttccccctgtacactttcttctagagacaatggccttcggtttttctctaaactcctgaaggtgttctcaccttagcccctttacaccttttgttccccgtgtctctctcattgagcattctttcttgcaactacttgaggtttgcttctatttctttttgaggcttccccttgtatgatacctcttggagagtcttttcctggccacactataggcacccataggatttctctagtgcttcatgcttactttgctatttgatttctggaactttaaaatatgttgtatatcttctacagtaaaacttcaagtatgaaatacataggataaatgtatatatactatgtgactacctcaaaattttaagattatcttaaacattatcccaaagtgaagacaccaatttatcacaaactgcatagaagaactctctcctcctgggccattttagtcactatttttatcctcaaagtaagtattaacctgatttctgatatcatagattagtattgtttatataattgaattaaataatacatattcatttctgtttttggttagcagttgtttaatagcattggtgtagagagtattcagttgattgacaaagaccacagatgatctcttcattttgtgattaatggatatttgtgttgttaacattttttgaccttactaataattatggtattaagatatttgtatattttattaggtttaaatatttattcatttttgttggatgtatacttggaagaatagttgatgagagaaaggcacatttataattagaattttttgttgactgaattttttaaaaaatattttttattttaaagaatcagattgttttcagttatcgtttttggatgatttataatttatttctagtatgactagaacatataatttttatgaatttgaatcttatacaatttacttagtgtttatttatggcccagcatatggtaaattcaggtaactatttcatataatctttttttttttttgagacagagtctctctgtcacccaggcttgagtgcaatggagtgatcttggctgactgcaatttgcatctcctgggttcaagtgattctcatgcctcaatctcccaagtatctgggactacaggtgctcatcccctacatctggctaagttttgtattattagtggacacaggatttcaccatgttggccaggctggtctcttaactcctgacctcatgtgatcctcccactttggcttcccaaagtgtcgggattacaggtgtgagccaccacacccggtctccataaactcttttaaaaatgtttattttctgtctacacacacacaaccagagatatatgtatggatacatatatacagataaatgtgcaatatatatacacacacacatatataacacatagattacatttaattgtgtacttcaaatgttttatctccttaaataaaatatttcaaagatcactattttgtcttttctttttggtctgcttaaatttaatgtgagtactggtaggttcacttttttgtttttttgcttttttgtttttttttgagatggagtctcgctctgtcaccaggagttcagtggcactatctcggctcactgcaacctccgtctcccgggttcaagtgattctcctgcctcaacctcctgagtagctgggactataggtgcacaccaccatgcccagataatttttgtatttttagtagagacagggtttcactatgttggccaggagtatggtctcgatatcttgacctcgtgatctgccctcctcagcctcccaaagtgctgggattacgggcgtgagtcactgcacctggtcagttcaaatttttttaaaaagttttatttttactttaagttccagtatacatgtgcagaatgtgcaggtttgttacatacgtatatacgtgccatggtggtttgcagcaccgatcaacctgtcatctagattttaagcccctcatgtattagctatttgtcctgatactctcactccccttccatcccccggtgtgtgttgttcccctccctgagtccatgtattctcattgttcaactccctcttataagtgagaacatgtggtgtttggttttctgttcctgtgttagttgctgcggataatggctttgcatttcatccgtgtccctgcaacagacatgatctcattcctttttatggtgcatagtattccatagtgtacatgtatcatattttctttatccagtctatcactgatgagcatttgggttggttccatatctttgatattgtagatagcgctgcaatagacatacatgtgcatgtgtctttatagtagaatgatttatatgcctttgggtatatacgaagtaatgagattgctaggtcaaatggtgtttctggttctaggtctttgaggaatcaccacactgttttccatgatggttgaactaacttacattcccgtcaaaaatgtaaaaagctttcctatttctccccagcttcaccaggatctgttgttttttgactttttaatcatcgccattctgactggcatgagattgtatctcattgtggttttgatttgcatttctctaatgatcagtgatattgagcttttttcataagtgtgttggctgcataaatgtctttttttaagaagtgtctgtttatatcttttgcccactttttgatggtgttgttttttttttttttttgtaaatttgtttaactttcttgtagattccggatattagacctttgtcagagggatagattgcaaaaatcttccctcattctgtaggttgcctgttccctctgacgatagtttattttgctgtgcagaagctctttagtttgatttgaccccatttgtcaattttggcttttgttgcaattgcttttggtgtttgtgtcatgaaatttttgcccatgcctatgtcctgaatgatattgcctaggttttctcctagagtttttatggttttgggttttacatttaagtctttaatccatcttgagttaatttttgtataaggtgtaaggcaggggactagtttccgttttctgcgtatggctagccggtttctccagcaccatttatttaatagggaatcctttccccattgcttgtttttgtctggtttgtcaaagatcagatggttgtagatgtgtggtgtttttctgaggcctctgttctgttccactggtctatatgtctgtctttgttccagtactatgctggtttggttactgtaaggtgtaaggaaggaatccagtggcagttttctccatatggctagccagtttttccaaaacatttcttaaataaggaatcctttccccagttgcttgtttttgtcaggtttgttaacaatcagagggttgtagatgtgtagtgttatttctgaggcctatgttctgttccattggtctatatatctgtttggtaccagtaccattctgttttggttatgtagccttgtagtacagtttgaagtcaggtagcatgatgcctccagctttgttctttttgcttaggattgccttggttatatgggctcttttttgtttccatatgaaatttaaagtagtttttttctaattctgtgaggaatgtcaatggtagtttgatgggaatagctttgaatatataaaatactttgggcagcatggccatttttacaatattgattctttttatccatgaggatggaatgtttttccatttgtttgtgtcctgtcttaattccttcagcagtggtttctagtcctccctgaagaggtccttcacatcccttgttaggcatatgcctaggtattttattctctttgttgcaattgtgaatgggaatttattcatgatttggctctctgtcaaatcatgtactgtcagtgtatagtaatgcttgtgatttttgcatattgatttttgtatccagaggctttgctgaagttgcttatcagcttaaggaattttggagctgcgacaaaggggttttctaactatagaattatgtcatctgcaaacagagacaatttaacttcttcccttcctatttgaataccctttatttctttctctagttcacatttaaatccagcatcttattctatatatatatatattttaattttctaacctgttttatgtttctttactttcttactttttttgaagtatcttaaatcatttcttgtcttactaattttttggtaaagtgtttttaatgtattcccttagctggtaccacctaacctcataataatattggtaggagtaatagactctgaattgatggtagctggtctaggcacagcatttttcatagtatttcctttggattatggaaaagttaagtattacatatttattttatcaacattgaaacctttgtatttcaaaaggcatcttccaaaaagtaaaaaaaaaaatctatctgtccatagtggaagaaaatatttgaaaatcacatatttgataagggattgtatctataatatataaataattcttatgaatccataagataaatagaaaaagacaaaatattcacaagattaaaatagaaatttatctaaggaagatgtgtgaatgaccagtaagcacatgaaaagagggttaacatcttcagccataaggaaatgcaaatgaaaaccataatgagagaccactttacacacactagaatggctgtaatagaaagacaggtgataacaagtgttgggaagagtgtgaagaaattagagccctcctatccagctggtggtaatgaaaaatgatgcaaatactttgaaaaacagtttagcagttcttcataaacaacaatttcccatatgtctcagcaagtccactcctagcatctcctcaaaagaagtaaaaacatatttttacacggaaaatatgtataacaatgttcataaatgccaaaattggaaagacctaaaatgtccatgacctgataaatgggtaattttggtataaacatatcaaagaatattatatagaaataaaaatgaatgagttctgatacatcctacaacataaataaaactaaaactaattatgctaagtgaaagaagtcatttatgaaacaccataaattgtatgatttcatttatataaaatatgtgaagagaataatctattgagaaacaaagtaagatggtatttttctaggactagaggtttattgggagtgacttcatacattatgagtttaatttgaattcattaaaatgttctttagggctgtggctttgtaactatgtaaacatactaaatatatttagattttaaattttagtgaatgttatgctatgcaaattataattcattatcacatttcttaaaataatgataataaaaataaatttttgagaaagaatagattcatactttcagaaattttaggtattgaattgaaatatcatatttctctagttatgttctttcttttcattgtgcattctatcattaaaaatatttaaaataattatctacatatctttaatttttttgattttataattcattgcagtcattggtgacccattaaatctgtggggttgaaatgtaactttgaaataaactgtctggtggaaagtaaggacagattttacattggttaaatcacttcaatcccttcaaaattagtctcttaaaaacgggttaaaattcatattcactgttgacaaaataatttataaataccacctggtcacaaaactgtaatactcacacagggtcattaatgactgacttcaatgcattgagcaaatctctacttgacatggtcctgatgtccacactgagggctgctcccttggctttcatgtgagcaatgttatcatgttgatccgcaaacaagggaatgcccaccatagggatcccatggtagatcgcctcatagatgccattggttccaccatgagttataaaagctttggttttgggatgacctaaaagtggatgcattttaacaaaattattaattacaaggtatgagaattgaataagaaatgcacaatataaggaacttaaagcaaaactgttccctaggtaacattatacccacaaaactgcattgaaattgttttcaaatttcagaagaattgccaggtgaacaaaatgaaaaagcatattcttaattaaaaaattaaaatgtgcaaaaaaaagaataagattgggtatacaagaacgtggtcttttaagtattataaataatgaggtcacatttacatatttaaaaaatatttaaatacttaaaatatttaaaatatttaattttttttaaaaggcagcagggagtagggtggaggtggggctgaggaaggaccagttatgcatcatcatgaaatgtgttatcattttatcatgataaagattggttatttattcccataaaaagtagagtcactggtaatagaaaagtgtccgctatttttcagtgcctgttgaaataaccctgcagtaggggaaagaacagaggtaaagctgcataaataggagacagacagaaaatccaggatgttatttaaaacctgtgagaggaaattacacctgaacaaagagatttttattctgaccataaagaatgtgactgtatgtaataaaatgccaactactatagtgcattctttttatactaagactggaaaataaatataaagtagttaaatttgatttgttttttagttttccaataataaatgctaaatatgtttgttttatgttgaactattatcactccaatttgctgttactaatatattcactgtttgttctccagaatcttaccaagaaggtcattctggggtaaccacttgtacagtcgagtattggaacctaaagtatttggcttcttgccatcaaatctccatagaacctgttagggcaaggaaaatatcttgttcaatgaatagaactctaaaaacatagcatgttagaattctgaagagattaataatcagttagttaatccatataaaagatgaagaaataagaagaagtgatgtcaagtaatgagaactactaaaagtttgaggtaagttgaatacccacgtttaatgtcgttacttttataatcaattttgtatataaagaaataatgacatttctaacataatagctagacacatgagattgtgaaaggaaaataaatcttggcaacccaaactctatgctaaagggaaaagttaagctgcttagggcaaacctacctcccattctattcaaagtcagcccttgactcactgagataaatgaatatcaaattgcctcatttcgagaggctaatcagaaactcaaaggaattcagctatttgtctctcatctacctatgacctggaagccccttccatgcttcaagttgctctgcctttgtttctagctgtcccccatttctggaccgaacaaatgttcatcttatatatgttgattgatgtctcatgtatccctaaaatgtataaaaccaaactgtccccccaccaccttggacacatgtcatcaggacctcctgaggctgtgtcatgggtgcacattttcaaccttggcaaaataaactttctaaattatctgagaactgtctcatatattcagggttcatattttggtaaccatgaagagattctgagtggaggttccctgacctttgataaatgtcctatcagtgcttggtaccagcatgagctaaatttatggctcaaacaaagaagacaattggctgaggtctgggagcaacccctccagagaatctctgataccccaaaattcagacaagatctgaagtttattttgctgtacaactcctttttgttttttttggagttttacttgcttcctacaagaaaggcaagatttcctgtttccatgacaatggaaggcaggtaactctatggagtttgagctcgctcccaggagggaggatgaatttgaggtttctttcctgattctaggatggcagagggcagttttggcctgaaacccatccgtaggtaaacagctgaattgcggttttgtcttggttaatgtttaacaactagctggacttaatttctccttaccattacagtgcttagtgatcacatttctgggattttttttttttttgtacattccagtatttctcccatcagatttgatgaactttacctgacttgatcaaatctgagtgagaattccaaattgtgggtaacaaagcctgtctaatttggctaaaattctttgcagacgcaaaagagaaaacaaaacaaaacaaaacaaaacctaaaaaccatgctcttggtttctgtgtttgcttcctgtctttaaaaaaacaaatgttcttttgtttacttttcctccaccctatacctccttttgccttttgccatttgcagtatgaaaaatctagagaaggcttctaatgacttgaactcttttaaagaattcagaacaaaggcaccactcaccctttaggggtgtctgttttctttgtggagttccaagagttgtgggcagatttttttctcagtccaaagctctgttttcctatgttgaatgacctgatctctttggctttgagattaccacagattaccttgtactgtgagaggattttaccttggcatgtgtaatggcagacgagttacaaagtagggggtggctgagtacagtttactggaagtagtattgactgttgctatttttttcctcctaggaagttgttgtttaagaatcctaattctagtttggagatgtgttgtaaagggtctcctctattgtttttattccccaaattaatctcatttggcttgtctgtgtggatttgtgtgagaaactgaactgtggtttacataggaaaatgagagactgagttttctcagctccaaagtgaaagggcatctgctcctcccaggcaaaaggcacccctaagcaactgggggccttgtgggagtgtcttggggttgaccccctgtgacatggagtggccctgcagggaaatccccaagaaaaattaacttttaaaaaaaggctagtccaggaaacacatatgagggcagatcacccagcattttgagccctctcagaggtcatacacctctggagagagaaactgagacatgtaagagggtggaaacaactcagtggtgacacactgtggagtactgcccacaagcagcacacattgattcaccacacataaaccctaggccacagctcagttcctccttttaggaaaaaaagtgggaaacaaataatctaagaatgatgagaaaacaagaagaatgaccccctgatatcacttggtaggttttatgacacctctacttggcagagtttatgtaaaatgaaggtaatacggtctttgtgcacatatacattaagaaccctaggttgtcctgcaagctatagagttcctaagttctctctttttaaaaaaaattcttttcttcttgctttaaatttgcttttatttttctattaagataaaaaccacactatggattcaacaggtttttgtctgcaagctggtcaattttttttatctcatggctaaagttctgaagtaaaagccatagaatcttttgtgtgtgtgtacatgtgtttgcatatatttaaaaggccattataatttctataattttatgtttaataggcaattgaatccattttattttccttccagcacaccaaattttttgtctctgtaccttatgatgtaaattttgctatttaattttcacttggtttcttttaatatgcaaatgtaagactatttagcttacaactgcctatggtgatcaagtattcatacagattacctattgaaacaggttatcaagaatttggaagtctaatatggcaaaatgtagttttcataaatctataagatgtacttctattggcatgcttaatgtgtgtatgtatttatgtgttttgtacacaatgttttattactgaaaatatataaaagagctctaattaattggcttaagaaaataaaagtgcttgaattaaatactttgccagaaaaaaaagactagtcaaatgctttttcaagtttatgtaacttcaataaaatcttttataaataagataactttacaattattgctaaagtatgataatattagaaatgtcttaagaatttccagcatatatttttgtttgcatttattaatcaaacaatttcatacttattgttgccaaatactttaaggtgtcaaaatttgacataagggttacaaaactgtaaaccaagcacaaaacagaatgatctttgcttgtgtaattttttaataaataagacattgatattggtttaatgaaaatagccacatcttgaattaagtaagattatcataacttctaaccctgtggccttaagcaatctagtccacaggcagtaaggtttgttttgggaaaaaactgttatcatttttatttcaaagctaaaccataaagggtgtgaaatggcaacactatccttcaactcattttcaactcatataagtttttttcctcaagttctgtttgttgtggcataatgctaacagtgctttctaaaagctattcagctcctcaaggtccagggactatcacagaagaggtgggtgtgtgagattttaagaactgatactgagagataagttagtttatttacaaattaatcattaatgtcaaagacacactaatgcaagaccaacatatgggcccctgtgtcagattaacaaggttttctggaagcataaactgacttcttaataaagattataaaggttatgaaaggctgaggaaagttatatcttatggtcaagattagaattttatagattgttcataaaattttgaaaaacaaagttatttggcttcatgctattttattagggcttattgtttggcaaattgagtctcctctctcaaagaatgaagatttttgcctttttttgaaatccttgagttaccacattagtcaaatgaatgatttatcttacctgtgatattaagtgttttaaacctttgatatttgagaaattttccaaacaaattataaattatgattttttctgacctaagtaatcctttaatttattagtttccctaacatccaaaaatgacataatttggtttattttgtataaaaattatacaggaaacattgtcaaatatgaaatggtgtttggtctttttgagctgtatttatataagtatgttattgttatgtgttccaaaattatgggaaactcctataattctgatatgacttagtgtgtacgttatcagtaacaattatatgtgttaagttattgtgtgccacagaggtaacaaatttccttgtccattgtgtctttgactgagtctgccctaaaactttttgtcctccacagacaattgttgtcttactttggtcctctttagaaggcgattttatactcagccataaaattctaacaggtgctcttgaaaaaaagtttttgataattttggagattgtgacattagaatggaagaaaaactttcaggactcatggagaactaaaatgttcatgagtatcaagcagaacaggaattaactacatggactgaaataataaaaaactaaagtaatcttttagactttgcttaaaacattgctgatcctttgttttgtttttttttcagagtgaaggaatctttttttttttgagctattaacagcttttaacaatttagtatactcctatgaaaaaaatttagaacatatttgtttccctctacctgatttttcagaatttggaaactatttgtgagtattttttacttttgtcaatacagttatttgcataagtgcaataagaatctattttcatttttaacaaaacacaattggagaaactggttattttatcaaggcttccactggtatggtgggctttcctttagggaatcaaacttaacttatggagccaataaaaccccttgggaaaactggcctcataccttcatctataaggtccctgtacagggttcctgaactgtgttaagcaaagaatgtaactttctgacaggcccaggaaccccaagtttattttggaaccccaagaggagaggaattcacccaactcgtaggtatttgatggtagaaatctatggctttcctcagctttaaaaaagtcctatctgagattctttctataagacaaagttccatcaaagccactttaaaagcctatgtaaataaaaaattattcttcctcctctgtatacaataatcaggccaagtataataaagcaaatcagttgtaccatggtttgtctttagtaaaattgggaaactgaagacagaaaaattatgtttcaaaaataacagtatacctgttgttagattctagtcttgcctaatgtttttcaacttttattactgtctacagtttggactgaattctaatttttcatggctacacgtcttcaaaatagtgtcttcaggttttttttcctccctttccaccatttttcctagtttggagtcactgtaaactaagtcatgctttcataaagccctacaaattaagctagacaacttaaacttcagaagaaaataacagcagccaatttacatacataatccactttcttacctgcctactgatttatggacttcagagtaatgggcctatattaattttcaaggatttttcttttgtttggttttgtttttctccctttctccctttattttgtcttcataggacatgagacttcacaacctactaaaaatgaactttcctaataactcaggacctgcttaggaataaaccttccttgccattagagatcagatgaaaacctgagaccagagactcattttcttctaaaatgctttctccaaaagattttttttaaatgtaaaaggaaaataagcctgggggccccaaagtcactaagcaaatcactgcctcccattctattcaaagtcacccctctgctcactgggataaatgcatatctgattgcctccttggagaggctaatcagaaagtcaaaggaatgcctcctccctgcttcaagttggcaaaaataaactttctaaatgtactgagacctgtatcagatatttggggttcacaagattatcaatgaaatattcaaatatttaagaattgttaggcagtcttaattctagtaataaaaaagtagcaaattagtaataacctatatatttattttatatactttatactagctgtaaccttccaaatttaatataaatttattaatttttgagtgatatgagaagagtttacttatatccacttgtctactagtcataagttattttatgaatttgacatcattgattacaaaagactaaatatttaaactgcacatatggtgagaaataatgctacatatgtagtatgtgtaatttcttttcatttgctaactatcaagtgctactttcaggaaaaatttcaagtggcagtgtttgacacaaattcagactattatcagtattgctacttttgtaaatgctaacaatgtaggaaaaaggagcccattgacaattcatgattaacaatacagatgctgaaaatgtagaaaattgtattttgctgcattttgcttaactgatctttcacacttagatgatgcactacctagcattgacagccttgatatatggtcagctatagccagtcattaccatgtctagtaccaaactaaggtactgattttagaattcccaagcaatctttataaactggagtagaatttacaagtgttgaccttgtatttgatatgggagtgttaaagtaactctgtgttttcagcaaaaacttgcatagatcattcagagagggctatgtcagataagaaactaaaacgtaaattgaaaatacacaaagattgtatagattagaaaataagttcctaccatgtttatttatattttctgctccttcctcaatctggagaaggcactaatctgattcttagagcatagtctttgttgggccacatttaataatgcacatagtctaccctaaaagcaggattctatctccatcctttccattacatttttctgcttaagacattagtggcacccaagtcagcagagcagacaagttttttttttttttctctaaatctacttggctaggtgggtacctccagagcagtggctagtcagactaggacattctttctctgaatggcaccctgaacagaacgctaaatagacctattccaatgcatgggaagtaaaaacagccagattgcttggtaagacgaagctgcatgatgcatttcaaagttttttcaatacctgcttattgttattgtgatagtacagtaacttattaaaatttaactgctttttgataatatctacagtgtatacagtaccttctaaaatcctgtaaaccaaaaggagcaaatgacagggcagaatttagtgatttctatgtacatgctacgataccatgataataccaaacttcactagcacctcttaaatatatttccttctgatcacaatattaatgccaacgttattatcaaccaaaactcctctctttatgattttaagatcttccatatatgtttttgctttgaacagatgtctgagataattagaactatcatagcagttaaattttcaggcagaacatttctgtaatggactcttgaagagtttaacagattcatttagtagccatccacagttaaggcactttatctaaccttttgtgggatctgggcaagggctgatgcaatcatgttggcactttcttctgacatgttactgatcatcgaccccagagaaaacaccacaataccattttctccagagctctgcacaaactcttccatttcctgtgaagaaagaatttgttctatcagaaaagagcaacagcacagaaaacactattgacaggattgttacaaacatctaagatgagaaagtcaggagctattggagtaatttttttaaactgacctaatcattcagtttctttgaaaggagatgtgtaatataatatatgtgggatctttcatgcaaatttgtgtaaatatgtgtgcatatgcatgtatgtatgtgtgtgtaaggaggaaatgaaacaaagctatgacactgcagtaggaggagataatgctagaaaatgttacacccagacactttatttataatattataattactaacataggttattggaaggtagctttacttggcttcaattctaattttttttgtggttctactaaatctcttgtgtttatttggagtagttttattttattttatttttttctgttcagttcttttagttaggagtcattggagccattacatgactatgagcaatgaggaaaagttagttacaattggaatgatattatatctacatttatttagcttctagctctctaaccctttatatttcacttaaagttagggtttcctagtcttaccccactacccctcactgcccccgacacccccaccccccaaaaacaccttaaaagctgaagtataagaatcactgacattcagcagtctggtattgtggtttggaatttctgggaaatagttctgagaattccatttataatacagtattatatactatatagttacataattaagtgatcttatttctcaggtcattgcttaggtatgactatgacaccttttgtcctgaaatcacactgtgaatttgatgtgctatgtataactgaatgtgggggaccctcatcatcactttgctgtgtctcacagggggcacttgaaccacagtgggagaggtcaccaggactttctccagtggagatctgctcaccccctagagtagctccctcacactatatgaagctcctggtgaatatgtgtttgctttgaaatgaatgagaattattctgacttgtgtttcctgatgtgtccctgtttttaaacttaaatccattctctaatgccacatcgctcaatgtattctcacaccaaaaaaaaaaaaaagagagagagaaagaggaaaagaaatgtagacccataagtttcctggatatcatatcaaaattgtatactcatctttttgttgctgttgtcccttttgttctaaattctctttttctcagtaaaataatgaccaaccccttctgtcataacaaatatactttctggtcctaatcattgggggaaatttctttataaaactgtttacaaataaaaaaagaaattctaaaatatgtcaattcagaccatatattggtaagtatttttaaaaaatataatttaactttatgacatcttttttttttttccagatggagtctttctctgtcacccaggctggagtgcaatgatgcaatcttggctcattgcaacctctgcctcccaggttcaagcaattctcctgcctcagtctcctgagtagctgggattacaggcacctgccaccacgcctggctaatttttctgtttttagtagagacaggtttcaccatcttggccagagtggtcttgacctcctgaccttgtgatccacccgcctcagcctcccgatgtgctgggattacaggcatgagccactgtgcctggcctgacatcagttttaattggagattcagtgtatggctattagagataattcatgaggcatccaggaactcagtgtaattgcagttgcctgtagccacatttaatgtaacttgagttcaatgttttgtctcattcactgccaaaagtctgcttcacccacccagtattgaagtaataaaacatctatttatagacagatcagcactgatctcattctgtgatgtctttatgaaagtaatggtaatagaagatcaatgtaagtagttttataaaagtatgaaaatttagaaaaagaaaatcatttacccatatctctatctcaatttaaaatgtgtaccatttcattatgggtttaattctatttatataactcaatgtacatatgtgatgtttatttagaaaattttattctcattgtatatgcctttttattctacaaaaaaactgtgatcttgttctactcatcattttgttccttagtttccaactatacctgtaccacggctgacagtgtaattaaacattgttttgaaaaaaggattgtaatggcttggtatgcacattatgtaagtttttaaccatttcttaatgtaagatatttgaattatttccagagtttttttaatgagtatttgctaccgatattgaatcttaccatcatgatttattctctgtacagtttcatgtgagtatattataaaggcaatgcctatatgcatttttcaaacacttgatactttttggcaagagtcttattcttttgaaatatacaaacattatctgagaatctaatacataatggaaaagcaagcaaatttgtggcaacaattattttgtgtacaaaagaattagagaatcagtttcacaattatttacttggattcaagtctaccttctgcaagttaacaacaacggaggctcacacttgtaatcccagcactttgggaggctgaggcatgtggatcacctgaggtcaggagttcaagaccagcctggccaacatggtgaaactctgtctctactaaaaacacaaagattagtcagatgtgttggcaggtgcctgtaatcccagctactcgggaggctgaggcaggagaatcagatcgcttgaacctggggggtggaggtttcagtgagccgagatcatgctagtatcagtaataatcactattgtactactagtcatttatcccttgtccttattctgctactctcttccccctgctactggcactatcactttcttttaatgtgagtgaggaatttttttttgagaataagataagagtacacagaattaccttttaagctagaatattaatgaagagcctccacctttacaatacaactttagctttccagcttgttcaactgactgcccaaacttaaacatttacatttaaacaagtacacagagtatctgttctctaggactttgctagagaatataatcttgatgtgttggaaaatcaatcactattaaatgaagactgatatcttaaatggctggcacatgttagctaatttaaagtattaaaaataatgactaaaataatcataatatcaacaatatttttggatcactggctgtgtgtcagagacaacttaagtgttttatctgtggtaactactttttttccacacagcacaatatgaagttgtgattattattataaaagtagtcatgattgcttaaactcatgtaaaagttcctaaatgatctttacattttacaaacttgcctttttgcaatattatacattgggaatattgggattttttaaaaggaaatctgatcatatctcttcatttcttaactcttttcactcttttcagtagctctccattgtccctatgggtatatcaaattacatatatatatatatatattttttttttttttgagacagattctcactctgttgcccaggctggagtgcaatagcgtgatctcggctctctgcaacctctgcctccggggttcaagtgattctcctgcctcagcttcccaagtagctgctattacagtcacctgccaacatgcctggctaacttttgcatttttagtagagacggggtttcaccatgctggccactctggtctccaactcctgacctcaggtgatccacctgccttggcctcccaaagtgctgggattacaggtgtaagccaccacgcccggcccatcattgacttttactcaaccttttcctgtaaattaaatttggagttcctgggaactgcccttattgcttttctacttttctgccttaatgcaagcctttactttttttttttttgtttatttgtttgtttttgagacagagtctcgctctgtcgcacaggctagagttcagtggtgtggtctcagctcactgcagcctctgctcccagactcaagcaagcctcctgcctcagcctcttaagtagctacgactatgagactacaggcacacaccagcatgcctggctattattttattttttatttttgttagagatgaggttttaccacgtttcccaggctggtctcaaactcctgagcccaagcaatcatgccttctctgcctcccaaagtgcagggattataggtgtgagccaccttgcctggcctctggttttctttttgggtgtttctcatcccctcatcgtttcacctatctctgcacattattgagtactcactttaattgtcaatgagtttgggatctcttctgcatatttctttatcattgtggtctttccttataacactttttagacttttctttttcattgtttttattctatctttcaaagtacaatgtaaggcatgagggagcagaaactgtgctacctttattctctgaaaatccagcacttacctgtggtttgtattaatcactctacaaatattttttgaagaaatgaatcatactatcttttgggtggcacaatgaaggccttactttaaccaaccctgttttcaaaatctccctagtaaacctctttggtctttaatgataataacattcacatacttgtgatactacagaaatatatgattttctaatggcaagtccttgtttttgacctcccatattcccctcactctgagttaaacactctgaaagaaacatatccagccattccttctgaaaatgtcaagcaaacaaatgaaacaagaacacatttaccttaggcaggggtttggctggtttacagtgaagtcctccaacaaaatcaacatttggtaagaatgggcgaggaaattcaaaatcccaataggttcgaatgagccacatttcagctttccccattgtctcaaataatgtagtgggtcttcctgatggaaaaaaacaaaacaaaacaaaaggtagctaacacgagaattgttatttgaatatgcaggtattttcctgaaaggacttggaataacatacccaaacatatataaaatgtctgtgcattgataaaatatatataaatacatttatatatagtcataatttagattttatttattgcatatgttgctcatatgtatatataaggaaggcaatgtattcagagatctgtaagaagaaatcacatctttaatgtaacatcagtatattcacaatcataaataattattaaaataagtcactaatatggtttgactgtccccacccaaatctcctctcatcttgaattataatccccataatccccatgtgtccagggagggacccagtggcaggtgattggatcatggtgtggattcctccatgctgttctcatgatattgagtgagctctcatgagatctgatagttttataagtgtctggtatttcccctgcttgcacttctctctcctgccactaagtgagaagatccaagcttgcttccccttagcctttcaccatgattctaagtttcttgaggcatcccagtcatgtagaactgagtctattaaacttcttttctttataaattacccagtctcaggtatttctttacagcagtgtgagaatggactaatgtagccactatgaacttaaatacacatttgtcttccctctgaagctgcaatagtaacaaatatacctttaaacaactctttcagttccacaattaattcatcttaccttacccatgaaaacagctttccaggaagtactctagtgtctacagtttattaagctagtcccttgatccttggttctcaaagtaaaccatgagttttttgagctcaacactgaaatctttacacctactactgtcttggttcatcttaagatcttaatataattagatttttaaaataaatatatttacaaatgagaattaaaacattttcagaatttattgacatagagatatgtgctctcccttaatttggcccctattttctttgatggagagatgcagtttaataaaatatagattaaaacttagatgttcactttcaacaagatttcagtttttgaaagaaataattgtcaacctgttattgaaggaatgtataaacattagaaatctcaagttttaggcttctgtttctggagtagagccactatattactcaactgtgaaggaatccttcttacatgaaaaacaaaatttaatttctaaatgaggaaactgaggaactcaaagagaaacaaattcctcaatcctgcattgataatttttctagaaatatgtgtaaatactaaatttacgtgtctgccttcatgaagatgtttcttgaggtatctattgactttttttaaagatgaaaaaatgtatagcaaaatgatatgtgatagtttaaagaaatcattagtgctttacaatgaaggtttatgactctctgggtgtcctgtagtagtgatggccccagggttctaactgattctataaggtcaacattctataatatttttgagactgatagatcatcttacatttgcaattcataatttcccttaaaaacactatcttctgacattatatttatataagctcaccttcaaaggcacagaaaagttagaacttaataagcaccagttagacacatgacttacctagaacttcactataaaactggtcccacttcttcagatcataaatttgaaaccaaaagtcaaaataaagcatatgtatcatattttttatcctctccatgaaaatcatttgatcacttaattctgacataacaacaggtacataggaaggagggaacagaaatcctccaccattcttctcaaatgtgtagccaacagagaatcgaagactgtacagaaagggtatgttaaatagttcagccagtagctcaccacagggattaagggcatctgccagaatgacatcaaactttgactcttgtagtttcatcataagtttcttattcaaaactgcatctttacagagcttgttactgtagtcataatattcccaacacaattcttgtaattgtgaaaaatatgaccaaaatgtattttttgaaacaccatatatccatctatcgagaattttcagaagagaatcttccaaatcatttttagttaaagatgtaggataaacttctaatttaatagcagatgatttactggcattgacaagagtagaagccgaagatgtcaacacagtcacctcatgacccctctgaacaagctcttccaggattgtcttcatatttatccaatggctgtattctgtgggccacactagcacctttccacagcttccagagctaaagtaacaactgagctgtatcagcagaaagactgacgtccatttcagagacatcctggtcttatgcaatgcttcttttccagttgttgtttctttctgtcatttctcatacttatatctgaggaaaaatcaatcaagttaaaatataactgctaaaatttgaagtaaatacataatactaacagtctgaataggtgcatgccaaggagaccaacaaaagattgatgacctcatatttattttagtgtgtttggtgttcttttatgtttacaattactctagtcaagcaataatttttatgacctagaatatgtaagtaacctgtcttatgtaattattttataatactgttaagaacagtggcaagtgagaggctcctgcctgttcggtgcccttgacatagagagaagaagtaattatacaactcaaacggcattttttaatatcgtggtgcaagtaatgtcttctaaaactttgttgacacataattcatatgccatatgactcaccaattagtgtgtacagttcaatgtttcctagtatattcacagaattttactttcactacaataatcagtattatctccaaaagattctatacaatagcctctaaccccccactctgaaattttgcatccatcctaccctaggcaaccactaatctaatttctatctctatagattagcattttctggaccctttaaaaaataaatgagggttttccagtgatcatggcagatgggatgcaggactagattgcagctccagacagagcagcatgcagaggcttgcattgtgaattttagctgcagatcaactgcaagaacagaccagcaattctgagaggatccacacaccctctgcaggaagcgtactgctcctgcaggacctgggagacatcccaaacactgtgagtgccccaacaatggaagtgggaaagggtgatccccctctccagaatacacatccccactggagaagctgaagttctgttggcaggagaagttcctgactttatgtgaagctgagtcaaattagagaaccaagccaagcaaaatacaggggtagaggaagtagcagaaaggcactgggagctctctggatacccaagcggctcattcctgcctggcatcacagggatctatcaggagggtggccagtgatgcagggggttcaaagattctcctcagggcctgaaggcttgaagggatgagtaactcctcccttctcaggcccagccccaagatgcaagaccacttgcatcagcagcgtgtgtcagcaagatagcagaagcaggaagagagccggccagaagacacttaccctggctggaagagatgtacccctgaagatcaagaaataggccatccaggtactacatagcagtcacaacagactgggacacttactgtttacagaggactacaaaacccctgtcccatcctcactgggggctgatgccattttaggcctcagcccacctgcaaccaggcgttcattaaaacagcatgttgctccacaccgcctcctgttgtctgttggcgcgctgttggggttcaaactgattcaagaaccttacatctggtgccaaatcctaggaggggctcaggtctgtgtcgcttgtggacctacccctccaccccagagagcaggccacagcaattagacagaggaagctcctcagcctccagtcgcctctctgtgcatgcgcatcagccactgatctcgcctactggtaagtttcccttggagcccggttaacagggcaaaatctacatggcctctcttggtttctccagtccaaaaatccaacactgatccaagaaggcgccagcgtgcgccaggcactcgctggtcatctggtcttagggggatgcctctaagccatttcatcccattccaggaaccaaaaaggcagcggagacgataactccttttatcgtctccctccagctgtccaggatggtctcctttttccctgttctctcgagctacccttcattatgggaaactcccggtcctcaattccaaaaaacagccctccagcctgcctcattaaaaatctgcaaaccttaggcctcaggcaagatatctgccataagtgccttgtcttttttatacgataaagcctggtcgcagtatgaattagataacgggtccaaatggcccgcaaatggaacactcagctttacagttttaactgacttaagcagttattgcagatgactgggaaaatggggagaaattccttgtgtccaggcctttttgcactcagatcacagcccgacctctgcaattcttgcttacctgttcaaatccttcttcattctcgccgccctcattgcctttatcctcccgaccctacctctttttcctcattggatggagcagactgctgtccacccctcccagaccctacccctccatctcaaccaacttcattaactccccaagcttcctcattgtcttctcagccaccatcttcccagccaccatcttcccagccagcatcacccacttcttttcctataccatcctctcctcaggaaaactctagcattgcctgtactcattctccttccttacagccctctcacggagcctgtaaacccatcccgccaccttacacccgtatctatcctccaatgcctatcaactcaaccccccttccctcttcaaaccctcagcaggaaccccttctggcttcttccttctctcctgcccatactagctccggcaccatctttggcccccatgccccacccgtactttagcgccagtgctagaatgcccccttcgggaagtagcaggaactgaaggtattgttagagttcatgttcccttctccctcactgatctctctcaaactaacaaaagactcagttcatttccagaagatcctacctcttatattagggagattcagtaccttactcagtcttatgaactaacctggcatgacagctacttatcttctcttccaccctcaccccagaagaccagcaccgtacttggaccctagctcaggtgcatgctaatacaattcatcatcaagctcctgcccagcctactggcacagaggcagttcccaaccaggacccccactgggattatcaagacagggcctctggacacagccatcaagacctcatgattatgtgtctccttgcaggactcaaaaagggtgcccataaagtggtaaactatgaaaaactttcagaaatcaccgaaggtcctgacaaaaacccagccctttttctctcttgtttaactgaagccatgagaaaattaccaacctggacccagccagcccagaaggaaccactatttcaaaccttcagttcctcacccaatctaccatgatatttggcgcaagcttcagaaggttgatgacggccctcaaaccccacagtgggaccttcttaatttagccttcaaagtctttaacagttgtgatgaggaaagtaaaagaaaaaaacagtttccaatgcttgcctttaccctgcaggcccacagggccacagctccatacagaagcctcctagcaaaacacctccacctggcgcctgtttcaagtgtggcaatgaaggctactggtccaggccatgcccaaacccagctgtgctcaccaggctgtgccccctctgtggaggactcagtgaaagtcaggctgtgagcggctccagcaaggatcgcctccatccctttccgagctggccaaaacctcctactcggatctcatcggccttgccactgaagactgacagtgccctggaacagatgtcccagcaactaccattgcttcatctgagccaagggtaactctgatggtggcaggtaggcatgcatgttttttaaaaattaatattggagcaacctactctgctttacctaaattttcaggacccacccagtcctcccaagtctctgttgtgggaatcaatggacaagtctccaaaccccaagacccccctccacttttctgctccctgaacaccttttccttcagtcactctttcttagtcctgccttcatgcccagctccgctcctaggcagagatattctttcaaaactccacactactctccacttccacattccccatagtacccaacacatcaacccagacccctccaaggcttctaacaggcttctaaccttcttctactcctccgacctcccaccctgaaacatgcaacttttccttatcccgcacctgtagttaaccccactgtttgggatacttccacaccctcggtcacagagcaccacacccccatccacatcacccttaaagagcccaccccgttcctatcacagaagcagtatctcatcccccaagcagctctcataggcctaaagcctatcatttctctcctcctcaccagtcacctactctgcccaacaaactctccttttaacacatcagttctacctgttaaaaagccagatggaacttatcacttagtccaggacctcaggctcattaaccaagctgtactcccagtgtgtccagtagtttctaacccatatactttactttcctcacttccctcgaataccacccatttttctgttctaaacctaaatgatgctttttcacaattcctttacaccctgattcccaaaacctctttgcctttacctgggaaaaccccgacacccacctttcaggtcagctcacctggtgcgtactacctcaaggttttagagacagcccccacctttttggacaggcccttgctagtaacttctgtactttatccctaaaatcatcctctcttctttaatatgttaataatctgctcctgtgtagcccgtctcaaagagactgcaacacccatacatactatctcccttttaaacctcttggcagaacaggggtatcaggtctcccctaagaaagcccaaatatgcaccccccagtcacctatctaggcctagctcttacccctgaatgcaagggctcacaacagaccacatactccctccttctgtccctcccgcctccacaaactaagcaagaaattctctcttttccaggattagcaggatattttaagctctgggtttcctccttcgctctacttaccaaaccgttgtaccaagctgctaaaggccctctccatgagcctttaaaacctgcacagcctattacccaacctttccatctactccaaaagtctctcatctcagcccccatcctcactctcccagacttcaccaaacctttctccctctataccgatgaatggcgtggagttgcactaggtgttctaacccagtctaagggacccacccggccaggttgttgcctacctccctaaacagcttgaagccacagttctcggatggcctgcctgcccctgagcattggtggcagttgctgtcctcactcttaaaagcctaaaactatctcttcatgccaacctaacagtttattcaacccataacatcaaagacatgttagctcaccgcagtgtactaagtcttttctctgccccacggctcctccagctgtatgctctattcatagaaactccccacatcaccatgctaaccacctcccatctaaacccggccatgctcttacccgaagctacaaccgcccaagactcttcttcacactcttatgtgtgaatactgttcaaacctttcttataccttttccaaacctaacagaaaaatcccttccagatgcgtcctttactcggtttgtagatggcagctccttcctacatcaaggacaccgacatgctggctatgctatagtgtcaccccccaacactattgaagtcaatctgctcctcttaggcaccacctcccaaaaggctgaactcattgccctcactcgagctctcattctagcatccggaaaacagatcaatatattcaaattctccttatgtgttccacgtagtgcactcacactcatccatctggaaagaacggggtttcctcactgcaaacaatactgtcataagtggctctctcatcagcaagctccttcaagctgccaggctcccacagaaagttgccatcattcattgcaggggccaccaaaccccagacaatcctaaattggctggaaatgtgctagcagatcaggtagccaaacaagtagccctactaccctttcgaggccagttgctgtccttgtccttgttctctcctctttacttctaagaagaaaaagatttccaagcccaaaaccttcaaaagcaaggacgatattatgtcaaggaagggtgcttagttattcctcactctcaaagccttcctcacctccaaagcctccacaactctttccatgttggttaacaacctcttgcagcttctccacgctattctcacttgtcgtcacttttccagccatgttcaagaaattatccagtcctgctctatctgccactcaatgtaaccccagggatccctccagcctctgccttttcatacccaccaagcccagggccaggtacctggggaagattggcaagtagacttcactcatatgctgcatgataaatgtctctgctatcttctaatccttgtctgtactttctctggctagggagaagtgttcccaacaacttcaaaaggtgcaaatatcatcacacaaactcatcatgcatacagttccctgtttcagactcccaacatccatccagtccgataacagtcctgccttcatcagccacattacccgaggcatctctacatccttaagaataagtaagttctccacacaccctacacacctcaatcttcaggcaaagttgaaaaaattaactctgtccttaaagcctaactcatcaagccggctctagaaacctgcgagtcatggacaaaaaaatctcccttttgccctcatgagactttgcacaacaccaaaagcaccctctttttttgtttttgtttttgtttttgttttgttttgttttgtttttattatactttaagttttagggtacatgtgcacaacgtgcaggttagttacatatgcatacatgtgccatgttggtgtgctgcacccattaactcgtcatttaacattaggtatatctcctaatgctattcctcccccctccccccaccccataacagtccccagtgtgtgatgttctccttcctgtgtccatgtgttctcattgttcaattcccacctatgagtgagaacatgtggtgtttggttttttgtccttgtaatactttgctgagaatgatggtttccagcttcatccatgtccctacaaaggacatgaactcatcattttttatggctgcatagtattccatggtgtatatgtgccacattttcttaatccagtctatcattgttggatatttgggttggttccaagtctttgctattgtgaatagtgcagcaataaacatacgtgtgcatgtgtctttatagcagcatgatttatagtcctttgggtatatacccagtaatgggatggctgggtcaagtggtatttctagttctagatccctgaggaatcgccacactgacttccacaatggttgaactagtttacagtcccaccaacagtgtaaaagtgttcctatttctccacatcctccctggcacctgttgtttcctgacttttaatgattgccattctaactggtgtgagatggtatctcattgtggttttgatttgcaattctctgatggccagtgatgatgagcattttttcatgtgtctgttggctgcataaatgtcttcttttgagaagtgtctgttcatatcctttgcccagtttttgatgcggttgtttgtttttttcttgtaaatttgtttgagttcattgtagattctggatattagccctttgtcagatgagtagattgcaaaaatgttctcccattctgtaggttgcctgttcactctgatggtagtttctgttgctgttcagaagctctttagtttaataagatcccatttgccaattttggcttttgttgccgttgcttttggtgttttagacgtgaagtccttgcccatgcctaatgtcctcaaagtattgcctaggttttcttctagggtttctatggttttaggtcaaacatgtaagtctttaatccatcttgaattaatttttgtataaggtgtaaggaagggatccattttcagctttctacatatggctagccagttttcccagcaccatttattaattagggaatcgtttccccatttgtggtttttgttaagtatgtcaaagttcagatggttgtagatatgtggcattatttctgagggctctgttctgttcccttggtctatatctctgttttggtaccagtaccatgctgttttggttactgtagccttgtagtatagtttgaagtcaagtagtgtgatgcctccagctttgttcttttggcttaggattgacttggcaatgtgggctcttttttggttctatatgaactttaaagtagttttttccaattctgtgaagaaagtcattggtagcttgatggggatggcattgaatctataaattaccttgggcagtatggccattttcatgatattgattcttccttcccatgtgcatggaatgttcttctatttgtttgtatcctcttttatttcattgagcagtggtttgttgttctccttgaaaaggtccttcacatcccttgtaatttggattcctagatattttattctctttgaagcaattgtgaatgggagttcattcatgatttggctctatttttgtctgttattggtgtataagaatgcttgtgatttttacacattgattttgtatcctcagactttggtgaagttgcctatcagcttaaggagattttgggctgagatgatggggttttctagatatacaatcatgtcatctgcaaacagggacaatttgacttcctcttttcctaattgaataccctttatttccttctcctgcctgattgccctggccagaacttccaacactatgttgaataggagtggtgagagagggcatccctttcttgtgccaattttcaaagggaattcttccagtttttgcccattcagtatgatattggctctgggttgctcatagatagctcttagtattttgagatacatcccatcaatacctaattcattgagagtttttagcaagaagcgtcgttgaattttgtcaaaggccttttctgcatctattgagataatcatgtggtttttgtcgttggttctgtttacatgctggattaagtttattgatttgcatatgtagaaccagctttgcatcccagggatgaagcccacttgatcatggtggataagctttttgatgtgctgctggattcagtttgccagtattttactgaggatttttccattgatgttcatcagggatattggtctaaattctctttttttttgctgtatctctgcgaggcttcagtattgggatgatgctggcctcataaaatgagctagggaggatttcctctttttctattgattggaatagtttcagaaagaacggtaccagctcctccttgtgcctctggtagaattcggctgtgaatccatctggtcctggactttttttggttggtaagctattaattattgcctcaatttcagagcctgttatcagtctattcagagattcaacttcttcctggtttagtcttgtgagggtgtatgtgttgaggaatttatccatttcttccagattttctagtttatttgcatagaggtgtttacagtattatgtgatggtagtttgtatttctctgggattggtggtgatatccccttaatcattttttattgcatctatttgattcttctctcttttcttctttattagtcttgctaacgatgtattaattttgttgatcctttcaaaaaaccagttcctggatttattgattttttgaaaggtttttgtgtctctatttccttcagttctactctgatcttagttatttcttgctgtctgctagcttttgaatgtgtttgctcttgcttctctagctcttttaattgtaatgttagggtgtcaattttagatctttcctgcttcctcttgtggggatgtagtgctataaatttccctcgacacactgctttgaatgtgtcccagagattctggtatgttgtgtctttgttctcgttggtttcaaagaacatctttatttctgccttcatttcgttatgtacccagtagtcattcaggagcaggttgttcagtttacatgtagttgagtggttttgagtgagtttcttaatcctgagttctagtttgattgcactgtggtctgagagacagtttgttataatttctgttcttttacatttgctgaggagagctttacttccaactatgtagtcaattttggaataggtgtggtgtggcgctgaaaagaatgtatattctgttgatttggggtggagagttctgtaaatgtctatcaggtcaccttggtgcagagctgagttcagttcctggatatccttgttaactttctgccttattgatctgtctaatgttgacagtcaggtgttaaagtctcctattattattgtgtgggagtctaagtctctttgtaggtctctaaggacttgctttatgaatctgggtgcccttgtattgggtgcatatatatttaggatagttagctcttcttgttgaattgatccctttaccattatgtaatggccttctttgtctcttttgatctttgttgttttaaagtctgttttatcagacactaggattccaacccctgcctttttttgttttccatttgctcggtagatcttcctccatccctttattttgagcctatgtgtgtctctgcacgtcagatgggtttcctgaaaacagcacactgatgggtcttgactctttatccaatttgccagtctgtggagtatttagcccatttacatttatttttaaatgtattggagtatttagcccatttacatttaaggttaatattgttatgtgtgaatttgatcctgtcattatgatgttagctggttattttgctcattagttgatgcagtttcttcctagccatgacggtctttacaatttggcatcttttgcagtggctgctactagttgttcctttccatgtttagtgcttccttcaggagctcttttagggcaggcctggtggtgacaaaatctctcagtatttgcttgtctgtaaaggattttatttctccttcacttatgaagcttagtttggcgggatatgaaattctggattgaaaattcttttctttaagaatgttgaatactggcccccactctcttctggcttgtagagtttctgtggagagatctgctgttagtctgatgggcttccctttgtgggtaacccgacctttctctctggctgcccttaacattttttccttcatttcaactttggtgaatctgacaattatgtgtcttggagttgctcttttcgatgagtatctttgtgttgttctctgtatttcccgaatttgaatattggcctgcattgctagattggggaagttctcctggataatatcctgcagagtgttttccaagttacttccattctccccgtcactttcaggttcaccaatcagatgtagatttggtcttttcacagagtcccatatttcttggaggctttgttcatttctttttattattttttctctaaacttctcttctcatttcatttcattcatttgatcttccatcactgataccctttcttccagttgattgaattggctactgatgcttgtgtattcatcaagtagtctcatcctgtggttttcagctccatcaagtcctttaaggacttctctgcactggttgctctagttagccatttgtctaattttttttcaaggtttttaacttctttgccatgggtttgaatttcctcctttagcttggagtagtttgatcatctgaagccttcttctctcaactcatcaaagtcattctccatccagctttgttccatttctggtgaggagctgcattcctttggaggaggagaggtgctctgatttttagaatttccagtttttctactctttttttttccctatctttgtggttttatctacctttggtctttgatgatggtgatgtacagatggggttttggtgtggatgtcctttctgtttgttggttttccttctaacagttaggaccctcagctgcaggtatgttggagtttgctggaggtccgctccagaccctgtttgccttggtatcagcagtggatgctgcagaacagcggatattggtgaacagcaaatgttgctgtctgattgttcctctggaagttttgtctcagaggagtacccggccatgtgaggtgtcagtctgcccctacaggagagtgcctcccatttaggctactcagttgtcagagacccactggaggaggcagtctgtcctttctcagatctgcagctgcatgctgggagaaccaatactctcttcaaggccatcagacagggacacttaagtttgcagaggtttctgcttccttttatttggctatgctttgttcccagaggtggagtctacagaagcaagcaggcatccttgagctgcagttggctccacccagttcgagcttcccagctgctttgtttacctactcaagcctcagcaatgtcgggcacccctcccccagcctcgctgccaccttgcagtttgatctcagactgctgtgctaggtatgagtggggctctgtgggcataggaccctctgagccaggcatgggatataatctcctggtgtgccgttcactaagactgttggaaaagcgcagtattatataaagagtgacctgattttccaggtgccatctgtcaccgctttctttgattagaaaagggaattccctgaccccttgcacttcctgggtgaggcaatgcctcaccctgctttggctcatgctcggtgcactgtacccactgtcctgcacccactgtctgacactccccagtgagatgaacctggtacctcagttggaaatgcagaaatcacccatcttctgtatcactcatgctgagagctgtagactggagctgttcctatttggcctagctaattattaatatttcttttcttatagtaattttggttttggtttgttcttgcttttctagtcatttgagatagatcattacattttttatatgaaacctttctccttttcttgtgtaggcatttcttgttctaaacttgtctcttaatagtgcttctgttgaatctcacagattttgctattgcatgatgtgatctttctttgttttaagcaatttcaaaattgtttcttttttatctattggttataaggaatatgttgttaaattttcatggatttttctagttttgtcttggcattgattttataatttatttcattgtgttcagataaaataatcagtaaaatttttattttttaaaatttgttgagacttgcttaatgtcctcatatatggttaattctggggatgttatatgtgctataaaaagaatcttacattctgcagctgttggttaaaatgttctgtaaatatcaactacttcaatttggtctatggtacagtttaaatctcatgttgatttattgtctaaatatctgtccaatgctgaaaaggtgatggtgacatcctcaactattattggacttaggtctatctctcctttcaggtataataatatttgcttcatatatctcagcggttcatggttggttgcatatatatttacatttttgtctttttgaacaattgattcatttattatcatattaagtctctcttttcctctcaaaattttggcttaaagtttgtgttttgctgaggtaagtgtagctatttctgcttgatttgggtttctgtttgcatagcatatctatttcatcttttcaattgcagtctatgtgtaactttattggtgagatgagtatcttttaggctgaatattgttgagtcttgttttttaatccatcaatctacgttttcagttgtgtaatttaatccacttattttcaaggtatttatttatttataggtaaaggcttattcttttatttttttctgtttattttgtatctcccttattccttaatttctctcttattacttattttgacagtttgatagttttctatactgataaagtttgattattttttctttcacctttgtctgttggctctatgagtgagttatataattttgtgtgtttttatgaagtgtattatcatcttttcaccttcagatgttagacttcctcaaatattccttttaaggctggtttaatggtaataaattctttatgtttttgcttgtttgagaaatactttattcctctgtcttctgttttttttgtaggatcaaagtttgctttatataatattcttcattgacatgattataaaacaaattttatcacttagcatatattttcctattctttcctggcctataagttaatgctgagaaatccactattagctgaatgaagattcccttatagatgatgtgtcagctttcttctgccatttttagaacacctgctttgcatttgacttgataatttgacgatatgtgcatcagtgaagacctttttggattgaagtaacttggtggaactttcagcttcttggatctagatgttcatcttttgtcaataacttaagaagctttctgctattatttcattgaatataatttctatgctgtttatcttctcattctagaattttcatcatgttaattttttttcttttttacttagtgatgttgcataaattctgtaggattactttattctttttcttctttcttgtctatgtgagtcatttcaaaaacatggtaatagttggaaattatttcctctgctttgtctcttatgttcttgaagctctcaatagtatatttttaaaaaaatttgttcattgctttaaagtattttatatttttgtgggtacatagttggtggatatgcttacggggtacatgagatattttgatccaagcatgttctagtgaaaaatttttacaatgaacaattcaataaagttgcagaacatgaaattaacaagacaaaatcaataacatttctatttgcctacaatgagcagctgaaaaagaaatcaaaaaagtattcccatttacaatagtcacaaataaaattgaacatctaggaattaaaggactgaaagatctctataatgaaaactactgatgtaagaaattaacactgatgtaagaaaacactgatgtaagaaattagagggtaccaagaaatgaaaaaatattccatgttcattgattagatgaataaatattgttaacatttctatattaagcaaaacaatctactgatgcaataaaatcatgaaaataccaattacattcttcacagaaatagaaaaaaatctcaaaatgtatatgaaaccagaaaagacccagaatagtcaaaggtatcctaagcaaaagaaaccaacttggagtcacattatctgacttcatattacactacgcacctatagtaaccaaaccagcatgttactgccataaaaacagacacagagatcaatgaaacagaatagagaacccagaaaacaatctacacacctgcagtgaactcattttcatcaaagttgccattaacatacacagaaaaaaagacagtctctttaataaatggtgctgggaaaacagaatatctatatgcagaagaatgaaactagatccctagctctatccatatacaaaaatcaaataaaaatggtttaaaggcttatatctcagacctcaaattatgaactactacaagaaaacattaaagaaaatctccaggatgtttttctgggccaaaatttcttgggttataccccataatcacaggcaaagtaaaaatgaacaaatgagatcacatcaagttaatcagcttctatacagcaaaggaaacaatcaacaagtgaagagacagtccacagaatgggaaaaatatttacaaactatccatctgacaaggaattaataaccagaatatataaggggctcaaaccctctataggaaaagataaaaaaatggacaaagaatttgaatagagatgtttctcaaaagtaaacagaaaagtggcaaacagacatgtgaaaagatgctcaatatcactgatcatcagagaaagtcaaatcacaactacaatgagacatcttctcacaccatttaaagtagcttatacccaaaagacagacaaaaataaatgctgatggggatgtgaagaaaaaggaaccctatacaattttggtgggagtgaaaattagtaaagaccactatggagaacagttgacggttcctcaaaaaaatgaaaaatagagctaccatatgatccagcaatctcattgctagatatatacccaaaagaaataaatcagtatgtcaaagagatacccgcactcccatgtttgttgcactatttacaatagctaagatttagaattagcgtgaatgtccatcaacaaatgaatgaagaacatgtgttgcatagacacagtggagtaccattcagccatgaaaaagaatgagatccattcattttcaacaacatggatggaactggagctcattgtgctaagtgaaataagccaggcacagaaagacaaacatggtatgttatcacttatttgtgggatctaaaacttaattaaactaatgaacatagaaagtagaaggctgattacttgagcctgggaagggtactgggggcatgggggtaagcagggattttaacaggtatgtaaaaaggaataagacatactatttgatcacacaacagggtgactatagtcaataataacttcactgtacatttttaaataactaaaatagtgtaattatattgtgcataagacaaagtaaaaatgcttgaggggatagatactccattctccataatatgcttatttccaattgcatccctgtatcaaagtatctcatgtaccccacaaatatatacatttactaggtaaccacaaaaatttttaaaaattgaaaatttaaaaatttgaaagatatacttaatggaaaaacaagcaatttgtaatacaattattttatgtaataaacaattaggggacaggtttcaaaactattgacttggatttagtaacaacagtaagtattagcaattatcatgattgtactattagtcattctttcacttgtcctacttctctaccaactcttccgtttcctggtggcactattaatttcccttaatgtacatgggaaaattattaaaatataaagttagattgctttgaatttttattagtatttcatcaacttttatctcacgagaaagttaccatgtagaccttatataatttgcattcaacatggatattatgttttagccattgaataagattttagttgtatgttgatgctaataagaaggtaaacagaaatgatcccctaagagactgtataataatgttgcaaagaataattgctatctatatatatcttaaaagtgtgatattaatttaaaacacatgagattcttgtgttctctcataaggaatattctatagaataaataattgttattatgaactaagggcacttttcagatacaagtggtagaaattatttggtttttattaggcaagcacttttcatttttttcttggattctctgagatgcaggtatgacgttgagacataagttgccccagggagctttcctgagttgtcctgcaggcttggcataaggtggaaaaacacctgttcttatagggtaaaatgacctttttttgctgtaacatgtagacctctggaatctcagggatgaatggtttaaatgctggagtgaaagcaagtaaacactgggttttgttgcaaatattttgggggcacaatttctttttatgttgaagaatggtgtacattttaagctagaatactggtgaagagccccaatccttacaatacatcattagcatttcaccttgctcatctgtttgcaaaaacttctgcttctgcttttaaacaagtccacaggatatctgtcatctataacattgctggagaatgtaatgttgatgtgctagatgataatcagtatctattaaatgaggaatgatatctcaggtgactggcatatgataggtaattaatgttattggaaataacaaaaataaccaaaattgcaatattaatatttctggatcactgacttagtgccagacacattttaagtgttttacctgctttaacttttttccacaatacaatataaagctggcaaaagtacacataaatatctctatcaacattctggtatatttttctatcatttgctgcctgattttattaaaaaaattctaaattgtgtattctttttattctgaccctctgcagtctaattcattgaatatcttggaaactttttaaaggaaggaaatataatcagatctctccatttgttaactctttttagtagcttcccaatgccataataaatatttcaagatcctaataattatttggctccaacttgcctcttcagaatcatctgtttcttagtattcttctgcaaactaaacttgaagacttgagaactgtctttactactttgcctgcttttccttttgtgtcttcctctccccctcattcatcacctatttcttcacacctttcagttctcatcttgattatccatgtctccagtatactttctgttatcccaactggatatatccttgttattgtggtactgaagataatgcttttcacacattttattacttgcttatattttatctttcaacatagagtttaaggaatgtggggacagaaactatgtctacttttcttgtcttcttaaaatccaaagcagtggtttgtgtgaagcactttataagtattctttggttgaataactaatactttcttatatgttgcaaaatgaaggctttaatttgaacattactaggttcagatagtctctagtagtactcttttttctgtagtaataatgaaattcatataattgtgatgatatagaaataggaatctttaattggcatctggtttaccccacccactaaacatctttctttcacttcaagcaaaaacactgaaagaagaatatagtatcattcccaccaaaaatttaagacaaacaaaacaaaacaaaacaaaacaaacaggtttttttttttttttttttacctttggcagggattttgcaggtttgccgtgaagttttccaacaaagtgaacattttgtaagtgtgggtgaggaaattaaaaattcctgtagttttgaagaagctttgtttcacttttctccattatctcagataatgtagtattttttcataatgggaaaaaggaaaacaaaggcatatgacacaagataattgttatgagaatacaactgataattatctgaaaggagttagaataatgtagccaaagatatataaattgtctatgcttagataaaacaatatacatgtatttatacctggggataatttagtttttgtgcattatctattttgctcatatgtatttacaagaaagaccaagtgctaagagaattgtgggagaaaacttattcttctatcacatcagtgtattcgccatcgtaaaccataattaaaataaaccttagagaataaaacatgcatttgtttactctataaagcagcaatagtaatagatatacacttaaaacaagtctttgaggtccatgatcaatggattctactctactcataaaaaacaattttctaagaagtactcaatttttttcaaaaattaagctagtcccttgatcttttgttcttcaagtgaactgttgagtattttgtgagtatggctgaaatccttgtacctactactgctttgggttcatgctaaggtcttaataatgttagattttaagtaaacatattgtcaaatagcagctgaaattttttcagaaattattgaaatagagacttttgcctaacatggatttcactcatattgttcttagtgaagagacatagttaaaaaaaaaactatacagaagtaacttgatgttcacatttcaacagatgtttgactttaagacaaatgattttcaatcctttaatgaaggagtataaagatactagaaacttcaaattacctgcattgatttttgagtctttgatagagaaattgtatcgttcaattgtgaaggaaacattatggtactgtgggaaaatattttaatttctaaataagggacctgagatacacaattcaaaacaatcccctcaatgctaactagatagttgtgctagaaaaatgcataactcctcaatctacatgtctgcattcagcaggatgtttcttgatgtgtctaatgacttttcttaaatgaaaaatatgtcaagtaaaatggatgtgtgattgctgaaagaaatcctaatgacattaatttataggtttatgagttcctggagtgtgctgtattagtgatgaccacagggttctaacagatgctataatgtaagtctttccataatatttgtgagattgatagattattttatattttcatttcctcatttcttttattgaaaaacagtacttctctgactttatacgtacttaccttctgttttagttaattttcacactgttgacaaagacatactcaagatgggataaaaagaagtttgaaggactcacagttccacgtggctgggaaggcatcacaatcatggtggaatgcaaagagcaagccacgtcttacatggatggcagcaggcaaagagagagaacttgtgcagggaaactaccccttataaaaccatcagctattgtcagacttattcactatcatgagaacagcacaggaaagacctgcctccatgattcaattacctcttactaggaccctctcacagcacatgggaatacaagatgagatgtgggtggggacacagtcaagccatgtcattctgcccctggcccctcccaaatctcatgtccccacatttcaaaaccaatcatgccttacagacagtcctccaaagtcttaactaatttcagtattaactcagaggtccacagcccaaagtctcatctgagatgagacaagtgtcttctgcctatgaacctgtagaatcaaaagcaagttagttaattcccagatacaatgagggtaccagcattggataaatacagatatttcaaatgggagaaattggctaaaatgaaggggctacaggccccatgcatgccagaaatccaacagggcagtcattaagccttaaaattacaaaatgatcttttttgacttcatgtctcacatccaggtcacactgatgcaagaggtgggtttccatggccttgggcagctccacacctgtggctttgcagggtgcagcctcccccccagctgctttaaagggctggcattgagtgtctttagcttttccaggtgcatggtgcaagttgttggtggatctaccactcaggtgtctggaggatggtggcccttttctcacagctcctttaggcagtgtctgagaagcaactcagtgggagttccaactccacattttccttcttgaagtccctaggctacacagaatactgggacgatttttttctttctagcccaccaggcctgtgatggaaggggctgccgtgaaggcctgacatgctctgaagacatttcccccattgtcttggtgattaacatttggctcctcattacttatgcaaatttctgcagccagcttgaatttttcctcagaagaagttaactcttatggtttaatgtaaacacagtatattaaaagtctaagtatgtgcatggcaaagagacaaacaacttgctctttacttgagtctttaatgtcccttttatgtttgtaaatgctattatccaggtagtatcaataattttgcgtggatgagtcacttattttatgtaatatattttacaatagtgtcaagaacattcacagtgagaagttcctttagttctgcaatcactttgagatggaattaaagatgaaaataattatatgagtatatcagcatttcttggatattgtgcttcaaggaattttttggtaaaagttgacatataattgctatgctatacaatttactgattattttgtaaaatccattatttgtggtatattcacagaattgtacatccatgacaacaatcagtttcagagcatttttatttgtatcacaaaataaaccctgtactctttagtattttttcctcaccctgagtttctgcatttctcctgccctgctcaattgctaattaaatttgtatctatagatttgcctattctggaaattttaaaataaatataatcgtacaatatatagtttcttgtgactggcttccttcatttagcataacattttaaaggttcatttatgatgtagcatatgtaaggacttcattcctttttaatggcaaaataaacattttatatatgagcatacacattttatcgatttatttatcagttgatggacattaatttttccctatttttggctagtatgaataatgatgcttatgaacaagcttagtgtaactgtgttttcatttctgtcagatacatattcttagaagtagaattgctgtgttgtgtttccttgcatgtttagctataaaaggttaaactgtacgtgtaaacttttgagaaattgctagactgttttccaatgtggttgcaccattttccattcccatcagcaatgtgtaagtgttacaatgtctccacatcgttttcaacaaatgattatgtgtctttttattacagctaggctggtgggttgaagtagtgtcttgtggggaaaagaaagagagatcagactgttactgtgtctatgtagaaagaagtagacataagagactccattttgttctgtactaagaaaaaatcttctgccttgagatgcagttaatcgataacactagccccaaccctgtgctggcagagacatgtgctgtgttgactcaaggtttaatggatttagggctatgcagtatgtgctttgttaaacaagtgcttgaaggcaatatgtttgttagaagtcatcaccactctcttatctcaagtacccaggcacacaatacactgcggaaggccacagggacctctgcttaggaaagccaggtattgtaaaaggtttctccccatgcgatagcctgagatatggcctcgtgggaagggaaagacctgaccatcccccagcccaacacccgtaaagggtctgtgctgaggaggattagtaaaagaggaaggcctctttgcagttgagataagaggaagtcatctgtctcctgctaatccctgggcaatggaatgtctcattgtaaaacccgattgcatgttccatttactaagataggagaaaaccaccttagggctggaggtaagacatgctggtgacaatactgctctttaatgcaccgagatgtttatgtatgtgcacatcaaagcacagcaccttttcttaaccttgtttatgacacagagacatttgttcacatgttttcctgctgaccctctccccactataaccctattgtcctgccacatccccctctcgagatagtagagataatgatcaaaaaatactgagggaactcagagaccagtgccagtgtgggtcctctgtatgctaagtgccggtccgcagggcccacttttctttctctatactttgtctctctgtctctttcttttctcagtctcttggcccacctgacaagaaacacccacaggtgtggaggggctggcccccttcagtatctcattgttgattatatttccttggtgtctaatgatgttgaacattttgactttgcttataagccactgtattttttttcttttttggagaaatttctattcacatccattgcccatttttaattaatttctttttcttattaagttgtaagtcgtatttctgatacaagtacttcattagttatatcatttgaaaatagattctaagattatgtgggcttttgttttcttgatgctgtcctttgaagcacaaaagtactaaatttgataaagacctatttatatatttttcatatttgattgcttatgcttttgatgtcatatgtaagaaaccactgccaaattcaaagccatgaagattatcttctgtgtgttctttttggaattttatgattctacctcttaaatttaagcctttgacctacttttagtagttttgtaaatggcttgagaccagaagtcaaactttattcttttgtttgtgggcaatccgttattcaataagcatttgttcaagactgttcaattttttcattgaattgttttggcatctttgtaaaaaaccataaatatgtgggtatgtttctgggttctaaaatctattttgtttgtatatatgtctatttgtatgcctataccaggctcatttgattattatagatttgtagttggctttgaaagaagaaagtgtaaatcttccaactttgttattattattattattattttcagacaggatcttactctgtttcccaggctgaagtagagtggtgtgatcatggctcactgcagccttgaactcccaggctcaagcaatcctatcaccttagcctactgagttgctaggaccacaggcatgtgtcacctctcctggctaatatattattattagtattataaagacaagagtctccttatgttgcccaggctggtcttaaactcctttgctcaagtgatctacctgccttggcatcacaaagtacaactttgttctttattttaagacttttttggctatctttaggtttcttgaatatctttgtgaatttcagaattagtttgtcaatttactggaagaagccagttgggattttgatagggattgcattaaatctgtatatctatttggggagtggagtatggacactacaacaatactgtgttttaatctgtgaagatgagatgtctttccatttatttacatcttttaaatttctttcctctatgctttacagtatccataatgcaagttttacacttattttgttaaaattgattcctaatagttatattcttttggatgttatttgaagtgcaattgttttcttaatttcattttggatatttcattgcaattatgtaaagtaatttttttgtttattgatcttttatcctgaaaatttgctttgtttattgttccaatattttttctagcagattcctaaagattttctagatgtaaggtcatgtcatatgccaaaagtttaacttctttcttttcaatgtagatttatttttttcattttcttgcctttatcttgactagaagctccattaaaatattcaatatagataaagagtggatttagtctttctccattaagtatgatgttagctgtgcattttttatagataacacttaccagtttgagaaagtttccctctatccctactttacggggtactgttataatgaaggatattgaattttattaaattaatttttctgcatttattgagatgatcatgcagttttatttctctgttctaattacattttgtattatgttaatagagattttaacgttaaagcaactttgcatttttaataaaacttttacttattcagggtatataattgcttctgtatattcttacattcattttgctagcaaattttgtggatttctgagttcataatcataagatttatcgatctgtagtttttattttttgtgatatctttgtgtggttttactagaaggaattagttaaatatgttgataatgcatttttcttttctgtgatttgaaggattatttttgaggaattgttaatttttctgctttaaatgacttatagatttcaaaataaaggcatcttgacctaggcaattctttgtgggttgtattttggaccaattcagcctctctttttgttataggtctattcagatgttctgtttctttttgaatcagtttaatatattttcttgtctgtgtcttcctgtagtagaatttatgtcaaattaagttgggagtgggtgagggagcagttcatggttgaaattaataggctctcattatttttaccaggacttagtagattttcttgaataaatattgctaatattacgctttataattttaggtcaatgcctggacactttaattttttatagaaaacacaatattttaatgctaaagatgtgtttaaattgtttcttttttacaattgtgatgttctatgaagatttaaacttttgactgttaacagatgatttaaatagaaatgtagcatatgtactcagtgtacatgtgtatattcagcttgtcagcattgagttatctttcataaacttatatttatttatttgacacaaccaggtgggaggggttcccagagaaacaccagagagcctgtgcactgggaggagtgcacactggggtggagccacagaagttcatatgatttgcagtgaggaggagcccggcccctcctcttcttggatggaacctggaattcagtctgtgaggtggcaaacccaccggcaggaaaacacactctctcacttcactaagagcctctgttttgccttttcttcctttttacctaacaaaactctgcattattcaccttcaaagtccgtgtgcctaatttttcatggccatgtgacaagaaccttgcttttagttgaactaagaaaaagtcccacaacatatagatacacacacacacacacacacacacacaggcaaaaatgcaaaaacattcctcattttattttgttttacagatatggtcttttttacaaattgaaagcttattgctgccctgcattgggcaagtttaccagtgccatctttccaacaggatgtgctaactctgtcactgtggcacattttggtaaatttcacaaagttccaaacatttttattattattatatttattatgatgagttgtgttaactgattgttgattttactgtagtattgtgttgcgggcaccagaaactgtattgggataatacgataaacttaactgataagtgctggtgtcttctgactgctctaccaaccagcctttcccccatttctctctctctccttaggcctctctatttcccgaggcacagcaatgttgaaatcaggcaaattagtaatcctacaaatggcctctaaatgttcaagggaaaggaaggctctgtcatctcaatatcaaaagctggaaatgattaaacttattaagaaaggcatgttgaaagctgatacaggctcagatctgtacctcttatgccaaatagttagccaagttgtgaatataaaaaaaaaatttgggaaagacattaaaagtgctacacatgtacacatgaatgatatgaaagtgcaacagccttgttggctggataaaagatcaaaccagtgacaatagtccccaaatttagacaaagcctaaaccagaacaaggccataattctctccaatgctgacaggggtgaagaagaaatctttgaatctagcagtggttggttcacgaagtttaagggaataaaccatctccataacataaaagtgcaaaataaaagaagctacagaagattatccagaagatgtagccaaaatagttactgaaagtggccacactaaacaggagatttttccttgtgtacagagcatctttctcttgaaagaagataacatttagcttttttatatcttcacaggagaagtcaatgtctagcttcaatgcttcaaaggacaggatgactctttcattagaggctaatgcagctggtggcttgaagttgaagccaatttttttttttttttgagatggagtcttgctctgtcacccaggctggagtgcagtggcaccatctcagttcagtgcaagctccacctcccaggttcatgccattctcctgcctcagcctcccgagtagctgagactacaggcaaccgccaccacgcctggctaattttttgtatttttagtagagacggggtttcactgtggtcttgatctcctgacttcatgatccacccacctcggcctcccaaagtggtgggattacaggcatgagccaccgcacccggttgaagtcactgtttatttaccatttggaatatcctagggccttagataaattattctaaatctactctctctgtgctctattaatggaatatcaaagcttggttgataacacatttctttacagcataaattactaaatattttaatcccactgttgagatctattgaccagaaagaaatattcctttagaaatattagcattcattgacaatgtacctggtcacccaagagctcttatggagatatacagggagatcaatgttgtttttatgcctggtaatacaacattctttctgtaacacatatatcaaaaagtaatttcaacttttaagtcaattaaggaataagtttcgtaagattattgctgccattaacagcaatttctctgttggacgttgtcaaagtaaattcaacactttctggaaaagtttcacctttctagatgatattaagaacatttgagtcattaaatgaagtaaacatatcaacattaacaggaatttggcagaatttgatttcaaatatcatagataatgttgagagcttcaagaattcaatggaagaagtaaccacagatatggtagaaatagtaagggaactattactggaattaaaagaagaacctgaagttgtgactgaattgctataatctcatgataaaacttgaatagatgagttctttcttatggatcagcaaaaaaatttggtatagtgagatagaacctactcctggtgaagatgctgtgaacattgttgaaatgacaacaaagtacttagaatattacttaaggttatttgataaagcagcagtagggtttaagtggattgattccaactttaaaagaagttctatcatgagtaaaatgctaccaaattgcattgcatgctgcagataaatccaagtcaaaatcacaatgagatgctaactcaagccagtcagaatggctatttttaataagtcaaaaacaacagatgctggtgagattgtggagaaaaaggaacacttttacactgttggtgagagtttaaatttgttcaaccattgtgaaagacagtgtggtgattcctgaaagacctagaggcagaaatataatttttcccagcaatcccattactaggtgtatacccaaagtaacataaattgttctattataaagacacatgcatgcatatgttcgttgtggcaatattcacaatagcaaagacatggactcaacctaaatgcccatcaatgacagactggacaaagaaaatgtggtacatattctccttggaatactatgcatccctaaaaaagaatgagatcatatcctttgcagggacatggttggagttggaggctgttattcatagcaaaataatgcagaaacagataaccaaataccacatgtcctaacttatatgtgatagctaaataatgagaagatatggatacatggggggtaaaaacacacagtggggacttttggaggtcaggggatgcgaggagggagaggatcagaaagaatagctaatggattctaggcttaatacctgggtaatgggatgatctgtgcagcaaaccacgatggcacacgtttaccttgtaacaaacctggacatcctgcacatgtaccttgaactttaaataaaagttggaaatttttaaagaaggaaggtcaatgggtgcagcaaacattatttttgtctttttaaaagacattgccacagctccccaaactttcagcagccaccaccctgattagttagcagctgtcatcatcaatgcaagaccctccacctacaaaatgattacaactcactgcaggctcagatgattgttaggatttttaaagcaatgaagtattttcattacagtgtgtacattatttgtaacatatttatattgcagacttaagagactacagtatagtgtaaacataacatctatatgccatggaaaaccagaaaattttgtttgacttactttacttcagtgttctgggaccaaatctgcaatatcttggaagtatgtcttgtataagtgaaaataaaatgagatctactcttttaaaagtattttaagtgtatgatacattattgttaactatggccacaatgttgtgcagcagtgctctgaaacctgctcatcttatttttactggaactttatactcattgaaaagcaactctcaatttcctccattctccagccactggtaacctccattctactctccgtttctttgagtctgactgtttcaaatttcttacacaagtagaatcatagagtatgtgtcccattgagactggcttatttcacttaaaattatttcctgaaggttcatctatgttgttacatattgcaggatgggtggatcatatggaagttctatttttaattttttgagcaacctctacactgttttcattttggctgtaaaaatttatattcacactgacagtgtatgaaagtttcaatttctccatttcctagccaacaacttttattgtgtgtgtatatatgtatgtgtgtgtttgtgtctgtatgttgataaagacatggtaagaggtatgaggtgatatctcattgcagttttgattttcctgatgatgaatttacattaattagttttcatacagctgttgtccatatgtacaacttcctcagagaaatgtctttttcaagtatttgcctatttattaatcatggctttttttctctttttgctattgagttgttgcagttcctaatatattttaggtgttaacctctcatgagatatatgatttgaaagtgtttcccattcccattttatcttttcactctgttgacttctttgctctgcagaaactttttagtttgatgcaattctactttcatatatttgaccttgttacctgtacttctgaggtcatacccaatagaccattgcccagcccaatgtcataaaactttttccgtgttttattgtgagagttttatagtttcagggcttatgtttaagtctttcatttgttttgtgttgatttttgtatatgacataaactaagggtccaattttattcttttgcatgtggacatctggtgttctcatgcagtaccgtttcttgaagagagtgacatttattgagtatatttgagactcattgaatataagtgcattgtatatttgtgactttatcatctgggctctctattctgttacttaaatctctctctatttatgtctttatgtgaatatcatgttattttaataactgtagcttttaatatattttgaaataaggagatgtgatgccctataactgtgttttacttttcccacattgttttggctagttacttcttcctggatcattatacattttaagatttttttgtctttgtataagtcattggtgtttcgatagagattacatttaatatgttaatcactttaggttgtatagatgtttctgtaacattaaatcttccggtcaatatactatgtctttctaaattagtataatctttaatttcattcatcagtgttttgtagtttttagtatacatgtctttcttccacttgttacagtttattcttatgtattttgtcctttttgaggccattgcaaattggagtgttttgttaatttccttttctgatagttctttgttaatacacagaaaggtaagtgatttttgtatgctgattttatatgctgcaaatttactgaatttatgcacttgttctaataatatttggtggcatctttagggttttccacatataatatcatgtcctctgcaaacagaggttattttactgttgattcagaagcctgttgctttttttctttttcttgcctaattgttccggctaggatttccagtatggtgtataatagaagcagcaagagtgaacatcctttccttattgtgaaaacagatgaaaagttttcagtttttttttaatcattgagtatgatgttagctatgagcttttcatatattgcctttatcaggttaagataatttccttctatttcttgttgcaggaagtcagggaccctgaatggagggactggctggagctgaggcagaacatcataaattgtgaagatttcatggacatttatctgttccaaaaattaatacttttataatttcttatgcctgtctttactgcaatctctgaacataaattgtgaagatttcatggacatttatcacttccctaataatactattataatttcttacgcttgtctttactttaatctcttaatcctgttgtcttcataagttgagaatgtatgtcacctcaggaccactattgtacaaattggttgtagaacatgtgtgtttgaacaatatgacatctgtttgtaaaacatatatgtttgaacaatatgaaatcagtgtaccctgaaaaacaacagaataacagcaattttcagggaacaagggaagataaccataaggtctgactgcctgaggggttgggcagaataagccatatgtttcttcttgcagaaagcctataaatggatgtgcaaggaggagaaataccgctgaattcttttcccagcaaggagtaaccctggggaaggaatgcattcctggggagaggtctatgaatggccactctgggagtgtctgtcttatgcggttgagaaaaggactgaaatatgccctggtctcctgcagtaccctcaggcttactaggattgggaaattccagcctggtaaattctagctagactagttctctgctctcaaaccctgtttcctgttaagatgtttataaaaacaatatgggaacagcaggacatagagcctcatcagtaattctaattctgcctttgccttgtgatctatatggccctttgaagcatgtgatccttgtgacctactccctgtttatacaccccctcctcttttaaaatccctaataaaaagttgctggttttgcagctcagggtcgtctgcacagtcctaccaatatgcgatgtcaaccctggaggcccagctgtaaaatttctctctttttactcttactctttatttctcagaccagtcaccaattagggaaaatagaaaagacctacattgaaatattgggggcttgttcccccgatatcatttctatttctagtttgtttagagctctcttttaaaaactcataaacaattgatttttttcaaatgctttgttttgcatttactgatatatcaagtgatttttatgcatcattgggttaaggtgatatgtcacatttgctcatttttgtgtgttctattatccttaaatctagggataaatttgtcatttcttttaggaaagaagcaatgctgagtcttgaacatagtaaaagccaagcaacactactggtcttgtaatatcaaaaggaagagtgagactttcttcacaatttaattattgagtagtttctttgcaacagtaaaaacaacaaaattctgctgaaaatgaaaccaaagaattctgagtatttgcaaaatggtattaatattgtgaacggatgtcttaatattgggtcaatgtataaagtgtgaaacacagctcagtaatttttgtgcatgtgccacttgtgaatagaataatgtatttcacataaacccatatggttttacattattttttatttttccttgtttttaagtatttgactaagaatatttctaacttttaaataggtactaaatctctggaaaataaattttgacctaacagtgtaagttataaaaatatgttttgtcacaggaggaaggaaatcctctgtatcaacctcttcatgctggaattaactgaaggaattctatcttttggtcattccagcttcaagccttttatgtaactaatcccttttctccttctttcctgttttagcaaactttcagaaagaaaacaggcaacatcttgtgatgatgaagatcacagttgacacataggccagcaggaacctaatcacatgcaagttgtggtattggaaccaggtgaggtcgtgggctgcaacccgaaggtgcttggctcctttgtgctgcatgacaaactcaatccagaaggctgcttgatccaggggcttaattggcaaatcatggcgaattattgataacttcatagcattctctttgtagctgaaggataaacataaaaataccaacattgaaagtaaatttatttcctaagtctatggatggtctttgaaaagtgtcacatcaatgcttcaaagtaaatattatagaattgtcataggaatcgaatgttttggtttggacaaatgtagaaagtttattttttaaaatggaattttataaagaaaaatatgtcttaaattaaaaatggaaggtctgatgagaaagttaatgtctttgtagcagaggaaatattttgagccattctatgtgctacaggtaagacagtggaaatgcaatctgagattgatcatcttgatattttattttatttttttttgagaaagagtctttctctacggcccagattggagtgcagtggcatgattatgggtcacagcagcctccacagtgtgggcttaaacaatcctcccacctctgcctcctgagtagctgggactgcaggcatgcaccactttgcccagtaatttttaaatatttttttgtagagatggagtcctaccagtttgcccaggatggtttcaaactcttgggctcatgtgatccttttgctttagccttccaaatttctgggactacaggtgtgaactacctttatcgacccattttgatatttttaaggaaaaattgtttcacagctggtgtaatatttctaaattagtctttctctttctaccctactattctgtgttctaccatattttcctctcagtagtcagaataattttttgaaataaaagccagattatggcattcctctgataagattttcacctggcttctcactatattaagaataaaatctaaatctgtctttgttctacagaaccctacatggtcaggcatgggcaacttcttctaacactttccccaaccaccttctctcctagaggcattgcccttctattgttctttgagctccccaatgtgttctcacctgagcccctttacaccctttatcccctctctccctctcttggaatattcctccttgcaacaacttgaggcttgcttctatatctttttgaggcttccccttaaataatacctgttaaagaggcttttcgtggccacactatggtagtacctgtaggatttcctctattgttttgtgcttattttgctgtttaactcctggaacttaaaaatatgttacatgtcttctcaaataaaactttaagtataaaatacataaatgtacacaaattcagtgaatagctcaaaattttaacattaccttgaacaatatcctgatgtgaacaccaacttacctactacgcagattataatataagacatcacaacctgcctagaaaaactctgtcttcttgggccattttagtcactacttttgtcctcaagttaaaactaccttgacttctaatagattaatattgcttgtttacataatgaattatataatatatactcatttgtgtctttttttgggtagaagttattggctaattccattgctgtaatatgattcagtcaattgacaaataccacagattatctcctatttttatgactgatggatatttgggttgttaagatttttgaacactattactaattctggagtaagcaaatgtgtgtatatcattagatatacatattaatacatttttgatgggtatatacttgagagatgagttgctgagaaaaagatgcatgtagaattatgatgttttgttgactagctttttaaatacacaaatttaatttccaaaatttagagttgttttttaagttataattttttggataatttcgaatttatttctagtatggctagagcatttcctttttatgctttcgaatcttatcacatttgctaagtcctgatttttggcccagcagaagttcaattcactaactattccatatactcttaataaacgtatattctcaatatacattcacactcacctccacacctccacacataaaaatgtgtgtgtatatatatatatacacacatatacacaaacttactatatatatacacaatacatatatatgtatacacacacatatatacaataggttatatttatgctcttcaaatgtttatttttaagtcacttttttttctctgtttaaatttagtatgagttctagtagatttacttttaaatctactatcttattctgtattttattttctgttttccaatctgctgtatgtttcttttctaattctttcctgtttgcttttaaactatttttaatcattcactgtcttattatcttcctggtaaggtattttcagtatattttctaaggtggtacctccatatatatattgataatagtaatcaatagtcacagcattttctacattatttcttttggagcacagaaaaattattacagatttattttctcaatattaaaactttgtgcttcaagggacatcttcaataaagtaaaaaaaaagaatcaacctataaagagtgggagaaaatatttaaaaatcatagactgacaaggcattccaccaataatataaaaataattcttatgaatgaataataagataaaaatgttagaaatgttcaaaagataggaataaaattttctcaaaagaagacgaatgacttgccagtaagtgcatgaaaagatggttatgtctttagccacaaggaaaatgcaaattaaatccacaatgaaagatcattttatatccactgggatccctgtaacaaaaagataggagataacaagtgtagggaagagcatgaagaaattggaaccctcctgtacagctagaagtaacgaaaaacggtgcaagtactttgaaaaacagtttagcagttcttcataaacatcaactttccatatggctcagaaattccactcctagtatcttctcaaaattagtgaaaacaacttttttcacaaaaaatatgtatagcagtgtttataagagctaaaattggaaataactgaaatgtctgagagctgataaatgggtaaattcaaaatggtacattcatcaaagaatattagcaataaaaagaaaaaatgttctgacactttcaacaatatgggtgaaactaataaaagacattgtactaagtcaaagaaatcatttatagaacactgtaaattgtatgatttaatttacatgaaatatccagagagaataatctattgagaaagtaagttgatatttccctaggactggaggtttatcaacagtgattttatgcattttgaggtttattttagggtgataaaaatgttcaaaaattatattatggtgatggctttgtaactatgtaaatgtactaactacttttagatctcacttttaaataggtaaatattatgctatgcaaattgtatcttaaaataatgataatactaaaaatacattattgagcatgaatacagttatactttcagaaattttatgtattgaattgaaatactttattttatttctccaagttcattatttcattgtattataatccatcattcaaaaaacttatattttaaacaattatctatatatgtttaaaaatatttgtgtgtagaaggttgttacagtaattggtgacccattaaatatatgggatcaaatgtaactaaaataattggtgaaaaataaaagcaggtttcaagttggttaaattatttaaattctttcaaaattggtctcctaaaaggggtaagacatgtattcagtgttgtcaaaagaatctgtaaataccacatagtaaaaaaaattgtcatactcacacagggtcattaatgactgtcttcagtgcattgagcaaatctgtacttgacatggtcctgatgtccacattgagggccttcatgtgagcaatgttatcaggttgatctgcaaacaaaggaatgcccaccatagggatcccatggtagattgcctcatagatgccactggtttcaccatgagtcataaaagatttagtttttggatgacctaggattggataaattttagcaaaattattcataagactaaaatgagaaatgcacaatagaatgctctgaaaggggcagtgtctactaaataacagattattatacacatcaaactccattagaattgctttcagatttcagagaaagaagcacctaattcttctggaggtaagtgaaggctacatgaagaggtgggggcgtgtgtgacttcagactcaaaaaatgaattgatattgccaggtggacaaaatgaaaaagcacattctgaatgaaaaaaatgtgcaaaaaaaaagagaaaagaaaatcaataatattgtgtatgttagagcattttcccttaaatacatactgcggtctgagtgggatatgtggtgtatgcaaggcaacagggagtgtggtggtggtattggaatagaagaaaggcaggccacattacatcaggaaacgtgttatcactttatgataaagattgaggatttaggccgggtgcggaggctcatgcctataatcccagcactttgagaggcagaggtgggtggatcacctgaggtcaggagttcgagaccagcctggccaacatggtgaaacctggtctctactaaaaatacaaaaattagagaggcttggtggcaggtgcctgtaatcccagctactcgggaagctgaggcaggagaatcgcttgaacctgggaggtgaaggttgcagtgagccaaggtcatgccaatgcactccagcctggggacaagagtgagacttcatctcaaaaaaaaaaaaagattgagtatttattttcagaaaatgcagagttattggtaataaaagaggcactgttattttttagtgtcttttgaaattaaccctgaagtagggaaaaggacaggtgtaaagctgtacaaataggagacagagagacaatccaggaagttattgggaaaccccgtgagaggtaattatatctgaaataaagataatttgattctgaacataaagaatgtgagtgtctataataaaataccaactatatagttattttcctggtaagactggaaaataaatataaagtagttagcctttatatttgagttttttgataataaatgttccgtaagtttctttcaggttgaactatccttctaattagctgttagtcatatattcagtatttgttctgcagagtattaccaagaaggtcattctgggatatccacttgtacagctgagtattggatgctaaagtatttggtctctttccatccacagaacctgttggggtaaagaaaatatcttgttccatgagtagaatgccaaagctataagatgttagaactctaaagaaattgtcaatcagctagttaaaccccttccatataatagatgaaaaaacgagaacaagcaattttaggaaatgagtactactaaaagactattgaatatccacatttcatgtcttttattatcaatttggtatattagaaaatcatgatgttttcaacagagaagcttagacacttgagagtatcaataaaaaattcaaaaatttaagaaattattagacagtcattataattctactgtaaaatacagtaacaaattagtgacaacctatacatttattttatgtattttatactacctgtaatcttccaaatttaatgttagtttatttcttgagtgaaatgagaagtgttacttatatatatttttctgtaagttattttgttagtgtttgacatctttgatttataaaaaacaaaatctataaaatcagctacctgtgagaaataaatcagtgctacataggtagtacatataacttcttgtagattacacattacccagcactacatccaagaaaaatttcaagtgacaatttctttcttttcttttcttttttcttttctttctttttttttttttttttgagatggagtcttgctctgttgcccaggctggagtgcagtggcaccatctcagctcactgcaaccctcgcctcctgggttcaagcgatttttctgcctcagcctcccaagtagctgggattacaggcatgcactgccatgcccagctaatttttatattttttagtagagacggggtttcaccatgttggccgggctggtctcgaactcctgacctcaagtgatctgcccacctaggcatcccaaagtgcaagtggcaatttctgagtcaaattcaaagtactatcattttgctagttttggaaattcttccaatgtaggcgaaaagagccaattggcaatttatgaataagaatatacacactaaaaattgtaaaattatattttgctaaattttgcttaactgatcattaacacttagatgctgctataaagcatcgacagcatagattaatatgggctgctttagccaagccatacccatagacagtaccaaaataagatactgattttagattccccaagcaatccttataaactggagtgtaatttacaagtgttttccttgtatttgctatgtgagtgttaaagtaactttgtgtttccagaaaaaaattagcataggtcattaggagaaggctatgtcagagaggaaactaaaaagtaactcacaaatacacaaagacttcaagtgtattctgcatactacaaaataagttcctactatatttcatggagtgagggcatctgaacctctttccatgcctggcttccttctgcttgactccttcttatattcccttctccttcctccgttgggaggaggtgtttttctgatggttagagcagaggctttatgggaccacattttataatgcacggagtctaccctaaaagcaggattctgttccctccttttctatcatattttcctgtttaagacattagcaaggcccagtaaacagggcaggcaagttcttctgcttctctaaatctacttggctaggtggatacctccagaatagcggtttgtcagcctggacatcttttctctgaatgcattctgaattgcctactaaataggtctattccaaaatgtacaggaagtacaggagaccagattacctagcaagcctaaattgaatgatgcatttcagacttttttcaataccttattgttattgtaatagtgcagtaactgattaaaatgtaagtgattttaaataatatctatagtgtataccatgttctcaggaaacttgtaagcaaaagggacaaatgacagggcagaatttggtgatttctatgtacatgcctacaatactatgataataccacaacttcacctgcacctcttaaatatattttttctgatcacaatattaatgtcagaatttttatcaatcaaacacaccctcgttattttagtatcttccatatatatttttgtttttgaaccaatatctgagataattagagctatcatatcagttagtttttctggcagaaaatttctgtgattggactctttacagagtttaacagactcattcagtagctgtccaccattaagacattttatctaacctttcgtggaatctgggcaagagctgatgcaatcacgttggccctttcttctgtgatgttactgaccatagacttaagcaagactgccacgacaccattttctccagagctctgcacaaactcttccattttctgtgaagaatttgttctatcacaaaagagtgtcagcatagcaaacactatagaaaagattagtacatacatctaagaagagaaaatcaagcattatcagaaatttttggagtaatggctattttttaactgacctaatctctttctttggaagaagttatggaatatgatatacatggcatctgttatggctatttgtgtaaatatgtgtgtctgtaaaaggaaaagatgaaaaacaactatgacactatagaagaaggagacaatgctagaaaatattatacccagactcttcatttacaatactgtaattactaatatgggttcttggaaggtggcatttgttgtgtttaattccatatgttgtagttctactaaattccttgtgtctattaaggcagggttttttgtttgtttgtttgtttgttctttctgtagagtatttttagttgggagtcattggaaccattacctggctatgagcagtgaggaaaagttactattgaaataattttatatgtctatttctttagctctgtaattctttatacctcatttaaaacttgtcagattatgtctttttccctaaaaaaaaatctttaaaagctgaagtttaataatgatggagattcaagagtctgatactgtggtgtgaaatttctgtgaactagtcctgagaatcccatttataatacagaattatgcagtatatagttacataactgagtgattgtatttctcaggtcattgtttaaatattactaagacactttttttcctgaaatcacactgcataaaatgatatgctactggccaggcatggtggctcacacctgtaatcctagcactttgggaggtcgagatgggcagatcaccaggtcaagagattgggaccatcctggccaacatggtgaaactctgtctctactaaaaatacaaaaattagctgggcgtggtggcacacacctgtaatcccagatactcgggaggctgcggcaggagaattgcttgaacccgggaggtggaggttgcagtgagccgagattgtgccgctgcactccagcctgggcgacccagcgagactccatctcaaaacaaaacaaaacaaacaaaccaaacaaacaactgatgtgctacctataactgcctgtgagggaccctcatcatcacttttctgtgtctcacaggggcacttaatcctcagtggaagaatctaccagtcatttttccagtggagatctcttcactatcttgagtagctcattcacacaatataaagcccttgttgaatatgtgtttgcttgaaatttattgagaattactctgaattgtggtttcccttatgttctcatttgtaaatgtaaatgcatagtgtaattccacattgctcagtgcatacgcctatcaagacaaaataaagagaaagagaaatgtagcgccaaaagttttcagtatataatgtcaaaattgaatacccatctttttgttgttgttgtttcttttgttttccatttattatttatttattttctctgtaaaataatgatgaacccattctgacataaccggtatactttcagatcctaaacatgggaggtaaactttcttttaaaaacttgtttaaaaaaagaaatcctaaagtttgtgtatgcacaacatattttgccaagtatttttcaaaaatataatttgagccttatgacattagttttaattggagagtcactgtactactattccaggtagttcttggggctcccaggtattctgtgtgactcgttacctgtgtgaacacaaagtatctgaaacagttctcaatttagaaagtttattttgccaaggataaggacatgctcatgacactgcctcagaaagtctcaatgacacgtgctcaaggtggttggggcacagcttggttttacacattttagcagacatgagacatcaatcaatatgcgtatgatgtacattggtttggtcaggaaaggtggggcaattcaaagtgatgccttcatgtcatagataagagttaaaaggttgcattcttttttgggtcttagatgagccttttgctgaatacacagtatacatatgagagaagggttgagaaatagtcacttatgccttagtctgactcagtaaatctgcattttttccataaacaatggtgaagggatggctttgagttctgtcctcttttgtccctcacctgtgaagataagctatcaatttacatttccagggtgaaattcaacagaaatgtttcaggttaaagattttgaggcccacaaggaatttcctcttgggaagattgtaagggaggtatgtaacttaaaaacaacaacaacaacaacaacaacaaaaacccaactttgtagctattttatttaggaataaaatgggaggcaggtttggctgatacagtttccagcttgacttccctttgacttagtgactttgggttttcaagattatttttctttcagacctgtagccacatttaatggaacttgtgtttgatgttttttctcaatgcctcgctgcccagagtcttcttcatccacccaatattgaggtagcatattgtctgtttatacactcatcagtgatctcattctgggatatcttcatgaaaataatatatcagtgtacaaaatattaaagtatgaaaagcttaaaaaaattaaatttccctcatactctctgtctagagctattcctgatttaaatttgtatgcttttattatggtttttattctatttatataattcactgtgatgtttatttagataattttaatcttattgtatattccttttcatcctgcataaaaattgtgatctagttctattcatcattttgtttctcagtttccgacaattcttgtattatagctgacactgtaattatacatattttgataaaatgattgtaatggcatagaatgcatattgtatacatttttacatagtacccaatagtttttcaggccttctgcccttctcttccctctgtagtagtccccactgtctattgttcccatttttgtctatgtgtaccccaagcttagctcccacttttaagtgagaacacatagtatttagttttctgtttctgggttaattattctggttcatgtgtgtgtgtgtgtgtgcacaaatctccatgtatttgtttgtttatcttggctttaatctgtcattttattttcttttttcaaatgttgtctgcctatctatctatatatttatctatctaatctatctatctatctatctattatctatttatcatctatctatatatttaagaatgaggacatagaatgattcactgggatatctttgtatctgtgaaggacttagtatctggttggctttgatttttatgctgaacgcgtacaactactagaccttacctaaagggaaccaaaaatttcataaaaaagattatactttgatgtgttacatcaattctagttttctcattttaccctggtgaatttatttcaatttctttaaggaaaaactctctagtttttgtgtggaaagtgcaaagaggaacgtattatgtaatacagtaagggttagtgcatttcattttcatgtctttagtttcctttagtctgtaattatcccttcattttttgtctctgttaatttttgacttctagatgaattattgaccagttgttttgtagaatgattcttattttacatttgtttaatgttccttcatgattaagttgctatcacacattttttgaaagaatactgcagacatgttgttgtagtcttcacattacatcatttttgggcagcagatagtgttgatttgtcatgctggtgatactaactttgatttcttggttaagatgctgtctacaggtttattccctgtaaaattataatttctcattttggaattagaagtatcttgataggagactttgagactgtaaatatcctgtttccattacatcctttccctctaattttagcatccattcaaagataatttttgcctgaattaaattactgtggagtttgtctaatgattatttctatgtctataatttctttaacaattagtaagagaaattctactctaagaaagaacattttttcccttttatttccttatactggtttctgtcaatatgatttcatgagtatttggtttattccaaaggttacaatccacagctttcattattccattgctcaaattggtccagattcgattcattgggacttccttcagtttccttctatatttttctgatatgttgtcatcatgttgtatacttatttactttctggcacccctagatatttcaggcacatcctgtacttttgttgcctcaggggtaatgtcatttatatcttgaggaaggcatggttcgttttattggagtatagtgtctagaagcaaaatttcaagtacttagcatgttcattgcatctgggatattattacttctaggccatttacgcatagacattttggaaatgtatctatgcataacttttcattaacagcttaagagaataaataaattatcatttccataaaatacagaaaatggagagtgtagtaagctaaaacatggtaaatctaaatagtaaatatttacagataagctcaaactaataatttaatgtaaaaagttattttcatttaatgtcatgtaatagttatatatcaatttaaaaaagaattaaataaactcacccattatggtagagattctcagatatttcaatctagcttttatttttgtttaaaagagaaacacctaataaaaattacccatattactataaaatatatacagattttacaagaggcatatacccaatagcaaataaacgaaaattgatgcaatgctacaaaaatcaaacaaagcagaattaagatgcgaagtatcaaatgtgataagtgaatcatttcatgtggatagaaataattcacttaaaattaacaataataagtatttggagattgaaatatatctcagaaactgatagattgaacagagaaaataaattctatgaaagttgattgtattagcaacaaaagtaacaaaaataacgtactgaatcctgcatcttcaaatagagtataaatattcttttgaagtgcacatgaaaacttttataaaattaaactaaggcaatgtcacagatgaaatctccacaaattctgaagtatatatatcatatgtatctatataatgtgatacaattaaaataattataaacttaaagagaatgtattacctttcaaatatacacatttaagaatttcattcagtggagtggactgtgcttatcattcatgacccaagtctttactaccttttctgctccaaacacatataccatgaagagaagacggcatagaatatactcaggtaagtatacaactgagaaaacttacacaccagttgttagcattagagaaaattatatgaatagattcttataggagctataacaagatggttttggcaggataaaaaatgtggcaaaagccttaaaagtggaaaacaaaatttacctacggagttcagggaatttctgttctgaaaaaatgtaagttgtaataactaaaaaattaaaacaaattataatgaaactgatctctctagatgacagcagacacatgcaggaaatgaaagtttgcagaaattaacagctgttgaagattaactcatgaaaaccacatgaggaaataaccaattctacacaatagtaagattttcacccaaagtttataaatataggaaaaaatcaaaataattttttttctcagagatgagaaaatacttaacataaaaatggaattgggtgagaagcatgaatagaaagaggaacatttagaaattgtggaaattagaaatacagtcactgattgtataaaatgtaatagagttcacaaaataaaatggaaccgaatgaacgaataaaagaatgaacaaaacctgcaataaggtgaattagtaaactttctctttttctgactgaaccttgactgatagagcttccaacagaaatcacctaatactgtaggaattgccattaagctgattaaaatatgaaagtgttatttgctattaccacatgttagagccctcctgattgcctgctttacttctgaagctctgtcattatggtttcctggttttaaccactcattctatgcttcactgaaatattttgaactgattcaatgtgtttctctcaaatttaattttattctatcctgtctcttgcctcctgcaggttctcactgtgagcaatccagctccagagcttaccttctctgacctagggttcctcatttttttttttttaccagtttatctgaacttcattgatcttgttcctttgccaatcactctgagccactgtcatcatgactcaggattctagaatttgaacaaattataaatttgccctttgtatcttctgtatcccaaagaagaaccagtagacggtaccacaagagaaaaatgggtgcagtacatgaacaaaacacctgaatgaatcacaaacaaaaagagatggttgattagatttataattaagcatttgccaatcaaatcagtgattcatttttatattatttggattggtaaaatttaacatccaccatagatgaagcacgaaataactgtccactccagtgctgcataggtgggtgtacatagagggaggtagtgtttgaaggatacccctgggctcaactgactcaagctagctcagtcttggtaagagggagactggacacttctggtacagttgggctgcagacacactgtaccaactgtaagttcactttggtgagaatcttcatatgccctcacttgaaagaattttcttttccagataagtttatgccttttattcatccgaattttaccatgatgctgtgctcaatgatacaacaacatttgaggcactaaaaaatgaaaaattttaaatattgttgtctgctctaacagttttcaatttactgaaggtggaaattttacagttattaagaaataaagtaaactgaaaaaacataggtggagtgagactgagagaaaaagaaatggagagagtcatggaactcttcccagcagggtgaaaattattggatatttattaagaaaagggatgaatgaaatgaaaattaacatggctaaaaaaaggtctcaacacaacattatgagaggtaaggtggtcaaatgagactttttgaaattaatccaacctaaaagggccccaaactaatcagtttcatttatcgcagtgtggagtagtttaaaaagcaggaatgcagagatcacagttagaaagctgcttaataatttcttcagataatgctgaggcagattaatcaagataaaaattaacacacaaaaaaagggtttattggtttaaggccctgctgttgacccaaagccttgtgtaagactgtcaggggatagggaacagaaattccagagactccttaatacaagaccccatgtgatatgctaccaagatgcattggggaagccttgaccgaggttatagttaggttgagaaaccataaaaatataaagattaatagaattatgaaatttgtgatatttaaacaggcttaatttaaagaaagtgtgtctttttaacttaaatgtcttatgaaatggactttatgtctggctggaaacacttgttctgcctattgataatattgtaacacaaaacctgctgataaagtcctaaaggagcttaagtaaaggttaatgaaatgaaaaggaaaatgtataggaaagttggtatttttgaacatactttatgtgaagtagtatctattttatctgaatgtgtcaaggttgaaggacactgtatctaactaggaaatgtttcttgaatctaatattgtataacagaaggtatgcaaatttgcccttcagccaacattaattggacatgctaaatgaaaaccactatggtagggtggagtcaagatggccgaataggaatagctccagtctacagctcccagcatgagcgacacagaagacgaatgatttctgcatttccaactgaggtaccaggtgtatctcgctgaggattgttggacagtgggtgcaggacagtgggtgcggtgcactgagcatgagccaaagcagggcgaggcatctcctcatctgggaagtgcaaggggtcagggaattccttttactaaccaaggaaagggtgacagatggcacctggaaaatctggtcacttccaccctaatactgtgcttttccgatggtcttagcaaatggcacaccaggaggttatatcccacacctggctcagaaggtcctacacccacggagtctcgctcattgctagcaaagcagtctgagatcaaactgcaaggtggcagcgaggctgggggaggggctcccacaattgccttttgtttggctatgccctgaccccagaggtggactctacagaggcaggcaggcctccttgagctgtggtgggctccacccagttcgaacttcccagccactttgtttactcaaaaccgctcaactatatggaaactgaacaacctgctcctgaatgactactgggtacataacaaagtgaaggcagaaataaagatgttctttgaaaccaatgagaacaaagacacaacataccagaatctctgggacacattcaaagcagtgtgtagagggaaatttgtagcactatacaccctcaaaagaaagcaggaaagatctaaaactgacaacctaacatcataattaaaagaactagagaagcaagagcaaacacattcaaaagctagcagaaggcaaaaataactaagatcagaatggagctgaaggagatagagacacaaaaaacccttcaaaaaatcaatgaatccaggaactggttttatgaaagaatcaacaaaattaggagactgctagcaagactaataaagaagaaaagggagaagaatcaaatagatacaataaaaaatgataaaggggatatcaccaccgatcccacagaaatacaaactgccatcagagaatactataaacacctctatgcaaataaactagaaaatctggaagaaatagataaattcctcgacacaaacactctcccaagactaaaccaggaagaagttgaatgtcttaataggccaataagaggctctgaaattgaggcaataattaatagcttaccaaccaaaaaaagtccaggatcagacggattcacagcaaggacttcatgtctaaaacaccaaaagcaatggcaacaaaagccaaaattgacaaatgggatcttattaaactaaagagcttctgcacagcaaaagaaactaccgtcggagtgaacaggcaacctacagaatgggagaaaatttttgcattctacttatctgacaaagggctaatatccagaatctacaatgaactcaaacaaatttacaagaaaaaaacaaccccatcaaaaagcgggcgaaggatatgaacagacacttctcaaaagaagacatttatgcagccaacagacacatgaaaaaatgctcatcatcactggccatcagagaaatgcaaatcaaaaccacaatgagataccatctcacaccagttagaatggcaatcattaaaaattcaggaaacaacaggtgctgaagagggtgtggagaaataggaacacttttacactgttggtgggactgtaaactagttcaaccattgtggaagtcagtgtggtgattcctcagggttctagaactaggaataccatttgacccagccatcccattactgggtatatacccaaagaattttgaaacatgctgctataaagacacatgcacatgtctgtttatagtggcactattcacaatagcaaagacttggaaccaacccaaatgtccaataatgatagattggattaagaaaatgtgtcacatatacaccatggaatactatgcagccataaaaaatgatgagttcctgtcctttgtagggacatggatgaagctggaaaccatcattctcagcaagctatcacaaggaaaaaaaaccaaacaccgcatgatctcactcataggtgggaatagaacaatgagaacacatggacacaggaaggggaacatcacacactggggcctgttgtggggtgggggcagtggggagggatagcattaggagatatacctaatgttaaatgatgagttaatgggtgcagcacactaacatgacacatgtatacatatgtaacaaacctgcacattgtgtacatgtaccctaaaacttcaagaataaaaaaaaaagagtttttcaggatgatggtccatcctgaagtacataggaaaaaaaaaaaaaggaaaccactatggtattccaagttcatacaatgtagaatagaagctggagtgttagtacagaaagcattatctgttcgatagcccggataaacaacttcaggaaagtttcaggatgcaaaatcaatgtgcaagaatcactagcagtcctatataccaacaaaatccaagtcaagagccaaatcaggaacacaatcccattcacaactgccacaaaaaataaaataaaatgtctagaaatacagtttaccagggatgtaaaatatctttacaaggatcactacaaaccactgctcaagaaatcagagatgatacaaacaaatggaaaaaaaatccatgctcatgggtaggaagaatcagtatcattaaaatggttatactgcccaaagcaatttgtagatttcatgctattcttatcaaactgtcaatgacatttttcaaagaattagaaaaatgtattttaaaattcatatggaaccaaaaataaaaagcccaaatagccaaggcaattgtaagcaaaaagaatgaagctggaggtatcatattacctgatttcaaactatgctacagggccacagtaaccaaaacagcatgatactagtataaaaacagatacgtggatcaatgggacagaatagagaactcagaaataaggtcgcatacctacaactgtctgatctttaacaaagctgacaaaaaaaatggggaaaggacaccctatttaataaatggtgttgggataactggctagccctacgcagaagattgaaactggaccccttccttacacaatatacaaaaattaactcaagatggactaaagacttaaatgtaaaactcaacactataaaaaccgtggaagacaacctaggcaataccattttgtgcataggaacttgtaaagatttcatgataaaaacaccaaaagcaactgcaacaaaagaaaataaaaatgacaaacagtatctaagtaaacttaagagtttctgcatagcaaaataaaatattaacagagtaaacaaacatactaaagaatgggagaaaatttttgcaaactatgcatctgacaaagg

SEQ ID NO: 12187 - DNA, 2879 bp, Homo sapiens; identical to SEQ ID NO: 12180

SEQ ID NO: 12188 - DNA, 2018 bp, Homo sapiens
tgcgtagaggtgtttgtactattctctgatggtagtttgtatttctgtgggatcagtggtgatatcccctttatcattttttattgcatctatttgattcttctctcttttcttctttattagtcttgctagtggactatcaattttgttgatcctttcaaaaaaccagctcctggattcattaaatttttgaagggttttttgtgtctctatttccttcagttctgctctgattttagttatttcttgccttctgctagcttttgaatgtgtttgctcttgcttttctagttctttttttttttttttttttttttttgagacggagtctcgctctgtcgcccaggccggactgcggactgcagtggcgcaatctcggctcactgcaagctccgcttcccgggttcacgccattctcctgcctcagcctccccagtagctgggactacaggcgcccgcaactgcgcccggctaattttttgtatttttagtagagacggggtttcaccttgttagccaggatggtctcaatctcctgacctcatgatccacccgcctcggcctcccaaagtgctgggattacaggcgtgagccaccgcgcccggcctagttcttttaattgtgatgttagggtgtcaattttggatcttttctgctttctcttgtgggcattcagtgctataaatttccctctacacactgctttgaatgtgtcccagagattctggtatgttgtggctttgttctcattggtttcaaagaacatctttatttctgccttcatttcgttatttacccagtagtcattcaggagcaggttgttcagtttccatgtagttgagcggttttgagtgagtttcttaatcctgagttctagtttgattgcactgtggtctgagagacagtttgttagaatttctgttcttttacatttgctgaggagagctttacttccaactatgtgatcaattttggaataggtgtggtgtggtgctgacaaaaatgtatattctgttgatttggggtggagagttctgtagatgtctattaggtccgcttggtgcagagctgagttcaattcctgggtatccttgttaactttctgtctcgttgatctgtctaatgttgacagtggggtgttaaagtctcccattattattgtgtgggagtctaagtctctttgtaggtcactaaggacttgctttatgaatctgggtgctcctgtattgggtgcatatatatttaggatagttagctcttcttgttgaattgatccttgaccattatgtaatggcctttgtctcttttgatctttgttggtttaaagtctgttttatcagagactaggattgcaactcctgcctttttttgttttccatttgcttggtagatcttcctccatccttttattttgagcctatgtgtgtctctgcacgtgagatgggtttcctgaatacagtacactgatgggtcttgacactttatccaatttgccagtctgtgtcttttaattggagcatttagtccatttacatttaaagttaatattgttatgtgtgaatttgatcctgtcattatgatgttagctggttattttgcttgttagttgatgcagtttcttcctagccttcatggtctttacaatttggcatgattttgcagcggctggtaccggttgttcctttccatgtttagtgcttccttcaggagctcttttagggcaggcctggtggtgacaaaatctctcagcatttgcttgtctgtaaagtattttgtttctccttcacttatgaagcttagtttggctggatatgaaattctgggttgaaaattcttttctttaagaatgttgaatattggcccccactctcttctggcttgtagagtttctgctgagagatccgctgttagtctgatgggcttccctttgtgggtaacccgatctttctccctggctgcccttaacattttttgcttcatttcaactttggtgaatctgacaattatgtgtcttggtg

SEQ ID NO: 12189 - DNA, 43778 bp, Homo sapiens
ttatttatttatttttattattatactttaagttctagggcacatgtgcacaatgtgcaggtttgttacgtatgtatacatgtgccatgttggtgtgctgcacctattaactcatcatttacattacttatatctcctaatgctatccctccaccctccccctacctcaacaggccccagtgtgtgatgttccccttcctgtgtccaaatgttctcattgttcagttcccacctatgagtgagaacatgcaatgtttggttttttgtccttgcgatagtttgctgagaatgatggtttccagcttcatccatgtccctacaaaggacatgagctcatcattttttatggctgcatagtaatccatggtgtatatgtgccacattttcttaatccagtctatcattgttggacatttgggttggttccagttctttgctattgtgaatagtgctgcagtaaacatatgtgtgcatgtgtctttatagcagcatgatttataatcctttggatatatacccagtaatgggatggctaggtcaaatggtatttctagttctagatccctgaggaatcaccacactgtctttcacaatggttgaaccagtttacagtcccaccaatagtgtaaaagtgttcctatttctccacgtcctctccagcacctgctgtttcttgactttttaatgatcgccattctaactggtgtgagatggtatctcattgtggttttgatttgaatttctctgatggccagtgatgatgagcattttctcatgtgtctgttggctgcataagtgtcttcttttgagaagtgtctgttcacatccttcacccacttgttgatggggtcgtttgtttttttcttgtaaatttgtttgagttatttgtagattccggatattagccatttgtcagatgagtagatggcaaaaattttctcccattctgtaggttgcctgttcactctgatggtggtttcttttgctgtgcagaagctctttagtttaattagatcccatttgtcaattttggcttctgtttccattgcttttgttgtgttaggcatgaagtccttgcccatgcctatgtcctgaatgttattgcctagattttcttctagggtttttatggttttaggtctaacatttaagtctttaatccatcttgaattaatttttgtataaggtgtaaggaagggatccagtttcagctttctacatatggctagccagttttcccagcaccatttattaaatagggaatcctttccccatttcttgcttttgtcaggtttgtcaaagattggatagttgtagatgtgtggtattatttctgagggctctgttctgttccattggtctatatctctgttttggtaccagtaccatgctgttttggttactgtagccttgtagtatagtttgaagtcaggtagtgtgatgcctccagctttgttcttttggcttaggattgacttggcaaagcgggctcttttttggttccatatgaactttaaagcagttttttccaattctgtgaagaaagtctttggtagcttgatggggatggcattgaatctataaattaccttgggcagtatggccattttcacaatattgattcttcctatccatgagcattgaatgttcttccatttgtttgtatcttcttttatttcattgagcagtggtttgtagttctccttgaagaggtccttcacatcccttgtaagttggattcctaggtattttattctctttgaagcaattgtgaatgggggttcactcatgatttggctctctgtttgttattggtgtataagaatgcttgtgatttttgtacactgattttgtatcctgagactttgctgaagttgcttatcagcttaaggagattttggtctgagacgatggggttttctagatatgcaatcatgtcgtctgcaaacagggacaatttgacttcctcttttcctaattgaataacctttatttctttttcctgcctgattgccctggccagaacttccaacactatgttgaaaaggagtggtgagagaggacatccctgtcttgtgccagttttcaaagggaatgcttccagttttgcccattcagtatgatattggctgtgggtttgtcataaatagctcttattattttgagacatgtctgatcaatacctaatttattgagagtttttagcatgaagggctgttgaattttgtcaaaggccttttctgcatctattgagataatcatgtggtttttgtcattggttctgtttatattctggattatgtttattgatttgcatatgttgaaccagccttacatcccagggatgaagcccacttgatcatggtgaataagctttttgatgtgctgctggattcggtttgccagtattttattgaggatttttgcatcgatgttcatcagggatattggtctataattctcttttttggttgtgtctctgccaggctttggtatcaggatgatgctggcttcataaaatgagttagggggaggattccctctttttctattgattggaatagtttcagaaggaatggtaccagctcttccttgtacctctggtagaattcggctatgaatccttctggtcctggactttttttggttggtaagctattaattattgcctctatttcagagcctgttattggtctattcagagattcaacttcttcctgatttagtctagggagagtgtatgtgtcaaggaacttatccatttcttctagattttctagtttatttgtgtagaggtgtttgtagtattctctgatggtagtttgtatttctgtgggatcggtggtgatatcccctttatcattttttattgcatctatttgattcttttctcttttattctttattattcttgctaggggtctatcaattttgttgatcttttcaaaaaccaattcctagattcattgattttttgaagggttttttgtgtctctctctccttcagttctgctctgatcttagttatttcttgccttctgctagcttttgaatgtgtttgttcttgcttctctagttcttttaattgtgatgttagggtgtcaattttagatctttcttgctttctcttgtgggcatttagtgctataaatttccctctacacactgatttaaatgtgtcccagagattctggtaggttgtgtctttgttcttgttggtttcaagaacatctttgtttctgccttcatttcattatgtacccagtagtcattcaggagcaggttgttcagtttccatgtagttgagcagttttgagtaagtttcttaatcctgagttctagtttgattgcactgtggtctgagagacagtttgttataatttctgttcttttacatttgctgaggagtgctttactttcaactatgtggtgaattttcgaataagtgtggtgggtgctgagaagaatgtatattctgttgatttggggtggagagttctgtagatgtctgttaggtctgcttggtgcagagctgagttcaattcctggatatccttgttaactttctctcttgctgatctgtctaatgttgacagtggggtgttaaagtctcccattattattgtgtgggaatctaagtctctttgtaggtctctaaggacttgttttatgaatctgggtgctcttgtattgggtgcatatatatttaagatagttagctcttcttgttgaattgatccctttaccattatgtaatggccttctttgtctcttttgatctttgctggtttaaagtctgttttatccgagactaggattgcaatgcctgcctttttttgttttccatttgcttggtagatcttcctccatccctttattttgagcctatgtgtgtctctgcatgtgagatgggtttcctgaatacagcacactgatgggtcttgactctttatccaatttgtcagtctgtgtcttttaattggagcatttagcccatttacatttaaggttaatattgttatgtgtgaatttgatcctgtcattatgatgttagctggttattttgctcgttagttgatgcagtttcttcctagccttgatgatgtttactatttggcatgtttttgcagtggctggtactggttgttcctttccatgtttagtgcttccttcaggagctcttttagggcaggcctggtggtgacaaaatctctcagcatttgcttgtctgtaaaggattttatttctccttcacttatgaagcttagtttgactggatatgaaattctgggttgaaaattcttttctttaagaatgttgaatattggcccccactctcttctggctgagtttctgctgagagatcagctgttagtctgatgggcgtccctttgtgggtaacccaacctttctctttggctgcccttaacattttttacttcatttcaactttgttaaatctgacaattacgtgtcttggagttgctctctcgaggagtatctttgtggtgttctctgtatttcctgaatttgaatgttggcctgccttgctagttttgggaggtcctcctggatagtatcctgcagaatgttttccaacttggttccattctccccatcactttcaggtgcaccaatcagacgtagatttggtcttttcacacagttccctatttcttggaggctttgttcgtttctttttactcttttttctctaaacttctcacttcatttctatcatttgatcttccatcactgataccctttcttccagttcatcaaattggctactgaagcttgtgcattcatcacatagttctcatgccatggttttcagctccatcaggtcctttaaggacttctctgcattggttattctagttagccattcatctaatcttttttcaaggtttttaacttctttgcattgggtttgaacctccgcctttagcttggagaagtttgatcgtctgtagcctttttctgtcaactcttcaaagtcattctccgtccagctttgttccattgctggtgaggagctgcattcctttggaggaggaaaggcactctgatttttagaattttcagtttttctgctctgttttttccccatctttgtagttttatttacctttggtctttgatgatggtgatgtacagatggggttttggtgtggatgtcctttctgtttgttagttttccttctaatagtcaggaccctcagctgcaggtctgttggagtttgctggaggtccactccagaccctgtttgcctgggtatcagcagcggaggctgcagaacagcaaatattggtgaacagcagatgttgctgcctgattgttcctctgaaagtttcgtctcagaggggtaccctgccatgtgaggtgtcagtttgcccctactggggggtgcctcccagttaggctactctggggttagggacccacttgaggaggcaacctgtctgttctcagatctcaagctgcatgctgggagaaccactcctctcttccaagctgtcagacagggacatttaattctgcagaggtttctgcagccttttgcttagctatgccctgcccccagaggtggagtctacagaggcaggcaggcctctttgagctgcggtgggctccacccagttcgagcttcctggccgctttgtttacctactcaattctcagcaatggagggtgcccctcccctagccttgctgccacgttccagttcgatctcagactactgtgctagcaatgagcaaggttccgtgggcataggaccctctgagccatgcacgggatataatctcctggtgtgccatttgctaagactgttggaaaagcgcagtattagggtgggagtgacccaattttctaggtgctgtttgttcccccttaccttggctaggaaagggaattccctgaccccttgtgcttccctggtgaggcaatgcctcaccctgctttggctcatgctcggtgcactgcacccactgtcctgtacccactgtccgacaatccccagtgagatgcacccagtacctcagttggaaatgtggaaatcacccatcttctgcgtcactcaggctgggagctgtagactggagctgttcctattcggccatcttggaactgcttcagtgtcctccagttctatccatgttgccttgaataacagaatttcattcttttttatgattgaacaatatgtaattgtatatctataccacattttctttattcattcatctgtagtgggacacctaggttgattccatatcttggctattgtgaatagtgcttcagtaaacatgggggtccagatgtctcttccatacggtgatttcctttcctttggataaatacccagtagagggattgctggatcatatggtagttctatttatagtgttttgaggaagcttcatactgttttctatgatgagtatactagtttgcattcccactgtgtataagagtttatttttctctgcatcctcaccagcatttgttttttgttttttgtttttgtctttttcataatagtcatcctacctggggtgaaatgatacctcattgtggctttaatgtgcatttccctgatgattaaagacattgagcattttttcatatatttgttggtcatttgtatgtcttcatttgagaaatgtttgttcagattatttgcccatttttaaaatcatttttctgttgttggtgttgagatatcggagttccttgtatattctggatattaatcccctgtcaaatgagtagtttgcaaatattttcttctgttgtataggttatcttttccctctgttgattgtttcttttgcagtgcagaagctttttagtttgatatgatctcatttgtttatttttgtctttgttgccagtgcttttgtggtcttatttttacaggttagtaactctgttttaatcagggacttgaatcacaggaaaaacaattagaagcaattggatattgtacttcactattcccatccccatctccctgtcccacttctttttttttgagacggagtcttgctgtcgcccaggctggagtgcagtggcgcaatctcggctcactgcaggctccgccccctggggttcacgccattctcctgcctcagcctcccgagtagctgggactacaggcgcccgccacctcgcctggctaattttttgtatttttagtagagacggggtttcaccgtgttagccaggatggtctcgatctcctgtccctgtcccacttcttacaaagttggccctgaatgcctgatatgatgtgagatttgggatggttggatctggaatgagaagacctgagttcagatcccttcactgcctcctcctagtgagaaactggatgacatcagatttaggggagcctaattcttatctctcaggattctgattgataacataggcataatgatcactagcaatatggtgattaaagacttgggatactctctgggcaattgcaaaatatctcctaaatgcctggtcatgtgcatgggggaatgcaatttagatggggatttactcccaccctcatgaagacttgggacccaatgcttggggggatcctgtctaggagaccctgaggaacgttccgccgccagcagcaggcatgtctcacactcccaaaccttttcagggggtgtagaaagcagtgggcttcctgcaccggatggaaggttcgcttatttgctcaattgtaactgggaccaagaagcctggtagaagatacgcactcactgttgccagcaagaaccaaagatccagaggccacgagacacaaatgtagaaggccaagccctagccccacccgatagaactgtggcccaatcagtgacagttctcactaatcaggaagcagtagtaaaagtgagggaacccgcattcctgctctttaactttctggctttggggagaggtaggcaactcttctttgcagaaatagaaaggccgaagagggggagatggcaagtgtctcccctaagagatgcaccattctccctttttataacccagacatgtgcaaaaaaaagaaagaaaaataaaaagagatagggagagaatgtatgggatagatctcagtaattcttactgctattttaaagaaagccttggcatttatttagttgactatcaccagagttcaaattcaagaagatcctctgccacttcctgcagtttgtggactgtggtagaagttgagctgatctggcatcagcacagtaggacaaactggagttggaagactaaatgctcaagtctcagagtgatcttgattggcaggcgagctttggcgcagggaggttataaattaagcctattcctttaagtattttttttttaagtctgtgtaaattcttctttgatcttgagctgggggcagtgaacaccatctgctttgttttgttttgtgtttggaatgatgtagaataattcctgctgacccttgatatacgcacagcatgccccccagtaggcacagacggctctgcttgtgggtgtctcttgcctgcttttcatatttacttttgtttatcgttagggacaggagctcatgttgtcagaatttgtttaccaaaaaatgctcctaatttcttgctgaaactcaaggataaccttaggtactaaatggctaaacttactagagtagtccctaaaacaggaatagacagactgattaagggcccaggcgcatttctctaagtcatgaatcatattagttcatgtacttatcatatctattttataacctctactctttcttccatattacaaacaagcgttacctgttctgagtagctgtggttttcaataactggcctttactagtcttagggagtagcatacatactggtaccacctgagttcaaacaatgttagctggaaataaacattttaggaagagaatcaattctaccattagatttatttgtcaggaactaaaggacagctcagcagtaaactaagaattgagggagaatacattaaatactgtattttgggaaacactctttcaaaatatgtacatgcatctttgtcaacttaactaaatcaattgcttagcccaaacaagttagcttagaaatcatgtccccaagatatgcttctatctaatagtattttaaaatgagcaatattaaggatgctttaaaatgctgtaatacaattttctttacctaaatctaaagctcattgaaatgcctattatgaaggccaccatatgtgaggcaggcagtcttgacattttgttgggaagggagggagttacatctggagaaatgtcctcagaaatttattacaggatcggatatctgcaaagtgtgatagaacccagggtttgtgcccttcttgtagaggtagcaattctggtgtccctgttacagtgagaaccctttctggaagacaggcatcctggaactttacttggcctatctgcataacctttcctttttttgatttctccctgtgtattaggagaattttctttctatgatttgggatagtctgggaggacagcccacaagttttctagattgggaatgaataagagaaaattaatgtttcctgggtctaaattctcctgaaatcctttatcaactgtgtgatttcggggtgaccgtttaattagataatgcatttaaagtgctatcacagtgcttgatgaatagtaaacattcaataaactaatgttttataatgtttaaattattattaaaacactattttcatttattcatgattcactcaaaatatccagcaattcaaagtgtcttctctgtgtctggtgctgtggaatgtgggggatggtttggtgtgtttgcggtggccttctgaggtctccctagtctctcacctcctgccccaccaagtgggttcatccaaagcagatgagagtcttattaagttgacacaatgtgatgagaatgatggatttatttatacttttctcagtacactctgacagagcctcagttggtgccaagattgatgtgcatgagactgaaaggccctcttagtgcccaaatacctccttacaacttgtctcagtctctgaaatttctcccatgagtcattcttttttgcaagggaagctttggagaagcaaaggtgagttgtactagtttattcctcccttttagaggtgagaagatgggtggattcctgagccctaccatattccagctcttaatgctgctatcaaagataggttcctggacaggaaaagccatggacagcttttaaagttttaaaactttctcatatttttcatgggtggtttcaacaggaataaacacataatgtgcaagcaatttcacaatgccttgcattgaaatccatggatttctagatttctatcagaatcctggccttgggcttaggtgattcctatgtccttctacactttagctgtagaaacagcaggtggagtgaaagagcctgttcagagcagccagattttgttttggttgtcagctaaaacagaaacctcatcattccagacttggcagcttgttagtagaaaagccactgggaagctctaagttggtaatttagagcacaaatgtattccctgatacagctgcagagcagcaggtgtctgtgacttaagcaaacactagctttgaaaaagtgaaataagaaaatagaaaactttttttttgcacatgtcaatatggctgaaaatatgtttacttcttgttcctcttggttcttttcttattaacttgcttagacatatataagtgaacgtttcatgcaattcgattcaatttaacaaacatttattgagtacctactgtgtaccagactcagtgctaggtgttggggatcatcattttctgttttagattttggtgtggagacagacatgcatacggtttcataataaaggaataactaatttccttcagagcactggacaattctgatcatggagtaggagaagccttttaggagaaaatgaattaaagggataaatattgctgagatggattggagggagatagttccaggcagaatgagttgctggagaagaatctgaaggatgtcagagtgattgaaggtaggaggaaaaaataggaatgttccttttgtgtctctgtctgatggatatgctcacattgaaaaatgcaaacattcctttagaccgcctctaccaaaccatctgccctggtggccacagagcatagacccaccaaactacaaaagtatgcatgaacattttcttgttatacaaagcagggggagaatagaaaaagaatcatcaaaaatagatgaacactaactataaaaacaaatatagagtaataaaaatgtaaaaaaaaattcagatataagaaatttcataacttttgtctatacatctattatggcctcaaagatataatgggaaactattatccatatgagcagtacaaatgtaaaatacctgtgatttaccttaatttgaaatttagtgcaaagcctagataaaactgcaaatgccatagaagctatttttaagattattaaaataacttgactaaataaataaaaatcagagactgcaaacaggggaggggagaggggatggagagaggatgtttagtgggtagaaaaatacattagaaggaatatgatcaactgttcggcattatagtagggtaactacagttatcaataatgtgtagttcaaaatagctagaagacttggaatgttttcaacataaaagatgaatgtttgaggtgatggatattccaattaccctgatttggtcattacatattgtatacatatatcagaaaatcacatataccaccccccaaattgagcaaaatattggaaaaatgaaaacagagtttatgaatgagaaccctcaatttgtaaagacattgtgtgttcccaaattattatgggtttaatgtgattccaattaaattccaccaagatttttagaaactgttaatggtaaaaattcatttatcagatacttcaaaataataagagccatctatgaaaaactcatagccaatattatactgaacgggtaaaagctggaggcattccccttgaaaaccagaacaaggatgccttctctcaccacttctattcaacattgtactggaattcctaaccagagcaatcaggcaaaaggaagaaataaaaggcatccaaataggaagagaggaagtcaaactatccctgtttgcagatgatatgattatatacctagaaaaccccatactctctgccccaaatctccttgatctgataaacaacttcagcaagatatcaggatacaaaatcaatataaataattagtagcatttctatacaccaactacatcccagctgacagccaaataaataaagcaatcccattcaaaatagctcaaaaaatcaacctaggaatatagctaaccaggaaggtgaaagatctctacaaaatgagaattattgatatgaaacactgctcaaagaaatcagagatgacccacaaacaaatggaaaaatattcatgctgaagcataggaagaatcaatattattaaaatggccatactgcccaaagcaatttacagattcagtgctattcctatcaaactaccaatgacattattcacagaactagaaaaaactgttttaaaattcataggaaccaaaaaagagcctgaatagccaaggcaatcctaagcaaaataaagctggaggcatcacattacccgacttcaaactgtacgacagggctacggtaaccaaaacagcatggtactagtacaaaaacagaccagtggaacagaatagagagcccagaaataataacagagatatgcaaccatctgatcttcaacaaagttgacaaaaacaagcaatggggaaaggagtccctattcagtaagttgtgctgggataactgactagccatatggagaagatggaaactaaccccttccttatatcatatacaaaaaccaattcaagatggattaaagaattaaatggaaaatataaaactataaaaaccctgtaagataacctaggaaatacaactctggacacaggacctggcaaagacttcatgacgatgatgccaaaagcaattgcaagaaaagcaaaaattgataaatgggacctaattaaactaaagagcttctgcacagcaaaagaagccatcaatagagtaaacagacaacctacagaatagaagaaaatatttgcgaactatgcatctgacaaaggtctaatatccacaatctataaagaacttaacaacaacctcattaaaaagtgggcaaaggacatgagtagacacttttcaacagaagacctacataagagcaacaagcatatggaaaaatgctcaacatcactaattattagtgaaatacaaatcaaaactacaatgagatattatctcataccagtcagaatgactttcattaaaaagtcaaaaataacagatgctgttgaggtcatggagaaaagggaaagcttatacactgttggtgggaatataaattagtttagccattgtggaaagtagtgtggcaatttctcaaataatttaaaaacagaattgtcattcaacccaataatcccattattgagtacgtatccgaaagaatataaatcattctactataaagacaatgcacacctatgttcattggggtactattcacaatggcaaagacatggaatcaacctgaatggccatcgatggataaagaaaatgtggaacatatacaccatggaatactacacagccataaaaaagaatgagatcatgtcctttgcaacaacatggatggagctagaggccattatcataagggaattgacgcaggaacagaaaatcagctaccacgtgttctcactcataagtgggagctaaacaacgagaacacatggatgcaaagaagggaacaacagacaccaagtcttccttgagggtagagggtgggaggagggagatcataaaaaaactacctgtcaggtactatgcttattaactgggtgacaaaataatctatacaccagacccctgtgacattcaatttacctatataacaaacctgcacatatactcctgaacctaaaataaaagttaaaaaaaatttttaaagtggtgaaattaagaacaaagggatattatggaaggttaaggaaaattccctctttcattatatcttgtaattttagattctgtgagcagatattagaatgcaagttcaaaaaattacatctcttagaatagaaacagccaattagagaagtttgaaaaaaaaaagaaatgctatcttactagataataaaatgtattttaaagctaaaatacatactactttatattgaagcaaaaacacagaaaagttaattgagcagaaaacaaaacaaagcaaaactctgaaacagatacttgcaaatataaaaatatagtatatggttaagtaaagatttcaaattcatgattaaagaagaaatttgttcattttcggtgctataacaattagttaccggagaaaattaatctttgtaacacacaatatactaaagtacattaacaatggattaaagagttaaatggaaaagtcttccttttgacataaaaacaaagacgcataaaacattacacaaaaatagactaccatactcgtttttcatatgaaatttgtgaataagttaaatttttaaagtggaaaaatatttgcgatttataatccactccttactatataaaaagtcttaacagattgtcttactccattcaggctgctataagaaaataccatagactgggtagcttgtacataacagaaatttatttcttaccattctggaggctggacagttcaagatcaaagtgctgatagagtcatgtcaggggagggctgctctctgcttcacaggtagcaccctttagctgtgtcctcacatagtggaaggaactagctagcagtctaggggctgtttttgtaaggtcattaatccccttcttgaggagtccattctcaaaaacgctcagaacatagcactgatcaatatacaaaaggtaaaaaaacaaaaacaaaaacaaacacacacacagtaggaaaatgaacaaaggaaatggatagacaattggtaggagatgacaaaatgcattccaaaatttgttgtttgcttatgaaatttttaaaaaagggaaatgtactatttggtagttataagggtaagaaaaatggaaatgctctcttagtgataatgggaatttaaatgcttataacctatggagagtgatttaatgatagccatcataagccttaaacatacttatgcccactaagcaattcctattctaggaattaatcctaaggaaatgatcaaaattgtgtgtatatgcttactaatgcatatgtttatcccagtggtttaaaaaataatagcgaataattggaaattactcaaatctccaaaaagataattgcctaaataaactatatcatagaacattatatagcctaaaaaattgttatgaaagattgtaatgaccatggaaaatattattcatttacattgaagaagaaaaaaaagagaccatataacattattttaattttgaaaaaatgaaacagttctgtacttatttacaaatttaacaagcacatagatccacttaacagtgattattgatgagtagtaggattagagattattttaattacattctttgtatttttctttgtttttcaaatctgctacacataatttgaaatttaaaaataaacacacacacattctgtttccaatggtcaacgctcagtgcccagcatacagcattccttcagaaagagtacctacaacattttaatagttggatggaaaatctggaaattagagtgccaatggcagtggggatggtgccaggaactgggccccccagattcatggcagaccagaagacccagaggccacataggcagagagtgtgaacaatctgtaaaacaccacagatgccatctcctccctgttatctgctctccccaaaccccctacacacacccagagccagaggaaggagctcggctttgcacaggaactaaagagctgatgaaacagtgaggggagctgagctctggtgctgtggattgatccacaccttgtcctctgtgtgtacgcctctgctgctctgaccttgagaagtacctttaatgtaaaatagaaaaaatgctttcttctttaagaagctgtcagattagagaatcagagagaatagcagttgacattggctgagggtttcttaactctgtaggccaggagaccttcatcaaaaagagtcagcatgatgaatgagaagtcctattatcccaaatgaaagtgaaaggggttgactgtaagtgggttagagctgagagtaaggcctgggcagaatgcggaggatgaaaattaacacaagattaaggctggtcattcattttctctgtctctgtctgtcccttcccccttcctctctctttctctttctctttctctctctctttctctccccctccctccctccctctctctctctctttctttttcttttcttttttctttccttttctttccttttccttttccttttctttttccttccttccttcctttctctttcttttctctctctctttttctttctttccttccttccttccttcctttctctctctttctttctttctttctttctttcttttctttctttctttcttcctttcctttcctttcttttcctttcttttcctttcctacttctttttctttctttcttctttctctctctctttccctcccccgccaacccctgtctctccttcttttcctttctccctccctctccatatttattaagcacctactgagtaccagcataccctgggagcttcaaatcattcaggtcctaatgatactacccttctcagtttaggggctctaattggctcatatcctcttgcagggtttgctggtatcttgtttttctattcttcccagagggataaagtgagtgatgatttgtattctcccctatgatattaagtagaccgtgggatttaacccccttctcccttgaaagtgactaatactagaaggacagaaaagaatggaatttcctaggtcagtggagtgaggttaaaagtgggggtaggagaatcttaagatacagattcatgattcagttattctgattgagtagatttatgtagggcccagactgtctgcatttttaacaatgcccttggttgattctgaggcccatggtcctccacactttgagaaatgttgagggtttaagtcgtcatcatcttgacatactctatttctctgtttctggtctcatagatgacatattcaatatggcccctagaggcttctgtgggcaactttcaggttttcaaccaggcaggagatcagtttaatacatgatccctatatattaacacatgttccattgagctcccttctcttgagccctttatactgttgtaaaacttgatcaagaaacggcattttggatggacttgtccagcatcctctaggtttcaaggaaaatcctagaaagattttctatttccttcatagagagttccagattgctgatctctaggtcagcaatgagggaagtaatagcacagccgccagactaagttgcaagagggaaatttgcaccaattagtgcagaatatctgctgccattcagatgcctctcaggtaggctgtgataacctatccaagctacaatttttctcttcctacaaggaagtgaggagagaaagcactggaggatctgtttgctttattgctgttcactgttcatgttctgttcaccacccttctgctatctttctatttcagggctagctgtggttcttattttggttgtcactttacctgcttctcaaatctcaggattggctgagtttggatacttgatttgttatattttcaaaccttactttgatcttgtaaaacaaaaagtgtttgagacaggtgtcaatccatttagaggtttattttgctgagattgaggacatgcctgagaaaaggagacacaagtctcagtgggatctatggcctgtacttttttcctaagagggttttgggggtttgaatatttaaaggagaaaaagcaggcaggaggggaaggaagaaagaaaattaaagggagggtatgtagtgaggtaactgttcacatttcttgtgaggctttgattagcactcactaaatccatgttgcatgtgaaaggcatagaggaacaatcaattatacatacatcttgcactcaataaatctgcattttacataagataagtaaatagagaatctactttattttgaggtaggaggagggatgatttctagtcttttctttgtcctgtacctgtgaaggtaagccattaatttacataatcagagtgagggaagctacctggggagatatgtggccttttattgtacagctatctgtttaggaacaaaaggaaaggcattttttcttttttgtatgactcagtttctgagcttaacttttccctttggtatagtgagtttggggtctcgagattttcttttcttttcacaacctcctagctctgacctcagagattctctgatctgggtatcattttctggtactggtgtttagtatgatgactgagaatggtgatacaatgtgatactcagtgggcctatgttttggttcacaaagagaataaattagatgccagacataattccgtaaagccccagctttaggaacacatggtcttaaaaagttctctaaggagatttactagcttgacagacgtatgtaaggctctgccatgatggaaagtctggggatttacctctggacgttttatcaacaaactgcaaaatacaatctcttattaattttccacctttgtgtgtttggttgaagaaaaaacaaaaggcacgtgctccactggggttggagaaagctgaagttcttacactctgcatatgagagttgacaattatttaatcaagggctgagaagtagcgataaaaagcatttcatttcggatccactctgcctgagcagagtgaccacgagggcagctgatccctgagacaggcaaacagaccaatgctggttctcctggtagcacatgtaaactcaggctggttctcctggtagcacatgtaaactcaggctggttctcttggtagcacatgtaaactcaggctggttctgtggaggagatgaggaaaggccataatcgtacaggttggcaagaccactttctttttttcctggtctggcctacagtttataaagttacctctgagccacttctgcaaaaggtctcattctcttctgcaatctttctatataattccatccaatttttgttctttccttgaactcttagagctttttgtccacactattaattttccattgtatatttctcatccttttctgcttctggtctctgcaatttgattttgatcattttgaaagcctgtttcttatttttctatgtattatggaggtggatttttcattctttcttccctacatatacgcccttctgtgtatctccttttccatttcctctatcctacatcctattcctaagagtggaggagctgctattctgagtgttcacaggatggaattttatcatttgcaagtacggccacagtgttttgaaggtccacactgcctgtagtagttactttggaacttcttgcccctataagtgtaccggttcaggctcttttctcattcttcacgttggtgttctctggggttctctcgattgacccctgagcatctccatttggtgttggaggggatggagttatttatgttagtgtgtgtgtatgtgtgtatggaggtaaagactcaagatgaaagcttggtcaggtgtggtagctcacgcctgtaatcccagcactttgggagaccgaggtgggtggatcacctgaggtcaggagttaaagaccagcctggccaacatggtgaaactctgtctctactaaaagtacaaaaattagctgagcgtagtggcacatgcctgtaatcccagctacttgggaggctgaggcaggagaattgcttgaacctgggaggcagaggttgcagtgagccgagatcgcaccactgcactccagccaaggcaacagagtgagactctgtcaggaggccgagtttgcagtgagccaagactgtgccactgcactccagcctgggtgatagagcaagactctgtcttaaaaaataaaaaaataaaaataaaataaaataaacaaaacagatggaagcacaagccatgtcctctgagttggttgttatcagagagccctgaatggctccttagcttgataccatgttgatatagtccagactccatcaagaaatcttaatgtgatacattttccattgctctttcaccttgtgaagaactgaatgaataaacgaatgaagtaatgaagccaaacaaggtgacttttgagttgcatcttaaagtgtgattcgaatgtttgacaataatagaagaagacatattccctgtgttggagaagggctggcctgaggctaatctgtcaagtagttagcctggttgtcagggctcctatttcctgctcggtcatctagtttcctaatcctgccttcaggctgtctagattcttccagttgtttttattctattagtttttagtacaggattaacccccacacacattccttgtctaccactaaggtgaagcaagttcaatgtttaaacaactagtgtattttgaagcatgtgtctgagcccgcaggagatacattccagagctttgtggggatggggagttagaggatcccactggagtcgttggcctgtggggagtagggtagggaggggcttgggctatctttcctttttattgtagaggtgagtttctagggtctgatgtaagctcaaaaaagtggctctctgcctaacataccatgtagagaagaatgtcaactttccctgtgaagagtgatgaggtcacaggtgtgggcatgagggcatctgcccatgtagtgtgatctggagggtaacaaagtcttgttgaaaaatcatccccctgttggcctaccatagtgctggaattgcccacacttctcatccttgtggatttatgtacgtttggcaaagcccttgtcaaaaaaataatcaggttaactgggaggtcacgtacaagtaaataccctgatgaggaatgggaatatataaactcatgaacatctaggaaacacgggcatgggttacttgataaagcactgttacctgtgtctgaccctagggaatggaacacaggtctagtcagttttgggaggctaatgtgttgtcagcgggggaatatgtggagattctgggaaagaggaagggacatgaggttttttgggtttttagagaatgagtaaaggggaaaagcacaagaaaagatgtctaaatagaaagtggggcactgatgacaatttttcctaacttcagaatttttccaacctttattttttctatggctatatgtatttaaataatttaggagtgaaccaacagctcatcctaaaggggagactttaactaattgcatattagaatatattagattaccaaaatgcttatctcaggcttgtaacagacatccattcagagtagggaactctatagattaactgtctatactacttaaataaatgagataattgatatatatgtatattcttaaaatcactccatcataccttcagaaaaagaagatgatcctttatatttgtggcctacattttggtctgtcacacacttactttctgtgcaaaaaggaagaacgagggtgattatatgtcttgtgatggttaattttatgtgtctgcttgactgggcttagagatgctccaatagctggtaaaatattatttctaagtgtatgagggtctcagacacactcagaagaaaaaggatcatcttctttttctgtaggtattgtggagtgattttaaggatatatatcaattacctcatttatttgggtagtatagacagttaatttatagagttcactactctgaatggatgtctgttacaagcctgagataagcacacacatctcttcctcttctgaaagagattagcgtttgaatcagtacgctgggtaaagaagaccaccctcaccaatgtgggcaggtgtcatccaacccattgagggcccaaatagaacaaaaaggcagaagaaaggtgaatcatctcttgctgtttgagctggggcatttattttctcctgccctaggacaccaatgcttctgtttctgaagccttcagacttgaaattacacgtgcccctcccctggttgcaacttatggtattctccatttccataatcccataagccagtccttcagagtaaatcagcctttctctctctctctccctctttctctctctgtgattggttctgtttctctggagaacattgactaatatacttgttaattggggaattaaggagacattcacgatcttccctttggctgcatgaagttagtaaaaaggtttgagaccttgttccaaagaagtggtatgacatcctattgtgtttttattttattttattattatactttaagttttagggtacatgtgcacaacgtgcaggtttgttacatatgtatacatgtgccatgttggtgtgacatcctattaagttttaattaccttaactataaggcctgttttgtcaacaatgcattctactgccttatttctgtaggatcaataagcctgcttcttaggtttgttctggaagtccctattcctctgttaccattcttcctcctgcagtactctgctttttggtcaactaaagatgacatacttatcactgtatcagctgtgataggctaagctgtgctctagtaataaacatatgttgacatttcaatgcctaggacaaaaatgttgtcttttatttgtggacacctgatatgggtctgctgggtttctcttttaaaagcaacatggtgagtatgtggcacaatctctgcccttgtcactgataaagatgcttaggccagaagtggtaccaggtagaactgaaaaaagggtgcaggccaagatcagactgacctgggtccttccacgcatcagctcattctccgaaaatgaagataacttcatggggttgtgaggagaattaatgatctaacacttataaagcttccagttcagtgcttggctcagagcagatactcaacaaatgttctttcccttcacttcccatgttatgttacatacagtgttgtgaataatgggaacaacattataacccaacttctctacatatcctgaatagatccttttttggggggaggataaggggtggtgagctgctaaaagtgtcaggctaattccttcaagccactcttttgttttatctctagacttaacatttactaacataaacaggagtatctctgaccatcagagtggtaagctagagaaataaacatattgcctctttctaattaatctggctactccttagagcaactttaacaagctatgatatgcagagagatgaaacattccaattatttttctgtaatgctataatccttttacaagtgcttccctctgatgtataatctcctaaatcagacactaaagaacaaataccagctttgatttgacaagcctctccttctcactgaaggggggagaaacaacctaccagaagccttgattcttcaacagctgtgaaatattccctccagaaggaaaatctttccgctgttgagtgctgagtactccggtgcttgatttgtttcctgcaggggccaccactgattatggcatttgaattcagtggctgttttccttctgatgagaatgaatgaggtgggaagtgggtggggtggatgtgggagaaggagtaatgatgagggagaaaaatacaagatggaaacggaggagctgtgaaagtgaaaagggcagagaggggcggaagttacatggcaagtgaacaacctcaaaagcatcagctcacacaaaggcacaagaccagacaggctgggagcggaaaccagctagagatgaaaacggaattcccgactttgagttttgtgagacttgacagttggttttgagtcctgggtctaccattttctagctatgtgcttttaactgtcaaaataactattgtgaaattaaaaaaaaattgaaagaagcatgtggaactgaaggcactgtacaaatatgagtcatttttagctattttatagaaatgtagttagatgcatatagagttagattgagaaacagcaggagagacaaaatttatactcatttaggaaagtttctgacaatatattttacacaggacaagttttgtgaagagtctcaactcactgggagtataaacaggaagcagttttgtttttctcaacaactgcaaccggctgtgccctgttcaacatttctgcctgggagtaggacttcttgtggcctccgtctgacttcctaatttctcagacaatttgtgttaacaaagcagtctccaaataagttctgtgaggctcagtcctgattgtttgagaacttcaagctcatgcataaatcaaaaccattctccatttccagcacctttctcctcagtgcttggagttgggtcaggagcatgaggtcaggagcatgagagaggaggcaagcttcctacttatacagggatgttagtgtcttctcctgggcctgtaaataccattaatctagttgttagcccatggggcaatgtgattggagagacatgctcccagattgctccacaggcactttctgagggaagtcacatctggctaaacctcagctgagacctcccaggagagtcatctgcacaggtgcctgtctacctcagggctgaacacagccagccctttgaggacattgctaccccgaacagtagacatagtctacacttaaagttgtgagctatatatatattttttcttagccatgtccttagttgtcagaactaggaagactgaggaggggaacctgatctctctgaagttcaatatgtatattggtatgtaactaaataagatgtgcatattaaactctagagggatctagctatcattcatttttatctgaagccattcacagaaaatcttgaagtcttttcataaatacaatgcatttcatatgttttctttgaaaaatggtaaatatttcctttcattttacggggaagatcattttcataatgctataaccccttttgtaaatttttgaaatcatggcaatcaagttgtactgaaattccaaaggtggccatgatggagaattctacttaggacatgacataaaatgcaagagagaatttggtctgcaagttgaaggttccttgtatttgatgtaaagaaaccttaaccttgatgaaataggaacatgtggttaatgtttttcttaagggaataatgacaactttttaatattttcagatttattgtactgtaagtttacctgttcagatttgggttttgtaaatggaatacctacctgtaatgtttcgttgattctgttcttggaaacacttttgttgggtccatacaaccttagagtcattgtttcctttaatgtaaactttatggaacattcaatgccaaactcagcagaatgtgttttcacaagaaaactgaatctcataagtgggatctattcattgcttccctttggctctgcagacctgtaaccactgctatgttattttctgatatttaggcctaaggccattagaaggatttcactgaggtgttcttattgacaacagaatcctgggaaatgaaatggaaacacagttgccaatcacagggaagggcctgtggggttaccactttttcttgtttgtttgttttgttgttgttgttttttgaggtagagtcttgctctgtcgcctaggctggaatgcagtggcgcaatcttggctcactcactgcaacctccgcctcccgggttcaagtgattctcctgcctcagcctccggagtagctgggattacaggcaccagataacacatccagggaatttttgtatttttagtagaaatgggtttcactatgttggccaggctggtctcaaactcctgacctcaagtaatccacctaccttggcctcccaaagtgctgggattataggtgtgagccactgtgtccagccttttcttgtttttaaatgtgcaataaactcttctgccaagacaattccattaggaagattctgcagagacatatactcagtaaattaatttaatcccaatcatagagttagaaaatctcatagttggaagaaactttgaaaaccatgtagtctagtaaccttctctgtgttcaattccccctccattatcctgaaaatatcttttagcgtctgcttgaacagccccagagatggagcttctaccaccccaggaggcagcacattcacaaatactgaaagtgcatccttatgaggaatctaaatgtaccactttcagatcttgaatatagccatttttctttcctttagagatcttctccatttcagtcattttttctcctttcatcacttcctcatctgatgaaagttggaggccaccacgattttggccattctgctcatctatagctactttaagtgtcattcctagattgaaacctgatattccaggtatagtctgatctagctcagagtaggacagaatcacatctttcattccttagaacctctaagttttcatttacccttctgtctgccttttccagttgctaagtcaatctcccttgcacctgtgcagttgaattttttattttgcggttgaattttagatccaaaaacaagatcttgcatttgtagacactaaatttcatattcttaattccttttagaaacatttttctattcattacatgaactactcaacctgcatactttatataatttttctttataatttttgagctttgaaaatatttttcttttctctttaattaagaacaaagttttagatgaagatttctcctgggaatttgcaaccatttctaaaatttggttctatatgaggattggtttacattcctccctccccaccactcaccaagagagactgtttacagatttggaacaattttcagatttaaaaaattgtccctaatatcacatatccttccatacttctaaacagatccattattttaattcaagaatttaaacactacttgtctgacatcatcttatgaacattttatacatgttctgaaagtctttaaaaaattatatcttttggccgggtgcggtggctcatgcctgtaatcccagcacttcgggaggccgaggcaggtggaacacctgaggtcaggagttcgagaccagcctggctgacatggtgaaaccccgtctctactaaaaatacaaaaattagccgggcgtggtgcaggcatctgtaatcccagctactcgggcagctgagggaggagaatcgcttgaacctgggcggtggaggttgcagtgagctgagattgcgtcattgcactccagcatgggcaacaagagtgaaactctgtctcaaaaaaaaaaaaaaaaaaattctatcttttttcctagtttaattttagaatagttgtgacaatgttttgtattatttcctctatatctcctgtttcactatcttccagaatgcttatgaattggtgattatgtctccttgatcaattttcagagttctctatatgttttttagcccttattgcctcagtcaaggaggtgaactcctcttttctctgtctcttctgtgcctctaattctaaaggtcttccttttgatgtttctattgactataactggtttcctgtcttctgtttctttcttttactgtcaacttattctaagttcttttccgaacacaatcctctaaagcttcctatcggaaattgactaaccttttactgtagtgtctgtgtttcagccataggcaccttctctgttggcccttgcttcagacttcctgtgtcttagcacagaaatcactaacaatgctattcatgtctgtctgtctttccttctgtccttccttctctttgttgtgctgttcatgagtttaatttttttctcttagagtcccttaaaaagtcattttgcagtgtagctgatggttaagcccccacattcagttcactccgcatccctattggagacagtcagtgctcactgagtacttgtggtccttgatagttctcaaacttccttgcaattaggatggccatgtgagtcattctggccacataggtatcacttccaggctgagagcagttcagtatccattgtgccctctttgtgctctcttctttaccatctgtggctggttgatcctccacttgagcaagaagcctccatttgaccaagaagccacaagttggtagaatcacgagttggaagctaccttgacctgtaaattatagttagaggagaatagcccagtgcctttcaggctgtgcctttagtgagaaatgaacttctgttatgttaagccactgaagtatggggtttatttgttacctcagcatagaccaacctaccttgactaacacagccatcatctaacatcttgatgcaggtgattctaactgtaatgagtacactgggagatggcttgaagttcatggcactcatgtttatttaagtgtgaggaccatgaatacaggggctattcatgagccactgggtttgcattagtggtgatcagtttcccagatatctcgaatttaaatgttttctaggctctctagaggaatcatctcctttttcctcttatgctttcaggaacttgctctttcaaaatgcaagcactgaagcactttctgttcataagatcgtctctgatgttggctcagctacctgtctttgaaaaactctagaaaaacttctttgattttccaagcccttaccaacgcccctattgtttcagactctctcccgctatcccaggaatgtcattttttagttcagaatgctggaggcttccatttaggcatgtggccaaatgtgcctgacagctgtcttcactaaattgggctacctgagctgcccagagaggaattgggcagactcttggcttcagggaaatcctggggcagctcacaactttgtttctccacgtctgcaacagaaggtgcatggaatagacaatcaagtgctgccttttaggtgattttgaaccatctggaccatgatctaggagggacaggctttcatgatgtttcacaaacatatactgttcctccttccctgtaatcaacgtcttgctgaggcaagtgaataccccccagaagatgaagaaacagggctgtggtttgtttccaaacataactgcagagacatacagtagatacagttttttcatctttggtagctctacatctggtctaaccaggccattgcaccttctgactcttgggtcaggcctccagatctgtttctaaaaccacctaaagttaatagtttatagtaactgttataaaacttttagagctaatggaaagtttcatctcttgctgcctcttaaggaagtaaactagtgctttatcctcccttattaaagaaggtagatacacagttctgaaaatagtacatttctgctattggcatcaagactggtctcttttcttaacatataatgatatttttttaggtagggattcggcaccagggatggctttcaggagcctcttccctttcatcattataatagaataattatcatatgcacctgaatgttctattattggttatagagaatgacacaacagtgttccgattatgctggctgcattaagaatggaagaaaggtcacactgaggtaatttaacatcattatttttgtagttatttcttcttcattaatgtttctaaaaatcctcctattcaaagctagcatttattgaacaaaattgttctttcttgggttagctcattgttcacaaagcccacaaggctgggaaacatttagtatcaaccctctctgtgttcatcagttaggattagttttatctcttggtaaaagagactcaaactaaataagttagaaacttatttctctctgacatgaaaatgtggaggcaaaaaagcagtccaaggctagtgtgatgctgtgagcaagccaggattcttctaatatgttgatctacttttcatgccttgtatttctaatgccaatcagtgacccaagatggctgcactggcttcagctatcaggtttgcgttgcagtctacagaaaggaggaagggctatgacaaggggtgcatgccaactgacttttaaggatggcccctggaggtgccacacatcattgtgcttaaagttcatcagcttcatcaggcagaacgtaggcatctggcctcgtataattgcaaaggaggttggggaacttaggtgttttttgtttattttttttctctgggaagtcatggattgagctaaaaaaccccgggttttattactgtggaagatgggagaacatttgttaatagtcatccagcagcctcagtctgtcttcaaatccctgaatgaaccagagggacatgggttggaactgtatcaagaaacaatctaaatgagaccaataaaggatcatttggattctaccccaactgctggccttatgggcagtacatcttggccctctggggaaagatatttctttcttccagccttcatttcctatatagcccatttgtgttctttaagactttaaagctttggataaatgcaaatgttctcttggaatattaatagattgaattgactagcatgatgtagtataagcacacagatgctggaaccagacagaaccatgtttaattctggctctttcccttattaaatgagcgactataagaatgaatgtgaatatcctggacttagatttctcatctgtaaaatgagttacaggaatgccttacatgttttctgtgtgtgtagtaaatgatataacgtttgcaaagtgcgaagttggttattagaaatgatcccttctttgcctttctctactagccatgtgtataacagctctaattcgagtcttatattatcagagcactgggccccaagcagatgtaaccaatgatgagtaagctttgatattctggggaagagaagaagctttctgataggactggatgtattactgtggtttaaggcctgatcagcattaggcaggattggaactcccaactgcatccaggagcacatttattctgatgtgttgctgtgatggttttaatcctgtcattttagcatggggtattttgatgcaatccaaaacacaaaccatggaatttcaccttttgaaagttgtcagtcagcctgcaaaaccagcatccgtctggagtaaacttcagagtgtgtttgaatgatgaggtgtcaagaatgagagtgtgattcaagagtgaagtagggataagggataactgttgtacactttttaaaaataatagaaacagtgtttttactttttatcatggatgttttcagtcaccaatgcaacctcatcaaatgcatcacgtcaaaatgtcctgcttaaaatgcagtcttagtgctgaataagcatagcatatactgctttggaaaaagacttagccatttaagagggatgcagttttctagaacatcaggaaattatcagtgaaattgtagagaaacaccaggatgtaaagatgccgtcccagaaacctgggagaattggcatgttgcatttgctaatgtatttcggcatttgtgttcactgctactgttactgtgcttttgaatttgtgcaatgacgtgctgtgatttagggtggtcttggccttgagtagtttttaccccataaaggacagttgctgaaggattgctcccttctccctgttttactgctaccatctcaatgctgtatgtgagtgcagtgaagcaatgatgcgctaactgtgcctttcagagctgtgtaaatcctttggttgataaactaggagcgtgtgaacaagataaacgccctagactgaagaagctacccaggatcctgaaagaaaagcatcctgacgtatgtcataataggcacgcagagaaattctgctcagatgagtatttttctagaccttagaattttgtgtcatatctctcactatctaaaagccttgtgtctggcaatagctaaaaatttgagaggaaagcaaaagaaagaaaatcacatcaatgtggctatatatcttatctttgttataatgcaatggtgatactctttgtgtaagctttgctgaccctaaatagggatttaatgtagtcaacataaaaagaaatatggtatatttctaaaattactgatatatgacactacacttatggggctacaactgagaaagcagtgaagtgagcatttttgaaaagaagttaaattgtcactcctacctttgtgtgttacaaacagttcttggataagagagatcagttccagtgttgtgtgtcataattatgaggtataaataaaatatggtaataaattcatgagactttcatgcagaaaaataaaaatgacctattgtctactataaattgggatgcagccatcatgcaaggcaaatgttaggccaagacataaagcatgcacaatatatggccacagttttctaagtttaaattttttgtggaagctgaccttaaacaaaactgtggattaaacctgtaaccctgaaactgactgtattaatttattgaatttataaataagctcaaaatatatactttttcttcaacagaaataaatgctggtttgttttttctttttctgttttaaccaccagggaaccagtttgaactaaacctgaacttaaatatattcaaaatccaaagatataaaacaccaaaaataagtcctgaatcaaataaaaattccatttttatcatctcttgagaaggttaaaccatcaaaatattctcatgaacaaatttcattattagatagccaggcagaagcaaattgtgcaatccccaacctttccttttttaacctttttaaaagatttataggtgcttttcttttcatttgcctctgaaacaccttccagcatttagattttcatttaattgtcacacagcccattttgcatggtaaatatttgcttatttctgactgatttcatatttctctaatgtttgatttcatctagggcttccttgctggtttttaattgaaagcttcatcaagtaaatacactgtactctagagtgtagatttatcaatttgcagagggcacagctcgcttgtgccccaggaagccatgtttattgattgccatgctgaagattcagacgggaactctcacagagtgaaggtggaggaaaatacagaagaagagagagatctggaagtcgataacaagcctctttttataaatgttcgcgtgtgccggaaaagtcaggaagcttagtgttttcagttttttgttttttaaacatgattcgtgcccagtttggctttgatggaagaaccatttaccatctctgaacaataaccagagaaacttgcttaagaaacagtcactgggcctggcgcagtggctcacacctataatcccagcactttgggaggctgaggtaggcggatcacctgatgtcaggagttcgagaccagcctggctaacatggtgaaaccctatctctactaaaaatgcaaagattagccaggtgtggtggcaggcgcctgtaatcccagctactctggaggctgaggcaggaggattgcttgaacccaagaggcagatgttgcagtgagctgagatcgcaccattgcactccagccagggtgacagagtgagactccatctcaaaaaaaataaacaaaaaaaaaaacagtcactgattaacatttccaccaactaaacaaagaaacaaaaagacaacaccaaaaaacagtcactgggcaattgttaggactgagagaataacgacaggagagatgctttcatctcttcaaaagaacttcccaagcatttaaaccttatcagagtctgctccggttatattctgggtgagcattactcagcatcctccttctccccaggctaacatgactgtattttttacaggctactcaaagcttacatttatgtgccccagggtttggtatttggtgctacattatttttgttttatcttcacctccaaagcatcgaactgaatcataaaatactgctgttaaaacacagtcatacacagaagaggaaggagccggcttgacggtgtgcagcaggaattcgggttgtccttttgttggagctggatatgaccacatgcacaagatgaggatttacccaaaggggtgagggacagaatttgaagtctacttgggataaaggctgtaggcattttccaaactctgggtgaaagatgcctaatgtatcttccaacttcattttgtttttactgcttttacttttgttttgtgtttggtgtgtatatccctaacgtatcgtgggtatgatcaaggacaacaccatgctgacccaccacttttttgccatggttatgtccatgggaagaatcagaattctgggctggtatgaccacagggcttatactggaggtaaaccctgatggtctttttagagagaaatttgtattttgttatcttcatgtttcccagatgtccactttccttcctgcagtattgaggtggtattggagtgacatatctgcctcttccagtaaccttttcacttagaccttatttgatgattcaattgctgagattgctgaaaagctaacttctcttggacctcattacctaggcagcaaggccaatggattgaaaagacagttggttacctgtccttcatgcatcacctggaacctcaggctttcatttaggagggtgatgtttccattcccagctcaccattagtactttgtatttataacctttgccctgccataagggagaggagggaagtaactcgtcttcccaggatgcctactgcccacatgccagctgatggctactgagggctcaccactaccgagaccctctcaggactgacctgcagcatttcctaaaccacaaggctcactgaaatcatctgagacagaaggtgaaaataccaatttctagtatcaactccagagctaacgaatcagcacttcatgaggtagagtacatgattctgtcttttgaacaagtcctgcgattaatcaagtttgagaaacctcttttgagactttccccaatatcctcctccacagttaaaactgaccttttccttgtcatattctttttcaggttgctatttaggaaataatcaatgattcatttttgttgaggcttttggtttaatatatgactgctcaaaaaaagggtatttctgtgtgtgatcaacaatcttctggagacagtgttagaattaaaagagggatgccttttcaggctctgtgttagcatgtggagcagagtgcatgtggcagagcttgtgaagcactcttactcctggagaactcacagaggcccttggagtgtatttcagggtgacagttttttctgcccacgctactggacttggaatgagagagtagatgaaatgtaaattcagacacatttgggaatcagcagttccttcttttgaatagattggcatggagtagaagatacaggtgacaggccaggggccgggtgacattcataaattatcagatcctaaaattcacattctagcagaattattttaaagaagcttagctctctttgggtgcataatgtcttattctttcatcttaagcattcatgtttgataaaaacgattcctcatgtaaattcatttattgtaattcagtctttcctaaactcccttgatatagagctacaaaatgttacttttctttttcctcttgagaaaggtgttaaaaatgcaatactgccttatggtatataaatttatctagaactcttggaacaaattctcctaccttttagaagctctgcccttctataacttgcctttcacctgcctaacaaattattcacttttgaaatacatatatatataattcatatataaaaatatatatagaaatgcatgtaatttatatatataaatatatttaatttatatataagtaaatatatagatacgtatatacacttatacatatatgtatatgtatgtgtgtgtctatgtgtatatatatatacatatatatatatatatatatagctcatgagaaatgaattcaactaaagttatccagttggtctgtttgcctcattctgctttactgagcagtctgtccttcgctaccttgatgctttccagcttgtttcactccatgtggtgaatgcaccttcagtgtggccatcccatcctggttaccccatagtcatgccaatctaagtttatggcactgactgacagtggtgccaaggatgactggtgtgagaggtggtcagtgactgtcttgatattgacctcaaaattacagaggtatatagtttgcttttccctggtaattatgagataaaattaacagtaatataccagttatggtatattaatcttgtgaatatttaatttatagattgagggataaataaatgtctcttagggattgggagagagtaagagagaggagttctgggtgctgtgccctgctggagatgaaaacgcagatggacctaatctgcatgctaaatagttctctctgttcctgttgcataaacaatgcaattcagtgctctattttgtagatggtttatgcctggcaaatagagctgctcagctttggaaccagcaatgctgcatcttctagtgacatgcctgctggaaatgggcctattgaattagtagtggctatgagacaataaatgaccaattcagtgtcaggaagcaagcagagcaagagggctttgtgtttgcccagttactttaatctgatttgggaccaacagagaaatgctttggtgcccccaaatctgattcggttcctccaaaccctatgcttagaaattcatttctttgagataatatagtatacttctaggaatcctatgtgaaaaaatgtaaaactcttctttagggtatcaagttattattcttagacatccataataaaagatggtcagtcactaaatactaacaccatcttgaggactgtggcaaaggattggaaagtttcagggcaaataagtgtaggatgaccagatgtttactttctcccaggaaaccctcatcactctttcggtacattgggcagtaagctacagtaggcagtgtgaatgcagtttcctagtatccaacctaatgaggagatacttagaatggagtactgaaaggcccaggctctgaactgaacaatcggcatccataaattattctcttagttcttgaggactcagtgctctactctaacgcactctgggaagggctacctggggaagaacttccaggcttgctgcttggattcatgtttcctgtaatgcaactttattcaggaatatatatatttttttaatttttaatttttttattattattatactttaagttttagggtacatgtgcaaaatgtgcaggttagttacatatgtatacatgcgccatgctggtgtgttgcccccattaacttgtcatttagcattaggtacatctcctaatgctatccctcccccctccccccaccccacaacagtccccagagtgtgatgttccccttcctgtgtccatgtgttctcattgttcaattcccatctatgagtgagaacatgcggtgtttggttttttgttcttgcgatagtttactgagaatgatgatttccaatttcatccatgtccctacaaaggacatgaactcatcatgttttatggctgcatagtattccatggtgtatatgtgccacattttcttaatcccgtctgtcactgttggacatttgggttggttccaagtctttgctattgtgaatagtgccacaataaacatgtgtgcctgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtgaaagtgttcctatttctccacatcctctccagcacctgttgtttcctgactttttaatgatcgccattctaactggtgtgagatggcatctcgttgtggttttgatttgcatttctctgatggccagtgatgatgagcattttttcatgtgtcttttggctgcataaatgtcttcttttgagaagtgtctgttcatatcctttgcccactttttgatggggttgtttgtttttttcttgtaaatttgtttgagttcattgtagattctggatattagccctttgtcagatgagtaggttgggaaaattttctcccattttgtaggttgcctgttcactctgatggtagtttcttttgctgtgcagaagctctttagtttaattagatcccatttgtcaattttggcttttgttgccattgcttttggtgttttggacatgaagtccttgcccatgcctatgtcctgaatggtaatgcctagattttcttctagggtttttatggttttaggtctaacatatttaagtctttaatccatcttgaattaatttttgtataaggtgtaaggaagggatccagtttcagctttctccatatggctagccagttttcccagcaccatttattaaatagggaatcctttccccattgcttgtttttctcaggtttgtcaaagatcagatagttgagatatgtggcattacttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggtgatgccggctcttttttggatccatatgaactttagttttttccaattctgtgaagaaagtcattggtagcttgatggggatggcattgaatctataaattaccttaggcagtgtggccattttcacgatattgattcttcctacccatgagcatggaatgtttttccatttgtttgtatcctcttttatttcattgagcagtggtttgtagttctccttgaagaggtccttcacgtcccttgtaagttggattcctaagtattttattctctttgaagcaattgtgaatgggagttcactcatgatttggctctctgtttgtctgttattggtgtataagaatgcttgtgatttttgtacattgattttgtatcctgagactttgtaagctgataagctgaagttgcttatcagcttaaggagattttgggctgagacgatggagttttctagatatacaatcatgttgtctgcaaacagggacaatttgacttcctcttttcctaattgaataccctttatttccttctcctgcctaattgccctggccacaacttccaaccctatgttgaataggagtggtgagagagggcatccctgttttgtgccagttttcaaagggaatgcttccagtttttgcccattcagtatgatattggctgtgggtttgtcatagatagctgttattattttgagatacgtcccatcaatacctaatttatcgagagtttttagcatgaagggttgttgaattttgccaaagatcttttctgcatctattgagataatcatgtggtttttgtctttggttctgtttatatgctggattacatttattgatttgtgtgtattgaaccagccttgcatcccagggatgaagcccacttgatcatggtggataagctttttgatgtgctgctggattcagtttgccagtattttattgaggatttttgcattaatgttcatcaaggttattggtctaaaattctcttttttggttgtgtctctgcccggctttggtatcaggatgatgctggcctcataaaatgagttagggaggattccctctttttctattgattggaatagtttcagaaggaatggtaccagttcctccctgtacctctggtagaattcggctgtgaatccatctggtcctggactcttttttgttggtaagctattgattattgccacaatttcaaatcttgttattggtctactcagagattcaacttcttcctggtttagtcttgggagagtgtatgtgttgaggaatttatccatttcttctagattttctagtttaattgcgtagaggtgtttgtagtattctctgatggtagtttgtatttctgtgggatcggtggtgatatcccctttatcattttttactgcgtctatttgattcttctctcttttcttctttattagtcttgctagtggtctatcagttttgttgatcctttcaaaaaaccgggtcctggattcactgattttttgaagggttttttgtgtctctatttcctttagttctgctctgattttagttatttcttgccttctgctagcttttgaatatgtttgcttttgcttttctagttcttttaattgtgatgttagggtgtcaattttggatctttcctgctttctcttgtgggcatttggtgctataaatttccctctacacactgctttgaatgtgtcccagagattctggtatgttgtgtctttgttctcattggtttcaaagaacatctttatttctgccttcatttcgttatgtatccagtagtcattcaggagcaggttgttcagtttccatgtagttgagcagttttgagtgagtttcttaatcctgagatctagtttgattgcactgtggtctgagagacagtttgttataatttctgttcttttaaatttgctgaggagagctttacttccaagtatgtggtcaattttggaataggtatggtgtggtgctgaaaaaaatgtatattctcttgatttggggtggagagttctgtaaatgtctatcaggtccgcttggtgtagagctgagttcaattcctgggtatccttgttaactttctgtctcgttgatctgtctaatgttgacagtggggtgttaaagtctcccattattattgtgtgggagtctaagtgtctttgtaggtcactcaggacttgctttatgaatctgggtgctcctgtattgggtgcatatatatttaggatagttagctcttcttgttgaattgatccgtttaccattatgtaatggccttctttgtctcttttgatctttgttggtttaaagtctgttttatcagagactaggattgcaatccctgcctttttttgttttccatttgcttggtagatcttcctccatccttttattttgagcctatgtgtgtctctgcacatgagatgggtttcctgaatacagcacactgatgggtcttgcttgactctttatccaatttggcagtctgtgtcttttaattggaggatttagtccatttacatttaaagttaatattgttatgtgtgaatttgatcctgtcattatgatgttagctggttattttgctcgttagttgatgcagtttcttcctagccttgatggtctttacattttggcatgattttgcagtggctggtactggttgttcctttccatgtttagtgcttccttcaggagctcttttagggcaggcatggtggtgacaaaatctctcagcatttgcttgtctgtaaagtattttatttctccttcacttgtgaagcttagtttggctggatatgaaattctgatttgaaaattcttttctttaagaatgttgaatattggcccccactctcttctggcttgtggagcttctgccaagagatctgctgttagtctgatgggcttccctttgtgggtaacccgacctttctctctggctgcccttaacattttttccttcatttcaactttgttaaatctgacaattatgtgtcttggagttgctcttcttgaggagtatctttgtgatgttctctgtatttcctgaatctgaatgttggccagccttgctagattggggaagttctcctggataatatcctgcagagtgttttccaacttggttccattctccctgtcactttcaggtacactgatcagatgcagatttggtcttttcacatagtcccatatttcttggaggctttgttcatttctttttattcttttttctctaaacttcccttctcatttcatttcattcatttcgtcttccatcactgataccctttcttccagttgatcacatcggctcctgaggcttcttcattcttcatgtagttctcgagccttggctttcagctccatcagctcctttaagcacttctctgtgttggttattctagttatacgtttgtctaaatttttttcaaagttttcaacttctttgccttttgtttgaatttcctcctgtagctcagagtagtttgatcgtctgaagccttcctctctcatctcgtcaaagtcattctccgtccagctttgttccgttgctggtgaggaactgcgttcctttggaggaggagaggcgctctgctttttagagtttccagtttttctgctctgttttttccccatctttgtggttttatctacttttggtctttgatgatggtgatgtacagatgggtttttggtgtggatgttctttctgtttgttagttttccttctaacagacaggaccctcagctgcaggtctgttggagtttgctagaggtccactccagaccctgtttgcctgggtatcagcagtggtgtctgcagaaccacggattttcgtgaaccacaaatgctgctctctgatcgttcctctggaagttttgtcttggaggagtacctggccgtgtgaggtgtcagtctgcccctactggggggtgcctcccagttaggctgcttggggatcaggggtcagggacccacatgaggaggcagtctgccttttctcagatctccagctgtgtgctgggagaaccactgctctcttcaaagctgtcagacagggacatttaagtctgcagaggttaatgctgtctttttgtttgtctgtgccctgcccccagaggtggagcctacagaggcaggcaggcctccttgagctgtggtgggctccacccagttcgagcttcccggctgctttgtttacctaagcgagcctgggcaatggtgggcgcccctccccgagcctcactgctgccttgcagtttgatctcagactgctgtgctagcaatcagcgagactccgtgggcataggatcctccaagccaggtgcgggatataatctcctggtgggccatttcctaagcccgttggaaaagcgcaatattggggtgagagtgacccggttttccaggtgctgtttgtgacccctttccttgaccaggaaagggaactccctgaccccttgcgcttcctgagtgaggcaatgcctcgctctgctttggctcgcacatgttgtgctgcacccactgtcctgcgcccactgtctggcactccctagtgagatgaacctggtacctcagatggaaatgcagaaatcacccatcttctgcgtcactcacgctcggagctgtagaccggagctcttcctgttcggccatcttggctcctctcccccattc

SEQ ID NO: 12190 - DNA, 3685 bp, Homo sapiens
gtctaacgtttaagtctttaatccatcttgaattaatttttgtataaggtgtaaggaagggatccagtttcagctttctacatatggctagccagttttcccagcaccatgtattaaatagggaatcctttccccatttcttgtttttgtcaggtttgtcaaagatcagacagttgtagatatgtggcattatttctgaggcctctgttctgttccattggtttatatctctgttttggtagcagtaccatgctgttttgattactgtagccttgtagtatagtttgaggtcaggtagcgtgatgcctccagctttgttcttttggcttaggattgacttgtcaatgtgggctcttttttggttccatatgaactttaaagtagttttttccaattctgtgaagaaagtcattgttagcttgatggggatggcattgaatctataaattaccttgggccgtatggccattttcatattgattcttcctacctatgagcatggaatgttcttccatttgtttgtatcctcttttatttcattgagcagtggtttgtagttctccttgaagaggtccttcacatcccttgcaagtcggattcctaggtattttattctctttgaagcaattgtgaatgggagttcactcatgatttggctctgtttgtctgttattgatgtataagaatgcttgtgattttgcatattgattttgtatcctgagactttgctgaagttgcttatcagcttgaggagattctgggcggagacaatggggttttctagatacacaatcatgtcatctgcaaacagggacaatttgacttcctcttttcctaattgaatgccctttatttccttctcctgcctgattgccctggccagaacttccaacactatgttgaataggagtggtgagagagggcatccctgtcttgtgccagttttcaaagggaatgcttccagtttttgtcccttcagtatgatattggctgtgggtttgtcatacatagctcttattattttgagatacgtcccatcaataactaatttattgagagtttttagcatgaaggttgttgaattttgtcaaaggccttttctgcatctattgagaaaatcatgtggtttttgtctttggttctgtttatatactggattacatttattgatttttgtatgttgaacagccttgcatcccagggatgaagcccacttgatcatggtggataagctttttgatgtgttgctggattcagtttgccagtattttattgaggatttttgcatcagtgttcatcaaggatattggtctaaaattctctttttttgttgtgtctctgccaggttttggtatcaggatgatgctggcctcataaaatgagttagggattccctctttttctattgattggaatagtttcagaaggaatggtaccagttcctccttgtacctctggtagaattcggctgtgaatccatctggtcctggactttttttggttggtaagctcttcattattgcctcaatttcagatcctgttattggtcttttcagagattccaattcttcctggtttagtcttgggagagtgtatgtgtcaaggaatttatccgtttcttctagattttctagtttatttgcatagaggtgtttatagtattctctgatggtagtttgtatttctgtgggattggtggtgatatcccctttatcattttttattgcgtctatttgattcttctctcttttcttctttattagtcttgctagtggtctttcaattttgttgatcttttcaaaaaaccagctcctggattcactgagtttttgaagggttttttgtgtctctatttccttcagttctgctctgatcttagttatttcttgccttctgctatcttttgaatgtgtttgctcttgcttctctagttcttttaattgtgatgttagggtgtcaattttagatctttcctgctttctcttgtgggcatttagtgctataaatttccctctacacactgctttgaatgtgtcccagagattctggtatgttgtgtctttgttctccttggtttcaaagaacatctttatttctgccttcatttcgttatgtacccagtagtcattcaggagcaggttgttcagtttccatgtagttgagtggttttgagtgagtttcttaatcctgaattctagtttgattgcactgtggtctgagagacagtttgttataatttcagttcttttacatttgctgaggagtgctttacttccaagtatgtggtcaattttggaattggtgtggtgtggtgctgaaaagaatgtatattctgttgatttggggtggagagttctgtagatgtctattaggtctgcttggtgcatagctgagttcaattcctggatatccttgttaactttctgtctcgttgatctgtgtaatgttaacagtggggtgttaaagtctcccattattattgtgtgggagtctaagtctctttgtaggtcactcaggacttgctttatgaatctgggtgctcctgtattgggtgcatatatatttaggatagttggttcttcttgttgaattgatccctttaccattatgtaatggccttctttgtctcttctgatctttgttggtttaaagtttgttttatctgagactaggattgcaacccctgcctttttttgttttccatttgcttggtagatcttcctccatccatttattttgagcctatgtgtgtctgggcacgtgagatgggtttcctgaatacagcacactgatgggtcttgactctttatccaatttgccagtctgtgccttttaattggagcatttagcccatttacatttaaggttaatattgttatgtgtgaatttgatctcgtcattatgatgttagctggttattttgctcattagttgatgcagtttcttcctagctttgatggtctttacaatttggcatgtttttacagtggctggtaccggtttttcctttccatgtttagcgcttccttcaggagctcttttagggcaggcctggtggtgacaaaatctctcagcatttgcttgtctgtaaagtattttatttctccttcacttatgaagcttagtttggctggatatgaaattctatgttgaaaattcttttctttaagaatgttgaatattggcccccactctcttctggcttgtagagtttctgccgagagataagctgttagtctgatgggcttccctttgtgggtaacccaacctttctctctggctgcccttaacattttttccttcatttcaactttggtgaatctgacagttatgtgtcttggagttgctcttctcgaggagtatctttgtggtgttctctgtatttcctgaatttgaatgttggcctgccttgctacactggggaagttctcctggataatatcctgcagagtgttttccaacttggttcctttctcaccatcactttcaggtacaccaattagaggtagatttggtcttttcacatagtcccatatttcttggaggctttgttaatttctttgtattcttttttctctaaacttccctttatgcttcatttcattcatttcatcttccatcgctgatatcctttcttccagttgattgcatcagttactgaggcttgtgcattcgtcacgtagtt

SEQ ID NO: 12191 - DNA, 28376 bp, Homo sapiens; identical to SEQ ID NO: 12148

SEQ ID NO: 12192 - DNA, 5591 bp, Homo sapiens
ttttttgcagattccttagtgttttttttttttattatactttaagttttagggtacatgtgcacaacgtgcaggtttgttacatatatatatgtgtgccatgttggtgtgctgcacccattaactcgtcatttaacattaggtatatctcctaatgctatccttcccccctcctcccaccccacaacaggccctggtgtgtgatgttccccttcctgtgtccatgtgttctcattgttcaattcccacctacgagtgagaacatgccgtgtttggttttttgtccttgcgatagtttgctgagaatgatggttttcagcttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaccatacgtgtgcatgtgtctttatagcagcatgatttataatcctttgggtatatacccagtaatgggatggctgggtcaaatggtatttctggttctagatccctgaggaatcgccacactgacttccacaatagttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgtcttttggctgcataaatgtcttcttttgagaagtgtctgttcatatccttcgcccgcttgttgatggagttgtttgtttttttcttgtaaatttgtttgagttcattgtagattctggatattagccctttgtcagatgagtaggttgcaaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctgtgtcctgaatggtattgcctaggttttcttctaggatttttatggctttaggtctaacatttaaatctttaatccatcttgaattaattttagtataaggtgtaaggaagggatccagtttcagctttccacatatggctaggcagttttcccagcaccatttattaaatagggaatcctttccccattgcttgtttttctcaggtttgtcaaagatcaggtagttgtagatatgtggcattatttctgaggcctctgctctgtaccattggtctatatctctgttttggtaccagtaccatgctgttttggttactgtagccctgtagtatagtttgaagtcaggtagcgtgatgcctccagctttgctcttttggcttaggattgacttggcaatgtgggctcttttttggttccatatgaactttaaagtagttttttccaattctgtgaagaaagtcattggtagcttgatggggatggcattgaatctataaattaccttgggcagtatggccattttcacaatattgattcttcctacccatgagcatggaatgttcttccatttgtttgtatcctctttcatttcatcaagcagtggtttgtagttctccttgaagaggtccttcacatcccttgtaagttggattcctaggtattttattctctttgaagcaattgtgaatgggagttcactcctgatttggctttctgtctgttattggtgtataagaatgcttgtgatttttgtacattgattttgtatcctgagactttgctgaagttgcttatgagcttaaggagattttggtctgagacaatgggattttctagatacacaatcatgtcatctgcaaacagggacagtttgacttcctcttttcctaactgaataccctttatttttttctcctgcctgatagccctggccagaacttccaacactatgttgaatagcagtggtgagagagggcatccctgtcttgtgccagttttcaaagggaatgcttccagtttttgtccattcagtatgatattggctgtgggtttgtcataaatagctcttattattttgagatacatcccatcaatacctaatttcttgagagtttttagcatgaagggctgttgaattttgtcaaaggccttttctgcatctaatgagataatcatgtggtttttgtcattggttctgtttatatgctggattacgtttattgatttttgtatgttgaaccagccttgcatcccagggatgaagcccacttgatcatggtggataagctttttgatgtgctgctggatttggtttgccagtattttattgaggatttttgcatcgatgttcatcaaggatattggtctaaaattctctttttttgttgtgtctctgccaggctttggtatcagaatgatgctggcctcataaaatgagttcgggaggattccctctttttctattgattggaatagtttcagaaggaatggtaccagctcctccttgtacctctggtagaattcggctgtgaatccatctggtcttggacttttttttggttggtaagctattaattattgcctcattttcagagcctgttattggtctattcagatattccagttcttcctggtttagtcttgggagggtgtatgtgtcaaagaatttacccatttcttctagattttctagtttatctgtgtagaggtgtttatagtattctctgatggtagtttgtatttctgtgggatcggtggtgatatcccctttatcatttttttattgcatctatttgattcttctctcttttcttctttattagtctagctagcggtctatccattttgttgatcttttcaaaaaaccagctcctggattcattgatttttttaaggggtttttgtgtctctatctccttcagttctgctctgatcttagttatatcttgccttctgctagcttttgaatgtgtttgctcttgcttctctagttcttttaattgtgattttagggtgtcaatttgagatctttcctgctttctcttgtgggcagttagtgctataaatttccctctacacactgctttaaatgtttcccagagattctggtatgttgtatctttgttctcattggtttccaagaacatctttatttctgccttcatttcgttatgtacccagtagtcattcaggagcaggttgttcagtttccatgtagttgagtggttttgagtgagtttctcagtcctgagttctagtttgattgcactgtggtctgagaggcagtttgttatagttacaatttctgttcttttacatttgctgaggagtgctttacttcaaagtatgtggtcaattttggaataggtgtggtgtggtgctgaaaagaacgcatattctgttgatttgggttggagagttctgtagatgtctattaggtctgcttggtgcagagctgagatcagttcctggatatcctcattaactttctgtctcattgatctatctaaggttgacagtggggtgttaaagtctccccttgttattgtgtgggagtctaagtctctttgtaggtctctaaggacttgctttatgaatctgggtgctcctgtattgggtgcatatatatttaggatagttagctcttcttgttgaattgatgcctttaccattatgtaatggccttctttgtctcttttgatctttgttggtttaaagtctgttttatcagagaccaggattgcaacccctgccttttttttgttttccatttgcttggtagatcttcctccatccctttattttgagtctatgtgtgtctctgcacatgagatgggtttcctgaatacagcacactgatgactctttatccaatttgccagtctatgccttttaattgggagcatttagcccatttgcatttaaagttaatattgttatgtgtaaatctgatcctgtcattatgatgttagctggttattttgcttgttagttgatgcagtttcttcctagcctcgatggtctttacaatttggcatgtttttgcagtggctggtaccggtcgttcctttccatgttgagtgcttccttcaggagctcttttagggcaggcctggtggtgacaaaatctctcagcatttgcttgtctgtaaaggattttatttctccttcacttatgaagcttagtttggctggatatgaaattctgggttgaaaattcttttctttaagaatgttgaatattggtccccaactctcctctggcttgtagagtttctgccgatagatctgctgttagtctgatgggcttctctttgtgggtaacccgacctttctctctggctgcccttaacattttttccttcatttcaactttggtgaatctgacaattatgtgtcttggagttgctcttctcgaggagtatctttgtggcgttctctgtatttcctgaatgtgaatgttggcctgccttgctagattcaggaagttctcctggataatatccggcagagtgttttccaacttggttccattctccccgtcactttcaggtacaccaatcagatgtagatttggtcttttcacatagtcccatatttcttggaggctttgttcatttctttttattcttttttctctaaacttttcttctcgcttcatttcattcatttgatcttccatcactgataccctttcttccagttgatcgaattggctactgaggcttgtgcattcatcatgtagttctcatgccatggttttcagctccatcaggtcctttaaggacttctcagcattggttattctagttagcctttcatctaatcttttttcaaggtttttaacttctttgccatgggtttgaacttcctcctttagctcggagtagtttgatcttctgaaggcttcttctctcaactcgtcaaagtcattctccctccagctttgttccattgctggtgaggaggtgcattccttcggaggaagagaggcgctctgatttttagaattttcagtttttctgctctgttttttccccatgtttgtggttttatctacctttggtctttgatgatggtgatgtacagatggggttttggtgtggatgtcctttctgtttgttagttttccttctaacagtcaggaccctcagctgcaggtgggttggagtttgccggaggtccactccagaccctgtttgcctgggtatcagcagcagaggctgcagaacaatggatattggtgaacagcaaatgttgctgcctgatcgttcctctggaagttttgtctcagaagagtacccagccgtgtgagttgtcagtctacccctactgggggttgcctcctagttaggctacttgggcatcagggacccccctgaggatgcagtctgtccattctcagatctcaagctgcatgctgggagaaccactactctcttcaaagctgtcagatagggacatttaagtctgcaggatttctgctg

SEQ ID NO: 12193 - DNA, 3337 bp, Homo sapiens
gtttcagctttctacatatggctagccagttttcccagcaccatttattaaatagggaatcctttccccattgcttgtttttctcaggtttgtcaaagatcagatagttgtagatatgcggcattatttctgagggctctgttctgttccattggtctatatctctgttttggtaccagtaccatgctgttttggttactgtagccttatagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttggagaggtccttcccatcccttgtaagttggattcctaggtattttattctctttgaagcaattgtgaatgggagttcactcatgatttggctctctgtttgtctgttgttggtgtataagaatgcttgtgatttttgtacattgactttgtatcctgagactttgctgaagttgcttatcagcttaaggagattttgggctgagacaatggggttttctagatatacaattatgttgtctgcaaagagggacaatttgacttcctcttttcctaattgaataccctttatttccttctcctgcctaattgccctggccagaacttccaacactgtgttgaataggagtggtgagagagggcatccctgtcttgtgccagttttcaaagggaatgcttccagtttctgcccattcagtatgatattggctgtgggtttgtcatagatagctcttattattttgaaatacgtcccatcaatacctaatttactgagagtttttagcatggagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcgttttgtcagtattttattgaggatttttgcatcaatgttcatcaaagatattggtctaaaattctctttttttgctgtgtctctgcctggctttggtatcagaatgatgctggcctcataaaatgagttagggaggattccctctttttctattgattggaatagtttcagaaggaatggtactagttcctccttgtacctctggtagaattcggctgtgaatccatctggtcctggactctttttggttggtaagctattgattattgccacaatttcagctcctgttattggtctattcagagattcaacttcttcctggtttagtcttcagagagtgtatgtgtccaggaatttatccatttcttctagattttctagtttatttgcatagagatgtttgtagtattctctgatggtagtttgtatttctgtgggatcggtggtgatatcccctttatcattttttattgcatctattcgattcttctttttttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacaaactgctttgaatgcgtcccagagattctggtatgttgtgtctttgttctcgttggtttcaaagaacatctttatttctgccttcatttcgttgtgtacccagtagtcattcaggagcaggttgttcagtttccatgtagttgagcggttttgagtgagattcttaatcctgagttccagtttgattgcactgtggtctgagagatagtttgttataatttctgttcttttacatttgctgaggagagttttacttccaactatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcattgatctgtctaatgttgacagtggggtgttaaagtctcccattattaatgtgtgggagtctaagtctctttgtaggtcactcaggacttgctttatgaatcttggtgctcctgtattgggtgcatatatatttaggatagttagctcttcttgttgaattgatccctttaccattatttaatggccttctttgtctcttttgatctttgttggtttaaagtctgttttatccgagactaggattgcaacccctgccttttttttgttttccatttgcttggtagatcttcctccatccttttattttgagcctatgtgcgtctctgcacatgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttgctcgttagttgatgcagtttcttcctagtctcgatggtctttacattttggcatgattttgcagcagctggtaccggttgttcctttccatgtttagtgcttccttcaggagctcttgtaaggcaggcctggtggtgacaaaaatcccttcaggagctcttgtaaggcaggcctggtggtgacaaaatctctcagcatttgcttgtctgtaaaggattttatttctccttcacttatgaagcttagtttggctggatatgaaattctgggttgaaaattcttttctttaagaatgttgaatattggcccccactctcttctggcttgtagggtttctgccgagagatccgctgttagtctgatgggcttccctttgagggtaacctgacctttctctctggctgcccttaacattttttccttcatttcaactttggtgaatctgacaattatgtgtcttggagttgctctt

SEQ ID NO: 12194 - DNA, 2560 bp, Homo sapiens
  misc_feature (2546)..(2546): n equals a,t,g, or c
  misc_feature (2549)..(2549): n equals a,t,g, or c
gaaagtcattggtagtttgatggggatggcattgaatctgtaaattaccttgggcagtatggccattttcacgatattgattcttcctacccatgagcatggaatgttcttccatttgtttgtatcctcttttatttctttgggcagtggtttgtagttctccttgaagaggtccttcacatcccttggaagttggattcctaggtatcttattctctttgaagcaattgtgaatgggagttcactcatgatttggctctctgtctgttcttggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggactggtgagaagggacatccctgtcttgtgccagttttcaaagggaatgcttccagtttttgcccattcagtatgatattggctgtgggtttgtcatagatagctcttaatattttgagatacgtcccatcaatacctaatttattgagagtttttagcatgaagggttgttgaattttgtcaaaggccttttctgcatctgttgagataatcatgtggtttttgtctttggttctgtttatatgctggaatacatttattgatttgcatatattgaacgagccttgcatcccagggatgaagcccgcttgatcagggtggataagctttttgatgtgctgctagattcggtttgccagtactttattgaggatttttgcattgatgttcatcaaggatattggtctaaaattctttttttttattgtgtctctgtccggctttggtatcaggatgatgttggtcttataaaatgagttagggaggattccctctttttctattgattggaacagtttcagaaggaatggtaccagttcctccttgtacctgtggtagaattcggctgtgaatccatctggtcctggactctttttcattggtaagctattgattattgccacaatttcagctcctgttattggtctattcagagattcagcttcttcctggtttagtcttgggagagtgtatgtgtcgaggaatttatccatttcttctagattttctagtttatttgcatagaggtgtttgtagtattctctgatggtagtttgtatttctgtgggatcggtggtgatatcccctttatcatttttattgcatctatttgattcttctctctttttttctttattagtcttgctagcagtgtatcaattttgttgatcctttcaaaaaaccagctcctggattcattgattttttgaagggtttttgtgtctctatttccttcagttctgctctgattttagttatttcttgccttctgctagcttttaaatgtgtttgctcttgcttctctagttcttttaattgtgatgttagggtgtcaattttggatctttcctgctttctcttgtgggcatttagtgctataaatttccctctacacactcctttgaatgtgtcccagagattctggtatgttgtgtctttgttctcgttggtttcaaagaacatctttatttctgccttcatttcgttatgtacccagtagtcattcaggagcaggttgttcagtttccatgtagttgagtggttttgactgagattcttaatcctgagttctagtttgattgcactgtggtctgagagacagtttgttataatttctgttcttttacatttgctgaggagagctttacttccaagtatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtttaatgtggacagtggggtgttaaagtctcccattattaatttgtgggagtctaagtctctttgtaggtcactgaggacttgctttatgaatctgggtgctcctgtattgggtgcatatatatttaggatagttagctcttcttgttgaattgatccctttaccattatgtaatggccttctttgtctcttttgatctttgttggtttaaagtctgtttcatcagagactaggattgcaacccctgcctttttttgttttccatttgcttggtagatcttcctccatccttttattttgagcctatgtgtgtctctgcccatgagatgggtttcctgaatacagcacactgatgggtcttgaccctttatccaatttgccagtctgtgtcttttaattggagcatttagtccatttacatttaaagttaatattgttatgtgtgaatttgatcatgtcattatgatgttagctggttattttgctcgttagttgatgcagtttnttncctatttcgat

SEQ ID NO: 12195 - DNA, 12074 bp, Homo sapiens
gtctctgcccggctttggtatcaggatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattcccacaatttcagagcctgttattggtctattcagagattcaacttcttcctggtttagtcttcggagggtgtatgtgtcgaggaatttatccatttcttctagattttctagtttatttgcgtagaggtgtttgtagtattctctgatggtagtttctatttctgtgggatcggtggtgatatcccctttatcattttttttgtgtctatttgatttttctctcttttcttctttattagtcttgctagtggtctatcaattttgttgatcctttcaaataaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttgaatctttcctgctttctcttgtgggcatttagtgctataaatttccctctacacactgctttgaatgtgtcccagagattctggtatgttgtgtctttgttctcgttggtttcaaagaacatctttttttctgccttcatttcgttatgtacccagtagtcattcaggagcaggttgttcagtttccatgcagttgtgcagttttgagtaagtttcttaatcctgagttctagtttgattgcactgtggtctgagagacagtttgttataatttctgttcttttgcatttgctgaggagagctttacttccaactatgtggtcaattttggaataggtgtggtgtggtgctgaaaaaaatgtatattctgttgatttggggtggagagttctttagatgtgtattaggtccgcttggtgcagagctgagttcaattcctgtgtatccttgttaactttctgtctcgttgatctgtctaatgttgacagtggggtgttaaagtctcccattattattgtttgggagtccaagtctctttgtaggtcactcaggacttgctttatgaatctgggtgctcctgtattgggtgcatttatatttaggatagttagctcttcttgttgaattgatccctttaccgttatgtaacggccttctttgtctcttttgatctttgttggtttaaagtctgttttatcagagactaggattgcaacccctgcctttttttgttttccatttgcttggtagatcttcttccatccttttattttgagcctatgtgtgtctctgcacgtgagatgggtttcctgaatacagcacactgatgggtcttgactctttatccccagtcaagacccatcagtctgtgtcttttaattggagcatttagtccatttacatttaaagttaatattgttatgtgtgaatttgatcctgtcattatgatgttagctggttattttgctcgttagttgatgcagtttcttcctagcctcgatggtctttacgttttggcatgattttgcagtggctggtaccggttgtgcctttccatgtttagtgcttccttcaggagctcttttagggcaggcctggtggtggcaaaatctctcagcatttgcttgtctgtaaagtattttatttctccttcacttatgaagcttagtttggctggatatgagattctgggttgaaaattcttttctttaagattgttgaatattggcccccactctcttctggcttgtagagtttctgccgagagatcggctgttagtctgatgggcttccctttgtgggtaacccgacctttctctctggctgcccttaccattttttccttcatttcaactttggtgaatctgacaattatgtgtcttggagttgctcttctcgaggagtatctttgtggcattctctgtatttactgaatctgaatgttggcctgccatactagattggggaaattctcctggataatatcgtgccgagtgttttccaactcggttccatcctccccgtcactttcaggtacacaatcagacgtagattttgtcttttcacatagtcccatatttcttggaggctttgttcatttctttttattcttttttctctaaacttcccttcttgtttcatttcattcatttcatcttccatcactgataccctttcttccagttgatcgcatcagctcctgaggcttctgcattcttcatgtagttcttgagccttggctttcagctccatcagctcctttaagcacttctctgtattggttattctagttatacattcgtctaaatttttttcaaagtttttaacttctttgcctttggcttgaatttcctcctgtagctcggagtagtttgaacgtctgaagccttcttctctcaactcgtcaaagtcattctctgtccagctttgttccgttgctggtgaggaactgtgttcctttgggggaggagaggtgctctgctttttagagtttccagtttttctgctctgttttttccccatctttgtggttttatctacttttggtctttgatgatggtgatgtacagatgggtttttggtgtagatgtcctttctgtttgttagttttccttctaacagacaggaccctcagctgcaggtctgttggagtttgctagagatccactccagaccctgtttgcctggttatcagcagcggtggctgcagaacagcgtattttcgtgaaccgcgaatgctgctttctgatcgttcctctggaagttttgtctcagaggagtacctggccgtgtgaggtgtcagtctgcccctactggggggtgcctcccagttaggctgctcgggggtcaggggtcagggacccacttgaggaggcagtctgcctgttctcagatctccagctgcgtgctgggagaaccactgctcttttcaaagctgtcagacagggacatttaagtctgcagaggttactgccatctttttgtttgtctgtgccctgtcctcagaggtggagcctacagaggcaggcaggcctccttgagctgtggtggcctccacccagttggagcttcccagctgctttgtttacctaagcaagcctgggcaattgcgggcacccctcccccagcctcgctgccgccttgcagtcgccttgcagtttgatctcagacctgtgctagcaatcagcgagactccgtgggcgccatgtgtgggatataatctcctggtgcgccgttttttaagcctgtcagaaaagtgcagtattagggtgggagtgacccgattttccaggtgccctctgtcacccctttctttgactaggaaagggaactccctgaccccttgcgcttcccgagtgaggcaatgcctcgccctgctttcgcttgggcacggtgtgctgcacccactgtcctgcgcccactgtctggcactccctagtgagatgaacccggtacctcagatggaaatgcagaaatcacccatcttctgcgtcgctcacgctgggagctgtagaccggagctgttcctatttggccatcgtggctgccagctcaaaattatatgttaatatatttgttgtgtagactataatgttttgatatagggatacattgtggaattactaaagctaattaatatattcattaccttacaattttatcattttttgtgtgtgtggtgaaaacatttaaaatctcctcagcagtttgcaggtgtacaatacattgttaataactatagtcaccaatttgtgttgcagttgatcttctaaatgtattctttctaactgaaattttgtatcctttgaccaaacatttccccaattcctacccctaccttttttctcctgataatatttggtcttgtgaaaattttatctcatctctcactatctctgatttatagaccatttgatatttatttttacaagctagataaaaactgccaagttagtatataaactgtagtcttttattttttaaactacgtattcttgtgaataagaattgataacttctatagatattaaaattaagtttttcctcatttgctatgtatacatcaacaactctgtctcctaggcgtgtatcatgtcagggcaggcagaactgaacggaagaataattttcagggtagaatgggagaaaatacagaattatgtgaagcaggctcaggggtttattattgaaacagaggagaggagctgggggcctgagccaatttgcgctgaagccaatgtggctgagatggctccttctgggaacagagatgtgcttggaggagccttggttctcctcaccaatataccccttatgttggctgctgcaggcagcactaccaggttcatttgactgctcacttgttggtagaaggtttgttaattttcttgtccgatttcttctgagattaggaatttccttggattaaaaacaaaataaatcattggttgagtctttttgcaggttaaaaaaaacaagaaaacttggaggtggatttgctgaggaggacagccatgttctctaccagaagtcagattgggtctttttcctaaaacaactaaaaacgcagtagtttgtttactttttaaaatccgtctcctccacctgtggaaagagaactttaaacactatttatgttacatgctgaatctaagactgttgttccttcagcttgaactgcagatattcctaaattgtacctgcatctctagtgaaagctgagtgtgctaaatgctgaccattctccattaactgagatttcagttatctaagagatttgcatcttagcagtactactgtattactctgtaagattccttctacctacctgagctcaaacttcatcctattcagaagatgttttaatataacaagtcagtaggccttctctaccacttaacaaatattaattgagcacctactgtgtacaaggcactgtgcttaattaagtcagggagtatttcagctccctgaaacagagagcatctcagccctcccagattgattctctggactaaatatgcatggtagcttcagtgcctgttgagagaaatgaatgtgtctgggagtgtaaagcagaggtccctaatggagttgttgattgtaggagtaattgtggaggaagtgacatttgagctgagaagtaaagaacaacagggcctagtgggtgatgggacagggatgaaggagccctccagagagagaaaaccatatttgtggacctgaatactcagagacctgaaggatgttcttgatggcaagaggctgggtggtgagaagatgaggtggagaaataggcagccacttttccatcttctgcatgtcaaagtgctgttctcatctttgagagaagctgtcctgtaaagaactcttcaggttctgtgtatttggaagtggcatctaaatcatgcccattggaatcttcttcctggatactatcatgtctttatgtaaacttgtgaatttaaaagtatacatagcagtgtcggagcaggctttcctttttatttttttgcatctggttttcagaatgcccattaggcaaatttttgacctttaactttttcaataggccttggataaggtgggtggtaaattgataggaaaactatagataagtatttgtccatctagttgtaccaaagaagtggtaatatagacttttgtggatcctttagagcacctgatatcacattaaataatatgatacctgaatatgtatttcagttgtttctcccactagaataccagggtaggaattttcttttgtttactgttgtatctgtagtgtccagagcagtgcctagcatgcagtgaatgcttattaaatattttttgaatgaatgaattataagacacttggaagctgagggaatttattataaacagagtttaatccctgaaaggagtcctgcacagagattgtcaatcaaatcatagttttgaagtctgtgttgtatgtctaagattgtattgagccctttaaatagaaactggaagataaacgtggtccctactctgattctaagagcttttatactaaaaggaaagagaatgtcatgagcatttatgtatatagcaaggcattaccatcaacagccattaaaaggggaggtttgtcaaggtggtcgtgagtcagttgagtatttggcctcttcacacgtgtgagaggctggaggctggtggggagctcacataggcgtaacagcccatgttcaaatccagcttcactgcttagtgtttgcattacattggcaagggttgactgcctcgagtgattgttttaagtgctctaggcaagtaataaatattagttctttttgccttgttctttccactatgggtgactgccctaattgagggtataccagataattgcactgtcttgatttgttaagtgcctctaaatgttcttctcctgacatctggactatgtttctagaggcctagggggaggaggaggtaaaggcacttgactttcccaaattagtctgtacccaagtggaactgcataaattgggtaccttaattacaccattgggtattactagggtgattacagggacaagagttaaatagggcttgtctacaaagagtcctgggaggaagtgagatgtgagagaactaaaagcatctaaaggacattttagatggagaggaggtgaagggtgttctcctgtgggttctgacttctgatgctaactcctaacggtgaaagctaggaagttgacttacatgtagctcagaggaggatgctaacctggctcactgcaacttccacctcctggattgaagcgattcccctgcttcagcctcctgagtagctaggattacaggtgcaagccatcatgcctggctaatttttgtatttttagtaaaggtggggtttcaacatgttggccaggttggtctcaaactcctgacctcaggtgatgcacccacctcggtttcccaaagtgctgggattacaggtgtgagccacggtgcctggccctaggtgtggtttttaattactatgtaatcccagggcccagtgtggacctaggacatagttactacatgatacagtgattatcgttggcacaaatgaatgaatcaaagagatagtatgttacaaaggagagggcacgaaatagattttttttttgagcacatgattagaagcagtattttaaggtcatttcctgggctgggaaggttaggaatattcttctgaccagcacctgttggaggaggtggaaaggatcccagatgccagccttctctgtgtccacccttctcccagccttgcctggggacactgagccccttgctgggcttcaagtgcctgatgcttttttgggaagccccataagcttgcttctctttttgcaaacattgcttaagttttcattaataaaaacattctaaagcttatttagtccagaatgaggaaaatgtaggagagagagagggtgtgggtgtgtgtgtggggcgagggggtgtctgtgtgtggttttacctacctatgtggttgccccttcttacctgtgaatgcagtggctgctttccttgttccttctccacagaccctgtaccctccatttcagtttctggcaagaattgtggccagacccagggatctgatgcagtggtccccaacattttctggtcacataatttctaaaagaattttgtaacattaaccctctgggatattttttaattgacatctacattttattttttttattattttattattattatactttaagttttagggtacatgtgcacaatgtgcaggttagttacatatgtatacatgtgccatgctggtgtgctgcacccattaactagtcttttagcattaggtatatctcctaatgctatccctccccccaacccccaccccacaacagtccccagagtgtgatgttccccttcctgtgtctgtgttctcattgttcaattcccatctatgagtgagaacatgcggtgttggttttttgtccttgcaatagtttactgagaatgatgatttccaatttcatccatgtccctgcaaaggacatgaactcatcattttttatggctgcatagtattccatggtgtatatatgccacattttcttaatccagtctatcattgttggacatttgggttggttccaagtctttgctattgtgaatagtgctgcaataaacatacatgtgcatgtgtctttatagcagcatgatttatagtcctttgggtatatacccagtaatgggatggctggatcaaatggtatttctagttctagatccctgaggaatcgccgcactgacttccacaatggttttactagtttacagtcccaccaacagtgtaaaagtgttcctatttctccacatcctctccagcacctgttgtttcctgactttttaatgatcaccattctaactggtgtgagatggtatctcattgtggttttgatttgcatttctctgatggccagtgatgagcgttttttcatatgtcttttggctgcataaatgtcttcttttgagaagtgtctattcatgtccttcgcccacttgttgatggggttggttggttttttcttgtaaatttgtttgagttcattgtagattctggatattagccctttgtcagatgagtaggttgcgaatattttctcccattttgtaggttgcctgttcactctgatggtagtttcttttgctgtgcagaagctctttagtttaattagatcccatttgtcaattttggcttttgttgccaatgcttttggtgttttagacatgaagtccttgcccatgcctatgtcctgaatggtaatgcctaggttttcttctagggtttttatggttttaggtctaacgtttaagtttccatcttgaattaatttttgtataaggtgtaaggaagggatccagtttcagctttctacatatggctagccagttttcccagcactatttattaaatagggaatcctttccccattgcttgtttttctcaggtttgtcaaagatcagatagttgtagatatgcagcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttgacgatgtgggctcttttatggttccatataaactttaaagtagttttttccaattctgtgaagaaagtcattggtagcttgatggggatggcattgaatctataaattaccttgggcagtatggccattttcacaatattgattcttcctacccatgagcatggaatgttcttccatttgtttgtatcctcttttatttcattgagcagtggtttgtagttctccttgaagaggtccttcacgtcccttgtaagttggattcctaagtattttattatctttgaagcaattgtgcatgggagttcactcatgatttggctctctgtttgtctgttattggtgtataagaatgcttgtgatttttgtacattgattttgtatcctgagactttgctgaagttgcttatcagcttaaggagatttttggctgagacaatggggttttgtagatatacaatcatgtcgtctgcaaacagggacaatttgactccctcttttcctaattgaataccctttatgtccttcttctgcctaattgccctggccagaacttccaacactatgttgaataggagtggtgagagagggcatccctgtcttgtgcccgttttcaaagggaatgcctccagtttttgcccattcagtatgatattggctgtgggcttgtcatagatagctcttattattttgagatacgtcccatcaatacctaatttattgagagtttttagcatgaagcgttgttgaattttgtcaaaggccttttctgcatctattgagataatcatgtggtttttgtctttggttctgtttatatgctggattacatttattgatttgcatatattgaaccagccttgcatcccagggatgaagcccacttgatcatggtgaataagctttttgatgtgctgctggattcggtttgccagtattttattgaggatttttgcatccatgttcatcaaggatattggtctaaaattctcttttttggctgtgtctctgcccggctttggtatcaggatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagagcctgttattggtctattcagagattcaacttcttcctggtttagtcttgggagggtgtatgtgccgaggaatttatccatttcttctagattttccagtttatttgcgtagaggtgtttatagtattctctgatggtagtttctatttctgtgggatcggtggtgatatcccctttatcatttttttgtgtctatttgatttttctctcttttcttctttattagtcttgctagtggtctatcaattttgttgatcctttcaaataaccagctcctggattcattaattttttgaagggttttttgtgtctctatttccttcagttctgctctgattttagttatttcttgccttctgctagcttttgaatgtgtttgctcttgcttctttagttcttttaattgtgatgttagggtgtcaattttggatctttcctgctttctcttgtgggcatttagtgctataaatttccctctacacactgctttgaatgtatcccagagattctggtatgttgtgtctttgttctcgttggtttcaaagaacatctttatttctgccttcatttcgttatgtacccagtagtcattcaggagcaggttgttcagtttccatgtagctgagcggttttgagtgagtttcttaatcttgagttctagtttgattgcactgtggtctgagagacagtttgttataatttctgttcttttacatttgctgaggagagctttacttccaactatgtggtcaattttggaataggtgtggtgtggtgctgaaaaaaatgtattttctgttgatttggggtggagagttctttagatgtgtattaggtccgcttggtgcagagctgagttcaattcctgtgtatccttgttaactttctgtctcgttgatctgtctaatgttcacagtggggtgttaaagtctcccattattattgtttgggagtctaagtctctttgtaggtcactcaggacttgctttatgaatctgggtgctcctgtattgggtgcatttatatttaggatagttagctcttcttgttgaattgatccctttaccgttatgtaacggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttgctcgttagttgatgcagtttcttcctagccttgatggtctttacgttttggcatgattttgcagtggctggtaccggttgtgcctttccatgtttagtgcttccttcaggagctcttgtaaggcaggcctggtggtgacaaattctctcagcatt

SEQ ID NO: 12196 - DNA, 3290 bp, Homo sapiens; identical to SEQ ID NO: 12101

SEQ ID NO: 12197 - DNA, 2869 bp, Homo sapiens
gcctgattgccctggccagaacttccaacactgtgttgaataggagtggtgagagagggcatccctgtcttgtgccagttttcaagggaatgcttccaatttttgcccattgagtatgatattggctgtgggtttgtcatagatagctctaattattttgagatatgtcccatcaatacctaatttattgagagtttttagcatgaagggttgttgaattttgtcaaaggccttttctgcatctattgagataatcatgtggtttttgtcattggttctgtttatatgctggattacgtttgttgatttgtatatgttgaaccagccttgcatcccaaggatgaagcccacttgatcatggtggataagctttttgatgtgctgctggattcagtttgccagtattttattgaggatttttgcatcgatgttcatcagggatattggtctaaaattctctttttttgttgtgtctctgccaggctttggtatcaggatggtgctggcctcataaaataagttagggaggattccctctttttctattgattggaatagtttcagaaggaatggtaccagctcctccttgtacctctggtagaatttggctgtgagtccatctggtcctggactttttttggttagtaagctattaattattgcctcaatttcagagcctgttattggtctattcagggattcaacttctttctggtttagtcttgggagggtgtatgtgtcgaggaatttatccatttcttgccagatttgtctagtgttatttggcgtagaaggtgatttgtagtatttctctgtatggtatgtttgtattttctgtggggatcacgtgggtgatatccccctgttatgcattcttttgattgccctcttattgtgagttctgtcttctctttgttctgtcctttatatgagtcaaagcatagccgggtcatatcctattattgttgaatctttttcaaacaaacccagctctctggattcatttgaattgttgaagggttttttgtgtctctatttccttcagctctgctgtgatcttagttatttcttgccttctgcctaagctttttgaatgtgtttgctctagcttctctagttcttttaattgtgatgttagggtgtcaattttagatctttcctgctttctcttgtgggcatttagtgctataattttccctctacacactgctttgaatgtgttccagagattctggtatgttgtatctttgttcttgttggtttcaaagaacatctttatttctgccttcatttcattatgtacccagtagtcattcaggaacagattgttcagtttccatgtagttgagcggttttgagtgagtttcttaatcctgagttctagtttgattgcactgtggtctgagagacagtttgttataatttctgttgttttccatttgatgaggagtgctttacttccaactacgtggtcagttttggaataggtgtggtgtggtgctgaaaagaatgtatattctgttgatttggggtggagagttctgtagatgcctattaggtccgcttggtgcagagctgagttcaattcctggatatccttgttgactttctgtctcattgatctgtctaatgttgacagtggggtgttaaagtctcccattattattgtgtgggagtctaagtctctttgtaggtctctgaggactggctttataaatatgggtgctcctgtattgggtgcatatatatttaggatagttagctcttcttgttgaattgatcccttcaccattatgtaatggccttctttgtctcttttgatcttgttggtttaaagtctgttttatcagagactaggattgcaacccctgcctttttttattttccatttgcttggtagatcttcctccatccccttattttgagcctatgtgtgtctctgcacgtgagatgggtttcctgaatacagcacactgatgggtctgactctttatccaatttgccagtctgtgtcttttaattggagcatttagcccatttacatttaaggttaatattgttatgtgtgaatttgatcctgtcattatgatgttagctggttattttgctcgttagttgatgcagtttcttcctagcctcgatggtctttacagtttggcatgtttttgcagtggctggtaccggttgttcctttccatgtttagtgcttccttcaggagctcttttagggcaggcctgatggtgacaaaatctctcagcatttgcttgtctgtaaaggattttatttctccttcacttatgaagcttagtttggctggatatgaaattctgggttgaaaattcttttctttaagcatgttgaatattggcccccactctcttctggcttgtagagtttctgccgagagatccgctgttagtctgatgggcttccctttgtgggtaacctgacctttctctctggctgcccttaacattttttccttcatttcaactttggtcactctgacaattatgtgtcttggagttgctcttctcgaggagtatctttgtggcgttctctgtatttcctgaatctgaatgttggcctgccttgctagcttggggaagttctcctcgataatatcctgcagagtgttttccaacttggttccattctccccgtcactttcagttacaccaatcagatgtagatttggtcttttcacatagtcacatatttcttggaggctttgttcatttctttctattcttttttctctaaacgtctctcctggcttcatttcattcatttgatcttccatcactgataccctttcttccagttgatcgaatcggctactgagacttgtgcattcatcacatagtt

SEQ ID NO: 12198 - DNA, 4494 bp, Homo sapiens
gtctaacatttaagtctttaatccatcttgaattaatttttgtataaggtgtaaggaagggatccagtttcagctttctacatatggctagccagttttcccagcaccatttattaaatagggaatccttttcccatttcttgtttttgtcaggtttgtcaaagatcagatagttgtagatatgtggcattatttctgaggtctctattctgttccattggtctatatctctgttttgggaccagtaccatgctgttttggttactgtagccttgtagtgtagtttgaagtcaggtagaatgatgcctccagctttgttcttttggcttagtattgacttggcaatgcgggctcttttgtggttccatatgaacttaagtagttttttccgattctgtgaagaaagtcattggtagcttgatggggatggcattgaatctataaattactttgggcagtatggccattttcatgatattgattcttcctactcatgagcatggaatattcttccatttgtttgtatcctcttttatttcattgagcagtggtttgtaattctccttgaagaggtccttcacttcccttgtaagttggatttctaggtattttattctctttgaagcaattgtgaatgggagttcactcatgatttggctctctgtttgtctgttactggtgtataagaatgcttgtgatttttgcacattgattttgtatcctgagactttgctgaagttgcctatcagcttaaggagattttgggctgagacgatggggctttctagatatacaatcatgtcatctgcaaacagggacaatttgacttcctcttttcctaattgaataccctttatttccttctcttgcctgattgccctggccagaacttccaacactatgttgaataggagtggtgagagaggacatccctgtcttgtgccagttttcaaagggaatgcttccagtttttgcccattcagtatgatattggctatgggtttgtcatagatagctcttattattttgagatacatcccatcaagatctaatttattgactttttagcatgaagcattgttgaattttgtcaaagaccttttctgcatctattgagataatcatgtggtttttgtcgttggttctgtttatatgctggattacatttattgatttgcgtatgatgaaccagccttgcattccagggatgaaacccacttgatcatggtggataagctttttgatgtgctgctggatttggtttgccagtattttattgaggatttttgcattgatgttcatcagggatattggtctgaaattctctttttttgttgtgtctctgccaggctttggtatcaggatgatggtggcctcataaaatgagttagggaggattccctctttttctattgattagaatactttcaaaaggaatggtaccagctcctccttgtacctctggtagaattcggctgtgaatccatctggtcctggactttttttgattggtaagctattaattattgcctcaatttcagagcctgttattggtctattcagagattcaacttattcctggtttagtcttgggagggtgtatgtgtcgaggaatttatccatttcttctagattttctagtttatttgcatagaggtgtttacagtattctctgatggtagtttgtatttctgtgggattggtggtgatatcccctttatcattttttattgcatctatttgattcttctctcttttctttattaatcttgctagcagtctatcaattttgttgatcttttaaaaaaaaccagcttctggattcattgatttttgaagggttttttgtgtctctatttccttcagttctgctctgatcttagttatttctcgccttctgctagttttgaatgtgtttgctcttgcttctctagttcttttaattgtgatgttagggtgtcaagtttagatctttcctgctttctcttgtgggcatttagtgctataaatttccctctacacactgctttgaatgcatcccagagattctggtatgttgtgtctttgttctcattggtttcaaagaacatctttatttctgccttaatttcgttatgtacccagtagtcattcaggagcaggttgttcagtttccatgtagttgagtggttttgagtgagtttcttaatcctgagttctagtttgattgcactgtggtctgacagacagtttgttataatttctgttcttttacatttgctgaggagagctttacttccaactatgtggtcaattttggaataggtgtggtgtggtgctgaaaagaatgtatattctgttgaattggggtggagagttctgtagatgtctattaggttcgcttggtccggagctgagttcaattcctggatatccttgttaactttctgtcttgttgatctgtctaatgttgacagtggggtgttaaaatctcccattattattgtgtgggagtctaattctctttgtaggtctctaaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcggagactaggaatgcaacccctacctttttttgttttccatttgcttggtagatcttcctccatccctttattttgagcctatgtgtgtctctgcctgtgagatgggtttcctgaatacagcacactgatgggtcttgactctttatccaatttgccagtctgtgtcttttaattggagcatttagcccatttacatttaaggttaatattgttatgtgtgaatttgatcctgtcattatgatgtcagcttgttattttgctcgttagctgatgcagtttcttcctagcctcgatggtctttacaatttggcatgtttttgcagtggctggtaccagttgttcctttccatgtttagtgcttccttcaggagctcttgtaaggcaggcctggtggtgacaaaatctctcagcatttgcttgtctgtaaaggattttatttctccttcacttatgaagcttagtttggctggatatgaaattctgggtggaaaattcttttctttaagaatgttgaatagtggcccccactctcttctggcttgtagagtttctgccgagagatcagctgttagtctgatgggcttccctttgtgggtaacccgacctttctctctggctgcccttaacattttttccttcatttcaactttggtgaatctgacaattatgtgtcttggagttgctgttctcgaggagtatctttgtggcattctctgtatttcctgaatctgaatgttggcctgccttgctaggttggggaagttctcctggataatatcctgtagagtgttttccaacttggttccattctccccgtcactttcaggtacaccaatcagacgtagatttggtcttttcacatagtcccatgtttcttggaggctttgttcgtttctttttattcttttttctctaaacttctcttcttgcttcatttcattcatttgatcttccatcactgataccctttcttccagttgatcaaattggctactgaggcttgcgcattcatcatgtagttctcctgccatggttttcagctccatcaggtcctttaaggacttctctgcattggttattctagttagccattcgtctaattttttttcaaggtttttaacttctttgccattggttcgaacttcctcatttagcttggtgtggtttgattgtctgaagccttcttctctcacctcatcaaagtcattctccatccagctttgttctgttgctggtgaggagctgcgttcctttggaggaggagaggcactctgctttttagagtttccagtttttctgctgttttttccccatctttgtagttttatctacctttggtctttgataatggtgacatacagatgggttttggtgtggatgtcctttctgtttgttagttttccttctaacagtcaggaccctcagctgcaggtctgttggagtttgccggaggtccagtccagaccctgtttgcctgggtatcagcagcagaggctgcagaacagcggatattggtgaacagcaagtgttgctgcctgatggttcctctggatgttttgtcccagaggagtacccggccgtgtgagatgtcagtctgcccctactggggagtgcctcccagttaggctacttgggggtcagggacccacttgaggaggcagtctgtccattctcagatctccagctgcatgctgggagaattgctactctcttcaaagctgtcagacagggacatttaagtctgcagaggtttttgctgccttttgtttggctatgccctgcccccagaggtggagtgtacagaggcaggcaggcctccttgagctg

SEQ ID NO: 12199 - DNA, 4886 bp, Homo sapiens
gtttaagtctgtaatccatcttgaattaatttttgtataaggtgtaaggaagggatccagtttcagctttctacatatggctagccagttttcccagcaccattcattaaaaagggaatccttttcccattgcttgtttttctcagttttgtcagagatcagatagttgtagatatgtggcattatttctgagggctctgttctgttccattgatctatatctctgttttggtaccagtaccatgctgttttggttactgtagccttgcagtagagtttgaagtcaggtagtgtgatgactccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctctttgatttccttgagcagtggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgattttgtatcctgagactttgctgaagttgcttatcagcttaaggagcttttgggctgagacaatggggttttctagatatacaatcatgtcatctgcaaacatggacaatttgacttcctcttttcctaattgaatactctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaaggattgttgaattttgtcaaaggctttttctgcatctattgagataatcatgtggtttttgtctttggctctgtttatatgctggattacatttattgatttgcatatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtccctgcccggctttggtatcaggatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagatcctgttattggtctattcagagattcaacttcttcctggtttagtcttgggagagtgtaggtgtcgaggaatttatccatttcttctagattttctagtttatttgcgtagaggtgtttgtagtattctctgatggtagtttgtatttctgtgggattggtggtgatatcacctttatcactttttattgcatctatttgattcttctctcttttcttctttattagtcttgctagaggtttattaattttgttgatcctttcaaaaaaccagctcctggattcattaatttttttgaagggttttttgtgtctctatttccttcacttctgctctgattttagttatttcttgccttatgctagcttttgaatgtgtttgctcttgcttttctagttcttttaattgtgatgttagggtgtcaattttggatctttcctgctttctcttgttggcatttagtgctataaatttccctctacacactgctttgaatgcatcccagagattctggtatgttgtgtctttcttctcattggtttcaaagaacatctttatttctgccttcatttcgttatgtatccagtattcattcaggagcaggttgttcagtttccatgtagttgagcagttttgagtgagattcttaatcctgagttctagtttgattgcactgtggtctgagagacagtttgtcataatttctgttcttttacatttgctgaggagagctttacttccaactatgtggtcaattttggaataggtgtggtgtggtgctgaaaaaaacatatattctgttgatttggggtggagagttctgtagatgtctattaggtccacttggtgcagagctgaattcaattcctgggtatccttgttgactttctgtctcgttgatctgtcaaatgttgacagtggagtgttaaagtctcccattattaatgtgtgggagtctaagtctctttgttggtcactcaggactcgctttatgaatctgggtgctcctgtattgggtgcatatatatttagaatagttagctcttcttgttgaattgattcctttaccattatgtaatggccgtctttgtctcttttgatctttgttggtttaaagtctgttttttcagagagtaggattgcaacccctgcctttttttgttttccatttgcttggtagatcttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatctgatcctgtcattatgatgttagctggttattttgctcgttagttgatgcagtttcttcctagtctcgatggtctttacattttggcatgattttgcagcggctggtaccagttgttcctttccatgtttagtgcttccttcaggagctcttttagggcaggcctggtggtgacaaaatctctcagcatttgcttgtctgtaaagtattttatttgtccttcacttatgaagcttagtttggctggatatgaaattttggcttgaaaattcttttctttaagaatgttgaatattggcccccactctcttctggcttgtagagtttctgccgagacatctgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaatgttgggctgccttgctagattggggaagttctcctggataatatcctgcagagtgttttccaacttggttccattctccccgtcactttcaggtacacaaatcagacgtagatttggtctttgcacatagtcccatatttcttggaggctttgctcgtttctttttattcttttttctctaaacttcccttcttgcttcatttcattcatttcatcttccattgctgataccctttcttccagttgatggcatcggctcctgaggcttctgcattcttcacgtagttctcaagccttggttttcagctccatcagctcctttaagcacttctctgtattggttattctagttatacattcttctcaattcttttcaaagttttcaacttctttgcctttggtttgaatgtcctcctgtagctcggagtaatttgatcatctgaagccttcttctctcagctcgtcaaagtcattctccatccagctttgttccgttgctgatgcagaactgagttcctttggaggaggagaggcactctgctttttagaatttccagtttttctgctctgttttttccccttctttgtggttttatctccttttggtctttgatgatggtgatgtacagatgggttttttgtgtggatgtcctttctgtttgttagttttcattctaacagacaggatcctcagctgcaggtctgttggagtacccggccgtgtgaggtgtcagtctgcccctgctagggggtgcctcccagttaggctgctcgggggtcaggggtcagggacccacttgaggaggcagtctgtccattctcagatctccagctgcgtgctgggagaaccactgctctcttcaaagctttcagacagggacatttaagtctgcagaggttactgctgtctttttgtttgtctgtgccctgcccccagaggtggagcctacagaggcaggcaggcctccttgagctgtggtgggctccacccagttcgagcttccaggctgctttgtttacctaagcaagcctgggcaatggcgggcgcccttcccccagcctcgctgctgccttgcagtttgatctcagactgctgtgctagcaatcagcgagattccgtgggcgtaggaccctccgagccaggtgtgggatataatctcctggtgagctgttttttaagcccatcggaaaagcgcagtattcgggtgggagtgaccctattttccaggtgccgtctgtcacccctttctttgactaggaaagggaactccctgaccccttgcgcttcccgagtgagggaatgcctcgccctgcttcggctcgcgcaaggtgcgcgcacccactgacctgtgcccactgtctggcactccctagtgagatgaacccggtacctcagatggaaatgcagaaatcacccgtcttctgcgtggctcacgctgggagctgtagaccggagctgttcctattcggccatcttggctcc

SEQ ID NO: 12200 - DNA, 670 bp, Homo sapiens
tttgttttgttttccatttgcttggtagatcttcctccatccttttattttgagcctatgtgtgtctctgcacgtgagatgggtctcctgaatacagcacactgatgggtcttgactctttatccaatttgccagtctgtgtcttttaattggggcatttaggccatttacatttaaggttaatattgttatgtgtgaatttgatcctgtcattatgatgttagctggttattttgctcgttagttgatgcagtttcttcctagcattgatggtctttacaatttggcatgtttttgcagtggctggtactggttgttcctttccatgtttagtgcttccttcaggagctcttgtaaggcaggcctggtggtgacaaaatctctcagcatttgtttgtctgtagaggattttatttctccttcacttatgaagcttagtttggctggatatgaaattctgggttgaaaattcttttctttaagaatgttggatattggcccccactttcttctggcttgtagagtttctgctgagagatctgctgttagtctaatgggcttccctttgtgggtaacccgacctttctctctggcttcccttaatattttttccttcatttcaactttggtgaatctgacaattatgtgtcttggggttgttcttcttgag

SEQ ID NO: 12201 - DNA, 3694 bp, Homo sapiens
gtctaacatgtaagtctttaatccatcttgaattaatttttgtgtaaggtgtaaggaagggatccagtttcagctttctacatatggctagccagttttcccagcaccatttattaaatagggaatcctttccccattgcttgtttttctcaggtttgtcaaagatcagatagttgtagatatgtggcattatttctgagggctctgttccattccattggtctatatctctgttttggtaccagtaccatgctgttttggttactgtagccttgtagtatagtttgaagtcaggtagcgtgatgcctccagctttgttcttttgacttaggattgacttggcaatgcgggctcttttttggttccatatgaactttaaagtagatttttccaattctgtgaaaaaagtcattggtagcttgatgaggatggcattgaatctataaattaccttgggcagtatggccattttcatgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctttctgtttgtctgttattagtgtataagaatgcttgtgatttttgcactttgattttatatgctgagcctttgctgaagttgtttatcagcttaaggagatttggggctgagatgatggggttttctagatatacaatcatgtcatctgcaaacagggacaatttgacttcctcttttcctaattgaatgccctttatttccttctcctgcctgattgccctggccagaacttccaacactatgttgaataggagtggtgagagagggcatccctgtcttgtgccagttttcaaagggaacacttccagtttttgtccattcagtatgatattggctgtgggtttgtcatagatagctcttattattttgagatatgtcccatcagtacctaatttattgagagtttttagcatgaagcattgttgaattttgtcaaaggccttttctgcatctattgagataatcatgtggtttttgtctttggctctgtttatatgctggatgatgtttattgattttcgtatgttgaaccagccttgcatcccagggatgaagcccacttgatcatggtgaataagctttttgatgtgctgctggattcggtttgccagtattttattaaggatttttacatcaatgttcatcaaggatattggtctaaaattctctttttttgttgtgtctgtaccaggctttggtatcaggatgatgctggcctcataaaatgagttagggaggattccccctttttcttttgattggaatagtttcagaaggaacggtaccagctcctccttgtacctccggtagaattcggctgtgaatccatctggtcctggacatttttggttggtaagctattaattattgcctcaatttcagatcctgttattggtctattcagagattcaacttcttcctggtttagtcttgggagggtgtatgtgtcgaggaatttatccatttcttctagattttctagtttatttgcatagaggtgtttatagtattctctggtggtagtttgtatttctgtgggatcggtggtgatatcccctttatcattttttattgcgtctatttgattcttctctcttttcttctttgttagtcttgctagcagtctatcaattttgttgatcttttcaaaaaaccaggtcctggattccttgattttttgaagggttttttgtgtctctatttccttcatttctgctctgatcttagttatttcttgccttctgctaggttttgaatgtgtttgctcttgcttcttcagttcttttaattgtgatgttagggtgtccgtattagatctttcctgctttctcttgtgggcatttagtgctataaatttccctctacacattgctttgaatgtgttccagagattctggtatgttgtgtctttgttctcattggtttcaaagaacatctttatttctgccttcatttcgttatgtacccagtagtcattcaggagcaggttgttcaatttccatgtagttctgcagttttgagtgagtttcttaatcctgagttctagtttgattgcactgtgatctgagagagtttgttacaatttctgttcttttacacttgctgaggagtgctttacttccaactatgtggtcagttttggaataggtgtggtgtggtgctgaaaggaatgtatattctgttgatttggggtggagagttctgtagatgtctattaggtctgcttggtgcagagctgagttcaattcctggatatccttgttaactttctgtctcattgatctgtttaatgttgacagtgggggggtaaagtctcctattattattgtgtgggagtcgaagtctctttgtaggtcactaaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatccaagactaggattgcaacccctgccttttttttgttttccatttgcttggtagatcttcctccatccctttattttgagcctatgtgtgtctctgcacgtgagatgggtttcctgaatacagcacactgatgggtcttgactctttatccaatttgccagtctgtgtcttttaattggagcatttagtccatttacatttaaggttaatattgttatgtgtgaatttgatcccatcattatggtgttagctggttattttgctcattatttgatgcagtttcttcctagccttgatggtctttacaatttggcatgtttttgcagtggctggtaccggttgttcctttccatgtttagtgcttccttcaggagctcttttagggcaggcctggtggtgacaaaatctctcagcatttgcttgtctgtaacgtgttttatttctccttcacttatgaagcttagtttggctggatatgaaattcgggtttgaaaattcttttctttaagaatgttgaatattggcccccactctcttctggcttgtagggtttctgccgagagatccgctgttagtctgatgggcttccctttgagggtaacccgacctttctctcttgctgcccttaacattttttccttcatttcaactttggtgaatctgacaattatgtgtcttggagttgctcttctcgaggagtatctttgtggcgttctctgtatttcctgaatctgaatgttggcctgccttgctagattggggaaattctcctggataatatcctgcagagtgttttccaacttggttccattctccccgtcactttcaggtacaccagtcagacgtagatttggtcttttcacatagtcccatatttcttggaggctttgttcgtttctttttattcttttttctctaaacttctcttcttgcttcatttcattcattttgtcttccatggctgataccctttcttccagttgatcacatcagctactgaggcttgtgcattcgtcgcgtagtt

SEQ ID NO: 12202 - DNA, 2229 bp, Homo sapiens
ccttcatttcgttacgtacttaatagtcattcaggagcaggttgttcagtttccatgtagttgagcaggggtgatttagtttcttaatcctgagttctagtttgattgcactgtggtctgagagacggttgttataatttctgttcttttacatttgctgagaagagctttacttccaactatgtggtcaattttggaataggtgtggtgtggtgctgaaaaaaatgtatattctgttgatttggggtggagagttctgtagatgtctattaggtctacttggtgcagagctgagttcaattcctgggtatccttgttaactttctgtctcgttgatctgtctaatgttgacagtggggtgttaaagtctctcattattattgtgtgggagtctaagtctctttgtaggtcactcaggacttgctttatgaatgtgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccttgcctttttttgttttccatttgcttggtagatcttcctccatccttttattttgagcctatgtgtgtccctgcacgtgagatgggtttcctgaatacagcacactgatgggtcttgactctttatccaatttgccagtctgtgtcttttaattggagcatttagcccatttacatttaaggttaatattgttatgtgtgaacttgatcccgtcattatgatgttagctggttattttgctcattagttgatgcagtttcttcctagcctcaatggtctttacaatttggcatgattttgcagcggctggtaccggttgttcctttccatgtttagtgcttccttcaggagctcttttagggcaggcctggtggtgacaaaatctctcagcatttgcttgtctgtaaagtattttatttctccttcacttatgaagcttagtttggctggatatgaaattctgtgttgaaaattcttttctttaagaatgttgaatattggcccccactctcttctggcttgtagagtttctgccaacagatccgctgttagtctgatgggcttccctttgtgggtaacctgacctttctctgtggctgcccttaacattttttccttcatttcaactttggtgaatctgacaattatgtgtcttggagctgctcttctcaaggagtatctttgtggcattctctgtatttcctgaatctgaatgttagcctgccttgctagattggggaagttctcctggatgatatcctgcagagtgttttccaacttggttccattctccctgtcactttcaggtacaccaatcagacgtagatttggtctctttcacatagtcccatatttcttggaggctttgtttgtttctttttattcttttttctctaaacttcccttctcacttcattttgttcatttcatcttccatcactgatactccttcttccagttgatcacatcggctcctgaggcttctgcattcttcacgtagttctcgagccttggctttcagctccatcagctcctttaagcacttctctgtattggttattctagttatatattcgtctaaatttttttcaaagtttttaacttctttgcctttggtttgaatttcctcctgtagctcggagtagtttgatcgtctgaagccttcttctctcaactcgtcaaagtcattctccgtccagctttgttccattgctggtgaggaactgcgttcctttggagtaggagaggcactctgctttttagagtttccagtttttctgctctgttttttccccatctttgtggttttatctacttttggtctttgacgatggtgatgtacagatgggtttctggtgtggatgtcctttctgtttgttagttttccttctaacagacaggaccctcagctgcagatctgttgaagtttgctagaggtccactccagaccctgtttgcctgggtatcagcagcggtggctgcagaacagcggattttcatgaaccacgaatgctgctgtctgatcgttcctctggaagttttgtctcataggagtacccggcagtgtgaggtgtcagtctgcccctactagggggtgcctcccagttaggctgctcgggggtcaagggtcatggacccacttga

SEQ ID NO: 12203 - DNA, 3692 bp, Homo sapiens
  misc_feature (3207)..(3207): n equals a,t,g, or c
gtctaacatttaagtctttaatccatcttgaattaatttttgtataaggtgtaaagaagggatccagtttcagctttctacatatggctagccagttttcccagcaccatttattaaatagggaatcctttccccatttcttgtttttgtcaggtttgtcaaagatcagatagttgtagatatgcagcgttatttctgagggctctgttctgttccattggtctatatctctgttttggtaccagtaccatgctgttttggttactgtagccttgtagtatagtttgaattcaggtagcatgatgcctccagctttgttcttttggcttaggattgacttggtgatgcaggctcttttttggttccatatgaactttaaagtagttttttccaattctgtgaagaaagtcattggtagcttgatggggatggcattgaatctataaattaccttgggcagtatggccattttcacgatattgattcttcctacccatgagcatggaattttcttccatttgtttgtatcctcttttatttcattgagcagtggtttgtagttctccttgaagaggttcttcacatcccttgtaagttggattcctaggtattttattctctttgaggcaattgtgaatgggcgttcactcatgatttggctctctgtttgtctgttattgatgtataagaatgcttgtgatttttgcacattgattttgtatcctgagactttgctgaagttcttatcagcttgaggagattttgggctgagatgatggcgttttctagatatacaatcatgtaatctgcaaacagggacaatttgacttcctcttttcctaattgaataccctttatttccttctcctgcatgattgccctggccagaacttccaacactatgttgaataggagtggtgagagagggcatccctgtcttgtgccagttttcaaagggaatgcttccagtttttgcccattcagtatgatattggctgtgggtttgtcatagatcgctcttattattttgagatacatctcatcaatacctaattgattgagggtttttagcatgaagcgttgttgaattttgtcacaggccttttctgcatctattgagataatcatgtgttttttgtctttagttctgtttatgtgttggattacatttattgatttgcgtattttgaaccagccttgcatcccagggatgaagcccacttaatcatggtggataagctttttgatgtgctgccggattcggtttgccagtattttactgaggatttttgcatcgatgttcatcaagaatattggtctaaaattctgttttttggttgtgtctctgccagtctttggtatcaggatgatgctggcctcataaaatgagttagggaggattccctctttttctattgattggaatagtttcagaaagaatgctaccagctcctatttgtacctctggtagaaatcggctgtgaatccatctggtcctggactttttttggttggtaagctattgattattgcctcaatttcagagcctgttattggtctattcagagattcaacttcttcctggtttagtcttgggaggatatatgtgtggaggaatttatccatttcctctagattttctagtttatttgcatagaggtgtttatagtattctctgatggtagtttgtatttctgtgggattggtggtgatatcccctttatcattttttattgcgtctatttgatttttctctcttttcttctttattagtcttgccagcagtctatcaattttgttgatcttttcaaaaaaccagctcctggattcattaattttttgaagggttttttgtgtctctatttccttcggttctgctctgatcttaattatttcttgccttctgctagcttttgaatgtgtttgctcttgcttttctagttcttttaattgtgatgttagggtgtcaattttagatctttcctgctttctcttgtgggcatttagtgctataaatttccttcttcacacagctttgaatgtgtcccagagattctggtatgttgtgtctttgttctcgttggtttcaaagaacatctttatttctgccttcatttcattatttactcagtagtcattcaggaacaggttgttgagtttccatgtagttgagcagttttgagtgagtttcttaatcctgagttctagtttgattgcactgtggtctgagagacagtttgttataatttctgttcttttacatttcctgaggagtgctttactccaactatgtggtccgttttggagtaggtgtggtgtggtgccgaaaagaatgtatattctgttgatttggggtggagagttctagagatgtctattaggtccgcttggcgcagagctgagttcaattcctgggtatccttgttaactttctgtctctttgatctgtctaacgttgacaatggggtgttaaagtctcccattattaatgtgtgggagtctaagtctctttgtaggtcactaaggacttgctttatgaatctgggtgctcctgtattgggtgcatatacatataggatagttagctcttcttgttgaattgatccctttaccattatgtaatggccttctttgtctcttttgaactttgttggtttaaagtctgttttagcagagactgggattgcaaaccctgcctttttttgttttccatttgcttggtagatcttcctccatccctttattttgagcctatgtgtgtctctgcacgtgagatgggtttcctgaatacagcacactgatgggtcttgactctttatccaatttgccagtctgtgtcttttaattggagcatttagcccatttacatttaaagttaatattgttatgtgtgaatttgatcctgtcattatgatgttagctggttattttgctcgttagttgatgcagtttcttcctagccttgatggtctttacaatttggcatgtttttgcagtggctggtaccagttgatcctttccatgtttagtgcttccttcaggagctcttttagggcagacctggtggtgacaaaatctctcagcatttgcttgtctgtaaagtattttatttctccttcacttatgaagcttagtttggctagatatgaaattctgggttgaaaattcttttctttaagaatgttgaatatttggtccccacactcntctggctgttagagtttctgcggagagatcagctgttagtctgatgagcttccctttgtggtaatccgacctttctctctggctgcccttaacattttttccttcatttcaactggtgaatctgacaattatgtgtctttgagttgctcttctcgatgagtatctttgtggcattctctgtattttctgaatctgaatgttggcctgccttgctagattggggaagttctcctggataatatcctgcagagtgttttccaacttggttccattctccccatcactttcaggtacaccaatcagacatagatttggtcttttcacatagtcccatatttcttggaggctttgttcatttctttttattcttgtttctctaaacttctcttctcgctgcatttcattaatttcgtcttccattgctgataccctttcttccagttgatcgcatcggctattgaggcttctgcatttgtcacgtagct

SEQ ID NO: 12204 - DNA, 3574 bp, Homo sapiens
gtctaacatgtaagtctttaatccatcttgaattaatttttgtataaggtgtaaggaagggatccagtttcagctttctacatatggctagccagttttcccagcaccatttattaaatagggaatcctttcccctttgcttgtttttgtcaggtttgtcaaagatcagatagttgtagatatgcagcattatttctgatggctctgttctgttccattggtctatatctctgttttggtaccagtaccatgctgttttggttactgtagccttgtagtatagtttgaagtcaggtagcgtgatgcctccagctttgttcttttggcttaggattgacttggcaatgagggctcgtttttggttccatgtgaactttagttttttccaattctgcgaagaaagtcattggtagcttgatggggatagcattgaatctataaattaccttgggcagtatggccattttcacgatattgattcttcctacccatgagcatggaatgttcttccatttgtttgtatcctcttttatttcattgagcagtggtttgtagttctcctcgaagaggtccttcgcatgccttgtaagttggattcctaggtattttattctctttgaagcaactgtgaatgggagttcactcatgatttggctctctgtttgtctgttattggtgtataagaatgcttgtgatttttgcacattgattttgtatcctgagactttgctgaagttgcttatcagcttaaggagattttgggctgagacgatggggttctctagacatataatcatgtcatctgcaaacagggacaatttgacttcctcttttcctaattgcatgccctttatttccttctcctgcctgattgccctggccagaacttccaacactatgttcaataggagtggtgagagagggcatccctgtcttgtgccagttttcaaaggaaatgcttccagtttttgtccattcagtatgatattggctgtgggcttgtcatagatagctcttattattttgagatgtgtcccatcaatacctaatttattgagagtttttaacatgaagcgttgttgaattttgtcaaaggccttttctgcatctattgagataatcatgtggtttttgtctttggttctgtttatatgctggattatgtttattgattttcgtatgttgaaccagccttgcatcccagggatgaagcccacttgatcatggtggataagctttttgatgtgctgctggattcggtttgccagtattttattgaggatttttgcatcaatgttcatcaaggatattgatctaaaattctctttttttgttgtgtctctgccaggctttggtgtcaggatgatgctggcctcataaaatgagctagggaggattcctctttttctactgattggaatagtttcagaaggaatggtaccagctcctccttatacctctggtagaattcggctgtgaatcatctggtcctggactttttttggttggtaagctattaattattgcctcaatttcagagcctcttattggtctattcagagattcaacttcttcctggtttagttttgggaaggtgtatttgtcgaggaatttattcatttcttctagattctctagtttatttgcgtagaggtgtttatagtagtctctgatggtagctgtgggatcggtggtgatattccctttatcattttttattgcgtctatttgattcttctctcttttcttctttattagtcttgctagcggtctatcagttttgttgatcttttcaaaagaccagctcctggattcactgatttttcgaagggttttttgtgtctctatttcctacagttctgctctgatcttagttatttcttgtcttctgctagcttttgaatgtgtttgctcttgtttctctagttcttttaattgtgatgttagggtgtcaattttagatctttcctgctttctcttgtgggcatttagtgctataaatttccctctacacactgcttcgaatgtgtcccagaggttctggtatgttgtgtctttgttctcgttggtttcaaagaacatctttatttctgccttcatttcgttatgtacccagtagtcattcgggaacaggttgttcagtttccatgtagttgagcagttttcagtgagtttcttaatcttgagttctagtttgattgcactgtggtctgaaagacagtttgttataatttctgttcttttacatttgctaaggagtgctttacttccaactatgtggtcaattttggaataggtgtggtgtggtgctgaaaataatgtatattctgttgatttaggatggagagttctatagatgtctattaggtccacttggtgcagagctgagttcaattcctggatatccttgttaactttctgtctcattgatctgtctaatgttgacagtggggtgttaaagtctcccattattattgtgtgggagtctaagtctctttgtggataactaaggacttgctttatgaatctgggtgctcctgtattgggtgcatatatatttaggatagttagctcttcttgttgcattgatccctttaccattatgtaatggccacctttgtctcttttgatctttgttggtttaaagtctgttttatcagagactaggattacaacccctgcctttttttgctttccatttgcttggtagatcttcctccatccctttactttgagcctatgtgtgtctctgcatgtgagatgggtttcctgaatacagcacactgatgggtcttgactctttatccaatttgccagtctgtgtcttttaattggagcatttagcccatttacatttaaggttaatattgttatgtgtgaatctgatcctgtcattatgatgttatagctggttattttgctcgttagttgatgcagtttcttcctagccttgatggtctttacaatttggcatgtttttgcagtggctggtaccggttgttcctttccatgtttagtgcttccttcaggagctcttttagggcaggcctggtggtgacaaaatctctcagcatttgcttgtctgtaaagtattttatttctccttcacttatgaagcttagtttggctggatatgaaattataggttgaaaattcttttctttaagaatgttgaatattggcccccactctcttctggcttgtagagtttctgccgagagatcagctattagtctgatgggcttccctttgtgggtaacccgacctttctctctggctgcccttaacatgttttccttcatttcaactttggtgaatctgacaattatgtgtcttggagttgctcttctcgaggagtatctttgtggcattctctgaattttctgaatttgaatgttggcctgccttgctagattggggaagttctcctggataacaacctgtagagtgttttccaacttggttcgattctccctgtcactttcaggtacaccaataagacgtagatttggtcttttcacatagtcccatatttctgggaggctttgttcgtttcttttattcttttttctct

SEQ ID NO: 12205 - DNA, 1345 bp, Homo sapiens
ttggggtgcagagttctgtagatgtctattaagtccacttggtgcagagctgagttcaatccctgggtatccttgttgactttctgtctcattgatctgtctaatgttgacagtggggtgttaaagtttcccattattaatgtgtgggagtctaagtctctttgtaggtcactcaggacttgctttatgaatctgggtgctcctgtattgggtgcatatatatttaggatagttagttcttcttgttgaattgatccctttaccattaagtaatggccttctttgtctcttttgatctttgttggtttaaagtctgttttatcagagactaggattgcaacatctgcctttttttgttttccatttgcttggtagatcttcctccatccttttattttgagcctatgtgtgtctctgcccgtgagatgggtttcctgaatacagcacactgatgggtcttgactctttatccaatttgccagtctgtgtcttttaattggagcatttagtccacttacatttaaagttaatattgttatgtgtgaatttgatcctgtcattatgatgttagctggttattttgctcgttagttgatgcagtttcttcctggtttcgatggtctttacattttggcatgattttgcagcggctggtaccagttgttcctttccatgtttagtgcttccttcaggagctcttttagggcaggcctggtggtgacaaaatctctcagcatttgcttgtctgtaaaggattttatttctccttcacttatgaagcttagtttggctggatatgaaattctgggttgaaaattcttttctttaagaatgttgaatattggcccccactctcttctggcttgtagagtttctgctgagagatctgctgttagtctgatgggcttccctttgagggtaacccgacctttctctctggctgcccttaacattttttccttcatttcaactttggtgaatctgacaattatgtgtcttggtgttgctcttctcaaggagtatctttgtggcgttctctgtatttcctgaatctgaatgttggcctgccttgctagattggggaagttctcctggataatatcctgcagaatgttttccaacttggttccgttctccccgtcactttcaggtacaccaatcagatgaagatttggtcttttcacatagtcccatatttcttggaggctttgctcgtttctttttattcttttttctctaaacttcccttctcgattcatttcattcatttcatcttccatcgctgataccctttcttccagttgatcgcatcggctcctgaggcttctgcattcttcacgtagtt

SEQ ID NO: 12206 - DNA, 6085 bp, Homo sapiens
ttctatttttcaatatttatttatttatttatttattattattattatttttttaattatactttaagttttagggtacatgtgcacatagtgcaggttagttacatatgtatacatgtgccatgctggtgcgctgcacccactaactcgtcatctagcattaggtatatctcccaatgctatccctcccccctcccacctccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcctagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccctgaggaatcgccacactgacttccacaatggttgaactagtttatagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcattttttcatgtgttttttggctgcataaatgtcttcttttgagaagtttctgttcatgtccttcgcccactttttgatggggttgtttgtttttttcttgtaaatttgtttgagttcattgtagattctggatattagccctttgtcagatgagtaggttgcgaaaattttctcccatgttgcaggttgcctgttcactctgatggtagtttcttttgctgtgcagaagctctttagtttaattagatcccatttgtcaattttggctttggttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcatcgtttattaaatagggaatcctttccccattgcttgtttttctcaggtttgtcaaagatcagatagttgtaggtaagtggtgttatttctgaggactctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaaggcattggtagcttgatggcaatggcattgaatctgtaaattaccttgggcagtatggccattttcacgatattgattcttcctacccatgagcatggaatgttcttccatttgtttgtatcctcttttatttccttgagcagtggtttgtaattctccttgaagaggtccttcacatcccttgtaagttggattcctaggtattttattctctttgaagcaattgtgaatgggagttcactcatgatttggctctctgtttgtctgttgttggtgtataggaatgcttgtgatttttgtacattgattttgtatcctgagactttgctgaagttgcttatcagcttaaggagattttgggctgagatgatggggttttctagataaacaatcatgtcgtctgcaaacaaggacaatttgacttcctcttttcctaattgaataccctttatttccttctcctgcctgattgccctggccagaacttccagcactatgttgaataggagcggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttgtagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcgttttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgctacaatttcagctcctgttattggtctattcagagattcaacttcttcctggtttagtcttgggagagtgtatgtgtccaggaatttatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcagtctatcaattttgttgatcctttcaaaaaaccagctcctggattcattgattttttgaagagttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcgttatgtatccagtagtcattcaggagcaggttgttcagtttccatgtagttgagcggctttgagtgagattcttaatcctgagttctagtttgattgcactgtggtctgagacatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcctcttgttgaattgatccctttaccattatgtaatggccttctttgtctcttctgatctttgttggtttaaagtctgttttattagagactaggattgcaacccctgcctttttttgttttccatttgcttggtagatcttcctccatccttttattttgagcctatgtgtgtctctgtacgtgagatgggtttcctgaatacagcacactgaatacagctcttgactctttatccaatttgccagtctgtgtcttttaattggagcatttagtccatttacatttaaagttaatattgttatgtgtgaatttgatcctgtcattatgatgttagctggtgattttgctcgttagttgatgcagtttattcctagtctcgatggtctttacattttggcatgattttgcagcggctggtaccggttgttcctttccatgtttagcgcttccttcaggagctcttttagggcaggcctggtggtgacaaaatctctcagcatttgcttgtctgtgaagtattttatttctccttcacttatgaagcttagtttggctggatatgaaattctgggttgaaaattcttttctttaagaatgttgaatattggcccccactctcttctggcttgtagggtttctgccaagagatccgctgttagtctgatgggcttccctttgagggtaacccgaactttttctctggctgcccttaacatttttttccttcatttcaactttggtgaatctgacaattatgtgtcttggagttgctcttctcgaggagtatctttgtggcgttctctgtatttcctgaatctgaacgttggcctgccttgctagattggagaagttctcctggataatatcctgcagagtgttttccaacttggttccattctccgcatcactttcaggcacaccaatcagacgtagatttggtcttttcacatagtcccatatttcttggaggctttgctcatttctttttattcttttttctctaaacttcccttcttgcttcatttcattcatttcatcttccattgctgataccctttcttccagttgatcgcatcggctcctgaggcttctgcattcttcacttagttctcgagccttgggtttcagctccatcagctcctttaagcacttctctgtattggttattctagttatacattcttctaaatttttttcaaagttttcagcttctttgcctttggtttgaatgtcctcccgtagctcagagtaatttgatcgtctgaagccttcttctctcagctcatcaaaatcattctccatccagctttgttccgttgctggtgaggaactgcgttcctttggaggaggagaggcgctctgcattttagagtttccagtttttctgttctgttttttccccatctttgtggttttatctacttttggtctttgatgatggtgatgtacagatgggtttttggtgtggatgtcctttctgtttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgcccattctcagatctccagctgcgtgctgggagaaccactgctctcttcaaggctgtcagacagggacatttaagtctgcagaggttactgctgtctttttgtttgtctgtgccctgcccccagaggtggagcctacagaggcaggcaggcctccttgagctgtggtgggctccacccagtttgagcttcccggctgctttgtttacctaatcaagcctgggcaatggcgggcgcccctcccccagcctcgctgccgccttgcagtttgatctcagactgctgtcctagcaatcagcgagattccgtgggcataggaccctccgagccaggtgtgggatatagtcttgtggtgcgccgttttttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggctcacgcacggtgcgcacacccactggcctgcgcccactgtctggcactccctagtgagatgaacccggtacctcagatggaaatgcagaaatcacccgtcttctgcgtcgctcacgctgggagctgtagaccggagctgttcctattcggccatcttggctcctcccaccttcaat

SEQ ID NO: 12207 - DNA, 3888 bp, Homo sapiens
tccccctaccccaccacagtccccagagtgtgatattccccttcctgtgtccatgtgatctcattgttcaattcccacctatgagtgagaatatgcggggtttggttttttgttcttgcgatagtttactaagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccctgaggaatcgccacactgacttccacaatggttgaactagtttacagtcccaccaacaatgtaaaagtgttcctatttctccgcatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtcctttgcccactttttgatggggttgtttgtttttttcttgtaaatttggttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttgtcttttgttgccattgcttttggtgttttggacatgaagtccttgcccatgcctatgttctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccatttcttgtttttctcaggtttgtcaaagatcagacagttgtaggtatgcggcgttatttctgagggctctgttctgttccattgatctatatctctgttttggtaccagtaccatgctgttttggttattgtagccttgtagtaaagtttgaagtcaggtagtgtgatgcctccagctttgttcttttggcttaggattgacttggcgatgtgggctcttttttggttccatatgaactttaaagtagttttttccaattctgtgaagaaagtcattggtagcttgatggggatggcattgaatctgtaaattaccttgggcagtatggccattttcacaatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctatgggtttgtcatagatagctcttattattttgaaatacgtcccatcaatacctaatttattgagagtttttagcatgaagggttgttgaattttgtcaaaggctttttctgcatctattgagataatcatgtggtttttgtctttggttctgtttatttgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctctttttttgttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctagtcctggactctttttggttggtaagctattgattattgccacaatttcagctcctgttattggtctattaagagattcaacttcttcctggtttagtcttgggagagtgtatgtgtcgaggaatttatccatttcttctagattttctagtttatttgcgtagaggtgtttgtagtattctctgatggtagtttgtatttctgtgggatcggtggtgctatcccctttatcattttttattgtgtctatttgattcttctctctttttttctttattagtcttgctagcggtctatcaattttgttgatcctttcaaaaaaccagctcctggattcactgattttttgaagggttttttgtgtctctatttccttcagttctgctctgattttagttatttcttgccttctgctagcttttgaatgtgtttgctcttgctttctagttcttttaattgtgatgttagggtgtcaattttggatctttcctgctttctcttgtgggcatttagtgctaaaaatttccctctacacactgctttgaatgcatcccagagattctggtatgttgtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaagtatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcgttgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcc

SEQ ID NO: 12208 - DNA, 400 bp, Homo sapiens
aaccctgccttttttttgttttccatttgcttggtagatcttcctccatccctttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggtgattttgctcgttagttgatgcagtttcttcctagtctccatggtctttacattttggcatgattttgcagcggctggtaccagttgttcctttccatgtttagcgcttccttcaggagctcttttaaggcaggcctggtggtgacaaaatctctcagcatt

SEQ ID NO: 12209 - DNA, 1937 bp, Homo sapiens
tgcgtagaggtgtttatagtattctctgatggtagtttgtatttctgtgggattggtggtgatatcccttttatcatttttcattgcatctatttcattcttctcttttcttctttattagtcttgctagtggtctattaatttgttgatcttttcaaaaaaccagctcctggattcattgattttttgaagggtttttttgtgtctctatgtccttcagttctgctctgattttagttatttcttgccttctgctagcttttgaatgtgtttgctcttgcttctctggttcttttaattgtgatgttagggtgtccactttagatctttcctgctttctcttgtgggcattagtgctataaatttccctctacacactgctttaaatgtgtcccagagattctggtatgttgtgtctttgttctcgttggtttcaaagatcatctttatttctgctttcatttcattatgtacccagtagtcattcaggagcaggttgttcagtttccatgtagttgagtggttttgagtgagtttcttaatcctgagttctagtttgattgcactgtggtctgagagacagtgtgttataatttctgttcttttacatttgctgaggagtgctttacttctaaataagtggtcaattttggaataagtggggtgtggtgctgagaagcatgtatattctgttgatttggggtggagagttctgtagatgtctattaggtccacttggtgcagacctgagttcaattcctggatatccttgttaattttctgtctcgttgatgtgtctaatgttgacagtggggtgttaaagtctcccattattattgtgtgggagtctaagtctctttgtaggtctctaaggagttgctttatgaatctgggtactcctgtattgggtgcatatatatttaggatagttagctcttcttgttgaattgatccctttaccattatgtaatagccttctttgtctgttttgatctttgttggtttaaagtctgttttatccaagactaggattgcaacccctgcctttttttgttttccatttgcttggtagatcttcctccgtccttttattttgagcctatgtgtgtctctgcacgtgagatgggtttcctgaatacagcacactgataggtcttgactctttatccaatttgccagtctgtgtcttttaattggagcatttagcccatttacatttaaggttaatattgttatgtgtgaatttgatcctgtcattatgatgttagctggttattttgctcgttagttgatgcagtttcttcctagcctcgatggtctttacagtttggcatgtttttgcagtggcgggtaccagtttttcctttccatgtttagtgcttccttcaggagctcttgtagggtaggcctggtggtgacaaaatctctcaacatttgcttgtctgtaaagtattttatttctccttcacttatgaagtttagtttggctggatatgaaattctgagttgaaaattctttcctttaagaatgttgaatattggcccccactctcttctggcttgtagagtttctgccgagagagagccactgttagtctgatgggcttccctttgtgggtaacccgacctttctctctggctgcccttaacattttttccttcgtttgaactttagtgaatctgacaattatgtgtcttggagttgctcttctcaaggagtatctttgtgtcgttctctgtatttcctgaatttgaatgttggcctgccttgctaggttggggaagttctcctggataatatcatgaagagtgttttccaagttggttgcattctccctgtcactttcaggtacaccaatcagacgtagatttgatcttttcacattgtcccatatttcttggaggctttgttcatttctttttattcttttttctct

SEQ ID NO: 12210 - DNA, 3345 bp, Homo sapiens
gtctaacatgtaagtctttaatccatcttgaattaatttttgtacaaggggtaaggaagggatccagtttcagctttctacatatggctagccagttttcccagcaccatttattaaatagggaatcctttccccattgcttgtttttctcaggtttgtcaaagatcagatagttgtagatatgtggcattatttctgagggctctgttctgttccattgatctatatctctgttttggtaccagtaccatactgttttggttactgtagccttgtagtatagtttgaagtcaggtagcatgatacctccagctttgttcttttggcttaggattgacttggcgatgcaggctcttttttggttccatatgaagtgtaaagtagttttttccaattctgtgaagaaagtcattggtagattgatgaggatggcattgaatctataaattaccttgggcagtatggccattttcacgatattgattcttcctacccatgagcatggaatgttcttccatttgtttgtgtccttgaacagtcgtttgtagttctccttgaagagttccttcacatcccttgtaagttgtgttcctgggtattttattctctttgaagcaattgtgaatgggagttcactcgtgatttggctctctgtttttctgttattgctgtataagaatgcttgtgatttttgcacattgattttatatcctgagactttgctgaagttgcttatcagcttaaggcgattttgggctgagatgatggggttttctagatatacaatcatgtcatctgcaaacagggacaatttgactttcccttttcctgattgaatatcctttatttccttctcctgcctgattgccctggccagaacttccaacactgtgttgcataggagtggtgaaagagggcatccctgtcttgtgccagttttcaaagggaatgcttccagtttttgtccattcagtatgatattggctgtgggtttgtcataaatagctcttattattttgagataggtcccatcaatacctaatttattgagagtttttagcatgaagcgttgttgagttttgtcaaaggccttttctgcatctgttgagataatcatgtggtttttgtcgttggttctgtttatatgctggattatgtttattggttttcgtatgttgaaccagccttgcatcccaggggatgaagccccacttgatcgtggtggataagctttttgatgtgctgctggatttggtttgccagtattttattgaggatttttgcatcgatgttcatcagggatattggtctacaattctctttttttgttgtgtttctgccaggctttggtatcaggatgatgctggcctcgtaaaatgagttagggaggattccctctttttctattgattggaatagtttcagaaggaatgctaccagctcctccttgtatcctggtggaattcagctgtgaatctgtctggtcctggactttttttggttggtaagctattaattattgccttaatttcagatcctgttattggtctattcagagattcaacttcttcctgatttagtcttgggagggtgtatgtgtcaaggaatttatccatttcttctagattttctagtttatttgcgtagaggtgtttatagtattctctgatggtagtttgtatttatgtgggattggtggtgatatcccctttaccatttttcattgcgtctatttgattcttctctcttttcttctttattagtcttcttagtggtctatccattttgttgatcttttcaaaaaaaacagctcctggattctttgattttttgaagggttttttgtgtctctatctccttcagttctgctctgatcttagttatttcttgccttctgctagcttttgaatgtgtctgctcttgcttctcagttcttttaattgtgatgttagggtgtcaattttagatctttcctgctttgtcttgcgggcatttagtgctataaatttccctctacacacggctttaaatgtgtcccagagattctggtatgttgtgtctttgttctccttggtttcaaagaacatctttatttctgccttcattttgttatatacccactagtcattcaggagcaggttgttcagtttccatgtagttgagcagttttgagtgagtttcttaatcctgagttctagtttgattgcactgtggtctgagagacagtctgttataatttctgttcttttacttttgctgaggagtgctttccttccaactatgtggtcaattttggaataactgcaatgtggtgctgagaagaatgtatattttgttgatttggggtggagagttctgtagatgtctattaggtctgcttggtgcagagctgagttcagttcctggatatccttgttaactttctgtctcattgatctgtctaatgctgacagtggggtgttagtttccattattatactgtggaagtctaagtctctttgtaggtctctaaggacttgctttatgaatctaggtgctcctgtattgggtgcatatatatttaggatagttagctcttcttgttgaattgatcccttaccattatgcaatggccttctttgtctcttttgatctttgttggtttaaagtctgttttatcagagactaggattgcaacccctgcctttttttgttttccatttgcttggtagatcttcctccatcccttaattttgaggctatgtgtgtctctgcatgtgagatgggtttcctgaatacaggacactgacaggtcttgactctttatccaatttgccagtctgtgtcttttaattggagcatttagcccatttacatttaaggttaatattgttatgtgtgaatttgatcctgtcattatgatgttagctggttattttgctcattagttgatgcagtttcttcctagccttgatggtctttacaattcggcatgtttttgcagtggctggtactggttgttcctttccatgtttagtgcttccttcaggagctcttgtagggcaggcctggtggtgacaaaatctctcagcatttgcttgtctgtaaaggattttatttccccttcacttatgaagcttagtttggctggatatgaaattttggattgaaaattcttttctttaagaatgttgaatattggcccccactctcttctggcttgtagagtttctgtcaagaaatctactattagtctgatgggcttccctttgcgggtaacctgacctttctctctgtctgcccttaacattttttccttcatttcaattatgaatctgacaattatgtgtcttggagttgctcttc

SEQ ID NO: 12211 - DNA, 2879 bp, Homo sapiens; identical to SEQ ID NO: 12180

SEQ ID NO: 12212 - DNA, 3953 bp, Homo sapiens
attgtagattctggatattagccctttgtccgatgagtagactgcaaaaattttctcccattctgtaggttgcctgttcactctgatggtagtttcttttgctgtgcagaagctctttagtttaattagatcccacttgtcaattttgacttttgttgccattgcttttggtgttttagacatgaagtccttgcccatgcctatgtcctgaatggtattgcctaggttttcttctagggtttttatggttttaggtctaacatgtaagtctttaatccatcttgaattaatttttgtgtaaggtgtaaggaagggatccagtttcagctttctacatatggctagccagttttcccagcaccatttattaaatagggaatcgtttccccatttcttgtttttgtcaggtttgtcaaagatcaggtggttgtagatgtgtggtattatttctgagggctccgttctgttccattggtctatgtctctgttttggtacaagtaccatgctgttttggttactgtagccttgtagtatagtttgaaatcaggtagcatgatgactccagctttgttcttttggcttaggattgtcttggcaatgcaggcccttttttaggttccatatgaactttaaagtagttttttccaatactttgaagaaagtcgttggtagcttgatggggatggcattgaatctataaattacctcgggcagtacagccattttcacgatattgattcttcctatccatgagcgtggaatgttcttccatttgtttgtgtcctcttttatttcgttgagcagtggtttgtagttctccttgaagaggtccttcacatcccttgtaagttgggttcctaggtattttattctctttgaagcaattgtgaatgggagttcactcatgatttggctctctgtttgtctgttattggtgtataagaatacttgtgatttttgcacattgattttgtatcctgagactttgctgaagttgcttagcagcttaagaagattttgggctgagacaatggggttttctagatatacagtcatgttatctgcaaacagggacaatttgacttcctcttttcctaattgaataccctttatttctttctcctgcctgattgccctggccagaacttccaacactatgttggataggagtggtgagagagggcatccgtcttgtgccagttttcaaagggaatgcttccagtttttgcccattcagtatgatattggctgtgggtttgtcataaatagctcttattattttgagatacgtcccatcaataactaattcattgagagtttttagcatgaagggctgttgaattttgtcaaaggccttttctgcatctattgagataatcatgtgctttttgtctttggttctgtttatatgctggattacatttattgatttgtgtatgttgaaccagccttgcatcccagggaggaagcccacttgatcatggtggataagctttttgatgtgctgctggattcagtttgccagtattttattgaggatttttgcatcgatgttcatcagggatattggtctaaaattctctttttttgttgtgtctctgccaggctttgatatcaggatgatgctgggctcataaaatgagttagggaggattcccgctttttctattgattggaatagtttcagaaggaatggtagcagctcctctttgtacctctggtagaattcagctgtgaatccatctggtcctggacttttttggttggtaagctattaattattgcctcaatttcagaacctgttattggtgtattcagagattcaacttcttcctggtttagtcttgggagggtgtgtgtgtcaaggaatttatccatttcttctagattttctagtttatttgcatagaggtgtttatagtattctctgatggtagtttgtgtttctgtgggatcagtggtgatatcccctttatcattttttattgtgtctatttgattcttctctctcttcttctttattaatcttgctagcggtctatcaattttgttgatcttttaaaaaaaaccagctcctggattcattgatttttttgaagggttttttgtgtctctatttccttcagttctgctctgatcttagttatttcttgctttctgctagcttttgagtgtgtttgctcttgcttctctacttcttttaattgtgatgttagggtgtcaattttagatctttcctgctttctcttgtgggcatttagtgctataaatttccctctacacacagctttaaatgtgtcccagagattctggtttgttatgtctttgttctcattggtttcaaagaacatctttatttctgccttcattttgttatgtacccagtagtcattcaggagcaggttgttcagtttccatgtagttgagcggttttgagtgagtttcttaactctcagttctagtttgattgcactgtggtctgagagacagtttgttataatttctgttcttttacatttgctggggagtgctttacttccaactacgtggtcaattttggaataagtgtgatgtgatgctgagaagaatgtatattctgttgatttggggtggagagttctgtagatgttgattaggtctgcttggtgcagagctgagttcaattcctggatatccttgttagctttctgtctcattgatctgtctaatgttgacagtgcggtgttagagtcttccattattattgtgtgggagtctaagtctctttgtaagtctctaaggacttgctttatgaatctgggtgctcctgtattgggtgcatatatatttaggatagttagctgttcttgttgaattgatcccttcaccattatgtaatggccttgtttgtctcttttgatctttgttggtttaaagtctgtttttatcagagactaggattgcaacccctgccttttttttgttttccatttgcttggtagatcttcctccatccctttattttgagcctatgtgtatctctgcatgtgagatgggtctcctgaatacagcatactgatggggtcttgactctttatccaatttgccagtctgtgtcttttaattggagcatttagcccatttacatttaaggttaatattgttatgtgtgaatttgatcctgtcattatgatgttagctggttattttgctcgttagttgatgcagtttcttcctagccttgatggtctttacaatttggcatgtttttgcagtggctggtaccagttgttcctttccatgtttagtgcttccttcaggagctcttctagggcaggcctggtggtgacaaaatctctcagcatttgcttgtctgtacagtattttatttctccttcacttatgaagcttagtttggctggatatgaaattctgggttgaaaattcttttctttaagaatgttgaatattggcccccactctcttctggcttgtagagtttctgctgagagatctgctgttagtctgataggcttccctttgtgggtaacccgacctttctctctggctgcccttaacattttttccttcatttcaattttggtgaatctgacaattatgtgtcttggagttgctcttctcgaggagtatctttgtggcattctctgtatttcctgaatttgaatgttggcctgccttgctagattggggaagttctcctggataatatcttgcagagtgttttccaacttggttccattctccccatcactttcaggtacaccaatcagacgtagatttggtcttttcacatagtcccatatttcttggaggcttttttcatttctttttacttttttttctctaaacttctcttcttgcttcatttcattcatttgatcttccatcactgataccctttcttccagttgatcaagttggctactgaagcttgtgcgttcatcacgtggtt

SEQ ID NO: 12213 - DNA, 1636 bp, Homo sapiens
gtatgttgtgtctttgttctcattggtttcaaagaacatctttatttctgccttcatttcattatttacccagtagtcattcaggagcaggttgttcagtttccatgtagttgagcggttttgagttagtttcttaatcctgagttctaatttgattgcactgtggtctgagagacagtttgttataatttctgttcttttacatttgctgaggagtgctttacttccaactatgtggtcaattttggagtaggtgtggtgtggtgctgaaaagaatgtatattctgttgatttggggtggagagttctatagatgtctcttaggtcaatttggtgcagagctgagttcaattcctgggtatccttgttaactttctgtctcgttgatctgtctaatgttgacagtggggtgtaaagtctcccattattattgtgtgggagtctaagtctctttgtaggtcactcaggacttgctttatgaatctgggtgctcctgcattgggtgcatatatctttaggatagttagctcttccttttgaattgatccctttaccattatataatggccttctttatctcttttaatctttgttggtttaaagtctgttttatcagagactaggattgcaacccctacatttttttgttttccatttgcttggtagatcttcctccatccctttattttgagcctatgtgtgtctctgcacgtgagatgggtttcctgaatacagcacactgatgggtcttgactctttatccaatttgccagtctgtgtcttttaattggagcatttagcccatttacatttaaagttaatattgttatgtgtgaatttgatcctgtcattatgatgttagctggttattttgcttgatagttgatgcagtttcttcctagcctttatggtctttacaatttggcatgtttttgcagtggctggtaccagttgttcctttccatgtttagtgcttccttcaggagctcttttagggcaggcctggtggtgacaaaatctctcagcatttgcttgtctgtaaagtattttatttctccttcacttatgaagcttagtttggctggatgtgagattctgggttgaaaattcttttcttaaagaatgttgaatattggtccccactctcttctggcttgcagagtttctgccgagagatcagctgttagtctgatgggcttccctttgtgggtaacctgaccttcctctctggctgcccttaacattttttccttcatttcaactttggtgaatctgacaattatgtgtcttggacttgctcttcttgaggagtatctttgtggagttctctgtatttcctgaatttgaatgttggcctgcctttctagattggggaagttctcctggataatatcctgcagagtgttttccaacttggttccattctccccgtcactttcaggtacaccaatcagacgtagatttggtcttttcacatagtcccatatttcttggaggctttgttcatttctttttattcttttttctctaaatttctcttctcgcttcatttcattcatttcatcttccatcactgatacactttcttccagttgatctcctcggctactaaggcttctgcattcgtcacgtagct

SEQ ID NO: 12214 - DNA, 6036 bp, Homo sapiens
tttatattcttttttttattattatactttaagttttagggtacatgtgcacattgtgcaggttagttacatatgtatacatgtgccatgctggtgcgctgcacccactaactcgtcatctagcattaggtatatctcccgatgctatccctccccccctcccaccaccccacaacagtccccagagtgtgatgttccccttcctgtgtccatgtgacctcattgttcagttcccacctatgagtgagaatatgcggtgtttggttttttgttcttgtgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgctgcaataaacatacgtgtgcatgtgtctttatagcagcatgatttatagtcctttgggtatatacccagtaatgggatggctgggtcaaatggtatttccagttctagatccctgaggagttgccacactgacttccacaatggttgaactagtttacagtcccaccaacagtgtaaaagtattcctatttctccacgtcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtccttcgcccactttttgatggggttgtttgttttttccttgtacatttgtttgagttcattgtagattctggatattagccctttgtcagatgagtaggttgtgaaaattttctcccattttgtaggttgcctgttcactctgatggtagtttcttttgctgtgcagaagctctttagtttaatgagatcccatttgtcaattttggcttttgttgccattgcttttggtgttttagacatgaagtccttgcccatgcctatgtcctgaatggtaatgcctaggttttcttctaaggtttttatggttttaggtctaacatttaagtctttaatccatcttgaattgatttttgtataaggtgtgaggaagggatccagtttcagctttctacatatggctagccagttttcccagcaccatttattaaatagggaatcctttccccattgcttgtttttgtcaggtttgtcaaagatcagatagttgtagatatgtggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcaggctcctttttggttccatatgaactttaaagtagtcttttccaattctgtgaagaaagtcattggtagcttgatggggatggcattgaatctataaattactttgggcagtatggccattttcacgatattgattcttcctacccatgagcatggaatgttcttccattggtttgtatcctcttttatttccttgagcagtggtttgtagttctccttgaagaggtccttcacatcccttgtaagttggattcctaggtattttatgctctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatggggttttctagatatacagtcatgtcgtctgcaaacagggacaatttgacttcctcttttcctaattgagtaccctttatttccttctcctgcctaattgccctggccagaacttccaacagtatgttgaataggagtggtgagagagggcatccttgtcttgtgccagttttcaaagggaatgcttccagtttttgcccattcagtatgatattggctgtgggtttgtcatagatagctcttattattttgaaatacatcccatcaatacctaattgattgagaatttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagccacttgatcatggtggataagctttttgaagtgctgctggattcggtttgccagtattttattgaggatttttgcatcaatgttcatcaaggatattagtctaaaattctctttttttgttgtgtctctgcctggctttggtatcagtacgatgctggcctcataaaatgacttagggaggattccctctttttctattgattggaatagtttcagaaggaatggtatcagttcctccttgtacctctggtagaattcggctgtgaatccatctggtcctgcactctttttgattggtaagctattgattattgccacaatttcagatcctgttattggtctattcagagattcaacttcttcctggtttagtcttgggagagtgtatgtgtccgggaatttatccatttcttctagattttctagtttatttgcgtagaggtgtttgtagtattccctgatggtagtttgtatttctgtgggatcggtggtgatatcccctttatcattttttattgcatctatttgattcttctctctttttttctttattagtcttgctagcggtctatcaattctgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttctttatgtacccagtagtcattcaggagcaggttgttcagtttccatgtagttgagtggttttgagtgagattcttaatcctgagttctagtttgattgcactgtggtctgagagatagtttgttataatttctgttcttttacatttgctgaggagagctttacttcccagtgtgtcgtcagttttggaataggtgtggtgtggtgctgaaaaaaatgtatattctgttgatttggggtggagagttctgtagatgtctattaggtccgcttggtgcagagctgagttcaattcctgggtatccttgttgactttctgtcttgttgatctgtctaatgttgacagtggggtgttaaagtgtcccattattaatgtgtgggagtctaagtctctttgtaggtcactcaggacttgctttatgaatcttggtgctcctgtatggggtgcatatatatttaggatagttagctcttcttgttgaattgatccctttaccattatgtaatggccttctttgtctcttttgaacttggttggtttcaagtctgttttatcagagactaggattgcaacccctgcctttttttgttttccattggcttggtagatcttcctccatccttttattttgagcctatgtgtgtctctgcccgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttgctcgttagttgatgcagtttcttcctagcctcgatggtctttacattttggcatgattttgcagcagctggtaccggttgttcctttccatgtttagtgcttccttcaggagctcttgtaaggcaggcctggtggtgacaaaatttctcagcatttgcttgtctgtaaagtattttatttctccttcacttatgaagcttagtttggctggatatgaaattctgggttgaaaattcttttctttaagaatgttgaatattggcccccactctcttctggcttgtagggtttctgccaagagatctgctgttagtctgatgggcttccctttgagggtaacccgacatttctccctgctgcccttaacattttttccttcatttcaactttggtgaatctgacaattatgtgtcttggagttgctcttcttgaggagtatctttgtggcattctctgtatttcctgaatctgaacgttggcctgccttgctagattggggaagttctcctggataatatcctgcagagtgttttccaacttggttccattctccccatcactttcaggtacaccaatcagacgtagatttggtcttttcacatagtcccatatttcttggaggctttgctcatttatttttattcttttttctctagacttcccttctcgcttcatttcattcatttcatcttccatcgctgataccctttcttccagttgatcgcatgggctcctgaggcttctgcattcttcacgtagttctccagccttggttttcagctccatcagctcctttaagcacttctctgtattggttattctagttatacattcttctaaatttttttcaaagttttcaacttctttgcctttggtttgaatgtcctcccgtatctcagagtaatttgatagtctgaagccttcttctctcagctcctcaaagtcattctccatccagctttgttccgttgctggtgaggagctgcattcctttggaggaggagaggcgctctgctttttagagtttccagtttttctgttctgttttttccccatctttctggttttatctacttttggtctttgatgatggtgatgtacagatgggtttttggtgtggatgtcctttctgtttgttagttttccttctaacagagaggaccctcagctgcaggtctgttggaataccctgccgtgtgaggtgtcagtgtgcccctgctggggggtgcctcccagttaggctgcttggtggtcaggggtcagggccccacttgaggaggtagtctgcccgttctcatatctccagctgctgcgtgctgggagaaccactgctctcttcaaagctgtcagacagggacatttaagtctgcagaggttactgctgtctttttgtttgtctgtgccctgcccccagaggtggagcctacagaggcaggcaggcctccttcagctgtggtgggctccacccagttcgagcttcccggctgctttgtttacctaatcaagtctgggcaatggcgggcgcccctcccctagcctcgctgctgccttgcagtttgatctcagactgctgtgctagcaatcagcaagactctgtgggcgtaggaccctccgagccaggtgcgggatataatttcgtggtgcgccgttttttaagcccgtcggaaaagcgcagtattcgggtgggagtgacccgattttccaggtgccatccgtcacccccttctttgactcagaaagggaactccctgaccccttgcgcttccggggtgaggcaatgcctctccctgcttcggctcacgcacggtgcgcgcacccactgacctgcgcccactgtctggcactccctagtgagatgaacctggtacctcagatggaaatgcagaaatcaccgtcttctgcatcgctcacactgggagctgtagaccggagctgttcctattcggccatcttggctcct

SEQ ID NO: 12215 - DNA, 2877 bp, Homo sapiens
ctacatatggctagccagttttcccagcaccatttattaaatagggaatcctttccccatttcttgtttttgtcaggtttgtcaaaggtcagatggttgtagatgtgtggtattatttctgagggctctgttctgttccattggtctgtatctctgttttggaaccagtaccatgctgttttggttactgtagccttgtagtatagtttgaagtcaggtagcatgatgcctccagctttgttcttttggcttaggattgacttggcaatgcaggctcttttttggttccatatgaactttaaagtagttttttccaattctgtgaagaaagttattggtagcttgatggggatggcattgaatctataaattgccttgggcagtatggccattttcatgatattgatttttcctgcccatgagcatggaatgttcttccatttgtttgtgtcctcttttatttcattgagcagtggtttgtagttttccttgaagaggtccttcacatcccttgtaagttggattcctaggtattttattctctttgaagcaattgtgaatgggagttcactcatgatttggctgtttgtctgttattgctgtataggaatgcttgtgatttttgcacattcattttgtatactgagactttgctgaaattgcttatcagcttaaggagattttgggctgagacgatggggttttctagatatacaatcatgtcatctgcaaacagggacaatttgacttcctctcttcctaattgaatacttttatttctttctccagcctgattgcccaggccagaacttccaacactatgttgaacaggagtggtgagagagggcatccctgtcttgtgccagttttcaaagggaatgcttccagtttttgcccattcagtatgatattggctgtgggtttgtcataaatagctcttattatttcaagatacgtcccatcaatacctagcttattgagagtttttagcatgaagggctgttgaattttgttgaaggcctgttctgcatctattgagataatcatgtggtttttgtctttggttctgtttatatgatggattacgtttattgatttgtgtatgttcaaccagccttgcatcccagggatgaagccaacttgatcatggtggataagctttttgatgtgctgctggattcggtttgccagtattttattgaggatttttgcatcgatgttcttcagggatattggtctaaaaatctctttctttgtcatgcctctgcccggctttagtatcaggatgatgctggcctcataaaatcagttagggaggattccctctttttctattaattggaatagtttcagaaggaatggtaccagctccactttgtacctctggtagaattcggctgtgaatccgtctggtcctggacttttttttgttggtaggctattaattattgcctcaatttcagagcctgttactggtctattcagggattcaacttcttccttgtttagtctgggaggctgtatgtgttgagcaatttatccatttcttctagattttctagtttatttgcgtagaggtgtttatagtattatctgatggtagtttgtatttctgtagagtcagtggtgatatcccctttatcatcttttattgcatctatttgattctttctcttttcttctttattagtcttgctagtggtctatcaattttgttttgttgatcttttcaaaaaaaccagctcctggattcattgattttctaaagggttgtttgtgtctctgtctccttcagttctgctctgatcttagttatttcttgccttctgctagcttttgaatgtgtttgctcttgcttctctagttcttttaactgtcatcttaggttgtcagttttagatctttcctgctttctcttgtgggcatttagtgctataaatttccctctacacactgctttaaatgtgtcccagagattctggcatgttgtatatttgttctcattggtttcaaagaatagctttatttctgccttcattttattatgtacccagtagtcactcaggagcaggttgttcagtttccatgtagttgagcggttttgaatgagtttcttaatcctgagttctagtttgattgcactgtggtctgagagacagtttgttatactttctgttcttttacatttgctgaggagtgctttacttccaactatgtggtcaattttggaataagtgcgacgtggtgctgagaagaatgtatagtctgttgatctggcgtggagagttctgtagatgtctattaggtctgcttgatgcagagctgagttcaattcctggatatcctctttaactttctgtctcgttgatctgtctaatgttgacagtgggttgttaaagtctcccattattattgtgtgggagtctaagtctctttgtaggtctctaaggacttgctttatgaatctgggtactcctgtattgggtgcatatatatttaggatggttggctcttcttggtgaattgatccctttaccattatgtaatggccttctttgtctcttttgatattagttggtttaaagtctgttttatcagagactaggattgcaacacctgcttttttttgttttccatttgcttggtagatcttcctccatccctttattttgagcctatgtgtgtctctgaacgtgagatgggtctcctgaatacagcacaatgatgagtcttgaatctttatccaatttgccagtctttgtcttttaattggagcatttagcccatttacatttaaggttaatattgttatgtgtgaattcgatcctgtcattatgatgttagctggttattttgctcgttagttgatgcagtttc

SEQ ID NO: 12216 - DNA, 8075 bp, Homo sapiens
tttcattcttttttttttttttttttaagttttagggtacatgtgcacaacgtgcaggtttgttacatatgtatacatgtgccatgttggtgtgctgcccccactaactcgtcatttacattaggtatatctcctaatgctatccctccccactccccccaccccaaaacaggccccagtgtgtgacgttcctcttcctgtgtccaagtgttgtcattgttcaattcccacctatgagtgagaacatgcggtgtttggctttctgtccttgcgacagtttgctgagaatgatggtttccagcttcatccatgtccctacaaaggacatgaactcatcattttttatggctgcatagtattccatggtatatacgtgccacattttcttaacccagtctatcattgttggacatttgggttggttcctagtctttgccattgtgaatagtgccacaataaacatacgtgtgcatgtgtcttaatagcagcatggtttataatcctttgggtatatacccagtaatgggatggctgggtcaaatggtatttctagctgtagatccctgaggaattgccacactgacttctacaatggttgaactagtttacagtcccaccaacagtgtaaaagtgttcctatttctccacatcctctccagcacctgttgtttcctgactttttaatgactgccattctaactggtgtgagttggtatctcattgtggttttgatttgcatttctctgatggccagtgatggtgagcattttttcatgtgtcttttggctgcataaatgtcttcttttgagaagtgtctgttcgtatccttcacccactttttgatgggtttgtttgtgtttttcttgtaaatttgtttgagttcattgtagattctggatattagccctttgtcagatgagtagattgcaaaaattttctcccattctgtaggttgcctgctcactctgatggtagtttcttttgctgtgcagaagctctttagtttaattagatcccatttgtcatttttggcttttgttgccattgcttttggtgttttagacatgaagtccttgcccatgcctatgtcctgaatggtaatgcctaggttttcttctagggtttttatggttataggtctaacatttaagtctttaatccatcttgaattaatttttgtataaggtataaggaagggatccagtttcagctttctacatatggctagccagttttcccagcaccatttattaaatagggaatcctttccccatttcttgtttttgtcaggtttgtcaaagatcagatagtcgtagatatgcggcattatttctgagggctctgttctgttccattgatctatatctctgttttggtaccagtaccatgctgttttggttactgtagccttgtagtatagtttgaagtcaagtagcatgatgcctccagctttgttctcttggcttaggattgacttggcaatgcgggttcctttttgattccatatgaactttaaagtagttttttccaattctgtgaagaaagtcattggtagcttaatggggatggcatagaatctataaattaccttgggcagtatggccattttcatgatattgattcttcctacccataagcatggaatgttcttccatttgtttgtatcttgttttatttcattgagcaatggtttgtagttctccttgaagaggtccttcacatcctttgtaagttgggttcctaggtattttattctctttgaagcaattgtgaatgggagttcactcatgatttggctctctgtctgttattggtgtataagaatgcttgtgatttttgcacattgattttgtatcctgagtccttgctgaagttgcttatcagcttaaggagattttgggctgagacgatggggttttctagatatacagtcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcataaatagctcttcttattttgaggtacgtcccatgaatacctaatttattgagagtttttagcatgaagggctgttgaattttgtcaaatgccttttctgcatctattgagataatcatgtggtttttgtcattggttctgtttatatgctggattacatttattgatttgcatatgttgaaccagccttgcatcccagggatgaagcccacttgatcatggtggataagctttttgatgtgttgctggattcggtttgccaatattttattgaggatttttgcatcgatgttcatcaggggtattggtctaaaattctctttttttgttgtgtctttgccaggctttggtatcaggatgatgctggtctcataaaatgagttagggaggattctctttttttctattgattggaatagtttcagaaggaatggtaccagctcctccttgtacctctagtggaattcggctgtgaatctgtctgttcctggactttttttggttggtaggctattaattattgcctcaatttcagagcctgttattggtttattcagagattcaactttttcctggtttagtcttgggagtgtgtatgtgttgaggaatttatccatttcttctagattttctagtttatttgtgtagaggtgtttatagtattctctgatggtaatttgtatttctgtgggatcggtggtgatatcccctttatcattttttattgcgtctatttgattcttctctcttttcttctttattagtcttgctagcagtctattaattttcttgattttttcaaaaaaccagctcctggattcattgattttttgaagggttttttgtgtctctatttccttcagttctgctctgatgttagttatttcttgccttctgctagcttttgaatgtgtttgctcttgcttctctagttcttttaattgtgatgttaggatgtcaattttagatctttcctgctttctcttgtgggcatttagtgctataaatttccccctacacactgctttaaatgtgtcccagagattctggtatgttgtgtctttgttctcattggtttcaaagaacatctttatttctgccttcatttcgttatgtacccagtagtcattcaggagcaggttgttcagtttccatgtagttgagcggttttgagtgagtttcttaatcctgagttctagtttgattgcactgtggtctgagagacagtttgttataatttctgttattttacatttgctgaggagtgctttaattccaactatggtcaattttggaataagtgtgatgtggtgctgagaagaatgtatattctgttgatttggggtggagagttctgtagatgtctattaggtctgcttggtgcagagctgagttcaattcctggatatccttgttaactttctgtctcgttgatctgtctaatgttgacagtggggtgttaaagtctcccattattattgtgtgggagtgtaagtctctttgtaggtctctaaggacttgctttatgaatctgggtgctcctgtattgggtgcatatatatttaggatagttagctcttcttgttgaattgatccctttaccattatgtaatggcctactttgtctcttttgatctttgttggtttaaagtctgttttatcagagactaggattgcaacccctgcctttttttgttttccatttgcttggtagatcttcctccatcccttcattttgagcctatgtgtgtctctgcatgtgagatgagtttcctgaatacagcacactgatgggtcttgactctttatccaatttgccagtctgtgtcttttaattggagcatttagcccatttacatttaaagttagtattatgtgtgaatttgattctgtcattatgatgttagctggttattttgcttgttagttgatgcagtttcttcctagccttgatggtctttacaatttggcatgtttttgcagtggctggtactggttgttcctttccacgtttagtgcttccttcaggagctcttttagggcaggcctggtggtaacagaatctgccagcatttgcttgtctgtaaagtatttaattcctccttcactttacgaagcttagtttggctggatatgaaattctggggtgaaaattcttttctttaagaatgctgaatattggcccccactctcttctggcttgtaaagtttctgccaggagatcagctgttagtctgatgggcttccctttgtgggtaacccgacctttctctctggctgcccttaacgttttttccttcatttcaactttggtgaatctgtcaattatgtgtcttggagttgctcttctcgaggagtatctttgtggcgttctctgtatttcctgaatgtgaatgttggcctgccttgctagactggggaagttctcctggataatatcctgcagagtgttttccaacttggttccattctccccgtcactttcaggtacaccaatgagacgtagatttggtcttttcatatagtgccatatttcttggaggctttgttcatttctttttattctttgttctctaaacttctcttcttgcttcatttcattcatttgatcttccatcactgataccctttcttccaattgatcgaatcggctactgaggcttgtgcattcgtcacgtagtttttgtgccatggttttcagctccatcaggtcatttaaggacttctctgcattggttattctagttagccattcgtctaatcttttttcaaggttcttaacttctttgccatgggtttgaacttcctcctttagctcggggaagtttgatcatctgaagccttctcctctcaactcgttgaagtcattctctgtccagctgtgttctgttgctggtgaggagctgcattcctttggaggaagagaggcgctctgatttttagaattttcagcttttctgctgttttttccccatctttgtggttttatctaccttttgtctttgatgatggtgacgtacagatggggttttggtgtggatgacctttctgtttgttagttttccttctaacagtcaggaccctcagctgcaggtctgttggggtttgccagaggtccactccagaccctgtttgcctgggtatcaccagcggaggctgcagaacagcaaatattggtgaacagcaaatgttgctgcctgattgttcctctggaagttttgtttcagaggggtacctggccgtgtgaggtgtcagtctgcccctactggggggtgcctcccagttagggtacttggggttcagggacccacttgaagaggcagtctgtccattctcagatctaaagctgcatgctggaagaaccactgctgtcttccaagctgtcagacagggacatttaagcctgcagaggtttctgctgccttttgtttggctatgccctgcccccacaggtggagtctacagaggcaggcaggcttccttgagctgtggtgggctccacccagttcgagcttcccagcctccagcaatggcaggcacccctcccccagcctcactgccaccttgcagtttgatctcagactgctgtgctagcaatgagcgaggctctgtgggcgtaggaccctccgagccaggcacgggatataatctcctggtgcgctgtttgctaagaccgttggagaagcgcagtagtaggatgggagtgacccaattttccaggtgccatctgtcatccctttccttggctaggaaagggaattccctgaccccttgtgcttccccggtgaggggatgcctcgccctgcttcagctcactcccggtgcactgcacccactgtcctgcacccactgtccgaaaatccccagtgagatgaacccggtacctcagttggaaatgcagaaatcatccgtcttctgtgtcgctcatgctgagagctgtagactggagctgttcctattcggccatcttggaactgcccctgactttcattctttgtactatttttgtcatagatttttcttctatgtattttaaacactctataataccttgttactgtttttgctttaaactaaataaaaatggaaaagataaataaaaaatggaaaagaaggtctgtgtttacctacacatttaccattttcagcattctttgtttctttgtgtagatctgggtgttcatctggtgtcattttcttttgcctgaaaaaacttcattttttcctggatttccacagtgtttggacatttcctgaaaaactttatttgttcattctgtcttgttttttttttaagatagggtcttgctctgtcacccaggttggagtgcagtggcgcaatgatagttcaccgcagcctcggactccaggaatcctcctgtttcagcctgccaggtagctaggactacaagcgcatgcccagctaatttttgtttgtttgttttgtagagacagggtctcactgtgttgcccaggctgatgttgaactcctagcctcaagagattcccctgctttagccccccaaagtgcagggattacaggcatgaacattgtgcctggattattcagtatttcttgtagtgcagatgtgctgttgagacagattctctcagcttctgtttgtctgaaaaagtcttaatgtcggattctggaaaaaacctctttatctggatatttataggaaagttgaaagactatcatagtgaatgcatagactgtaccctttgtacagatccacctattgttagcattttgcctcatttgctttatgaattactctgttcctctttctctctttttctgtgaatgtgtgtatgtgtccatataattacacacatattttcttctttaactgtctgaaaataagttatatagtgtttaccctttaccccgaaatatgtccttgtattatttcttaagaaaaaaagattctcttttattgccactgtagttagtacttgtagtagatttgactttgttataatacttttattcatctatccagttttgttagtggacccaataataacctttgtagattttttttcctgcagtacatgatccagttttggatcacatattgcatttcgtggtaatatcttttcagtctctttcaatctagaataattcctcagcctttctttgtcttttatgacactggccttttaaaagaatacagtctttgttgtgtgtgtgtgtttttcaagtaaaatcttctcattctggcagaaaattcagattatgccttcctggccagaatactaaaaagtgatgttttgtcttcggaatattacatctagagccatttgacatctgtgtacccctcatttgtgatatcaggcctgatcacctggccagtttctctctggtttatactttacatccgctgccttgctactaataagaagtctgcagagacacttcaacactatgtagctattctatacctcattaagatttcacccctatatttagcatcctttggtaatttttctctaaactattcttttctgtgatagttgcaaaatgatgatttttcaactttagcattgctttcacagttgctaattgatacttggcatgattctgaaaacaagagcccttccctctgccttattattattttctttttcttttttttttttttttttttgagacggagtctcgctctgtcgtccaggctggagtgcagtggcacgatctcggctcactgcaagctccgcctcccaggttcacgccattctcctgcctcagcctcccgagtagctgggactacaggcgcatgccatgcctggctaatgttttgtatttttagtaaagatggcatttcaccgtgttagccaggaaggtctcaatctcctgacctcgtgatctgtctgcctcggcctcccaaagtgctgggattacaggcgtgagccactgcgcccggcc

SEQ ID NO: 12217 - DNA, 1552 bp, Homo sapiens
gctttgaatgtgtcccagagattctggtatgttgtgtctttgttctcgttggtttcaaagaacatctttatttctgccttcatttcgttaggtacccagtagtcattcagaagcaggttgttcagtttccatgtagttgaatgcttttgagtgagtttcttaatcctgagttctagtttgattgcactgtggtctgagagactgttataatttctgttcttttacttttgttgaggagagctttacttccaagtatgtggtcaattttggaataggtatggtgtggtgctgaaaaaaatgtatattctattgatttggggtggagagttccgtagatgtctattacgtccgcttggtgcagagctgagttcaattcctgggtatccttgttaactttctgtctcgttgatctgtctaatgttgacagtggggtgttaaagtctcccattattactgcgtgggagtctaagtctctttgtaggtcactcaggacttgctttatgaatttgggtgctcctgtattaggtgcatatatatttaggatagttagctcttcttgttgaattgatccctttaccattatgtaatggccttctttgtctcttttgacctttgttggtttaaagtctgttttatcagagactaggattgcaacccctgcctttttttgttttccatttgcttggtagatcttcctccatccttttattttgagcctatgtgtgtctctgcatgtgagatgggtttcctgaatacagcacactgatgggtcttgactctttatccaatttgccagtctgtgtcttttaattggagcatttagtccatttacatttaaagttaatattgttatgtgtgaatctgatcctgtcattatgatgttagctggttattttgctcgttagttgatgcagtttcttcctagcctcgatggtctttacaatttggcatgattttgcagtggctggtaccagttgttcctttccatgtttagtgcttccttcaggagctcttttagggcaggtctggtggtgacaaaatctctcagcatttgcttgtctgtaaaggattttatttctccttcacttatgaagcttagtttggctggatatgaaattctgggttgaaaattcttttctttaagaatgttgaatattggtccccactcccttgtggcttgtagagtttctgccgagagatccgctattagtctgatgggcttccctttgtgggtaacccgacctttctctctggctgcccttaacattttttccttcatttcaacattggtgaatctgacaattatgtgtcttggagttgctcttcttgaggagtatctttatggcgttccctgtatttcctgaatctgaatgttggcctgccttgctagattggggaacttctcctggataatatcctacagagtgtttttcaacttggttccattctccccgtcactttcaggtacaccattcagacatagatttggtcttttcacatagtcccatatttcttggaggctttgttcatttctttttattcttttttctct

SEQ ID NO: 12218 - DNA, 2256 bp, Homo sapiens
gattttgtatcctgagactttgctgaagttgcttatcagcttaaggagatttttggctgagacaatggggttttctaaatatacaatcatgtcatctgcaaaccgggacaatttgacttcccattttcctaattgaataccctttatttctttctccttcctgattgccctggccagaacttccaacactatgttgaataggagtggtgacagaggtcatccctgtcttgtgccagttttcaaagggaatgcttccagtttttgcccatttagtatgatattggctgtgggtttgtcataaatagctcttattattttgagataggtcccatcaatacctagtttattgagagattttagcatgaagggttgttgaattttgtcaaaggccttttctgcatctattgagataatcatgtggtttttgtcattggttctgtttatatgctggattacgtttatttatttgtgtatgttgaaccagccttgcatcccagggatgaagcccacttgatcatggtggataagctttttgatgtgctgctggattcggtttgccagtattttattgaggatttttgcatcgatgttcatcagggatattggtctaaaattctctttttttgttgtgtctctgccaggctttggtatcaggatgatgctggcctcataaaatgagttagggaggattccctctttttctattgattggaatagtttcagaatgaatggtaccagctcctcattgtacctctggtagaattcagctgtgaatctctctggtcctggactttttttcgttggtaggctattaattattgcctcaatttcagagcctgttattggtctattcagggattcaacttcttcctggtttagtcttgggagggttacgtgtccaggaatttatccatttcttctcgattttctagttatttgcatagaggtgtttatagtattctctgatggtagtttgtatttctgtgggatcggtggtgatatcccctttatcattttttactgtgtctatttgattcttctctcttttcttctttgttagtcttgctagcagtgtatcaattttgtgatcttttcaaaaaaaatcagctcctggatttgttgattttttgaaggtttttttgtgactctatctctttcatttcttctctgatctcagttagttcttgccttctgctagcttttgaatgtgtttgctcttgcttctctagttcttttaattgtgatgttaggatgtcaattttagatctttcctgctttctcttgtgggcatttagtgctataaatttccctctacacactgctttgaatgtgtcccagagattctggtatgttgtgtctttgttctcgttggtttcaaagaacatttttatttctgccttcatttcgttatgtacccagtagtcattcaggagcaggttgttcagtttccatgtagttgagcagttttgagtgagtttcttaatcctgagttctagtttgattgcactgtggtctgagagatagtttgttataatttctgttcttttccatttgctgaggagtgctttacttccaactatgtggtcaattttggagtaggtgtggtatggtgctgaaaagaatgtatattctgttgatttggggtggagagttctgtagatgtctattaggtccacttggtgcagacctgagttcaattcctgggtatccttgttaacgttctgtctcgttgatctgtctaatgttgacagtggggtgttaaagtctgtcattattattgtgtgggagtctaggtctctctgaagatctctaaggacctgctttatgaatctgggtgctcccatattgggtgcatatatatgtaagatagttagctcttcttgttgaattgatccctttaccattaagtaatggctttctttgtctcttttgatctttgttggtttaaagtctgttttatcagagactaggattgccacccctgcctttttttgttttccatttgcttggtagatcttcctccatccctttattttgagcctatgtgtgtctctgcacgtgagatgggtttcctgaatacagcacactgatgggtcttgactctttatccagtttgccagtctgtgtcttttaactggagcatttagcccgtttacatttaaggttactattgttatgcgtgaatttgatcctgtcattatgatgttagctggttattttgctcgttagttgatgcagtttcttcctagcatcgat

SEQ ID NO: 12219 - DNA, 4320 bp, Homo sapiens
  misc_feature (1129)..(1129): n equals a,t,g, or c
ttatttatttatttatttagtattatactttaagttttagggtacatgtgcacaacgtgcaggttagttacatatgtatacatgtgccatgctggtgccctgcacccactaactcgtcatctagcattaggtaaatctcccaatgctatccctcccccatacccccaccccacaacagtccccagagtgtgatgttccccttcctgtgtccatgtgttctcattgttcaattcccccctatgagtgagaatatacggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttaggttggttccacgtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccactatggttgaactagtttacagtcccaccaacagtgtaaaagtgttcctatttctccacatcctctccaggacctgttgtttcctgactttttaatgattgccattctaactggtgggaaatggtatctcattgtggttttgatttgcatttctctgatggccagtgatgatgagcattttttcatgtgttttttggctgcataaatgtcttcttttgagaagtgtctgttcatgtccttcgcccactttttgatgggattgtttgtttttttcttgtaaatttgtttgagttcattgtagattctggatattagccctttgtcagatgagtaggttgcaaaaattttctcccattttgtaggttgcctgttcactctgatggtagtttcttttgctgtgcagaagctctttagttgaattagatcccatttgtcaattttggcttttgttgccattgcttttggtgttttagacatgaagtctttgcccatgcctatgtcctgaacggtaatgcctaggttttcttctgggtntttatggttttaggtctaacgtttaagtctttaatccatcttgaattgatttttgtataaggtgtaaggaagggatccagtttcagctttctacatatggctagccagttttcccagcaccatttattacatagggaatcctttccccattgcttgtttttctcaggtttgtgaaagatcagatagttgtagatatgcggcgttatttctgagggctctgttctgttccattgatctatatctctgttttggtaccagtaccatgctgttttggttactgtagccttgtagtatagtttgaagtcaggtagtgtgatgcctccagctttgttcttttgcctcaggattgacttggcgatgtgggctcttttttggttccatatgaactttaaagtagtttttccaattctgtgaagaaagtcattggtagcttgatggggatggcattgaatctgtaaattaccgtgggcagtatggcattttcatgatattgattcttcctacccaatgagcatggaatgttcttccatttgtttttatcctcttttgtttccttgagaagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtcatctgcaaacagggacaatttgacttcctcttttcctaattgaataccctttatttccctctcctgcctaattgccctggccagaacttccaacactatgttgaataggagtggtgagagagggcatccctgtcttgtgccagttttcaaaggtaatgcttccagtttttgcccattcagtatgatattggctgtgggtttgtcatagatagctcttattattttgagatatgtcccatcaatacctagtttattgagagtttttagcatgaagggttgttgaattttgtcaaaggccttttctgcatctattgaaataatcgtgtggtttttgtctttggttctgtttatatgctggattacatttactgatttgcgtatattgaaccaggcttgcatcccagggatgaggcccacttgatcatggtggataagctttttgatgtgctgctggattcggtttgccagtattttactgaggatttttgcatcaatgttcatcaaggatattggtctaaaattctcttttttggttgtgtctctgcccggctttggtatcaggatgatgctggcctcataaaatgagttagggaggattccctctttttctattgattggaatagtttcagaaggaatggtaccagttcctccttgtacctctggtagaattcggctgtgaatccatctggtcgtggactctttttggttggtaagctattgattattgccacaatttcagatcctgttattggtctattcagagattcaacttcttcctggtttagtcttgggagggtgtatgtgtcgaggaatttatccctttcttctagattttctagtttatttgcatagaggtgtttgtagtattctctgatggtagtttgtatttctgtgggatcggtggtgatatcccctttatcattttttattgcgtctatttgattcttctctctttttttctttattagtcttgctagcggtctatcaattctgttaatcctttcaaaaaaccagctcctggattcgttaattttttgaagggttttttgtgtctctatttccttcagttctgctctgattttagttatttcttaccttttgctagcttttgaatgtgtttgctcttgcttttctagttcttttaattgtgatgttacggtgtcaattttggatctttcctgctttctcttgtgggcatttagtgctataaatttccctctacacactgctttgaatgtgtcccagagattctggtatgttgtgtctttgttctcgttggtttcaaagaacatctttatttctgccttcattttgttatgtatccagtagtcattcaggagcaggttgttcagtttccatgtagttgactggttttgagtgagattcttaatcctgagttctagtttgattgcactgtggtctgagagatagtttgttataatctctgttcttttacatttgctgaggagagctttacttccaagtatgtggtcaattttggaataggtgtggtgtggtgctgaaaaaaatgtatattctgttgatttggggtggagagttctgtagatgtctattaggtccacttggtgcagagctgagttcaattcctgggtatccttgttgactttctgtctcgttgatctgtctaatgttgacagtggagtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccattatgaaatggccttctttgtctcttttgatctttgttggtttcaagtctgttttatcagagactaggattgcaacccctgcctttttttgttttccattggcttggtagatcttcctccatccttttattttgagcctatgtgtgtctctgcccgtgagatgggtttcctgaatacagcgcactgatgggtcttgactctttatccaatttgccagtctgtgtcttttaattggagcatttagtccatttacatttaaagttaatattgttatgtgtgaatttgatcctgtcattatgatgttagctggttattttgctcgttagttgatgcagtttcttcctagtctcgatggtctttacattttggcatgattttgcagcggctggtaccggttgttcctttccatgtttagtgcttccttcaggagctgttttagggcaggcctggtggtgacaaaatctctcagcatttgcttgtctgtaaagtgttttatttctccttcacttatgaagcttattttggctggatatgaaattctgggttgaaaattctttccttta

SEQ ID NO: 12220 - DNA, 4829 bp, Homo sapiens
tttacattaggtatatctcctaatgctatccctaccacctccccccaccccacgacaggcctcgttgtatgatgttccccatcctgtgtccaagtgttctcattattcaattcccaccaatgagtgagaatatgcggtgtttggttttctgtccttgcgatagtttgctcagaatgatggtttccagcttcattcatgtccctacaaaggacatgaactcatcctttttgatggctgaatagtattccatggtgtatatgtgccacattttcttaatccagtctatcattgacggacatttgggttggttccaagtctttgctattgtgaatagtgccgcaataaacatacgtgtgcatgtgtctttatagcagcatgatttataatcctttgggtatatgcccagcaatgggatggctgggttaaatggtatttctagttctagatccttgaggaatcactgcactgtcttccacaatggttgaactagtttacagtcccaccagcagtgtaaaagtgttcctatttctccacattctctccagcatctgttttttcctgactttttaatgatcaccattctaactggtgtgagatggtatctcattgtggttctgatttgcattctctgacggccagtgatgacgagcattttttcatgtgtctgttggctgcataactgtcttctttggagaagtgtctgttcatatccttcgcccaccttttgatggggttgtttgattttttcttgtaaacttgtttaagttctttgtagattctggatattagccctttgtcagattagtagattgtaaaaattttctcccattctgtaggttgcctgttcactctgatggtggtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaacatttaagtctttcatccaacttgaattaatttttgtataaggtgtgaggaagggtccagtttcagctttctacatatggctagccagttttcccagcaccatttattaaacagggaatcctttccccatttcttggttttgtcaggtttgtcaaagagcagatggttctagatgtgtggtattatttctgagggctcttttctgttccattggtctatatctctgttttggtaccagtaccatgctgttttggttactgtagccttgtagtatagtttgaagtcagctagcgtgatgcctccagctttgttcttttggcttaggattgtcttggcaatgtgggctcttttttggttccatatgaactttaaagtaattttttccaattctgtgaagaaagtcattggtagcttgatggggatggcattgaatctataaattaccttgggcagtatggccattttcacgatattgattcttcctatccatgagcatggaatgttcttccatttgtttgtgtcctcttttatttcattgagcagtggtttgtagttctccttgaagaggtccttcatgtcccttgtaagttggattcctaggtattttattctctttgaagcaattgtgaatgggagttctctcatgatttggctctctgtttgtctgttattggtgtataggaatgcttgtgatttttgcacatggattttgtatcctgagactttgctgaagttgtttatcagcttaagttgctttggggctgagacaatggggttttctaaatatacagtcatgtcaaccgcaaacagggacaatttgacttcctcttttcgcaattgaatacttttatttctttctcctgcctgattgccctggccagaacttccaacactatgttgaataggagtggtgagagagggcatcctgtcttttgccagttttcaaagggaatgcttccggtttttgcccattcagtatgatattggctgtgggtttgtcatagatggctcttattattttgagatacgtcccatcaatacctaatttattgagagtttttagcatgaagggcttttgaattttgtcaaaggccttttctgcatctattgagataatcaggtggttttcttctttggttctgtttatatgatggattacgtatattgatttgtgtatgttgaactagacttggatctcagggatgaagccaatttgatcatggtggataagtttttgatgtgctgctggattcaatttgtcagtattttattgaggatttttgcatcgatgtttatcagggatattggtctaaaactctcttttttgttgtgtctctgccaggctttggtatcagaatgatgctggcctcataaaattagttagggagtattccctctttttcagttgattgggatagtttcagaaggaatggtaccagctcctctttgtacctctggtagaatttggctgtgaatctatctggtcctggacttttatggttggtaggctattcattattgcctcaatttcagagcctgttattggtctctttagggattcaacttcttcctggtttagtcttgggagggtatatgtgtccaggaatttatccatttcttctagattttctagttagtttgtgtagaggtgtttatagtattctctgatggtagtttgtatttctgtagcatcagtggtgatatcccctttatcattttttattgcgtctgtttgattcttctctcttttcttctttattagtcttgctagtggtctatcaattttgttgatctttttaaaaaaccagctcctggattcattagtttttgaagggttttttgtgtctctatctccttcagttctgctctgatcttagttatttcttgccttctgctagcttttgaatgtgtttgctcttgctcttcaagttcttttaattgtgatgatagggtgtcaattttggatctttgctgctttctcttgtgggcatttagtgctataaatttcctgctacagaatgctttaaatgtgtcccagagattctggtatgttgtgtctttgttctcgttggtttcaaagaacatctttatttctgccttcatttcgttacgtacccagtagtcattcaggagcaggttgttcagtttccatgtagttgagtggttttgagtgagtttcttaatcctgagttctagtttgattgcactgtggtctgagagacagtttgttataatttctattcttttacatttgctgaggagtgctttacttccaactatgtagtcatttttgggataagtgtgatgtggtgctgagaagaatgtatattctgttgatttggggtagagagttctgtagatgtctattaggtctgcttggtacagagctgagttcaattcctggatatccttgttaacgttctgtctcgtttctctgtctaatgttgacagtggggtgttaaagtctcccattattattgtgtgggagtctaagtctctttgtagttctctaaggacttgctttatgaatctgggtgctcctgtattgtgtgcatgtatatctaggactgttaggttttcttgttgaattgatccctttaccattatgtaatggccttctttgtctcttctgatctttgttggtttaaagtctgtttttatcaaagactaggattgcaacccctgctttttttgttttccatttgcttggtagatcttcctccatccttttattttgagcctatgtgtgtctctgcatgtgagatgggtctcctgaatacagcacactgatgggtcttgactctttatccaatttgccagtctgtgtcttttaattggagcatttagcccatttacctttaaggttaatattgttatgtgtgaatttgatcctgtcattatgatgttagctggttattttgctcgttagttgatgcagtttcttcctagcatcagtggtctttacaatttggcatgcttttgcagtggctggtacctgttgttcctttccatgtttagtacttccttcaggagctcttgtaaggcaggcctggtggtgacaaatctctcagcatttgcttatctgtaaaggattttatttctctttcacttatgaagcttagtttggctggatatgaaattctgggttgaaaattcttttcttgaagaatgttgaatattggccttgactctcttctggcttgtagagtctctgccaagagatccgctgttagtctgatgggcttccctttgtgggtaacccaacctttctctctggctgcccttaacattttttccttcatttcaactttggtgaatctgacaattatgtgtcttggagttactcttctcaaggagtatctttgtggcattctctgtatttcctgaatttgaatgttggcctgccttgctagttggggaagttctcctggataatatcctgaagagagttttccaacttggttccattctcctcatcactttcaggtacaccaatcaaatgtagatttggtcttttcacatagtcccatatttcttggaggctttgttcacttctttctactcttttttctctaaacttctcttcttgcttcatttcattcatttgatcttcaatcactgataccctttcttccagttgattgaatgggctactgaagcttgtgcatgcgtcacgtagttcttgtgccatggttttcagctccatcaggtcatttaaggtcttctctacactgttgattctacttaggcattcatctaatcttttttcaaggtttttagcttctttgtgatggggttgaa

SEQ ID NO: 12221 - DNA, 4015 bp, Homo sapiens
ttcttttttcttttttttattatactttaagttttagggtacatgtgcacattgtgcaggttagttacatatgtatacatgtgccatgctggtgtgctgcacccactaactcgtcatctagcattaggtatatctcccaatgctatccctcccctctccccccaccccaccacagtccccagagtgtgatattccccttcctgtgtccatgtgatctcattgttcaactcccacttatgagtgagaatatgcggtgtttggttttttgttcttgcgatagtttactgagaatgatgatttccaatttcatccatgtccctacaaaggacatgaactcatcattttctatggctgcatagtattccatggtgtatatgtgccacattttcttaatccagtctatcgttggacatttgggttggttccaagtctttgctgttgtgaataatgccgcaataaacgtacgtgtgcatgtgtctttatagcagcatgatttatagtcatttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgacttttgaatgattgccattcaaactggtgtgagatggtatctcatagtggttttgatttgcatttctctgatggccagtgatggtgagcattttttcatgtgttttttggctgcataaatgtcttcttttgagaagtgtctgttcatgtccttcacccactttttgatggggttgtttgtttttttcttgtaaatttgtttgagttcattgtagattctggatattagccctttgtcagatgagtaggttgtgaaaattttctcccattttgtaggttgcctgttcactctgatggtagtttcttttgctgtgcagaagctccttagtttaattagatcccatttgtcaattttgtcttctgttgccattgcttttggtgttttggacatgaagtccttgcccatgcctgtgtcctgaatggtaatgcctaggttttcttctagggttttttatggttttaggtctaacgtttaaatctttaatccatcttgaattgatttttgtataaggtgtaaggaagggatccagtttcagcttcctacatacggctagccagttttcccagcaccatttattaaatagggaatcctttccccattgcttgtttttctcaggtttgtcaaagatcagatagttgtaggtatgcggcgttatttctgagggctctgttctgttccattgatctatatctctgttttggtaccagtaccatgctgttttggttactgtagccttgtagtatagtttgaagtcaggtagtgtgattcctccagctttgttcttttggcttaggattgacttggcaatgcaggctcttttttggttccatatgaactttaaagtagttttttccaattctgtgaagaaagtcattggtagcttgatggggctggcattgaatctgtaaattaccttgggcagtatggccattttcacgatattgattcttcctacccatgagcatggaatgttcttccatttgtttgtatcctcgtttatttccttgagcagtggtttgtagttctccttgaagaggtccttcacgtcccttgtaagttggattcctaggtattttattctctttgaagcaattgtgaatgggagttcactcatgatttggctctctgtttgtctgttgttagtgtttaagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttgtttccttctcctgcctaattaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcgttttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccttctggtcctggactctttttggttggtaaactattgattattgccacaatttcagctcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgcgtctatttgattcttctcttttcttctttattagtcttgctagcagtctatcaattttgttgatcctttcaaaaaaccagctcctggattcattgattttttgaagggttttttgtgtctctatttcctttagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcattggtttcaaagaacatctttatttctgccttcatttcattatgtatccagtagtcattcaggagctggttgttcagtttccatgtagttgagcggctttgagtgggattcttaatcctgagttctagtttgattgcactgtggtctgagagatagtttgttataatttctgttcttttacgtttgttgaggagagctttacttccaactatgtggtcaattttggaataggtgtggtgtggtgctgaaaaaaatgtatattctgttgatttggggtggagagttctgtagatgtctattaggtttgcttggtgcagagctgagttcaattcctgggtatccttgttgactttctgtctcgttgatctgtctaatgttgacagtggggtgttaaagtctcccattattaatgtgtgggagtctaagtctctttgtaggtcactgaggacttgctttatgaatctgggtgctcctgtattgggtgcatatatatttaggatagttagctgttcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatggatcttgactctttatccaatttgccagtctgtgtcttttatttggagaatttagtccatttatatttaa

SEQ ID NO: 12222 - DNA, 3686 bp, Homo sapiens
gtctaacatttaagtctttaatccatcttgaattaacttttgtataatgtgtaaggaaaggatccagtttcagctttctacatatggctagccagttttcccagcaccgtttgttaaatagggaatactttccccatttcttgtttttgtcaggtttgtcaaagatcagatagttgtagatgtgtggcattatttctgagggctctgttctgttccattggtctatatctctgtttggtaccagtaccatgctgttttggttactgtagccttgtagtatagtttgaagtcaggtagcgtgatgcctccagctatgttctttggcttaggattgacctggcaatgcaggctcttttttggttccatatgaactgtagttttttccaattctgtgaagaaagtcattggtagcttcatggggatggcactgaatctataaattaccttgggcagtatggtcattttcaccatattgattcttcctacccatgagcatggaatgttcttccatttgtttgtatcctcttttatttcattgagcagtggtttgtagttctccttgaagaggtccttcacatcccttgtaagttggattcctaggtattttattctctttgaagcaattgtgaatgggagttcactcatgatttggctctttgtttgtgtgtttttggtgtataagaatgcttgtgatttttgcacattgattttgtatcctgagactttgctgaagttgcttatcagcttaaggagattttgggctgagatgatggggttttctaaatatacaatcatgtcatctgcaaacagggacaatttgacttcctcttttcctaattgaataccctttatttctttctcctgcctgatttccctggccagaacttccaacactatgttgaataggagtggtgagagagggcatccctgtcttgtgccagttttcaaagggaatgcttccagtttttgcccattcagtatgatattggctgtgggtttgtcataaatagctgttattatttttagatacatcccatcaatacctaatttattgagagtttttagcatgaaaggctgttgaattttgtcaaaggccttttctgcatctattgagataatcatgtggtttttgtctttggttctgtttatatgctggattacgtttattgatttgcgtatgttgaaccagccttgcatcccagggatgaagcccatttgatcatggataagctttttgatgtgctgctggattcagtttgccagtattttattgaggatttttgcatcagtgttcatcagggatattggtctaaaattctctttttttgttgtgtctctgccaggctttggtatcaggatgatgctggcctcataaaatgagttagggaggattccctctttttgtattgattggaatagtttcagaaggaatggtaccagctcctccttgtacctctggtagaatttggctgtgaatctgtccagtcctggactttttttggttggtaagctattaattattgcctcaatttcagagcctgttattggtctattaagagattcaacttcatcctggtttagtcttgggagaatgtgtgtgtcgagtaatttatcaatttcttctagattttctagtttatttgtgtagaggtgtttatagtagtctctgatggtcgtttgtatttctgtgggatcggtggtgatatcccctttatcattttttattgcatctatttgattcttctctcttttcttctttattagtcttgctagcggtctatcaattttgttgatcttttcaaaaaaaaaaccagctcctggattaactgattttttgaagggttttttgtgtctctatctacttcagttctgctctgatcttagttatttcttggcttctgctagcttttgaatgtgtttgctcttgcttctctagttcttttaattgtgatgttagggtgtcaattttagatctttcctgctttctcttgtgggcatttagtgctataaatttccctctacacaccgctttaaatgtgtcccagagattctggtatgttgtgtctttgttctcgttggtttcaaagaacatctttatttctgccttcattttgttatatacccagtagtcattcaggagcaggttgttcagtttccattagttgagtggttttgagtgagtttcttaatcctgagttctagtttgatttcactatggtctgagagacagtttattataatttctgttcttttacatttgctgaggagtgctttacttccaactatgtggtcaattttggaataggtgcgggtgtggtgtggagaagaatgtatgttctgttgatttggcgtggagagttctatagatgtctattaggtccacttggtgcagagctcagttcaattcctgcatatccttgttaactttctgtctcattgatctgtctaatgttgacagtggggtgttaaagtctcccattattattgtgtgggagtctaagtctctttgtaggtctctaaggacttgctttatgaatctgggcgatcctgtattaggtgcatatatatttaggatagttagctcttgttgaattgatccctttaccattatgtaatggccttctttgtctcttttgatctttgttggtttaaagtctgttttatctgagactaggattgcaacccctgcctttttttgttttctatttgcttggtagatcttcctccgtccctttattttgagcctatgtgtgtctctgcatgtgagatgggtttcctgaatacagcacactgatgggtcttgactctttatccaatttgccagtctgtgtcttttaattggagcatttagcccatttacatttaaggttaattttgttatgtgtgaatttgatcctgtcattatgatgttagctggttattttgctcattagttgatgcagtttcttcctagcatcgatggtctttacaatttggcatgtttttgcagtggctggtaccagttgttcctttccatgtttagtgcttccttcaggaactcttttagggcaggcctggtggtgacaaaatctctcagcatttgcttgtctgtaaaggattttatttctctttcacttacaaagcttagtttggctggatctgaaattctgggttgaaaattcttttctttaagtatgttgaatattggcccccactctcttctggcttgtagagtttctgccaagagatcagctgttagtctgatgggcctccctttgtgggtaacccgacctttctctctggctgcccttaacattttttccttcatttcaactttggtgaatctgacaattatgtgtcttggagttgctcttctcgaggagtatctttgtggtattctctgtatttcctaatttgaatgttggcctgccttgctaggttggggatgttctcctggataatatactgcagagtgttttccaacttggttccattgtccccatcactttcaggtacaccaatcagacatagatttggtcttttcacatagtcccatatttcttggaggctttgttcatttctttttattcttttttctctaaacttctcttctcacttcacttcattcatttgatcttcaatcactgataccctttcttccagttgatcgaattggctactgaagcttgtgcattcatcacatagtt

SEQ ID NO: 12223 - DNA, 1933 bp, Homo sapiens
tttcttgttagtcttgctagcagtctatcaattttgttgatcttttcaaaaaaccagctcctggattcattgattttttgaagggctttttgtgtctctgtttccttcagttctgctctgatcttagttatttcttgcttctgctagcttttgaatgtgtttcctcttgcttctgtagttcttttaattgtgatgttagggtgttaattttagatctttcctgctttctcttgtgggcatttagtgctataaatttccctctaacacactgctttaaatgtgtcccagagattctggtatgttgtgtctttgttctcgttggtttcaaagaagatctttatttctgccttcattttgttatgtagccagtagtcattcaggagcaggttgttcagtttccatgtagttgagtggttttgagtgagtttcttaatcctgagttctagtttgattgcactgtggtctaagagacagtttgttataatttctgttcttttacatttgctgaggagtgctttacttccaactatgtggtcaattttggaataagtgtaatgtggtgctgagaagaacgtatattctgttgatttggggtggagagttctgtagatgtctattaggtctgcttggtgcagagctgagttcaattcctggatatccttgttaactttctgtctcgtggatctgtctaatgttgacagtggggtgttacagtctcccattattattgtgtgggagtctaagtctctttgtaggtctctaaggacttgctttatgaatctgggggctcctgtattgggtgcatatatatttaggttagttagctgttcttgttgaattgatccctttaccattatgtaatggccttctttgtctattttgatctttgttggtttaaagtctgttttatcagagactaggattgcaacccctgcctttttttgttttccatttgcttggtagatcttcctccatccctttattctgagcctatgtgtgtctctgcacgtgagatgggtttcctgaatatagcacactgatgggtcttgactctttatccaatttgccagtctgtgtcttttaattggagcatttagcccatttacatttaaggttaatattgttatgtgtgaatttgatcctgtcgttatgatgttagctggttattttgctcgttagttgacgcagtttcttcctagccttgatggtctttacaatttggcatggttttgcagtggctggtaccggttgttcctttccatgtttagtgcttccttcaggagctcttgtagggcaggcctggtggtgacaaaatctctcagcatttgcttgtctgtaaaggattttatttctccttcacttatgaagcttagtttggctggatatgaaattctgggttgaaaattcttttctttaagaatgttgaatattggcccccactctcttctggcttgtagagtttctgccgagagaccagctgttagtctgatgggcttccctttgtgagtaacctgacctttctctctggctgcccttaacattttttccttcatttcagctttggtgaatctgacaattatgtgtcttggagttgctcttctcgaggagtatctttgtggcattctctgtatttcctgaatttgaatgttggcctgccttgctagattggggaagttctcctggataatatcctgcagagtgttttccaacttggttccattctccccgtcactttcaggtacaccaatcacatgtagatttggttttttcacatagtcccatatttcttggaggctttgtttgtttctttttattcttttttctctaaacttctcttctcgcttcatttcattcatttgatcttccatcagtgataccctttcttccagttgatcaaatcggctactgaagcttttgcatatgtcacgtagtt

SEQ ID NO: 12224 - DNA, 1431 bp, Homo sapiens
atatttgctgaggagtgttttacttccaactatgtggtcaattttgaaataagtgtgatgtggtgctgagaagaacgtatattctgttgatttggggtggagagttctgtagatgtctattaggtccacttggtgcagagctgacttcaattcctggatatccttgttaactttctgtctcgttgatctgtctaatgttgatagtggggtgttaacgtctcccattattattgtgtgggagtctaggtctgtttgtaggtctctaaggacttactttatgaatctgggtgctcctgtattgggtgcatatatatttaggatagttagctcttcttgttgaattgatccctttaccattatgtaatggccttctttgtctcttttgatctttgttggtttaaagtctgtattatccgagactaggattgcaacccctgcctttttttgttttccatttgcttggtagatcttcctccatccctttattttgagcctatgtgtgtctctgcaagtgagatgcgtttcctgaatacagcacactgatgggtcttgactctttatccaatttgccagtctgtgtcttttaattggagcatttagcccatttacatttaaggttcatattgttatgtgtgaatttgatcctgtcattatgatgttagctggttattttgctcgttagttgatgcagtttcttcctagccttgatggtctttacaatttggcatgtttttgcagtggctggtactggttgctcctttccatgtttagtgcttccttcaggagctcttgtaaggcaggcctggtggtgacaaaatctctcagcatttgtttgtctgtaaaggattttatttctccttcacttacaaagcttagtttggctgggtatgaaattctgggttgaaaattctttaagaatgttgaatattggcccccactctcttctggcttgtagagtttccagcaagaggttcactgttagtctgattggcttccctttgtggacaacctgacctttctctctagctgcccttaacattttttccttcatttcaattttagtgaatctgacaattatgtgtctttgagttgctcttctcaaggagtatctttgttgtgttctctgtatttcctgaatttgaatattggcctgccttgctagattggggaagttctcctggataatatcctgcagagtgttttccaacttggttccattctccccgtcacttttaggtacaccaatcagatgtagatttggtcctttcacatagtcccatatttcttggaggctttgttcatttctttatattcttttttctctaaacttcccttctcgcttcatttcattcatttgatcttccatcactgataccctttcttccagttgatcaaatcggctgttgaagcttgtgcatgtgtcacgtagtt

SEQ ID NO: 12225 - DNA, 581 bp, Homo sapiens
aagaatgtatattctgttgatttggggtggagagttctgtatatgtctattaggtccgcttggtgcagagctgagttcaattcctggatatccttgttaactttctgtcttgttgatctgtctaatgttgacagtggggtgttaaagtctcccattactatggtgtgggagtctaagtctctttctaggtctctaaggacttgctatatgaatctgggtgctcccatattgggtgcatatatatttaggatagttagctcttcttgttgaattgatccctttaccattatgtaatggccttctttgtctcttttgatctttgttggtttaaagtctgttttatcagagactaggattgcaacccctgccttttttctgttttccatttgcttggtagatcttcctccatccctttattttgagcctatgtgtgtccctgcacgtgagatgggtttcctgaatacagcacactgatgggtcttgactctttatccaatttgccagtctgtgtcttttaattggagcatttagcccatttacatttaaggttaatattgttatgtgtgaatttgatcctggta

SEQ ID NO: 12226 - DNA, 2455 bp, Homo sapiens
ggccattttcacaatattgattcttcctacccatgagcatggaatgttcttccatttgtttgtatcctcttttatttcattgagcagtggtttgtagttctccttgaagaggtccttcacgtcccttgtaggttggattcctaggtatttcattctctttgaagcaattgtgaatgggagttcactcatgatttggctctctgtttgtctgttgttggtatataagaatgcttgtgatttttgcacattgattttgtatcctgagactttgctgaagttgcttattagcttaaggagattttgggctgagatgatggggttttctagatatacaatcatgtcatcggcaaacaggaacaatttgacttcctcttttcctaattgaatgccctttatttatttctcctgcctgattgccctggccagaacttccaacactatgttgaacaggagtggtgagagaggacatccctgtcttgtgccagttttcaaagggaatgcttccagtttttgcccattcagtatgatattggctgtgggtttgtcatagatagctcttattattttgagatacatcccatcaatacctaatttattgagagtttttagcatgaagtgttgttgaattttgtcaaaggccttttctgcatctattgagataatcatatggtttttgttgttggttctgtttatatgctggattatgtttattgatttgcgtatgttgaaccagcctcacatcccagggatgaagcccattcgatcatggtggacaaggtttttgatgtgctgctggatttggtttgccagtattttattgaggatttttgcatcgatgttcatcagggatattgctctaaaattctctttttttgtgtgtctctgccaggctttggtatcaggatgatgctgggctcataaaatgagttagggaggattccctctttttctgttgattggaatagtttcagaaggaatggtaccagttcctccttgtacctctggtagaatttggctgtgaatccatctggtcctggacttcttttgtttggtaagctattaattattgcctctatttcagagcctgttattggtctattcagagattcaacttcttcctggtttagtcttgggaggctgtatgtctccaggaatttatctatttcttttagattttccagtttatttgcatagaggtgtttatagtattctctgatggtagtttgtatttctgtgtgattggtggacatgtcccctttatcattttttattgcatgtatttgattcttctctcttttcttctttattagtcttgctagcagtctatcaattttgttgatcttttcaaaaaaccagcctctggattcattgattttttgaagggttttttgtgtctctatttccttcagttctcctctgatcttagatatttcttgccttctgctagcttttgaatgtgtttgctcttgcttctctagttcttttaattgtgatgttagagtgtcaattttagatctttcctgctttctcttgtgggcatttagtgctataaatttccctctacacactgctttcaatgtgtcccagagattctggtatgttgtgtctttgttctcattggtttcaaagaacatctttatttctgccttcatttcgttatgtacccagtagtcattcaggagcaggttgttcagtttccatgtagttgagcggttttgagtgagtttcttaatcctgagttctagtttgattgcactgtggtctgagagacagtttattttaatttctgatcttctatatttgctgaggggtgctttacttccaagtatgtggtcaattttggaataggtgtggtgtggtgctgaaaagaatgtatattctgttgattcggggtggagatttctgtagatgtctattaggtctgcttggtgcagagctgagttcaattcctggatatccttgttaactttctgtctcattgatctgtctaatgttgacagcggggtgttaaagtctcccattattaatgtgtgggagtctaagtctctttgtaggtcactcaggacttgctttatgaatctgggtgctactgtattgggtgcatatatatttaggatagttagctcttcttgttgaattgatccctttaccattatgtaatggccttctttgtctcttttgatctttgttggttaaaagtctgttttatcagagactaggattgcaacccctgcctttttttgttttccatttgcttggtagatcttcctccatctctttattttgagcctatgtgtgtctctgcacgtgagatggatttcctgaatatagcacactgatgggtcttgactctatccaatttgccagtctgtgtcttttaattggagcatttagctcatttacatttaaggttaatattgttatgtgtgaatttggtcctgtcattatgatgtta

SEQ ID NO: 12227 - DNA, 299 bp, Homo sapiens
caacccctgcctttttttgttttccatttccttggtagatattcctccatccctttattttgagcctatgtgtgtctctgcacgtgagatgggtttcctgaatacagcacactgatgggtcttgactctttatccaatttgccagtctgtgtcttttaattggagcatttagcccatttacatttaaagttaatattgttatgtgtgaatttgatcctgtcattatgatgttagctggttgttttgctcgttagttgatgtagtttcttcctagccttgatggtctttacaatttggca

SEQ ID NO: 12228 - DNA, 2521 bp, Homo sapiens
gaaagtcattggtagcttgatggggatggcattgaatctataaattaccttgggcagtatggccattttcatgatattgattcttcctacccatgagcatggaatgttcttccatttgtttgtatcctcttttatttcattgagcagtggtttgtagttctccttgaagaggtccttcacttcccttgtaagttggattcctaggtatttcattctctttgaagcaattgtgaatgggagttcactcatgatttggctctctgtctgttattggtgtataagaatgcttgtgatttttgcacattgattttgtatcctgagactttgctgaagttgcctatcagcttaaggagattttgggctgaaacaatggggttttctagatatacaatcgtgtcatctgcaaacagggacaatttgacttcctctttcctaattgaatgccctttatttccttctcctgcctgattgccctggccagaacttccaacactatgttgaataggagtggtgagagagggcatccctgtcttatgccagttttcaaagggaatgcttccagtttttgtccatttagtatgatattggctgtgggtttgtcatagatacctcttattattttgagatatgtcccatcaatacataatttattgagagtttttagcatgaaacgttgttgaattttgtcaaaggcgttctctgcatctgttgagataatcatatggtttttgtcattggttctgtttatatgctggattacgtttattgattttcgtatgttgaaccagccttgcatcccagggatgaagcccacttgatcacagtggataagctttttgatgcgctgctggattcggtttgccagtattttattgaggatttttgcattgatgttcatcaaggatattggtctaaaattctctttttttgttgtgtctctgccaggttttggtatcaggatgatgctggcctcgtaaaattagttagggaggattccctctttttctattgattggaatagtttcagaaggaatggtaccatctcctccttgtacctctggtagaattcggctgtgaatccatctggtcctggactttttttggttggtaagctattaattatttcctcaatttcagatcctgttattggtctattcagagattcaacttcttcctggtttagtcttgggagggtgtatgtgtccaggaatttatccatttcttctagattttatagtttatttgcgaagaagtgtttatagtattctctgatggtagtttgtatttctgtgggatcggaggtgagatcccctttatcattttttattgcatctatttgattattctctcttttcttctttattagtcttgctagcggtctatcaattttgttgatcttttcaaaaaaccagctcctagattcactgattttttgaaggttttttttgtgtctttatttccttcagttctgctctgatcttagttatttcttgccttctgctagcttttgaatgtgtttgctcttgcttctctagttcttttaattgtgatgttggggtatcaattttggatctttcctgctttctcttgtgggcatttagtgctataaatttccctctacacacttctttgaatgtgtcccagagattctgttatgttgtgtctttgttctcgttggtttcaaagaacatctttatttctgccttcatttcgttatgtacccagtagtcattcaggagcaggttgttcagtttccatgtagttgagcagttttgagtgagtttcttaatcctgagttctagtttgattgcactgtggtctgagagacagtttgttataatttctgttcttttacatttgctgaggagtgctttacttccaactgtgtggtcaattttggaataagtgcggtgtggtgctgagaagaatgtatcttctgttaatttggggtggagagttctgtagatgtctattaggtcctctttgtgcagagctgagttcaattcctatatatccttgttaactttctgtctcgtttatctgtctaatgttgacagtggggtgttaaagtctcccattattattgtgtgggagtctaagtctctttgtaggtctctaaggacttgctttatgaatttgggtgctgctgtattggtgcatatatatttaggaaagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatcattttattttgagcctatgtgtgtctctgcatgtgagatgggtttcctgaatacagcacactgatgggtcttgactctttatccagtttgccagtctgtgtcttttaattggagcatttagcccatttacatttatggttaatattgttatttgtgaatttgatcctttcattatgatgttagctggtta

SEQ ID NO: 12229 - DNA, 4113 bp, Homo sapiens
gtctaacatttaagtcttcaatccatcttgaattaatttttgtataaggtgtaaggaagggatccagtttcagctctctacatatggctagccagttttcccagcatcatttattaaatagggaatcctttccccattgcttgtttttctcaggtttgtcaaagatcagatagttgtagatatgcggtgttatttctgagggctctgttctgttccattgatctatatctctgttttggtaccaatagcatgctgtttaggttactgtagccttgcagcatagtttgaagtcaggtagcgtgatgcctccagctttgttcttttggcttaagattgacttggcgatgcaggctcttttttggttccatatgaactttaaaatagttgtttccaattctgtgaagaaagtcattggtagcttgatggggatggcattgaatctataaattacctcgggcagtatggccattttcacgatattgatgcttcctacccatgagcatggaatgtccttccatttgtttgtatcctcttctatttcattgagcagtggtttgtagttctccttgaagacgtccttcacatcccttctaagttggatttctaggtattttattctctttgaagcaattgtgaatgggagttcactcatgatttggctctctgtttgttattggtgcataagaatgcttgtgatttttgtacattgattttgtatcctgagactttgctgaagtagcttatcagcttaaggagattttgggctgagacaatggggttttctaaatatacaatcatgtcatctgcaaacagggacaatttgactttctcttttcctaattgaataccctttacttccatctcctgcctaaatgccctggccagaacttccaacactatgttgaataggagtggtgagagagggcatccctgtcttctgccagttttcaaagggaaagcttccagtttttgcccattcagtatgatattggctgtgggtttgtcatagatagctcttattattttgagatatgtcccatcaatacctaatttattgaagagtttttagcatgaagcgttgttgaattttgtcaaaggccttttctgcatctattgagataatcatgtggtttttgtctttggttctgtttatatgctggattacatttattgatttgtgtatattgaaccagccttgcatcccagggatgaagcccacttgatcatggtggataagctttttgatgtgctgctggattcagtttgccagtattttattgaggatttttgcatcaatgttcatcaagaatattggtctgaaattctcttttttggttgtgtctctgcccggctttggtatcaggatgatgctggcctcataaaatgagttagggaggattccctatttttctattgattggaatagtttcagaaggaatggtaccagttcctccttgtacctctggtagaattcggctgaaaatccatctggtcctggactctttttggttggtaagctattgattattgcctcaatttcagagcctgttattggtctattcagagattcagcttcttcctggtttagtcttgggagagtgtatgtgtcgaggaatttatccatttcttctagattttctagttgatttgtgtagaggtgtttgtagtattctctgatggtagtttgtacttctgtgggatcggtggtgatatcccctttatcattttttttcgtgtctatttgattgttctctcttttgttctttattagtcttgctagctgtctatcaattttgttgatcctttcaaaaaactggctcctggattcattaattttttgaagggttttttgtgtctctatttccttcagttctgctctgattttggttatttcttgccttctgctagcttttgaatgtgtttgctcttgcttttctagtttttttaattgtgatgttagggtgtcaatttggatcttttctgctttctcttgtgggcatttagtgctataaatttccctctacacactgctttgaatgtatcccagagattccggtatgttgtgtctttgttcttgttggtttcaaagaacatctttatttctgccttcatttcgttatgtacccaatagtcattcaggagcaggttgttcagtttccacgtagttgagcagtttgagtgagtttcttaatcccgagttctagtttgattgcagtgtggtctgagagacagttttttgtaatttctgttcttttacatttgctgaggagagctttacttccaagtatgtggtcaattttggaataggtgtggtgtggtgctgaaaaaaatgtatattctgttcatttggggtgcagagttctgtagatgtctattaggtctgcttggtgcagagctgagttcaattcctgggtatccttgttaactttctgtctcattgatctgtctaatgttgacagtggggtgttaaaggctcccattattattgtgtgggagtgtaagtctctttgtagatcactcaggacttgctttatgaatctgggtgctcctgtatcgggtgcatatatatttaggatagttagctcttcttgttgaattgatccctttaccattatgtaatggccttctttgtctcttttgatctttgttggtttaaagtctgtgttatcagagactaggattgcaacccctgcctttttttgttttccatttgcttggtagatcttcctctatcctttgattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttgctcgttagttgatgcagtttcttcctagtctcgatggtctttacaatttggcatgattttgcagcagctggtaccagttgttcctttccatgtttagtgcttccttcaggagctcttttagggcaggcctggtggtgacaaaatctctcagcatttgcttgtctgtaaagtattttatttctccttcacttatgaggcttagtttggctggatatgaaattctgagttgaaaattcttttctttaagaatgttgaatattggcccccactctcttctggcttgtagagtttctgccgagagatccgctgttagtctgatgggcttccctttgtgggtaacctgacctttctctctggctgcccttaacattttttccttcatttcaactttggtgaatctgacaattatgtgtcttggagttgctcttctcgaggagtatctttgtggcgttctctgtatttcctgaatctgaatgttggcctgccttgctagattggggaagttctcctggataatatcctgcagggtgttttccaacttggttccattctctccgtgactttcaggtacaccaatcagacgtagatttggtcttttcacatagtcccatatttcttggaggctttgtttctttttattcttttttctctaaacttccattctcacttcatttcattcatttcatcttccatcactgataccctttcttccagttgatcgcatcggctcctgaggcttctgcattcttcacgtagttctcgagccttggctttcagctccatcagctcctttaagcacttctctatattggttattctagttatacattcgtctaaatttttttcaaagtttttaacttctttgcctttggtttgaatttcctcctgtagctcagaatagtttgatcgtctgaagccttcttctctcaattcgtcaaagtcattctccatccagctttgttccgttgctggtgaggaactgcgttcctttggaggaggagaggcgctctgctttttagagtttccagtttttctgctctgttttttccccatctttgtggttttatctacttttggtctttgatgatggtgatgtacagatgggtttttggtgtggatgtcctttctgtttcttagttttccttctaacagacataaccctcagctgcaggtctgttggagtt

SEQ ID NO: 12230 - DNA, 4894 bp, Homo sapiens; identical to SEQ ID NO: 12080

SEQ ID NO: 12231 - DNA, 3689 bp, Homo sapiens; identical to SEQ ID NO: 12009

SEQ ID NO: 12232 - DNA, 3692 bp, Homo sapiens
gtctaacgtttaagtctttaatccatcttgaattgatttttgtataaggtgtaaggaagggatccagttacagctttttacatatggctagccagttttcccagcaccatttattaaatagggaatcctttaccctttgcttttttttctcaggtttgtcaaagatcaggtagttgtagatatgcggcgttatttctgagggctctgttctgttccattgatctatatctctgttttggtaccagtaccatgctgttttggttactgtagccttgtagtatagtttgaagtcaggtagtgtgatgcctctagctttgttcttttggctcaggattgacttgccggctcttttgtggttccatatgaactttaaagtagttttttccaattctgtgaagaaaggcattggtagcttgatggggatggcattgaatctctaaattaccttgggcagtatggccattttcacaatatttattcttcctacccatgagcatggaatgttcttccatttgtttgtatcctcttttatttccttgagcagtgctttgtagttcttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaagggggttgtctagatatacaatcatgtcatctgcaaacagggacaatttgacttcctcttttcctaattgaataccctttatttccttctcctgcctaattgccctggccagaacttccaacactatgttgaataggagtggtgagagagggaatccctgtcttgtgcctgttttcaaagggaatgcttccagtttttgcccattcagtatgatattggctgtgggtttgtcatagatagctctttttattttgaaatacatcccatcaatatctaatttgttgagagtttttagcatgaagggttgttgaattttgtcacaggccttttctgcatctattgagataatcatgtggtttttgtctttggttctgtttatatgctggattatatttattgatttgcatatattgaaccagccttgcatcccagggatgaagcccacctgatcatggtggataagctttttgatgtgctgttggattcggtttgccagtattttattgaggatttttgcatcaatgttcatcaaagatattggtctaaaattctcttttttggttgtgtctctgccaggctttggtatcaggatgatgctggcctcataaaatgagttagggaggattccctctttttctattgattggaatagtttcagaaggaatggtacaagttcctccttatacctctggtagaattcggctgtgaatccgtctggtcctggactctttttcgttggtaagctattgattattgccacaatatcagctcctgttattggtctattcagagattcaacttcttcctggtttagtcttgggagagtgtatgtgtcgaggaatttatccatttcttctagattttctagtatatttgcgtagaggtgtttgtagtattctctgatagtagtttgtatttctgtgggatcggtggtgatatcccctttatcattttttattgcgtctacttgattcttctctctttttttctttattagtcttgctagtggtctatcaattttgttgatcctttaaaaaaaccagctcctggattcgttaattttttgaacggttttttgtgtccctatttccttcagttctgctctgatcttagttacttcttgccttcagctagcttttgaatgtgtttgctcttgcttttctagttcttttaattgtgatgttagggtgtcaattttggatctttcctgctttctcttgtgggcatttagtgctataaatttccctctacatactgctttgaatgtgtcccagagattctggtatgttgtgtctttgttctcattggtttcaaagaacatctttatttctgccttcatttcgttatgtacccagtagtcattcaggagcaggttgttcagtttccttgtaggtgagcggttttgagtgagattcttaatcctgagttctagtttgattgcactacggtctgagatatagtttgttataatttctgttcttttacatttgctgaggagagctttacttccaagtatgtggtaaattttggaataggtgtggtgtggtgctgaaaaaaatgtatattctgttgatttggggtggagagttccgtagatgtctattaggtccgcttggtgcagagctgtgttcaattcctgggtatccttgttgactttctgtctcgttgatctgtctaatgttgacagtggggtgttaaaatctcccattattaatgtgtgggagtctaagtctctttgtaggtcactcaggacttgctttatgaatctgggtgctcctgtattgggtgcacatatatttaggatagttagcttttcttggtgaattgatccctttaccattgagtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcctgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggtgattttgctcgttagttgatgcagtttcttcccagtctcgatggtctttacattttggcatgattttgcagcggctggtaccggttgttcctttccatgtttagtgcttccttcaggagctcttttagggaaggcctggtggtgacaaaatctctcagcatttgcttgtctgtaaagtattttatttctccatcacttatgaagcttagtttggctggatatgaaattctgggttgaaaattcttttctttaagaatgttgaatattggcctgaactctcttctggcttgtagagtttctgccgagagatctgctgttagtcttatgggcttccctttgagggtagcctgacctttctctcttgctgcccttaacattttttccttcatttcaactttgatgaatctgacaattatgtgtcttggagttgctcttctcgaggagtatctttgtggcgttctctgtatttcctgaatctgaatgttggcctgccttgctagattggggaagttctcctggataatatcctttagagtgtttcctgcagagggggggttccattctccccatcactttcaggtacaccagtcagacgtagatttggtcttttcacatagtcccatatttcttggaggctttgctcgtttctttttattcttttttctctaaacttcccttctcgcttcatttcattcatttcatcttccatcgctgataccctttcttccagttgatcgcattggctcctgaggcttctgcattcttcaggtagtt

SEQ ID NO: 12233 - DNA, 3692 bp, Homo sapiens
gtctaatatgtaagtctttaatccatcttgaattgatttttgtataacgtgtaaggaagggatccagtttctgctttctacatacggctagccagttttcccagcactatttattaaatagggaatcctttccccattgcttgtttttgtcaggtttgtcaaagatcagatagttgtagataagtggcattatttctgagggctctgttctgtttcattggtctacatctctgttttggtaccagtaccatgctgttttggttactgcagccttgtagtatagtttgaagtcaggtagcgtgatgcctccagctttgttcttttggcttaggattgacatggcaatgcgggctcttttttggttccatatgaactttaaagtagttttttccaattctgtgaagaaagtcattggtagcttgatggggatggcattgaatctataaattaccttgggcagtatggccattttcatgatattgattcttcctacccatgtgcatggaatgttcttccatttgtttgtatcctcttttatttcattgagcagtggtttgtagttctccttgaagaggtccttcacatcccttgtaagttggattcctaggtattttattctctttgaagcaattgtgaatgggagttcactcatgatttggctctctgtttgtctgttattggtgtttaagaatgcttgtgatttttgcacattgattttgtatcctgagactttgctgaatttgcttatcagcttaaggagattttgggctgagacaatggggttttctagatatacaatcatgtcatctgcaaacagggacaatttgacttcctgtttccctaattgaatcccctttatttccttctcctgcctgattgccctggccagaacttccaacactatgttgaataggagtggtgagagagggcatccctgtcttgtgccagttttcaaagggaatgcttccagtttctgtccattcagtatgatattggctgtgggtttgtcatagatagctcttattattttgagatacgtcccatcaatacctaatttgttgagagtttttagcatgaagggttgctgaattttgtcaaagacctttttctgcatctattgagataatcatgtggtttttgtctttggctctgtttatatgctggattacatttattgatttgcgtatattgaaccagccttgcatcccagggatgaagcccacttgatcatggtggataagctttttgatgtgttgctggattcggtttgccagtattttattgaggatttttgcatcaatgttcatcaaggatattggtctaaaattctctttttttgttttgtctctgccaggctttggtatcaggatgatgctggcctcataaaatgagttagggagggttccctctttttctgttgattggaatagtttcagaaggaatggtaccagctcctccttgtatctctggtagaattcggctgtgaatccatctagtcctggactttttttagttggtaagctattaattattgcctcaatttcagatcctgttattggagtattcagagattcagcttcttccttgtttagtcttgggagagtgtatgtgttgaggaatttatccatttcttctagattttctagtttatttgcatagaggtgtttgtagtattctctgatggtagtttgtatttctgtgggattggtggtgatatccccttggtcattttttatttgcgtctatttgatccttctctcttttcttctttattagtcttgctaatggtctatcaattttgttgatcttttcaaaaaatcagctcctggattcattgatttttgaagggttttttgtgtctttatttccttcagttctgctctgatcttagttatttcttgtcttctgctagcttttgaatgtgtttgctcttgcttctctagttcttttaattgtgacgttagggtgtcaattttagatctttcctgctttctcttgtgggtatttagtgctataaacttccccctacacactgctttgaatttgtcccagagattctgtatgttgtgtctttgttcttgctggtttcgaagaacatctttatttctgctttcattttgttatgtacccagtagtcattcaggagcaggctgttcagtttccatgtaattgagtggttttgagtgagtttcttaatcctgagttctagtttgattgcactgtggtctcagagtttgttataatttctgttcttttacatttgctgaggagtgctttacttccaactatgtggtcaattttagaatagttgtggtgtggtgctgaaaagaatgtatattctgttgatttggggtggagagttctgtagatgtctattaggtcctcttggtacagagttgagttcaatttctggatatccttgttaactttcggtctcattgatctatctaatgttgacactggggtatcaaagtctcccattattattgtgtgggagtctaagtctctttgtaggtcactaaggacttgctttatgaatctgggtgctcctgtattgggtgcatatatatttaggatagttagttcttcttgttgaattgatccctttaccattatgtagtggccttctttgtctcttttgatctttgttggtttaaagtctgttttatcagagactaggattgcaacccctgcctttttttgttttccatttgcttggtagatcttcctccatccctttattttgagcctatgtgtgtctctgcatgtgagatgggtttcctgaatacagcacactgatgggtcttgactctttatccaatttgccagtctgtgccttttaattggagcatttagcccatttacatttaaggttaatattgttatgtgtgaatttgatcctgtcattatgatgttagctggttattttgctcgttagttgatgcagtttcttcctagccttgatggtctttacaatttgttatgtttttgcagtggctggtacaggttgttcctttccatgtttagtgcttccttcaagagctcttgtagggcaggcctggtggtgacaaaatctctcagcatttgcttgtctgtaaagtattttatttctccttcacttatgaagcttagtttggctggatatgaaattctgggttgaaaattctttgctttaagaatgttgaatattggcccccactcttttctggcttgtagagtttctgccgagagatcagctgttagtctgatgggcttccctttgtgggtaacccgacctttctctctggctgcccttaacattttttccttcatttcaactttggtgaatctgacaattatgtgtcttggagttgctcttctcaaggagtatctttgtggcgttttctgtatttcctgaatttgaatgttggcctgccttgctagactggggaagttctcctggataatatcctgcagagtgttttccaacttggttcctttctccccgtcactttcaggtacaccaatcagacgtagatttggtcttttcacatagtcccttatattttggaggctttgttcgtttctttttattcttttttctctaaacttcccttctcacttcattccattcatttcatcttccatcgctgataccctttcttccagttgatcgcatcggttactgaggcttatgcatttgtcacgtagtt

SEQ ID NO: 12234 - DNA, 2400 bp, Homo sapiens
gaaccagccttgcatcccaggatgaagcccacttgatcatggggggtaagctttttaatagtgttgctggattcggtttgctagtattttattgacgatttttgcatcgatcttcatcaaggatattggtctaagattctatttttttgttgtatctctgccaggctttggtatcaggatgatgctggcctcataaaatgagttagggaggattccctctttttctattgattggaatagtttcagaaggaatggtaccagctcctgcttgtacctctggtagaattcggttgtgaatctgtctggtcctggactttttttagttggtaagctattaattattgcctcaatttcagagcccgttattggtctattcagagattgaacttcttcctggtttagtcttgggagagtgtatgtgtcgaggaatttatccatttcttctagattttctagtttatttgcatagaggtgtttgtactattctctgatggtagtttgtatttctgtgggatcagcggtgatatcccctttgtcattttttattgcatctatttgattcttctctcttttcttctttattagtctcgctagcggtctatcaattttgttgatcttttcaaaaaaccagctcctggattcattgattttttgaagggttttttgtgtctctatttccttcagttctgctctgatcttagttattgtttgtcttctgctagcttttgaatgtgtttgctcttgcttctctagttcttttaattgtgatgttagggtgtcaattttaggtctttcctgctttctcttgtgggcatttagtgctataaacttccctctacacactgctttgaatgtgtcccagagattctggtatgttgtatctttgttcttgctggtttcaaagaacatctttatttctgccttcgttttgttaggtacccaatagtcattcaggagcagattgttcagtttccatgtagttgagcagttttgagtgagtttcttaatcctgagttctagtttgattgccctgtggtctgagagatagtttgttataatttctgttcttttacatttgctgaggagtgctttacttccaactatgtggtcaattttggaataggtgtggtgtggtgctgaaaagaatgtatattctgttgatttggggtggagagttctgtagatgtctattaggtccacttggtacagagctgagttcaattcctggatatccttgttaactttctgtctcgttgatctgcctaatgttgacagtggggtgttaaagtctcccattattattgtgtgggagtctaagtctctttgtaggacactaagaacttgctttatgaatctgggtgctcctgtattgggtgcatatatatttaggatagttagttcttcttgttgaattgatccctttaccattatgtaatggccttctttgtctcttttgatctttgttggttgaaagtctgttttatccgagactacgattgcaacccctgcctttttttgttttccatttgcttggtagatcttcctccatccctttattttgagcctatgtgtgtctctgcacgtgagatgggtttcctgaatacagcacactgatgggtcttgactctttatccaatttgccagtctgtgccttttaattggagcatttagcccatttacatttaaggttagtattgttatgtgtgaatttgatcctgtcattatgatgttagctggttattttgctcattagttgatgcagtttcttcctagccttgatggtctttacaatttggcatgtttttgcagtggctggtactggttgttcctttccatgtttagtgcttccttcaggagctcttttagggcaggcctggtggtgataaaatctctcagcatttgcttgtctgtaaagtattttatttctccttcacttatgaagcttagtttggctggatatgaaattctgggttgaaaattcttttctttaagaatgttgaatattggccccccactctcttctgtcttgtagagtttctgccaggagatccgctgttagtctgatgggattccctttgtgggtaacccgacctttctctctggctgctcttaacatttttcccttcatttcaactttggtgaatctgacaattatgtgtcttggagttgctcttctcgagaagtatctttgtggtgttctctgtatttcctgaatttgaatgttggcctgccttgctagattgaggaatttctcctggataatatcctgcagagtgttttccaacttggttccactctctccgtcattttcaggtacaccaattatacttagatttggtcttctcacatagacccatatttcttggaggctttttcatttctttttattcttttttctct

SEQ ID NO: 12235 - DNA, 2574 bp, Homo sapiens
gattgacttggcgatgcgggctcttttttggttccatatgaactttaaagtagttttttccaattctgtgaaggaagtcattggtagcttgatggggatggcattgaatctgtaaattaccttgggcagtatggccattttcaagatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtctgttgttggtgtataagaatgcttgtgatttttgtacattgattttgtatcctgagactttgctgaagttgcttatcagcttaaggagattttgggctgagacgatggggttttctagatatacaatcttgtcgtctgcaaacagggacaatttgacttcctcttttcctaattgaatgccctttatttccttctcctgcctgattgccctggccagaacttccaacactatgttgaataggagtggtgagagagggcatccctgtcttatgccagttttcaaagggaatgcttccagtttttgcccattcagtatgatattggctgtgggtttgtcatagatagctcttattatattgagatacatccatcaatacctaatttattgcgagtttttagcatgaagatttgttgaattttgtcaaaggccttttctgtatctactgagataataatgtggtttttgtctttcgttctgtttatatgctggattacatttattgatttgcatatgttgaaccagccttgcatcccagggatgaagcccacttgatcatggtggataagctttttgatgtgctgctggattcagtttgccagcattttattgaggatttttgcatcaatgttcatcaaggatattggtctaaaattctcttttttggttgtgtatctgcctgactttggtatcaggatgatgctggcctcataaaatgagttagggaggattccctctttttctatagattggaatagtttcagaaggaatggtaccagttcctccttgtacctctggtagaattcagctgtgaatccatctggtcctggactctttttggttggtaagctattgattattgccacaatttcagctcctgttattggtctattcagagattcaacttcttcctggtttagtcttgggagggtgtatgtgtgcagaaatttatccatttcttctagattttctagtttatttgcgtagaggtgtttatagtattctctgatggtagtttgtatttctgtgggatcggtggtgatatcccctttatcattttttattgcgtctatttgattcttctctcttttcttctttattagtcttgctagtggtctatcaattttgttgatcctttcaaaaaaccagctcctggattcatggattttttgaagggttttttgtgtctctatttccttctgttctgctctgatcttagttatttcttgccttctgctagcttttgaatgtgtttgctcttgcttttctagttcttttaattgtgatgttagggtgtcaatttttgatctttcctgctttctcttgtgggcatttagtgctataaatttccctctacacactgctttgaatgtgtcccagagattctggtatgttgtgatgttgtgtctttgttcttgttgatttcaaagaacatctttatttctgccttcatttcattatgtacccagtagtcactcgggagcaggttgttcagtttccatgtagttgagaagttttgagtgagattcttaatcctgagttctagtttgattgcacagtggtctgagagacagtttgttactatttctgttcttttacatttgctgaggagagctttacttccaagtatgtggtcagttttggaataggtgtggtgtagtgctgaaaaaaatgtataatctgttgacttggggtggagagttctgtagatgtctattagatccgcttatgcagagctgagttcaattcctgggtatccttgttgactttctgtctcgttgacctgtctaatgttgacagtggggtgttaaggtctcccattattaatgtgtgggagtctaagtctctttgtaggtcactcagaacttgctttatgaatctgggtgctcctgtattgggtgcatatatatttaggatagttagctcttcttgttgaattgatccctttaccattatgtaatggccttctttgtctcttttgatctttgttggtttaaagtgtgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagtcaatattgttatgtgtgaatttgat

SEQ ID NO: 12236 - DNA, 4131 bp, Homo sapiens
tttttacttatttatttttaaattatactttaagttctagggtacatgtgtacaacatgcaggtttgttacatgtatacatgtgccatgttggtgtgctgcacctattaactcgtcatttacattaggtatatctcctaatgctatccctcccccttctccccacccctcgacaggccccggtgtgtgatgttcccttccctgtgtccaagtgttctcattgttcaattcccatttatgagtgagaacatgcagtgtctggttttctgttcctgtgttagtttgctgagaatgatggtttccagcttcatccatgtccctataaaggacatgaactcatccttttttatggctgcatagtattccatggtgtatatgtgccacattttcttaatccagtctatcattgatggacatttgggttggttccaagtctttgctattgtgaatagtgccacaataaacatacgtgtgcatgtgtctttatagcagcatgatttataatcctttgggtatatacccagtaatgggatggctgggtcaaatggtatttctagctctagatccctgaggaatcgccacactgtcttccacaatggttgaactagtttacagtcccaccaccagtgtaaaagtgttcctatttctccacatcctctccagcacctgttgtttcctgactttttaatgattgacattctaactggtgtgagatggtatctcattgtggttttgatttgcatttctctgatggccaatgatgatgagcatttttttctcatatgtttgtttgctgcataaatgtcttcttttgagaagtgtctgttcatatctttccccctatttttggaggggttttttttttttttgtaaatttgtttgagttctttgtagattctggatattagccctttgtcagatgagtagattgcaaaaattttctcccattttgtaggttgcctgttcactctgatggtagtttcttttgctgtgcagaagctctttagtttaattagatcccatttgtcaattttggcttttgttgccattgcttttggtgttttagtcatgaagtccttgcccatgcctatgtcctgaatggtattgcttaggttttcttctagggtttttatggttttgggtctaacatttaagtctttaatccatcttgaattaatttttgtataaggtgtaaggaagggttccagtttcagctttctacatatggctagccagttttcccagcaccatttattaaatagggaatcctttccccatttcttgtttttgtcaggtttctcaaagatcagatagttgtagatgtgtggtattatttctgagggctctgttctgttccattggtctatatctctgttttggtaccagtaccatgctgttttggttactgtagccttgtagtatagtttgaagtcaggtagcgtgatgcctccagctttgttcttttggcttaggattgttttggcagtatgggctcttttttggttccatatgaactttaaagtagttttttccaattctatgaagaaagtcatgggtagcttgatggggatggcattgaatctataaattaccttgggcagtatagccattttcacgatattgattcttcctatccatgaccatggaatgttcttccatttgtttgtgtcctcttttatttcgttgagcagtggtttgtagttctccttgaagaggtccttcacataccttgtaagttggattcctaggtattttattctctttgaagcaattgtgaatgggagttcactcatgattttgttctccgtttgtctgttattgatgtataagaatgctagtgatttttgcatattgattttgtatcctgagactttgccgaagttgcttatcagcttaaggagattttgggctgagatgatggggttttctagatacacaatcgtgtcatctgcaaacagggacaatttgacttcctcttttcctaattgaataccctttatttctttctcctgcctgatggccctggccagaacttccaacactatgttgaataggagtggtgagagagggcatccctgtcttgtgccagttttcaaagggaatgcttccaatttttgcccattcagtctgatattgggtgtgggtttgtcataaatagctcttattattttgagatatgtcccatcaatacctaattcattgagagtttttagcatgaagggctgttgaattttgtccaaggccttttctgcatctgttgagataatcatgtggtttttgtctttggttctgtttatatgctggattacttttattgatttgtgtatgttgaaccagccttgcatcccagggatgaagcccacttgatcatggtggataagctttttgatatgctgctggattcagtttgccagtattttattgaggatttttgcattgattttcatcagggatattggtctaaagttctctttttttgttatgtctctgccaggctttggtatcaggatgatgctggcttcataaaatgagttagggaggattccctctttttctattgattggaatagtttcagaaggaatggtaccagctcttccttgtacctctggtagaattcggctgtgaatccatcttgtcctggactttttttggttggtaggctattaattattgcctcaatttcagagcctgttattggtctattcagggattaaacttcttcctggtttagttttgagagggtgtatgtgtccaggaatttatctatttcttctagattttctagtttatttgcatagaggtgtttatagtattctctgtgtactctgtatttctgtgggattggtggtgatatccactttatcattttttattgcatttatttgattcttctctctttttttgtttattagtcttgctagcggtctatcaattgtgtgttaatttttaaaaaaccagctcctggattcattcattttttgaaggtttttttgtgtctctgtctccttcagttctgctctgatcttagttatttcttgtcttctgctagctgttgaatgtgtttgctcttgcttctctaatatttttaattgtgatgttagggtgttgattttagatctttcctgctttctcctgtgagcatttagtgctataaatttccctctaaacactgctttagctgtgtcccagagattctggtacattgtgtctttgttctcactggtttcaaataacttatttatttctaccttaattttgttatttatccagtggttattcaggtgcaaattgttccgtttccatgtagttgtgtggttttgagtgagtttcttaatcttgagttctaatttgattgcactgtggtctgagacagtatgttataatttctgttcttttacatttgctgaggagtgctttacttccaactatgtggtcaattttggaataggtgcgatgtggtgctgagaagaatgtatattctgttgatttggggtggagagttctgtagatgtctattaggtctgcttggtgcagagctgaattcaattcctggatatccttgttaactttctgtcttgttgatctgtctaatgttgacagtggggtgttaaagtctcccattattattgtgtgggagtctaagtctctttgtatgtcactaaggacttgctttatgaatctgggtgctcctgtattgggtgcatatatatttaggatagttagctcttcttgttgaattgatccctttaccattatgtaacggccttctttgtctcttttgatctttgttggtttaaagtctgttttatcagagactaggattgcaacccctgcttttttttgttttccatttgcttggtagatcttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaggttaatattgttatgtgtgaatttgatcctgtcattatgatgttcactggtgattttgctcattagttgatgcaggttcttcctagcctcaatggtctttacaatttggcatgtttttg

SEQ ID NO: 12237 - DNA, 4137 bp, Homo sapiens
tttttgttggttttttttttttcactttcttttttttttttaatttatttttttattattatactttaagttttagcgtacatgtgcacattgtgcaggttagttacatacgtatacatgtgccatgctggtgtgctgcacccactaactcgtcatctagcattaggtatatatcccaatgctatccctcccccctccccccaccccacaacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgctgcaataaacatacgtgtgcatgtgtctttataccagcatgatttataatcctttgggtatatacccagtaatgggatggctgggtcaaatggtatttctagttctagatccctgaggaatcgccacgctgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatatcttctgttgagaagtgtctgttcatgtccttcacccactctttgatggggttgtttgtttttttcttgtaaatttgtttgagttcattgtagattctggatattagccctttgtcagatgagtaggttgcaaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctagattttcttctagggtttttatggttttaggtctaacgtttgagtctttaatccatcttgaattgatttttgtataagttgtaaggtagggatccagtttcagctttctacatatggctagccagttttcccagcaccatttatgaaatagggaatcctttccccatttcttgtttttgtcaggtttctcaaagatcagatagttgtagatatgtggcgttatttctgagggctctgttctgttccattgatctatatctctgttttggtaccagtaccatgctgttttggttactgtagccttgtagtatagtttgaagtcaggtagtgtgatgcctccagctttgttcttttggtttaggattgacttggcgatgcgggctcttttttggttccatatgaactttaaagtagttttttccaattctgtgaagaaaggcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttctctgttgttggtgtataggaatgcttgtgatttttgcacattgattttgtatcctgagactttgctgaagttgcttatcagcttaaggagattttgggctgagaaaatggggttttctagatatacaatcatgtcatctgcaaacagggacaatttgacttcctcttttcctaattgaataccctttatttccttctcctgcctaattgccctggccagaacttccaacactatgttgaatagaagtggtgagagagggcatccctgtcttgtgccagttttcaaagggaatgcttccagtttttgcccattcagtatgatattggctgtgggtttgtcatagatagctcttattattttgaaatatgtcccatcaatacctaatttattgagagtttttagcatgaacggttgttgaattttgtcaaaggcctttcctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttctttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggttctggactctttttggttggtaagctattgattattgccacaatttcagatcctgttattggtctattcagagattcaacttcttcctggtttagtcttaggagagtgtatgtgtcaaggaatttatccatttcttctagattttctagtttatttgcgtagaggtgtttgtagtattctctgatggtagtttgtatttctgtgggatcggtggtgatatcccctttatcattttttattgcgtctgtttgattcttctctctttttttctttattagtcttgctagcggtctatcaattttgttgatcctttcagaaaaccagctcctggattcattaattttttgaagtgttttttgtgtctctatttccttcagttctgctctgattttagttatttcttgccttctgctagcttttgaatgtgtttgctcttgcttttctaattcttttaattgtgatgttagggtgtcaattttggatctttcctgctttctcttgtgggcatttagtggtataaatttccctctacacactgctttgaatgcgtcccagagattctggtatgttgtgtctttgttctcgttggtttcaaagaacatctttatttctgccttcatttcgttatgtacccagtagtcattcaggagcaggttgttcagtttccatgtagttgagcggttttgagtgagattcttaatcctgagttctagtttgatcgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtccacttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttctttttgaattgatccctttaccattatgtaatgaccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatagtgttatgtgtgaatttgatcctgtcattattatgttagctggttattttgctcgttagttgatgcagtttcttc

SEQ ID NO: 12238 - DNA, 2383 bp, Homo sapiens
cagtatgatattggctgtgggtttgtcataaatagctcttattattttgagatatgtcccatcaatacctagtttattgagagtttttagcatgaagacctgctgaattttgtcaaagcccttttctgcatctattgagataatcatgtggtttttgtctttggttctgtttatatgatggattccatttattgatttgcttatgttgaaccaggcttgcatcccagggatgaagccaacttgatcatggttgataagctttttgatgtgctgctggatttggtatgccagtattttattgaggatttttgcattgatgttcatcagggacattggtctaaaattctctttttttgttgtgtctcggccaggcatggtatcaggataatgttggcctcacaaaatgagttatggaggagtccctctttttctattgattggagtaatttccgaaggaatggtaccagctcctccttgtacctctggtagaattccgttgtgattccgtctggtcctggacttttttgggttggtaggctgttaattattgcctcaatttcagaacctgttattggtctattcagggattcaacttcttcctggtttagtcttgggagggtgtatgtgtcaaggaatttatccatttcttctagattttctagtttatttgcatagatgtgtttatagtattctctgatggtagtgtgtatttccatgggatcggtggtgatatcccctttatcattttttattgtgtctatttgattcttctctcttttcttctttgttagtcttgctagcggtctatcaattttgttgatcttttcaaaaaaccagctcctggattcgttgattttttgaggagttttttgtgtctctatctccttcagttctgctctgatcttagttatttcttgccttctgctagcttttgaatatgtttgctcttgcttctctagttcttttaattgtgttgttagggtgtcaattttagatctttcctgctttctcttgtgggcatttggtgctataaatttccctctacatactgctttaaatgtgtcccagagattctggtttgttgtgtctttgttctcattggtttcaaagaacatctttatttctgccttcatttcgttatgtacccagtagtcattcaggagcaggttgttcagtttccatgtagttgagcggttttgactgagttttttaatcctgtgttctggtttgattgcactgtggtctgagagacagtttgtaataatttctgttcttttacatttgctgaggagtgctttacttccaactatgtggtcagttttggaataagtgcgatgtggtgctgagaagaatgtacattctgttgatttggggttgagagttctgtaaatgtctattaggtcctcttggtgcagagctgagttcaattcctggatatccttgttaactttctgtgtcatggatctgtctaatattgacagtggggtgttaaagtctcccattattatggtgtgggagtctaagtctctttaggtgtctaagggcttgctttatgaatctgggtgctcctgtattgggtgcatatattaggatagttagcttttcctgttgaattgatccctttaacattatataatggccttctttgtctcttttgatctttgttgatttaaagtcttgtttatcagagactagaattgcaacccctgctttttttttgttttccatttgcttggtagatcttccttcatcccattattttgagcctatgtgtgtctctgcatgtgagatgggtctcctgaatacagcacactggtgggtcttgactctttatccaatttgctagtctgtgtcttttaattggagcatttagcccatttacatttaaggttaatattgttatgtgtgaatttgatcctgtcattatgatgttagctggttattttgctcgttagttgatgcagtttcttcctagccttgatggtctttacaatttggcatgattttgcagcggctggtactggttgttcctttccatgtttagtgcttccttcaggagctcttttagggcaggcctggtggtgacaaaaatctctcagcatttgcttgtctgtaaagtattttatttctccttcacttatgaagcttagtttggctggatatgaaattctgggttgaacattcttttctttaagaatgttgaatattggcccccactctcttctggcttgtagagtttctgctgagtgatctgctgttattctgatgggcttccctttgtaggtaacctgacctttctctctggccgcccttaatgtttttttccttcatttcaactttggtgaatctgacaattacgtgtcttggagttgcacttctcaag

SEQ ID NO: 12239 - DNA, 4121 bp, Homo sapiens
gtctaacgtttaagtctataatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatgtgtggcattatttctgagggctctgttctgttccattgatctagatctctgttttgtaccagtaccatgctgttttggttactgtagccttgtagtatagtttgaagtcaggtagtgtgatgcctccatctttgttcttttggcttaggattgacttggtgatgcgggctcttttttggttccatatgaactttaaagcagttttttccaattctgtgaagaaagtcattggtagcttgatggggatggcattgaatctataaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggatttcactcatgatttggctctctgtttgtctgttattggtgtataagaatgcttgtgatttttgtacattgattttgtatcctgagactttgctgaagttgcttatcagcttaaggagattttgggctgagacagtggggttttctagatatacaatcatgtcatctgcaaacagggacaatttgacttcctcttttactaattgaataccctttatttccttctcctgcctaattgccctggccagaacttccaacactaagttgaataggagtggtgagagagggcatccctgtcttgtgccagttttcaaagggaatgcttctagtttttgcccattcagtatgatattggctgtgggtttgtcatagatagctcttattattttgaaatacatcccatcaatacctaatttattgagagtttttagcatgaagggttgttgaattttgtcaaaggctttttctgcatctattgagataatcatgtggtttttgtcttcggctctgtttatatgctggattacatttattgatttgcatatgttgaaccagccttgcatcccagggatgaagcccacttgatcatggtggataagctttttgatgtgctgctggattcggtttgccagtattttattgaggattttttgcatcaatgttcatcaaggatattggtctaaaattctcttttttggttgtctctctgcccggctttggtatcagaatgatgctggcctcataaaatgagttaggaaggcttcactctttttctattgattggaatagtttcagaaggaatggtaccagctcctccttatacctctggtagaattcggctgtgaatccatctggtcctggactctttttggttggtaagctattgattattgccacaatttcagatcctgttattggtctattcagagattcaacttcttcctggtttagtcttgggagagtgtatgtgtcgaggaatttatccatttcttctagattttctagtttatttgcgtagaggtgtttgtagtattctctgatggtagtttgtatttctgtgggatcggtggtgatatcccctttatcattttttattgcgtctatttgattcttctctctttttttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcatttaattgtgatgttagggtgccaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcattatgtacccagtagtcattcaggagcaggttgttcagtttccatgtagttgagcggttttgagtgagattcttaatcctgagttctagtttgattgcactgtggtctgagagatagtttgttataatctctgttcttttacattttctgaggagagctttacttccaagtatgtggtcaattttggaataggtgtggtgcggtgctgaaaaaaatgtatattctgttgatttggggtggagagttctgtagatgtctattaggtccgcttggtgcaaaactgagttcaattcctgggtatccttgttgactttctgtctcgttgatctgtctaatgttgacagtggggtgttaaagtctcccattattaatgtgtgggagtctaagtctctttgtaggtcactaaggacttgctttatgaatctgggtgctcctgtattgggtgcatatatatttaggatagttagctcttcttgttgaattgatccctttaccattatgtatggccttctttgtgtcttttgatctttgttggttgaaagtctgttttatcagagacttggattgcaacccctgcctttttttgttttccatttgcttggtagatcttcctccatccctttattttgagcctatgtgtgtctctgcatgtgagatgggtttcctgaatacagcacactgatgggtcttgactctttatccaatttgtcagtctgtgtcttttaattggagcatttagtccatttacatttaaagttaatattgttatgtgtgaatttgatcctgtcattatgatgttagctggttcttttgctgattagttgatgcagtttcttcctagcctcaatggtctttacattttggcatgattttgcagcggctggtaccagttgttcctttccatgtttagtgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagagtttctgccgagagatccgctgttagtctgttgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatctcctgcagagtgttttccaacttgtttccattctccccatcactttcaggtacaccaatcagacatagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcatgtagttcttgagccttggttttcagctccatcagctcctttaagaatttctctgtattggttattctagttatacattcttctaaagttttttcaaagttttcaacttctttgcctttggtttgaatgtcctcccatagctcagagtaatttgatcgtctgaagccttcttctctcagctcgtcaaagtcattctccatccagctttgttccattgctggtgaggaactgtgttcctttggaggaggagaggtgctctgctttttagagtttccagtttttctgttctgtttttttccccatctttgtggttttatctacttttggtctttgatgatggtgatgtacagatgggtttttggtgtggatgtcctttctgtttgttagttttccttctaacagacaggaccctgagctgcaggtctgttggagt

SEQ ID NO: 12240 - DNA, 6626 bp, Homo sapiens
gtctaacgtttaaatctttaatccatcttgaattgatttttgtataaggtgtaaggaagggatccagtttcagctttctgcatatggctagccagttttcccagcaccatttattaaatagggaatcctttccccattgcttgtttttgtcaggtttgtcaaagatcagatagttgtagacatgcggcgttatttctgagggctctgttctgttccattgatctatatctctgttttggtaccagtaccatgctgttttggttactgtagccttgtagtatagtttgaagtcaggtagcgtgatgcttccagctttgttcttttggcttaggattgacttggccacacgggctcttttttggttccgtatgaactttaaagtagttttttccaattctgtgaagaaagtcattggtagcttgatggggatggcattgaatctgtaaattaccttgggcagtatggccattttcatgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattttgaatgggagttcactcatgatttggttctctgtttgtctgttgttggtgtataagaatgcttgtgatttttgtacattgattttgtatcctgagactttgctgaagttgcttatcagcttaaggagattttgggctgagacaatggggttttctagatatacaatcatgtcatctgcaaacagggacaattggacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtcccatcaatacctaatttattgagagtttttagcatgaagggttgttgaattttgtcaaaggctttttctgcatctattgagataatcatgtggtttttgtctttggctctgtttatatgctggattacatttattgatttgtgtatattgaaccagccttgcatcccagggatgaagcccacttgatcatggtggataagctttttgatgtgctgctggattcagtttgccagtattttattgaggatttttgcatcaatgttcatcaaggatattggtctaaaattctcttttttggttgtgtctctgcccggctttggtatcagaatgatgctggcctcatcaaatgagttagggaggattccctctattgattggaatagtttcagaaggaatggtaccagttcctccttgtacctctggtagaatttggctgtgaatccatctggtcctggactctatttggttggtaaactattgattattgccacaatttcagctcctgttattggtctattcagagattcaacttcttcctggtttagtcttgggagagtgtatgtgtcgaggaatttatccatttcttctagattttctagtttatttgcatagaggtgtttgtagtattctctgatggtagtttgtatttctgtgggatcggtagtgatatcccctttatcattttttattgtgtctatttgattcttctctttttttctttattagtcttgctagtggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcattggtttcaaagaacatctttatttctgccttcattttattatgtacccagtagtcattcaggagcaggttgttcagtttgcatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtccacttggtgcaaagctgagttcaattcctgggtatccttgttgactttctgtctcgttgatctgtctaatgttgacaatggggtgttaaagtctcccattattaatgtgtggtagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccgtttgcttggtagatcttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggtgattttgctcgttagttgatgcagtttcttcctagtctcgatggtctttacaatttggcatgattttgcagcggctggtaccgattgttcctttccatgtttagtgcttccttcaggagctcttttagggcaggcctggtggtgacaaaatctctcagcatttgcttctctgtaaaggattttatttctccttcacttatgaagcttagtttggctggatatgaaattctgggttgaaaattgttttctttaagaatgttgaatactggcccccactctcttctggcttgtagggtttctgccaagagatccgctgtaagtctgatgggcttccctttgagggtaacccgacctttctctctggctgcccttaatattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatttcctgcagagtgttttccaacttggttccattctccccatcactttcaggtacaccaatcagacgtagatttggtcttttcacatagtcccatatttcttggaggctttgctcatttctttttattcttttttctctaaacttcccttctcacttcatttcattcatttcatcttccattgctgataccctttcttccagttgatggcatcggctcctgaggcttctgcattcttcacgtagttctcgagccttggttttcagctccatcagctcctttaagcatttctctgtattggttattctagttatacattcttctaaattttttttcaaagttttcaacttctttgcctttggtttgaatgtcctcccgtagctcagagtaatttgatcgtctgaagccttcttctctcagctcgtcaaagtcattctccatccagctttgttccgttgctgttgaggaactgtgttcctttggaggaggagaggcgctctgctttttagagtttccagtttttctgttctgttttttccccatctttgtggttttttttgcttttggtctttgatgatggtgatgtacagatgggttttcggtgtggatgtcctttctgtttgttagttttccttctaacagacaggaccctaagctgcaggtctgttggaataccctgccgtgtgtggtgtcagtgtgcccttgctggggggtgcctcccagttaggctgctcgggggtcaggggtcagggacccacttgaggaggcagtctgcccgttctcagatctccagctgcatgctgggagaaccactgctctcttcaaagctgtcagacagggacatttaagtctgcagaggttactgctgtctttttgtttgtctgtgccctgccccccagaggtggagcctacagaggcaggcaggcctccttgggctgtggtgggttccacccagttcgagcttcctggctgctttgtttacctaatcaagcctggccaatggcgggcgcccctcccccagcctcgctgccgccttgcagtttgatcacagactgctgtgctagcaatcagcgagattccttgggcgtaggaccctctgagccaggtgtgggatatagtctcatggtgcgccgttttttaagccggtctgaaaagcgcaatattcgggtgggagtgacccgattttccaggtgcgtccgtcacccctttcttttactcggaaagggaactccctgaccccttgtccttcccaggtgaggcaatgccttgccctgcttccgctcgtgcacggtgcacgcacccactggcctgcgcccactgtctggcactccctagtgagatgaacccggtacctcagatggaaatgcagaaatcacccgtcttctgcgtcactcacgctgggagctgtagaccggagctgttcctattcggccatcttggctcctccccctatttccatttgttttccaatggagagaaaaaagcaaggttcatcctcaaattatgatcccttcttgagaggaatacaagagatggaaagtgaaccaaactgagcttgtgtcataacccaaaagccttttcacagtgccttttttctttcattacactacatgttgtacatataacatatagctagatttttaaaaaatttaaaactcttatggaaaaacacataataaagtgtaattggtgataaactgcattgaaagctaggtgatctaagtcaaatgttccaatgctggtttgatgagagtaatgagttagtggagaacttaatattttagatacgaatacaccaggatcacatttgttttagggtgcatttttgtgtttaaatattaaaaacaggtgcaaatttagattatctattgactgcctgaatattcactgagtcagaccatttgcagttttttttttcttggaggtaaagttctttgctttgctactatttttcactgtacttggtgaaagaatggattttccccttcattaaaggggttggcccggtgcatgtagcacattgggaagaaagtggtttgatggaaactgcttgagcttgtaactttcaactttcctagttttttgttctctctctgagacctttaagttcattgtacgtgtaaaaatggcaaaaaggcaggctggtaatgagcttggttgccttcattccctacttttgccactcagggtttgatttttcaatatttgaaagttcagcagtctcaaacggtgaatctatttagagattattttatttttatattttgggataatagacaatgtaggcaagttgtacaaatgttttaaacagccagtggggtgtgtgtgtgtgtgtgtgtgtgtgcgcatgtgtgtatttggagcgaatccaaaatgtccctcagaactatttgctactttcttgttgacttttcagaagatttggttgtcctagaaatgacacttatgtagctcatggagaagaggacatggggcaaccattaattctgtcatcatttgtagctacagtatattttgtagattagaattgttctcagaaaccattgctgatttgtgcagtgttactcatttctttatttacttaggtcagtggggtgaggaccatgaggaaattaagatggaaactaccactatctacaggcataccttgcagatattgcaggtttggtttcagaccagcacaacaaattgaatattgtcataaagtgagtcacatgaaaatttggttttcccgtgcatatagaatttatgtttacactactgtaggtctgttaagtgtgaaatagcattatctctaaaaatgtagatagcttactaaaatacttcattgctaaaaaaaattctaataattaactgagccttcagtgagttatctttttgccattgtagggtcttgccttgatattgatggtccctgactgatgaaggtggttacactaaacaacagattttcaatgtaggtaaaacagccttataatagaagaagatgctatctgtcattttcaaagctagagagaagcctagcttcaaaccttcaaaggattgactgtctgaatattcaccaggatggaggtcactgaaagttggggtggctgtggtaatttcttaagacaacaatgaagcttgccacatcaatggactttctctttcagaaaagatttctctgtaaagcatgtgatgatgtg

SEQ ID NO: 12241 - DNA, 681 bp, Homo sapiens
caacccctgcctttttttgttttccatttgcttggtagatcttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatctgatcctgtcattatgatgttagctggttattttgctcgttagttgatgcagtttcttcctagtctcgatggtctttacattttggcatgattttgcagcggctggtaccagttgttcctttccatgtttagtgcttccttcaggagctcttttagggcaggcctggtggtgacaaaatctctcagcatttgcttgtctgtaaagtattttatttgtccttcacttatgaagcttagtttggctggatatgaaattttggctttgaaaattcttttctttaagaatgttgaatatttggcccccactctcttctggcttgtagagtttctgccgagacatctgctgttagtctgatgggcttccctttgagggtaacccgacctttcttttctggctgccctttacattttttccttcatttcaactttgttgaatctgaccattatgtgtcttggaattgctcctttcg

SEQ ID NO: 12242 - DNA, 2793 bp, Homo sapiens
cctccatatggctagccagttttcccagcaccatttattaaatagggaatcctttccccatttcttgtttttgtcaggtttgtcaaagatcagatggttgtagatgtgtggtgttatttctgagggctctgttttgttccattggtctatatctctgttttggtaccagtaccatgctgttttggttactgtagccttgtagtatagtttgaagtcaggtagcatgatgcctccagctttgttcttttggcttaggattgtcttggcaatgcgggctcttctgtggttccacatgaactttaaagtagttttttccaattctgtgaagaaagtaattcgtagcttgatgggaatggtgctgaatctataagttgccttgggcagtatggccattttcacgatattgattcttcctatccatgagcatggaatgttcttccatttgtttctgtcctcttttatttcattgagcagtggtttgtagttctccttgaagaggtccttacatcccttgtaagttggattcctaggtattttaatctctttgaagcaattgtgaatgggagttcactcatgatttggctctctgtttgtctgttattggtgtataagaatgcttgtgatttttgcaaattgattttgaatcctgagattttgctgaacttgcttatcaacttaaggagattttcagctgagatgatggggttttctagatatacaatcatgtcatctgcaaacagggacaattcgacttcctcttttcctaattgaataccctttatttctttctcctgcctgattgccctggccggaacttccaacactatgttgaatactagtggtgagagagggcatccctgtcttgtgccagttttcaaagggaatgcttccactttttgccattcagtatgatgttggctatgggtttgtcatagatagctcttattattttgagatatgtcccatgaatacctaatttattgagagtttttagcatgaaggttgttgaattttgtcaaaggccttttctgcatctattgagataatcatgtggtttttgtctttggctctgtttatatgctggattatgtttattgatttgcatatgttgaaccagccttgcatcccagggatgaagcccacttgatcatggtggataagccttttgatgtgctgctggatttggtttgccaatattttattgaggatttttgcactgatgttcatcagagatattggtctaaaattctctttttttgttgtgtctctgccaggctttggtatcaggatgatggtggcctcataaaatgagttagggaggattccctctttttctattgattggaatagttcagaaggaatggtaccagctcctccttgtacctctggtagaatttggctgtgaatcagtctggtcctggacatttttttggttggtaggctattaattattgcctcaatttcagagcctgctattggtctattcagagattcaacttcttcctggtttagtcttgggaggttgtatgtgttgaggaatttatccatttcttctagattttcaagtttatttccatagaggtgtttataatattctctgatggtagtttgtatttctgtgggatcagtggtgatatcccctttatcattttttattgtgactctttgattcttccctcttttcttctttattagtcttgctagcagtctatcaattttgttgaccttttcaaaaaaccagctcctggattcactgattttttgaagggttttttgtgtctctatctccttcagttctgctctgatcttagttatttcttgccttctgctagcttttgaatgtgtttgctcttgcttctctagttcttttaatggtaatgttaggatgtcaattttagatctttcttgctttctcttgtgggcatttagtgctgtaaatttccctcacacactgctttaaatgtgtcccagagattctggtatgttgtgtctttgttctcattggtttcaaagaacatcttcatttctgccttcatttcgttatgtacctcgtagtcattcagtagcaggttgttcagtttccatgtagttgagcagttttgagtgaggttcttaatcctgagttctagtttgattgcactgtggtctgagagacagtttgttataatttctgttctttcacatttgctgaggagtgctttacttccaactattggtcatttttggaatacgtgtggtgtggtgctgaaaagaatgtatattctgttgatttggggtggagagttctgtagatgtctattaggtccacttggtgcagagctgaattcaattcctggatatcctttttaactttctgtctcgttgatctgtttaatgttgacagtgggtttttaaagtctcccattactactgtgtgggagtctaagtctctttgtaggtctctaagggcttgctttatgcatctgcgtgctcctgtattgggtgcatatgtatttaggatagttagctcttcttgttgaattgatccctttaccgttatgtaatggccttctttgtctcttttgatctttgttgatttaaagtctgttttatctgagactaggattgcgaccactgcctttttttgttttccatttgcttggtagatcttcctccatccctttactttgagcctatgtgtgtctctgtctgtgagatgggtctcctgaatacagcacactgatgggtcttgactctttatccaatttgccagtctgtgtctttaaattggagcatttagcccatttacattta

SEQ ID NO: 12243 - DNA, 1816 bp, Homo sapiens
cctgagttctagtttgattgcactgtggtctgagagacagtttgttataatttctgttcttttacatttgctaaggagtgctttacttccaactatgtggtcaattttggaataggtgtggtgtggtgctgaaaagaatgtatattctgttgatttgagatggacagttctgtaaatgtctattaggtccgcgtggtgcagagctgagttcaattcctggatatccttgttaactttctgtcttgttgatctgtctaacgttgacagtggggtgttaaagtctcccattattatcgtgtggaagtctaagtctctttgtaggtcactcaggacttgctttatgaatctgggtgctcctgtattgggtgcatatatatttaggatagttagttcttcttgttgaattgatccctttaccattatgtaatggccttctttgtctcttttgatcttgttggtttaaagtctgttttatccgagactaggattgcaaaccctgcctttttttgttttccatttgcttggtagatcttcctccatccctttattttgagcctatgtgtgtctctgcatgtgagatgggtttcctgaatacagcacactaatgggtcttgactctttatccaatttgccagtctgtgccttttaattggagcatttagcccatttacatttaaggttagtattgttatgtgtgaatttgatcctgtcattatgatgttagctggttattttgctcgttagttgatgcagtttcttcctagcctcgatggtctttacaatttggcatgtttttgcagtggctggtaccggttgttcctttccatgtttagtgcttccttcaggagctcttttagcgcaggcctggtggtgacaaaatctctcagcatttgcttgtctgtaaagtattttatttctccttcacttatgaagcttagtttggctggatatgaaattctaggttaaaaattcttttctttaagaatgttgaatattggccgggcgcggtggctcacgcctgtaatcccagcactttgggaggccgaggcaggcggatcacgaggtcaggagatcgagaccatcctggctaaaacggtgaaaccccgtctctactaaaaatacaaaaaattagccgggtgtagtggtgggcgcctgtagtcccagctacttgggaggctgaggcaggagaatggcgtgaacccgggaggcggagcttgcagtgagccgagatcccgccactgcactccagcctgggtgacagagcgagactccgtctcaaaaaaaaaaaaaaaaaaaaaaaaagaatgttgaatattggcccctactgtcttctggcttgccgtttctgctgagatatcagctgttcatctgatgggcttccctttgtgggtaacccaacctttctctctggctgcccctaatattttttcctgcatttgaactttggtgaatctgacaattatgtgtcttggagttgctcttctcgaggagtatctttgtggcattctctgtgtttcctgaatttgaatgttggcctgccttgctagattggggaagttctcctggataatatcctgcagagtgttttccaacttggttccattatccccaccactttcaggtacaccaatcagacgtagatttggtcttttcacatagtcccatatttcttggaggctttgtttgtttctttttattcttttttctctaaacttctcttcacacttcatttcattcatttcgtcttccatcactgttaccctgtcttccagttgatgacatcagttactgaggcttgtgcattcatcacatagtt

SEQ ID NO: 12244 - DNA, 4565 bp, Homo sapiens; identical to SEQ ID NO: 12049

SEQ ID NO: 12245 - DNA, 4549 bp, Homo sapiens
tccattcccacctatgagtgagaacatgcggtgtttggttttctgtcctcgggatagtttgctcagaatggtggtttccagcttcattcatgtccctacaaaggacatgaactcatccttttttatggcttcatagtattccacggtgtatatgtgccacattttcttaatccgatctatcactgatggacatttaggttggttgcaagtctttgctattgtgaatagtgctgcaataaacatacgtgtgcctgtgtctttatagcagcatgatttataatcctttgggtatatgccgagtaatgggatgactgagtcaaatggtatttctagttctagatccttgaggaatcgccacactgtcttccacaatggttgaactagtttacagtcccaccaacagtgtaaaagcattcctatttctccatatcctctccagcacctgttgtttcctgactttttaatgattgccattctaactggtgtgagatggtatgtcattgtggttttgatttgcatttctctgatggccagtgatgatgagcattttttcatgtgtctgttggctgcataaatgtcttttgagaagtgtctgttcatatcctttgcccattttttgatggggttgtttgattttttcttgtaaatttgtttaggttctttgtagattctggatattagccctttgtcagatgagtagattgcaaaaattttctcccattctgtaggttgcctgttcactctgatggtagtttcttttgctgtgcagaagctctttagtttaattagatcccatttgtcaattttggcttttgttgccattgcttttggtgttttagtcatgaagtccttgcccatgcctatgtcctgaatggtattgcctaggttttcttctagggtttttatgattttaggtctaacatgtaagtctttcatccatctcgaattaatttttgtataaggtgtaaggaagggatccagtttcagctttctacatatggctagccagttttcccagcaccatttattaaatagggaatccttttcccatttcttgtttttgtcaggtttgtcaaagatcagatggttgtagatgtgtggtattatttctgagggttctgttccattggtctatatctctgttttgataccagtaccatgctgttttggttattgtagccttgtagtatagtttgaagtcaggtagcatgatgcctccagctttgttcttttggcttaggattgtcttggcaatgcaggctcttttttggttccatatgaactttaaagtagttttttccaattctgtgaagaaagtcattggtagcttgatggggatggcattgaatctataaattaccttgggcagtatggccattttcacaatattcattcttcctatccatgagcatggaatgttcttccattgtttgtgtcctcttttattttgttgagcagtggtttgtagttctccttgaagaggtccttcacatcccttgtaagttggattcctaggtattttattctctttgaagcaattgtgaatgggagttctctcatgatttggcttactgtttgtctgttattggtgtataggaatgcttgtgatttttgcacattgattttgtatcctgagactttcctgaagttgcttatcagcttaaggagattttgggctgagatgatggggttttctagatatacaatcatgtcatttgcaaacagggacaatttgacatcctcttttcctaattgaataccctttatttctttctcttgcctgattgccctggccagaacttccaacactatgttgaataggagtggtgagagagggcatccctgtcttgtgccagttttcaaagggaaggcttccagtttttgcccattcagtatgatattggctgtgggtttgtcatagatagctcttattattttgagatatgtcccatcagtacctaatttattgagagtttttagcatgacgggctgttgaattttgtcgaaggccttttctgcatctattgagataatcatgtggtttttgtctttggttctgtttgtatgatggattacgtttattgatttgtgtatgttgaaccagtcttgcatcccagggatgaagcccacttgatcatggtggataagcttttagatgtgctgctggattcggtttgccagtattttattgaggatttttgcattgatgttcatcaggatattggtctaaaattctctgtttttgttgtgtctctgccaggctttggtatcaggatgatgctggcctcataaaatgagttagggaggattccctctttttctattgattggaatagtttcagaaggaatggtaccagcttctctttgtacctctggtagaattcagctgtgaatccatctggtcctggactttttttggttggtaggctattaattagtgcctcaatttcagagcctgttattggtctattcagggattcaacttcttcctggtttagtcttgggagagtgtatgtgtcgaggaatttatccttttcctctagattttctagtttatttgcatagaggtgtttatattattctctgatggtagtttgtatttctgtgggatcggtggtgatatcccctttatcattttttactgcgtctatttgattcttctctcttttcttctttattagtcttgctagcggtctatcaattttgttgatcttttcaaaaaaccagctcctggattcattgatttttttttgaagggttttttgtgtctctatctccttcagttctgctctgatcttagttatttcttgccttctgctagcttttgaatgtgtttgctcttgcttctctagttcttttcattgtgacgttagggtgtgaattttagatctttcctgctttctcttgtgggcatttagtgctataaatttccgtctacacattgctttaaatgtgtaccagagattctggtatgttgtgtctttgttccattggtttcaaagaacatttttatttttgccttcattttgttatgcatccagtagtcattcaggagcaggttgttgagtttccatgtagttgagcggttttgagtgagtttcttaatcctgagttctagtttgattgcactgtagtctgagagacagtttgttataatttctgttcttttacatttgctgaggagtgctttacttccaaacatgtggtcacttttggaataagtatgatgtggtgctgaaaataatgtatgttctgttgatttgaggtggagaattctgtagacgtctattaggtccgcttggtgcagagttcaattcttggtgagttcaattcctggatatccttgttaactttctgtctcattgagctgtctaacgttgacagtggggtgttaaagtctccccttattattgtgtaggagtctaagtctctttgtaggtctctaaggacttgctttatgaatctgggtgctcctgtattggatgcatatatatttaggatagttagctcttcttgttgaattgatccctttaccattatgtaatggccttctttgtctcttttgatctttgttggtttaaagtctgttttgtcagagactaggattgcaacctttgcttttttttgttttccatttgcttggtagatcttcctccatccctttattttgagcctatatgtgtctctgcctgtcagatgggtctcctgaatacagcacactgatgggtcttgactttttttttttttttttgagacagagtctcgctctgtcacccagggtggagtgcagtggcgtgatctcagctcactgcaagctctgcctcccaggttcacgccattctcctgcctcagcctcctgagtagctgggacaacaggcgcctgccaacgtgcccggctaattttttgtatttttagtagagacgggttttcaccatgttagccaggatggtctcgatctcctgacctcgtgatccacccaccttggcctcccaaagtgctgggattacaggtgtgagccaccatgcccggccgggtcttgactcttatccaatttgccagtctgtgtcttttaattggaatatttagcccatttacatttaaggttaatattgttatgtgtgaatttggtcctgtcattatgatgttagctggttgttttgcttgttagttgatgcagtttcttcctagcatcgatggtctttacaatttggcatgtttttgcagtggctggtactggttgttcctttccatgtttagtgcttccttcaggagctcttataaggcaggcctggtggtgacaaaatctctcagcatttgtttgtctgtaaaggattttatttctccttcacttatgaagcttagtttggctggatatgaaattctgggttgaaaattcttttctttacgaatgttgaatattggccccccactctcttctggcttgtagagtttctgccaagagatctgctgttagtctgatgggcttccctttgagggtaacccgacctttctctctggctcccttaacattttttccttcatttcaac

SEQ ID NO: 12246 - DNA, 2945 bp, Homo sapiens
gaaagtcattggtagtttgatgggaatggcattgaatttataaattaccttgggcagtatggccattttcacgatattgattcttcctatccatgagcgtggaatgttcttccatttgtttgtgtcttctatttcgttgagcagtggtttgtagttctccttgaagaggtccttcccatcccttgtaagttggattcctaggtattttattctctttgaagcaatagtgaatgggagttcactcatgattggctctctgttgtctgttattggtgtataagaatgcttgtgattttgcacattgatttgtatcctgagacttgctgaagttgcttatcagcttaaggagatttgggctgagacgatggggttttctaaatatacaatgatgtcatctgcaaacagggacaatttgacttcctcttttcctaattgaataccctttatttctttctcctgcccgattgccctggccggaacttccaacactatgttgaataggaatggtgagagagggcatccctgtcttgtgccagttttcaaagggaatgcttccagtttttgcccattcagtatgatattggctgtgggtttgtcataaatagctcttattattttgaggtacgtcccatcaatacctaatttattgagagtttttagcatgaagggctgttgaattttgtcaaaggctttttctgcatctattgagataatcatgtggtttttgtctttggttctgtttatatgctggattacatttattgatttgcatatgttgaaccagccttgcaccccagggatgaagccaacccgatcgtggtggataagatttttgatgtgttgctggattcagtttgccagtatcttattgaggatttttgcatcgatgttcatcagggatattggtctaaaattcttttttgttgtgtctctgccaggctttggtaacaggatgatgttggcctcataaaatgagttagggaggattccctctttttctattgattggaatagtttcagaatgaatggtaccagctcctctttgtacctctggtagaatttggctgtgaatctgtctggtcctggactttttttgattggtaggccattaattattgcctcaatttcagagcctgttattggtctattcaggcattcaacttcttccttgtttagtcttgggaggatgtatgtgtcaaggaatttatccatttcttctagattttctagtttatttgcatagaggtgtttataatattctctgatggtagtttgtatttctgtgggatgggtggtgatatcccctttatcattttttattgcacctatttgattctcctatcttttcttctttattagtcttgctagcagtctatcaattttgttgatctttaaaaaaaaccagctcctggattcatggattttttgaagggttttttatgtctctatctccttcagttctgctctgatcttagttatttcttgccttctgctagcttttgaatgtgtttgctcttacttctctagttcttttaattgtgatgttagggtgtcaattttagatctttcctgctttctcttgtgggcatttagtgctataaatttccctctacacactgctttgaatgtgtcccagagattctggtatgttgtgtctttgttctcattggtttcaaagaacatctttatttctgccttcatttctttatgtacccagtagtcattcaggagcaggttgttcagtttccatgtagttgggcggttttgagtgagtttcttaatcgtgagttctagtttgattgcactgtggtctgagagacagtttgttgtaatttctgttcttttacatttgctgaggagtgctttacttccaactatgttggtccattttggaataagtgtgatgtggtgctgagaaaaatgtacattctgttgatttggggtggagagttctgtagatgtctattaggtccacttggtgcagagctgaattcaattcctggaaatccttgttaactttctgtctcgtttctctgtctaatgttgacaatggggtgttaaagtctcccattattattgtttgggagtctaagtctgtttgtaggtgtccaaggacttgctttatgaacctgagtgctcctgtattgggtacatatatatttaggacagttagctcttcttgttgaattgatccctttacgattagtaatggccttgtctcttttcatctttgttggtttaaagtctgttttatcagagacaagattgcaacccctgctttttttgttttccatttgcttggtagatcttcctccattcctttattttgagtctatgtgtgtctctgcatgtgagatgggtctcctgaatacagcacactgatgggtcttgactctttatccaatttgccagtctgtgtcttttaattggagcatttagcccatttacatttaaggttaatattgttatgtgtgaatttgatcctgtcattatgatgttagctggttatttgctcgatagttgatgcagtttcttcctagccttgatggtctttacaatttggcatgtttgcagtggctggtactggttgttcctttccatgtttagtgcttccttcaggagctcttgtaaggcaggcctggtggtgacaaaacctctcagcatttgtttgtctgtaaaggattttatttctccttcatttaggaagcttagtttggctggatatgaaattctgggttgaaaattcttttctttaacaatgttgaatattggctcccactctcttctgacttgtagagtttctgctgagagatctgctgttagtctgttgggcttccctttgtgggtagcccaacctttctctctggctgcccttaacatttttttccttcatttcaactttggtgaatctgacaattatgtgtcttggagttgctcttctcaag

SEQ ID NO: 12247 - DNA, 4983 bp, Homo sapiens
attgtccttcacttcctttttttaaattatactttaagtttcagggtacatgtgcacaacgtgcaggtttgttacatatgtatacatgtgccatgttggtgtgctgcacccattaactcgtcatttacattaggtatatctcctaatgatatccctcctccctccccccaccccacaacaggccccagtgtgtgatgttccccttcctgtgtccatgtgttctcattgttcaattcccacctatgagtgagaatatgcggtgtttggttttttgtccatttctcagtttgctgagaatgacggtttccagcttcattcatgtccctacaaaggacatgaactcatcattttttatggctgcatagtattccatggtgtatatgtgccacattttcttaatcgagtctatcattgttggacatttgggttggttccaagtctttgctattgtgaatagtgccacaataaacatacgtgtgcatgtgtctttatagcggcatggtttataatcctttgggtatatgcccagtaatgggatggctgggccaaatggtatttctagttctagatccctgaggagtcgccacactgtcttccacaatggttgaactagtttacagtcccaccaacgtgtaaaagtgttcctatttctccacatcctctccagcacgtgttgtttcctgactttttaatgatcgccattctaagtggtgtgagatggtatctcattgtggttttgatttgcatttctctgatggccagtgatgatgagcatattttcatgtgtcttttggctgcataaatgtcttcttttgagaagtgtctgttcatatccttcacccacttggtgatgggttgtttttttcttgtacctttgtttgagttcattgtagattctggatattagccctttgtcagataagtagattgcaaaaattttctcccattctgtaggttgcctgttcactctgatggtagtttcttttgctgtgcagaagctctttagtttaattagatcccatgtgtcaattttggcttttgttgccattgcttttggtgttttagacatgaagtccttgtacatgcctatgtcctgaatggtattgcctaggttttcttctagggtttttacggttttaggtctaacatttaagtctttaatctatcttgaattaatttttgtataagatgtaaggaagggatccagtttcagctttctacatatggctagccagttttcccagcaccattgattaaatagggaatcctttccccatttcttgtttttgtcaggtttgtcaaagatcagatagttgtagatatgtggaattatttctgagggctctgttctgttccattggtctatatctctgttttggtacaagtaccatgctgttttggttactgtagccttgtagtatagtttgaagtcagatagcgtgatgcctccagctttgttcttttggcttaggattgacttggcaatgcaggctcttttttggttccatatgaactttaaagtagctttttccaattctgtgaagaaagtcattggtagcttgatggggatggcattgaatctataaattaccttgggcagtatggtcattttcaccatattgattcttcctacctatgagcatggaatgttcttgcatttgtttgtatcctcttttatttcgttgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgcacgttgattttgtatcctgagactttgctgaagttgcttatcagcttaaggagatttggggctgagacgacggggttttccagatatacaatcatgtcatctgcaaacaggggcaatttaacttcctcttttcctaattgaatacaatttatttccttctcctgcctgattgccctggccagaacttccaacactatgttgaataggagaagtgagagagggcatccctgtcttgtgccagttttcaaagggaatgcttccagttttagcccattcagtatgatattggctgtgggtttgtcatagatagctcttattattttgagatacgtcccatcaatacctaatttattgagagtttttagcatgaagtgttgttgaactttgtcaaaggccttttctgcatctactgagataatcatgtggtttttgtctttggttctgtttatatgctggattacatttattgatttgtgtatgttgaaccagccttgcatcccagggatgaagcccacttgatcatggtggataagctttttgatgtgctgctggatttggtttgccagtattttattgaggatttttgcatcgatgttcatcagggatagtggtctaaaattctctttttttgttgtgtctctgccaggctttggtatcaggataatgctggcctcttaaaatgagttagggaggattccctctttttctattgattggaatattttcagaaggaatggtaccagctcctccttgtacctttggtagaatacggctgtgaatccatctggtcctggacttttttttgttggtagcctattaattattgctttaatttcagagcctgttattggtctattaagagattcatcttcttcctggtttagtcttggaagggtctatgtgtcgaggaatttatccatttcttctagattttctaatttatttgcatagaggtgtttatagtattctctgatggtagtttgtatttctgtgggatcggtggtgatatcccctttatcattttttattgcgtctatttgatacttctctcttttcttctttattagtcttgctagcagtctaacaattttgttgacctttcgaaaaaccagctcctggattcactgattttttgaagggttttttgtgtctctatttccttcagttctgctctgatcttagttatttcttgccttctgctagcttttgaatgtgtttgctcttgcttctctagtgcttttaattatgatgttagggtgtcaattttagatcttttctgctttctcttgtgggcatttagtgctataaatttccccctacacactgctttgaatgtgtcccagagattctggtatgttgtgtgtttgatctcattggtttcaaagaatatctttatttctgccttcatttcgttatgtacccagtagtcattcaggagcaggttgctcagtttccatgtagttgagtggttttgagtgagcttcttaatcctgagttctagtttgattgcactgtggtctgagagatggtttgttataatttctgttgttttacatttgctgaggagtgctttacttccaactatgtggtcaattttggaatagatgtggtgtggtgctgaaaagaatgtatattctgttgatttggggtggagagttctgtagatgcctattaggtcctcttggtgctgagctgagttcaattcccggatatccttgttaactttctgtcgcattgatctgtctaatgttgatagtggggtgttaaaatctcccattattattgtgtgggagtctaagtctcttcataggtctctaaggacttgctttatgaatctgggtgctcctgtattgggtgcatatatatttaggatagttagctcttcttgttacattgatccctttaccattatgtaatggccttctttgtctcttttgatctttgttgtttaaagtctgttttaacagagagtaggatttcaactcctgcctttttttgttttccatttgcttggtagatcttcctccatccccttattttgagcctatgtgtgtctctgcatgtgagatgatttcctgaataccgcacactgatgggtcttgactctttatccaatttgccagtctgtgtcttttaattggagcatttagcccatttacctttaaggttaatattgttatgtgtgaatttgatcctgtcattatgatgttagctggttattttgctcgttagttgatgcagtttcttccaagcatcgatggtctttacaatttggcatgtttttgcagtggctggtactggttgtttctttccatgtttagtgcttccttcaggagctcttgcaaggcaggcctggtgttgacaaaatctcttagcatttgcttgtctgtaaaggattttatttctccttcacttatgaagcttagtttggctggatatgaaattctgggttgaaaatacttttctttaagaatgttgaatattggccccactctcttctggcttgtagagtttctgccaagagatcagctgttagtctgatgggcttccttttgtgggtaacccgacctttctctctggaagccgttaacattttttccttcatttcaactttggcgaatctgacaattatgtatcttggagttgctcttctcgaggaatatctttgtggcgttctctgtatttcctgaatttgaatgttggcctaccttgctaggttggggaagttctcctggataatatcctgcagagtgttttccaacttggttccattctccccgtcactttcatgtacaacaatcagaagtagatttggtcttttcacatagtcccatatttcttggaggctttgttcatttctttctactcttttttctctaaacttctcttcttgcttcatttcattcatttaatcttcaatcactgatacctttcttccacttgatcgaattggctactgaagcttgtgcatgtgtcacgtggttctcgtgccatggttttcagcgccatcaggtcatttaaggtcttctctctgctgtttattctagttagccatttgtctaatcttttttcaaagtttttagcttctttgcgatgggttcaaacatcctcctttagctcggagaagtttgttatt

SEQ ID NO: 12248 - DNA, 1537 bp, Homo sapiens
ttttacatttgaatttttttaaattaattaattaatttatttattgatcattcttgggtgtttctcgcagagggggatttggcaaggtcataggacaatagtggagggaaggtcagcagataaacaagtgaacaaaggtctctggttttcctaggcagaggactctgcggtcttccgcagtgtttgtgtccctgggtacttaagattagggagtggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaataatttttcttagtacagaacaaaacaaaaagtctcccatgtctacttctttctacacagacacggcaaccatccgatttctcaatcttttccccacctttcccccctttctattccacaaaaccgccattgtcatcatggcccgttcttaatgatctgttgggtacacctcccagacggcatggtggccgggcagaggggctcctcacttcccagtaggggcggccgggcagaggcgcccctcacctcccggacggggtggctggccaggccggggggctgacccccccacctccctcccggaccgtgcggctggccgggaggggggctgacccccccacctccctcccggacggggctgctggcctggcgggggctgacccccacctccctcccggacggtgtggctgccgggcggagacgctactcacttctcagatgaggtggctgccgggcggagggactcctgacttctcatatggggcggttgccaggcagagggtctcctcacttctcagacggggcggctgggcagagacgctcctcacctcccagactgggtcgcggcggggcagaggcgctcctcacatcccagacggggcgttggggcagaggcgctccccacatttcagacgatgggtggccgggcagagacgctcctcacttcctagatgggatggcggcagggaagaggcgcttctcacttcgtagatgggatggcggccgggcagagacgctcctcactttccagactgggcagccaggcagaggggctcctcacatcccagacgatgggcggccaggcagagacgctcctcacttcccagacggggtggcggccgggcagagactgcaatctcggctctttgggaggccaaggcaggcggctgggaggtggttgtagcgagccgagatcacgccactgcactccagcctgggcaccattgagcactgagtgaacgaggctccgtctgcaatcccggcacctcgggaggccgaggctggcggatcactcacggttaggagctggagaccagcccggccaacacagcgaaaccccgtctccaccaaaaaaatatgaaaaccagtcaggcgtggcgatgcacgcctgcaatcgcaggcactcggcaggctgaggcaggagaatcaggcaggggcgttgc

SEQ ID NO: 12249 - DNA, 221 bp, Homo sapiens
tcgcccactttttgatggggttgtttgtttttttcttgtaaatttgttggagttcatcgtagattctggatattagccctttgtcagatgagtaggttgcaaaaattttctcccattttgtaggttgcctgttcactctgatggtagtttcttttgctgtgcagaagctctttagtttaattagatcccatttgtcaattttgtcttttgttgccattgct

SEQ ID NO: 12250 - DNA, 88 bp, Homo sapiens
cctcgctgccgccctgcagtttgatctcagactgctgtgctagcaatgagcgaggctccgtgggcgtaggaccctccaagccaggtgt

SEQ ID NO: 12251 - DNA, 1084 bp, Homo sapiens
tttttttttttattatactttaagttttagggtacatgtgcacattgtgcaggttagttacatatgtatacatgtgccatgctggtgcgctgcacccactaactcgtcatctagcattaggtatatctcccaatgctatccctcctccctccccccaccccaccacagtccccagagtgtgatattccccctcctgtgtccatgtgatctcattgttcaattcccacctatgagtgagaatttgcggtgtttcgttttttgttcttgtgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatatgtgtgcatgtgtctttatagcagcatgatttatagtcctttgggtatatacccagtaatgagatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtccttcgcccacttttggatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttggacatgaagtcctcgcccatgcctgtg

SEQ ID NO: 12252 - DNA, 391 bp, Homo sapiens
ttctttgtgatgggttcgaacatcttcttttagctcagagaggtttgttattaccgatcatctgaagccttcttctctcaactcgtcaaagtcattctccatccagctttgttccattgctggtgaggagctgtgttcctttggaggagaagaggcactctgattttcggaattttcagcttttctgctctggtttctccccatctttgtggttttatctacctttggtctttgatgatggtgacatacagatggggttttggtgtggatgttctttctgtttgttagttttccttctaacagtcaggaccctcacctgcaggtctgttggagtttgctggaggtccactccagaccctgtttgcctgggtatcaccagcggaggctgcag

SEQ ID NO: 12253 - DNA, 1081 bp, Homo sapiens
ttttttttattattatactttaagttttagggtacatgtgcacaatgtgcaggtttgttacacatgtatacatgtgccatgtttgtgtgctgcacccagtaactcgtcatttagcattaggtatatctcctaatgctatccctccccgctcccccaaccccacaacagtccccggtgtgtgatgttccccttcctgtgtccaagtgttctcattgttcaattcccacctgtgagtgagaacatgtggtgtttggttttctgtccttgtgatagtttgctgagaatgatggtttccagcttcatccatgtccctacaaaggacatgagctcatcattttttatggctgcgtagtactccgtggtgtatatgtgtcacattttcttaatccagtctatctttgttggacatttgggttggttccaagtctttgctattgtgaatagtgctgctataaacatacgtgtgcatgtgtctttatagcagcatgatttataatcgtttgggtatatacccagtaatgggatggctgggtcaaatggtatttctagttctagatccctgaggaatcgccacactgactttcacaatggttgaactagtttacagtcccaccaacagtgtaaaagtgttcctatttctccacatcctctccagcacctgttgtttcctgaagtttttaatgatcgccattctaactggtgtgagatggtatctcattgtggtttatatttgcatttctctgatggccagtgatgatgagcaatttttcatgtgttttttggctgcataaatgtcttcttttgagaagtgcctgttcacatcctttgcccactttttgatggggttgtttgtttttttcttataaatttgtttgagttcattgtaggttcttgatattagccctttgtcagatgagtaggttgcaaaaatgttctcccattctgtaggttgcctgttcactctgatagtggtttcttttgctgtgcagaagctctttagtttaattagatcccatttgtcaattttggcttttgttgccattgcttttggtgttttcgacatgaagtccttgcccatgcc

SEQ ID NO: 12254 - DNA, 410 bp, Homo sapiens
gctggtgaggagctgcattcctttggaagaggagaggtgctctgatttttagagtttccagtttttctgctctgtttttttcccatctttgtggttttatctacctttggtcttcgatgatggtgatgtacagctgggtttttggtgtggatgtcctttctgtttgttagttgtccttctaacagtcaggaccctcagctgcaggtctgttggagtttactggaggtccactccagaccctgcttgcctgggtatcagcagtggtggcagcagaacagcggatattggtgaaccgcagatgctgctgcctgatcattcctctggaagttttgtctcagaggagtacccagctgtgtgaggtgtcagtccgcccctactgggggatgcctcctagttaggctactcggggg

SEQ ID NO: 12255 - DNA, 48124 bp, Homo sapiens
gtgtgtcttgtgatggaatatgctgaagggggctctttatataatggtgagtgtcattagacctgtctttatctagtggattaaaataatttgaaaaattttaatataaaccctaagttgtttaacattcttcacaatttgccgtcagagtcccaaaagggcataatttttaaaaatctgctaagaataaaaatggaaagataagattctataacattagtatgtgaaatttagaggtctatcaattttttaagtagatggtactttgcatttcattaaaagcatttaagtaaaagtttactttttaaatagattttaaaatatcttcagatttttttctttttgccctctcataactttgagcctcctcattttagaattctttaaccatatttcgatttcactctgctttattttttcttttttttcaaaaaaaaatgtgaaaactcacttcacacaaccttttatttgtagtaatgaaaaaaaactttgtgtagttacattggagaacagagttcttttaccctaaaaataccaaccatatgcagaaatgtattgtctcttgtagcaccagttatataaaacaaattgttacattttattttttaattagtattattttatgtaaacttttacttatatttactgcccatgtgttcatcattgtgatggatatctaataccccattgtcttatttgattgaactacttctggtttttagccattacagaaaatacaggtgcaaacatcttgatatacattgttttgtttctttctgtactgttctctgcctctctcttgtagtagtgtgccataagactgctcataatttatattactttataaaagtctttatctgtttgaaaaaatgtggtaatgtatattgattttacttcaatgtaggaataacatttaatagatgtactattaaatgttaatatcatggcaattatccactcaaaattagtagatattttcatcctttttatttagaagaaaaattaaaaggccaggcatggtggctcactcctgtaatcccagcactttgggaggccaaggcaggcagatcatgaggtcaagagatcaagaccatcctggccaacatggtgataccctatctctactaaaaatacaaaaattagctgggcgtggtggcacacgcctgtagtcccagctactcgggaggctgagccaggagaatcgcttgaacccaggaggtggagtttacagtgagccaagatcgcaccactgcactccagcctggcgacaaagtgagagtccgtctcaaaaaacaaaaagaaaaaagaaagtaaaaaattaaaagcaggactgatggagcatatgtatatgtagaaaaatacccagtcatgtgttctgatagtgcttgcattcacattgtgtcttttgttatatgcaataaagttctttttagtttgtgcctttctttcgcagtgctgcatggtgctgaaccattgccatattatactgctgcccacgcaatgagttggtgtttacagtgttcccaaggagtggcttatcttcacagcatgcaacccaaagcgctaattcacagggacctgaaaccaccaaagtaagttataataatgtgacacccctcagcctcttcctccttctctctcactctcaccaccccgaacccactctctaattcaagctcattattgtacaggagtttctcttttctctatttggcttactcagtgtttacttttaactcaccttcatcatttagtcatttatctaagcttgtattttagatgttgtctttagtgggatttttatttttggtaacctctaccttagattagcatacttctagaatctgttagcctataaaaatctcattttgtgcctgcagtatataatgttgctgttagacaattccttgggggcagagataggtctgacgtttttcttgctgtgtccctaacacctagcacataaacattctacagaaatttgcagagttgttattacttgctctttcagaggaaagtaaaagggcatttcttggcatctgggtagaaattgaaaatattctggattcttcataatgtgaatacttgggactttaaaaaacttataaattccttagataagtattttaaaagactaaaactttgggggttttgtttgtataggtattcagttaaagaaaacatacacataaaacatattgtttccttttctctctttttttttcttttatgcacctgtgacacagtaaaaatagtctccacgtatcttctttaccctccccccaagctcccaccccagcacattagtctttacagaagaggtttcccttaggaaatcagtatagtcttcagttattccattctcttgatactggttaaagcattaaaacatcccttctgggtgcaacttgtcactctcaggtctaatctgatatactctacataggttccaactcttagaatcactgttcttgctatgtatcttatctctactcccaaacttaaactgatttctgtttccccaggtcactgataaaataatgtttaagcttttatttttcctgaggctattatcttagttacctgccttaactaatgaaaaaatcacttagcctttttttcttcattgtgaatattcagtcatcctttttccactatattaacagagttgaattattaaagcaaacttatgagaatcacagctcttaaccagcaacaaattgacaaatgatccaaaggatataggcaagcatcagatacagccaaagcattcttttcctaaaagagtctgaacgcatctgatgcaacacccaaaagtatcccttttctcctcgttacagtatgttttggctttggaataaatgattagttattgaacaatatatggagaaatatcttacaaaaggaagtcatttccattttctaacatcttttacattgcactaattacatggtttaaatgactatccctaatcttcatccaactacaccccatgaattttaggtttatttaatcaacctagttagaccagatatatccttctaaaatcatttgtagatagagattctccttttgctagtaaataccattaacatatttacagaaggtctggtctaggtcatttattccaggcctctccatgattggattcatcttgcaaatcgtctttggagcccctggtatacaagttggactttagaatcagaattgattctagttcagaaagtactgggtaaaagaaattctttggaatggctatgattttatatataattggacatacatgaatacctgctatatctttattttttaattatttttattattattattattttttattttgagacacagtctcgctctgtcgcccaggctggagtgcagtggcgcaatctcagctcactacaacctccacctcccgggttcaagcaattctcctgcctcagcctcccaagtagctgggactacaggcatgtgccaccatgcctggctaattttttgtatttttagtagagacagggtttcactgtgttagccaggatggtttcaatctcctgacctcgtgatctgcccgcctcagcctcccaaagtgctgggattacaggcctgagccactgcacccggccaatacctgctatatcttattgtcagtggaaaacctacagattctgtggtcaggaagagttcctcaaaatggtatctaaagaaggtacctgatgatctagggaggtgttttatacactatcaagttgtgcttgtgcttgtattttatcttttgcaagtttattcacatttacattagaaattaaaatgtgtttttaatcttaacagtgtgaaagtaagcctacaaagataatttaagttcagatttcagtgagccctgaatttcctgttcaaggctggtgaacttttgaagtcgagtaaaggagtactaacataaaactcattcaggaaaattatcttgaatcatcagaaattatcttgatatcttgaatataccagtataaaacaaggaaactagttacagagttcttataattttcttgggtaaaaagtgtaagagtttgaacaagaacattgagatgcgggaaaaaagctttgttgaagtacatatagaggtatactggatttagcattcttttcactggaatgattatgagagtctttttggtattatggaactgtgaatagtagtttatctgacttattttagtcacattggactaaaagagaagaaatttccaaatagtctctccagatgtaaaaagtttataaaacttgtaattaaaatgaattcctatgtactgctattggatattactacaatgtgatggtgcaaattatattacccatttctatttctctttgtcatgaaaagcaaaaccttgtaagtaagagtatgctacttggtgactgtagttgggtaatagtacacctaggaaagtccgaatcttaagttcagaaaattttccagaaatctctcattaggtcattttagctataatagatttgtattcctcccacacattcatagtctaagcacaaaaatggttttgggattgaacatttttagaagtatcttcaaaataaagacattaaattacagaccatttttttccttctatattggattattttctttatatagtgttactattttttaagtaatacatatttatgattaaactcccatttcaggataccgtaatgttgacctaacagaagttttttaaaccccacgttttattttggccagatagaagtatgatcaggaaagattttggagctagagatgaagacatcagaatgtgagtctagcagccttccaaagagagctaggttatggttaattaatttttgcttattatttctctgaactattaggcttttatagtgaccaagtaaattagtcatttcacagaagttgaatgataacattcattttgcttaaccttttccatttccacaaatgtctcttcttttattgtagaataaaatgttggccttgtaacttttgatgttttttgtttttttttaaacagcttactgctggttgcaggggggacagttctaaaaatttgtgattttggtacagcctgtgacattcagacacacatgaccaataacaaggggagtgctgcttggatggcacctgaagtttttgaaggtaaaatggcaaaagtatggtatgtttgataatctccctcactccttgtgaattcatatgtttttatagattttccccatttccatggttttatttctgcataatacataaagtatacaatgaaatctaaggggatattaaatatagtgttatatcctaaattttatagtaagatttaaatcttctatgcttctaagcatatgtacagttgatcctcattgttcaccaatttcttaattgcaaaattgcctatttgctaacatttatttgtaaccccaaaattaatactcatggtgctttcatggttatttgcagacagtgctttcatgtactcgcagacagtgtgcatgcgctgagcagtgcaaattttgagtcatctaacgcatgcttccagctgaggttgaacaagacaacgtttttccgtcttgtttcagctctcatgctgtaagcaggtgtccttttttgtgctgttcagagccctttttcatttttgtgatttttgttggtaattttgctacttaaaatggccctcaagcatagtactgcctaagtacaagaaggctatgatgtatcttaacagacaatatacatatgttaaattatcttcattcaggcatgagttacagaaatgttgactatgagttcaatggtaataaatcaacagtatatatgaataaggtgtctttaagcagaaatacgcatgaaacaaggctatatattgatcagttgacaaaaacatggtgaccagaggcacacaggaacctacccctgtattttccttaggagcagtgattcagtgttcactaattcagtgttctcagaaactttatagaacataaataccaggaataatgagaattaactgtgcttttgtattggtttcctagcaattaaaaattgagagccctaaagtttaaatgaggatgccttaaaaagaatgcaaatagctgggcgcggtggctcaggcctgtaatctcagcactttgggaggctgaggtgggcggatcatgaggtcaggagatcgagaccatcctgtataacacggtgaaaccccatctctactaaaactacaaaaaattcgccgggcgtggtggcgggcgcccgtagtcccagctactcgggaggctgaggcaggagaatggtgtgaacccgggaggcggagcatgcagtgagccgagatcgtgccactgcactccagcctgggtgacagagcaagactccatctcaaaaaaaaaaaagaatgcaagtaattggacagaaataagatactaagaattacaaataaatgtcaagcttatatgtttaccttcttttatacctccatatgtcactgaagttttaaaagagttgtctgtaaattatatgctaggtttctgtataaaaacatcaaattatcttttaaatgaaagaagttgaactgaaggtatgtgatttgtatgttaggaagtgtaaatgcccataaaattcagatacattcagttaatcagactctggttatagcttatttctttcagttttgatgactttaaagggttttctgtttgtttttagccaccccagaggaagagaaattgcaatgcaactagtcacctgagtggagctcttttgccctaaaattcaatttagtaataaatgaataatcaggtgttatattacacaagattaaataatgcctcctgtttcatatacagaatgtatacatttgacattgttttaaaattatttacttatttaatatacctttatgtgagttaaaatgacccaatgttactgtatgtggagagcaaaaagatttgtttatacaaaagattaattttattgctctagacaacccttaattgtctagagcaacaaaatgcagactgttaggctgtgtaagtttcttcatttctgaaagatgtcagtcaacctgtagcccaaattagactgtagcatggttgtagtgctatattacagtgtactgcttagcatgtaaagctatagctataataattgttcattcttacagtgagttgagtgtttgtttgtttttgggagattatgacgggtgcttattgtgctggctgattcaaccacctacttagtttgtaaattttgctgtgtaactcaggttatccataattttcgttacttacaacgtaatgtttaagtttataaattaagaatttcccttcaccatatattgaggaaaaaactgtaacactaaattagaaagttcttctgctttgatagcagagtagtgctgtctgtcagagtgggaagaaaatttaagattaaaatgtaacagaaaggaggccaggcacaatggctcatgcctgtgatcccagcgcctcgggaggccagagcaggaggatcagttgagcccaggagtttgagaccagcctgggcaacatggcaagaccccatctctacaaaaaatttaaaaaattaaccagttgtgccagcgcatgcctgtagccccagctactcaggaggatcacttgagcccaagagtttgaggctacactgagctccagcctggatgagagtgtgagatcctgtctcagaataaaataataataaacaacataaaggaatgtacagatgtttcatactctgccccagagaaagtatcagtctaaatacataaaagtcaagtcctgtgcctcttgatgaaaaaactgcctcttgatgaaaaaagatagaaaataactgagtttctgaagtagttttttagtgtattgttgatacttaattcatttaaaaatgtacttgttgaaaagacaaagtacttcagaaagagtagtttcttagttctacatgtgacagcctcatttttatccctgatacccattctcaaaatttaagccattgtttctgtaagtcatgtggaaaaatagtctttaggttatatactaccttttttttttctaggtagtaattacagtgaaaaatgtgacgtcttcagctggggtattattctttgggaagtgataacgcgtcggaaaccctttgatgagattggtggcccagctttccgaatcatgtgggctgttcataatggttcgtaaaaagaaatttttcttaaaagtactttttgtgttttctacttggaagactactcctgtccccttccctaaagaatatcatttatctctaacattaaaatgtacaattctttgttaagagactgctttgctattatcagactctgccctgtccctgccccagagtccagcagagcaggattgagagtagtcctggtctacacatgcggctgaggatgttcactggctccgctgattagggaaaggccatcagtacgcaacctagacagttggctctctcttagggagaagcatcaggctggatcatggaaaaaataaaaaaatacatacataaaatctctgacatggttaatataactggagagttatagcccttttctcctgaagaagcaagggcctcatcaaggagaagaagcaaagaataataatgcttcacatatttttcctgtttatattctcacccacccttagaaggtgagtactgttgcctcattttacagattaggaaactgaggcctagagaggttaaataacttgcttaaggtcacaagattagtaagtggtagagctgggattcaaatccagatgcttctgacttgaatgctcatatcttaagtcatattgacttatggactcaatgtccttgcatctgtcctgtttcttttatagttctggtaatgttgtttttaaccacatatgatgttagaatgcatcctcttcattagtaaagttactttacatttgcttgggaaaatagcttttcatgaaggaaaattacttaccttcttaattttagcgccactcttagttatttcatttctatgccttgtttataatcatgtgactaatggccattttttacattattccacaagtctaaaaacaaatgtctgcctaattatttaggtcattcatagatttatcaaacagtaccatcatctgagtaatcttagctgtttttaccagtttcctatactgcctttaatattactaccattagtatcattgtggagactgttcagcattgaccaggacagcttgcttgcttgctttctatcagttgtcagtaaataattgaacgtccgtgaagtaaagagtaaaagaactaacttgttaattgataaaattacaaagcacttttattactccaaattacagatcttaaactacaagatctataaaataaataccactttggaaatacgtacaaagagtttgcatcattctttgggtaaatacattcttccccccttcctctcattttcaattgtaggtactcgaccaccactgataaaaaatttacctaagcccattgagagcctgatgactcgttgttggtctaaagatccttcccagcgcccttcaatggaggaaattgtgaaaataatgactcacttgatgcgggtataatccttcttttgaggggctttggatttaggggaatttaatatgtgctgagttttaatggaattttaaaagggatgttattactatattctgctttatatattgctatgttttctaagtgagaatgggcatttattactcatagtcagaagaggaaacatttcgagagggaaaatctagttctttatcactggaaagatggctagactaggtttctagacttgcttttttctttttgcttacattagtggacaagtatgtttgtctctgggcctgttgcctcatttgtaatgtgggagaaactgaaatagatagtctctaaagccatcacaggacttggatatattaatattatgacttcaatacatgataaactaaattttacatttttctgataccaattttcatcaagcatttagtcatttatgcaaggcaataggttgcattctcagacacatttatttgagtgacttttactatttggcctattttcaggtttttatatcccagtaaaaagttaaactttcttctatttagaagaacccttttaaatgattatcaaattttcctagtctgtgaatcaagcgcctttagaattatttggaatattttacgcctctggtttttggtacattaacaaaaactgtgaagtggtatcttggctttaaaaagttcaaatatctatgaaagtgcctgaattttgaaacagtttgttcagtagaagaatcttacaatctccttaaatatagactaagtaatttcctaaatggtaaaacgttgtttattcaatctattgaaaatttcttacgcaaagcagcttgaactaatctactaaaagtttaccatcgtatttggataccagtcatatatagaagcctaggccttaaaggtgtgtgcataagaaaacaacttagtctctgtagtcagattacttaaaactttaggatatataagttattgcagttgtaattttgcttctctgttccttgtctaatttgaggagaatacgtttcctttttttctctaaattctaacatttttgtccagcagatactttgagtattatgcctccagtttgtagaaagacattcataatctatcctcttaatatttaaaatgttctaacaattattctatggtatactagtctcagtcttcagactaacagtcactggaagtttacatcactactgtaagaacatgagtatgttttacataattatgagaaatgatactattttatttcatatgtttctctagagaaatatttgctgttttcttcaagactatctagactccaatgtaagctagattcttaggtaggtgcatggcattgatcaaagttgaaatccaagagtacattattgtaatctttgtaaaataaaaaacttaggcacctacaaatttagtatataacttagggaaaataaaacattaatcaggatttaatttgtattaaggaaattttaagctgtggtttacttttttatatatagtactttccaggagcagatgagccattacagtatccttgtcagtattcagatgaaggacagagcaactctgccaccagtacaggtaaatggatagattggaagagtattgacttgatttttctttcatctctattcccatgaaattataatcaagaagtaatgaataatgtccccatttgcattttaattccttcatttcatatgattgactgcaatttgagtttacaggtgcgtcattcttcatgtaggtaccctgattaaagagttattgaagacctgcttccaagtcttagaattcctacataattatgaataaaaagatggcatattgtattacagtgaatgtcattcttaacttgaaaaatcacttttacatgcatactactagatcaagtagtattagaaattattgtaaatgtatttaaacatttcttcatcacgaacaccctagtttttgttctcttctacagaggctctgatttaagaagctatgttaaaagttccttagttttccgaaatgtgaagtagtagtgggacatgtaatttgtggtcatcaaaaagatagtagaaataatactgtaacttagaaatattgtacttctcaaaatatagtggcattataagcatttcattattaattgaaacttaaagatatgtgtgtgtctatatgcacatgtatttaccctgcatttattgaaaaatacttttactgatctatttctcccacctcaagaatagttttatttattttaagatggttactgcttggctagttattctcaaattccagttttactgaaaatattttgagttgctctgaattctaaaatgtacttctctaaaattctatcatttgtgtctcccacgtcctctaaactctctcttcatttccttactgtgaccttgaattttttgagcctcccaccttttcactggtcctcagtcctcttaggtccttttttctttctccctccacttaattccaatcaactattataattcttttgggaataattttcatctttctagcctctctctcaagcttgcttggctaaaccacaagcctaatgaaagctgacactcggcttactccttgcctgtaccaatgcagctgagtgtggctggagatagcacaggtttactatcctcacgtgcatgtttagtgctattggacagttgtactgtattgtagttcatctctttcctcctatatgtcttaattttatactgtagcctctcctcagacttcaaacacctcctcgccactcctcactctcagctgatcttgtttgctctttctctgagaaaattggagtaatcggaagacagcttccacaacatctgtgcccatctactctgctttcttctgttactctggctaaactatccatacttctggccaaaggtgtacctttctgcctgtgcattatatcccatctgctcctctgagcaattctcccctgtctcttgcatcatcagttttagctttctactggatcattcctaaaacatacgtagtctgtatttgcattcactagcttctcttttccccttctttcttgagctgactccattcagacgtattatgccagtacttcagaattgttcttgtcaaggtcactagttatctctacatcactacatttaaggaatcattttcatttctcatcttgactctcagtagcacttgacctaattcattactttctccttcttacagacagcactttcttcagttggcctccgagataccatactagcctagattccatcttacatctctggccgtctgttctcagttttctttgctggttattcctcatctccccaacctagaaatgttggagtgcccagggcctgctcatttggcttcttcacttatctgtctgcactcatttccttggtaacctcattcattattatggccttatataccatctgttggctcataatgttttccatcttatacctgaactctatactcatatatccaactatttcctttacatctactagaaactcaaacttaatattttccaaactgagttcctgatacttccttcaaactcactcttcctttagtctttccgcatctcaattaatagccctcagttcttctactagctcaggttaaaaaccttaagttattcttgactattagaagactatttaggcatcttggttccttttttgtgctatccttaagtttctcttaaaatgggtttgtttggatatcttcattagcttgaaaagtcttattttatttctgttcctgcctggctagtttataaaagaatgtaagttacataataccaagtgaagcatttgtattatttccagccattagtcataaatgtttctgcttttcctaggctcattcatggacattgcttctacaaatacgagtaacaaaagtgacactaatatggagcaagttcctgccacaaatgatactattaagcgcttagaatcaaaattgttgaaaaatcaggcaaagcaacaggtttgttatgttattacaagtaaaactggtaaccttaccagtagtcacaatattatactaactgaaattaattatttaccatcttctattttataaatcctgaattttcttcctgaaacatgcaaaagagcttacaaatagagacacgtaatgagattctcctaccatttattaccaaatggtttttccttctaatgattgctacctttgccaattctaaatccctatctataataatccctaaatgtaatggttgatggttaaaaatgtaaaatgggtatattttggctgcgctgcccagttagaggagttgttctaagtctatcatttcatgctgttcagatttattatatttttgccattgttgatttttaaaaatatttcaaggagtgagtttattcattttgcctgaggcatttaggttaacgaataattggggcttttagctcccagttctagtgactgccttttcataaagacagtatctgcagcttgctttcccttacccctgtagctccctctcgtacaaacttccctctcctttcagagcagaacaggatctatcagaatcccatttgccatcttcctccttttaggttgcctaagattgctaaatctaaagaacttcagtaattcagattgacctgtaattttaacagagtgaatctggacgtttaagcttgggagcctcccgtgggagcagtgtggagagcttgcccccaacctctgagggcaagaggatgagtgctgacatgtctgaaatagaagctaggatcgccgcaaccacaggtaaaaaggaactacaagtctgaagagtgaaaatgtatataagcctttttggccatggtagtttcagttgtcaaaggttttttgtgtgtgtcttatatttttttttaaataggaagtaggtttacaatatatttttctaagttactagcaatagtttatgcatttatctcaaattccaaataaggaaggtatgacttgtaaaattatttggatgagaaagtatgccttcctcatttacagattttatcaaatgtaattctttctgctcaaacatgagttgaaagtctaagtgagaaattgaaattctgccaaaaccagaatattttggggattttcagtgatactactagatttttgtgctgaactcaaataatagcaaatattttgtttcaaatttaacagaaaaatgtattccagatccatgtatgatttgaccttctatctgcttcttcattccagtgacaaaataatagctaagctggttgtggttaatttttttaattgtaaaataaaatatcataattttattagatcttgaaaaagctagcatttaaattccattgttcagttcttaaaattattaatcatggaagaactggtcagcacaaaaacaattacatgttttgttacttaagtaaactgacaacctaattctgtgaccaggtttcattttagtaatgctggtttaatttggacgtttttggttttttgctgattctttccagggatcagggggagctgattttaaaagtaaacacgtttctgttgtggaaaatgtggaaatgtaaacaagccaaaaaaacttacataattaccccactcagagataaacacttaacatttttgtgtatttaccccatcttttaactatgtatgtgtataaatgtatatattcatgtgtatttgcatcttttttaacttagctaaccaattttttaggtctttttttcacttatttggtttttttctaaatagaatattctcattgtgtgtggagctcttttcagaaagaagttgtcaagatggaccatcatactatacttgtcttcaactaatcatgatcattgattttatcagctactattagaatccattagatataacagaatatccgaaataacagtgtctataacacataagcattatttttcacatataaacaagtctggaggtagtgggctctgtgatcttgaagtaactggtctcctatttctgtgctgtaatccctactgtatagcttccattctcaaagttatcctgtgctccaaaatggctgttgaagttccatttcatcacttctacattccaggcaataggaaggaagacatgggggcagggcaaatagacatccaagttctttgaaggaacattcccagatgcctctcttaacaacatccacacatcattggtcaaagtaacatggtcgaatggctacacgtagctccaagggaagaggagatctgccctcttttatctgatgacttttctgtcctaaataaaatcagagtactattgctaaaacagaagggaagagtggaaactggcagaagatagctgtgtctgccacagatgggtcttcagaaactatcaagttgagtagaagtcaccagccactgacaagcccatgagtctccatgagtcacaagtatttctttggagcagggttgtctcactgtagtgtcagatgaaccctactcaccgggacataccctcatgctttgaggaacccttttcacttcagggatgttgttcaggatagatctgccacatactaattgctgtctcaaaactgaaaattgttataataatggtttcatgtcttcgctagtatcatatttctagtcaagcactggttttttattattatttacagaaatgactttgctagaaggataaccacacacattaaaattttgcctaagtgtagaacaaatgctattgtacatcccttgagttttacacaatttaaattttttcatgaattgtcttacttggaaagagtcatactttccagccttttgacagactttgtgtttactgtgaatgtaccctaaactttggaaaatataataaatatttggtactagaaatatgtataagtatgactacaaaagcatatacatttcacactttgattcaataattattatttaatcattggattttactttatagcacacttcaagaaacacctaacttgaacatgtattcctgtgtttgtgtaattaaaacaaatacgacaacttactttttaacgcctttcttcctctcctccttcgttcccccacccccatcacagatcagtgatttcacttaggtagactgtttctatgaatatatttgaaattttgcttcctcattaccctgcagctttgtctctgttctttttatttttttctgctaattaaaaccagtgtgtaaaacatcttgtatttggtagttgtttgctctttaatctcgccttttctgagcatggatgaaaagttaggtagttctgcatgccattctgcatgaaatgttattaacatgaactatttgaaaatgagtctatttttgtagttaatcattttccgtgttactgtttgtggttgtttgcatgtatactgtatatatgtgtttttgcagcctattccaagcctaaacggggccaccgtaaaactgcttcatttggcaacattctggatgtccctgagatcgtcatatcaggtatcatagaccacctgagttggtctaatagctgtggaaccggaataatgatccctggtacttgtaaaatgcttcttgctccaatttttacaagacatgaaaatggataccttgcatgcagtaattagggagacagattgaaaaactacatttattctgaagcagtcttgaaaagatacctctgatctacaataagtgaggataaaatagaagagaaagtaaacctttttggagaagggagaacaccaacccagaattctaccaacttcctctctacttttaagtgagcacatgagctaaacccagaccttttttgcacccaacagaaagaggaaacaactaattaaaatttgttattttccttggctcctttccttcctcagttactgctttttgggtcccctctagactttctgtcctaacctctttctgttggtagcaagtgaatgtgaagttgagagaagagagttgctaaatagcattttgccttaacctggaaaacaaaaagtaaagctaaatgagatgtgctgttttgcagggtatcttgccaaagaatcatgtaaaatagttggtcaattctgatttttgtgtattatcaggagaatctcataaattacatgtttttatacctaacttacacatggtactttagtgtctaaaattggtaaactgctttatttcttatggtgatcatttcatagaggaatatgttaccatttttaatagaaacttaaatggcatattgaccttcagtattgattaatgtattatcaaaattatcatttatttatccctttaggcttttctctacctctttacccaaaatcttgataaggaaatacatattttccacacacgttcatgagtgcgagttggatgaattcttcagcatgctgtcctttgcctgtgattgtgtttttagcagtgttgataattctagttgaatacctaatggttattttctcctctactaaactgaaaactatgtaaggatagaatccatatctttgtgcattattttgttgttgttgcttattattgattgtatcagcagttgctggctcagtgcttcacatattaagcatattaacatagtgtttaataaatacatttattaaataaatgaacagacctattgagcatctcccctggtgagaaactagcatacaaaaatatgaattatactattcttaggtgccattttgtctgtataaaactatcttatattaattttcccctggttatcaaagtggtttcttattttacaacatcattactattgctattcaaagagtagagttaacccatttttcacatggtaatttttatttattgaatctggactgcttcagaaattaacaaagagatcattttacatggagatcagtttacctccatgcggaaaggtactgtgtataagggacgtactttaaagaggtggaagcatttaaacttacataccgctgaactgtgcttcccttaaatgtttgagggaatcaggaaaatttagacagatggcagtgtaatcttatgactaagcattaagaataaatttatatatggcagcgtagcccacgctatacaagataatgggggagggaaaaataaggaaagaataatagtttataactgtcaggtactactggcatctagtgggcagagaccagggatgctgctaaacatcctgatgtgtaccaggcagtcttctccaacaaagaatgatccagcccaaaatggcagcagtgctgaggctgaaaacccctgattagatgttctttgtgccctacaaagtagcttaaagtacatcttattttacctttatacaatcttacaactaggttatcggatgaaattatagctgtttaacagacgaagaacttagatctgatgatgtttagtggtttttccagaatcatatagccaggaccccaacccagatcttctgactccaagtcacatccattttttgttcttttgtttaagtcagagaagctagagtaatttcttcttgctttctcttagtgttcacattaaggagagctcttcagccagggagatcctcttttatgacattgggcctttatggaatcaggtaaccttaattctcttaattgccagagcagcagtgctattcatatgaaaatattattcagtaataccttttattaaatattctttttaggcttttcccccctcagatatcaaacattaacttactcaggtgcactttctttaatagaagaatacaagctgtagaattgacactagtggacataaaagccaatcatgaatgtgctcataggtaatgtttttaaattaaatataaaaataccgcccatcctttgggaatatctcaaatttcctacatgacattttaattgtaaagaagggtgatacttaatttccaaaatttcttaatactttctagaaattgttttgttctaagtggatttcccacaagctttatggtattagcaaatacttcttgatatattcaaactgtttaattagcattaaaacccaattgcaaggattctttttaaatatagctttttaaagatcttatttacatggataagagtttcgttaatacttccctttggccaagtgcaatgtactgagtctaatgtacttcttggaatgaactacctctcttaataagagcaatccttcaagcatcacaaaaaaggttttgtatatatatctttaaagtcactaaaatgtctaacctagtcataggtaaagaaatgcaaagaccctaatcttgtaatcttgttttttgctcgctcttcaaaatgtgtatactatgccatcagtcaaatgtggaagaaaaagcaacttagcaaaacagcactatttatcaatttagtagtctctcagatcatacagaaattaacctttaataccttaggactccctgtgggtcagactgtacaattttttatacctcttctaccatattactggctctgaagaactgacaaacttttgtacggtaacccttccttctttccactgtccatctgcccttaaaagagtgagctttatagattagcctggctcctttttaccaaggaagacacgcagctaagagcaaattaccagtagagtgtgtgacattttgctgactcttcctttgtagagaaggtcctgccaagtagcagtgtgctacctaagcaaagtaaatgtaaatgtggaagtttcttgcccagtatttagaccatatgaactacagttttctaatgcatttgcttgctggtaagttggaagggacttcgagaaaagaaatagattttcttaaatgttttttattaaaacttgagttttaaaaaccatatcctttctcctttcagccagtacatctaatttgttacatttatatttgaagaaaagggaataggtagcagattattggattctttgaagtttttctagattttttttgttctaggactttaataagggcagtaagaacacagatcattgttttgcatggattttctttactttttcccatattttctttttgtcactatctaagcttccaagaatctatttttcacccaccttcatctcaagtacacaaatgaaatagattattgggattgtgaaactatgtaagacattctaatgcagttcatctgatgttagaagaatacctaaattttacatttcttttaaaaatccaaatgtcaaagaggaacaggtagaatgcctaaatattacaaaaaaagaggaacaacctttttcagtttaacatgtagagtaagagaataagtagttaagaaagcgaattatttttcatgcttgtagcatcagtaatggaagatgggttgttctgctctggagcctttgtgtgagtagttatagcatttaaggaaataaactgtaattataatgcattctaaaatctactggaaaaaaatactgtcatatacatatatacttaccacctataaaagatttaattaaacattagtcttctgcacttctactctgatataaaatttgttgtacatggttcataccggcttgattgcttttataaagtgaaatgagtttcccaaatgtgatatgcaaaagtaaaattttctaaattacagacatttttaatgctattatatcatcatagataaatttatttcttagttcagattagattataatgcttgatttcaagtacttgaaaaccatccattctatagatgaacattgccttgaagtgcttcaatttgagaaccttgaacagtgttgctttagtgtaccttttgttatttctaagcctaaaataatatggcataacattcgagagcaataaaatgccttgaccaaagaggattttctgtcttacatactgttcttaaggatatgcaaaagaagattgaatatacaaatgtttttgagtcagatcttactgaaatagataagatttttgcctagtttcctgaagaacctgaacttaattgatatttattgtttgttatatcattcttaaagctaaaaagaaaccttaggtgtccttatgatttcagccgcatttagatctcttaactgaataaaaaacgcgtattcgcttttaatttcagtcaaggacgtttagctctattgtatattggttttttactaacagtatgataagtagtaaattggagtaagtagaatgtagagaggcccaaacattttaactgaaaaatagatgagtagttaggcttctaatacttgtatcttgttgccctccttcagaagtttcaaatgtcaggtattggcaaataaattatctaggtggggagggctttatagaatgcttaaacaactggaagcagagatgcttttcaaggacacctgagcactattttgctttctccaccaggatgaaaatatcacttttttaatagtatatttggttcaagagccggtcggtaactaatgtttgtaaacctttctttaactggaagcatgtaagttattaaatatttcctccagactactgcagcaccaatatgaagaggcaaagagagaaagaattgagtttttctagatctggcaagttctcacctagcacagatagtgtcattagcagatgtaagcctttgatagggatcctagggctaaggggtgctatactaagatgtactgtactagtttctgtgtatagccacctcactttcaataaaattctctatttgtggcatattaaatagggaagttaatctaactttataatgaatatttaggtggcctttctgccatattgtatagtctaccaagatcactttttgtaatctaaaaaattcaactctaagctaataaagctggtttattggaaagcaaataaaccacctgacggacctttccagtgaaagagccagaatttgttaaaattagtaaagaaatacgaaactttggcagcctaaattagaacatatattttaaaattacatgttcagtttaccatgaagcagtaatgtaatgctagtgtatcatgctatgcatttttttaaatcttgggtattttacacatgaagagaatggtgtcccataatgtgtaatattcaaaactcgtgaatctcaaaatttctaacatttaggttaagagaagtctccaggaaaatgtagtgttgattcttacatgaagacagtcttcaggaagttttaaagtagaaaataagagtagtgtaagtcaaggaaaactatgagcttaactgataagaaaaattacaggagtggctgtctgggacctaagccagcagtctctggaagaaacccgggataacttttaaataccagctcaggaaatcagttgtacttaaaagagcagcttttttgaagaggggctctgttttaatgacattactgtaaaaagaatggaactgacccctaagttgctttctatttgcggtgggcaggagtgcagatttagtatgcactggcaatgtgatgtattcttagaagtcattctaaaaagtggaatttgttctctattataagacatgaacgttccagaattcattacagaatgaaatactcaggatagcatatgcaggtttcagattccttgatcaggcatctgtttacatcatgctgtcctcatttctactactttttccatttacactaccatgtataatataggtatgtacatatcaaaggaccaaaaaaggtaaaatgagtgaatgtctaaattagtattcagttgcaaaaaacttcagaatcaattcaaatttactgagaacacacccagtaattttcatttgaagtaataggaggttgatttttcttacattcatatttctaaattatgacttaaaatttaatattggagcaacaagtatttgttgattgcaatcctgttttgctttgtctgaactatctgccagatggtttctgccatggttgtgctaattaaaatgcattgcctaatactgcttgctttgattcatgcagtagcttaaagatttctcattttatggcatttgttaactgtcagctcttctttaccttacttccttaaaaggttttacttcccttttctcctatccttccacctaaatttaagttcagtttttgttgttattgcaatggtgatgtaatggtttatagacacatgtgtcgggtggttcctcagattaacaaatgttgctgtgttgctaatctgaaaagagaattccagacacttttacaagcctgtctcatcaccgctaattttagaatgaatgtgttgaatgaaatgtgcctaaaattgcttattagtcacggttgtggggatcctttttgtccttgggaaacaggggtagttgaaagtattcagaaaagtaatctagtggatctaattcaataaatgcacagttttgttgttttagtttgtaatgaaaagttgaaatttttggaataaaatgaaatttgaagtaaatgtgaattcagataatgcaaagaattataaaacgtagcttaaaatggaaaaaaactgatgatgtcttacatttgcaagaggagttacaaatttgagtttttatattcactacacatattattctattaaacattcttattccattgtaaggtccttttagtttatctgcagcataataatggggtcatgtgggttaaggtgctaaattatattgctgattggttttaaaaggatgtctctacgaaagattctggaagtctaaaattttaagaatgaattctgtctactaatcgggaaactacaattagagtgagtacatgttctaagtgttgcccactagttgagaaattacgtaatacagatttcagagtcaaaagaattttgagtattgtatcagctgttactcagtattttggtgtttccttttagacagctgatctctcacgttagaagatactgcataaacagctttattcccaaataaaagtgctgagtgaagccattgctcaattcattgttttgctgaggacttatatgtgtagaattctctcataaattgatttttaattaaattaattataaacatagaagtttctaaagcagaattaacacaatagcccatttcaacaagctgtatatttgagaacagagtgacagttattaacatccagtaggaaattaagagttgttgttcacaaataataaattactagattctgacaaagactaatggggattaagtaagcgtgactcaatataacaaatttaagcctaagcatcttctaggccctgaaatgaacaaggtattgctgccagttaaagtcagttgtgtcttacaacctgctagctgtcttgctgtaaaaactgtaacgtaaggcccttgaaatagatgccgtcatcagccccagcccccaagcattcatctatttaaacacatgacagaagatggtggaagagagttcagcagctattcatgtggtagaagtggttattgtattaggacatactctgttgtaggccagcaacttttgagttaaaacaccgcagctgtttctcttcctttctttacatctttctcttcttttttttttttcttagcaataaactcacttttttttccccacaaacattttgtgtagatccaaggagcaacaaattccaactttctgctgtagcaattacacgctttttgtctgtttgactagattttagtattttactttttttcttctttttaaaggcaacggacagccaagacgtagatccatccaagacttgactgtaactggaacagaacctggtcaggtaagacaacattcaaattttctatctttgaagaatactaggcagaaaacaagaattaactgtattctactctgcaaaattagttttatgagttgacctaaagttgtgatagagaaattcattgcacctgaacttaaatacttaggggggaaaaaaacataggtgccattgttaatttaacttgaaagataatttattaaagtaggtttattaaactccatggaaaagtaaattgttcattagcgctgtatatatgttatatggttttatgtatgttttaataagtattcaattttataatttaacaatttatcattaaagtgtcctttaaagtgaatcattaatatgtctcctttttactaataagggtagtaaacatttccccaataagttgctactcctctagcgccacgtagggcattacatggagaactctaacgtcttttaacttggcatatccactggattaatatttttttcaaatatccttaagataacatttactaagcaaatgtgtaaactctcgaaaggcttctattccagtggttaagatttcattgtttatatttctggatcctcctctaaactctccttgtctctttatcactgctgctttgcagatgatgcagacagtgttataatttaagccattactgattagtgcagagttttaacccaccaggtatataaaagtagctcagtcattgttttttctgtgttactcagattaatacacttgacatatataatttattatatactatattctgtaaaatgaatgaagattaattataaggtgtttgttttcagctgtacaagaataagttttatgagagcagcataaaagtaatgaaattaagtaatgaaattgttacatattaagaagtattaagtattaaattattaagtattaagtaatgaaattattacatcgtgacccatatttttgtaaaattttagcgtttatatattataaacaatctgttgtaatttatgataatatgtattagtacttgtcatcctaaaaaggtattttattattatatcatttgtataatatacttaaaatttgggagatcctttgtagtcattaataaaaaagtcttttatacccatcaaccaacttaccaaaaaccacttcaaatatttaagtggtgaatatccttgatcttcatttatatctggaaatatgtttatttcacaaaatgcttataaacacatatataaataaaatctatatagacacattaatttattatgttttgtgatactagtgactctaaatcttgatttcattatttagtgatagtttttttcagtgcatctgtttttgtaagaccccagaacttttggctgaagtttcccgttttctccccctcagatacttaaaagttttaatcagcccatttagtaacagatagtttgacatctgctatttgctttgattctttggaggtttgatgagctcagccttttaaactctgtttactattgccactgatattccagttatgagaacttctagccaactgtttgactaggaatgagaagcttgtcctaagacatgtcaggagcagctactagtttgaaagcttttctgtagactctagaataaaagtgttgccataattcaggactgatcttcccacaccaagtcttacttatttcttcacaagttccacattatttgagattttcgttgttacccttttaattcacaataccttcaggtagtaaaacgctggaactgaggccaactatgggtgtgggacagtcatttgtggaattgtcatagaccactctgaaagatttggggtgagggagagtttgatatgggtgagggagagtttgatatggcagtaaaacctgttctgaaacaggtgatgtatgaccattgtgtagccacattttaaaactgatccactctttcaaaattatttgtgttatagccttaaaatgcctaatgttcagcttggcatgagagtggcaaatactaatcctaatgtactatgaaaacatttctcccaaaaaatgtatgataagtgaccattaaatcttttaaattactcacaaagatgatattcatttgaggaagaaaagtattcacaatatgtgttttcaaaattggaaggtgccatcctttttgaagtctggctaagcgtgattccatcttgcagaggaaagtaaacttattgtactgtggctcttgactcaaaacataatcttagtaaaaccacttagaatttccatctgtaaactaaaattaaattggttgtttttctgctgccatccatttgagaggaacagtaaatgaagcaagcttcttaattaaaagtaatgatataagtataggtgtaaaagattgcattcttacaacatacaactcactttcaaacatggttttttcattaattcaggaagctttttaaacactcaatagatgtgacttcctagaagctttgaaaagatactgagaaagaaaaaagcagtccctgacatccaggaactggtttgacactgtggcctcactgttgttagtagctagccttattctcaacggctggctgtcacagctagagcatgttactgtcttattggacataatctctcagaacaccaatatcagacaagataatgctgagaccgtgataaaaggagacaaaacaagactacttcggaatgttttctaagcacagacaaaaacaaggtcactgtgccacccacaaaatacctaacattgtcctctcccagctattaagagtgactgctgcttctttaccaattacagcttggtcctcactctggactgccctccctgtggaattgcccttgctttctgacagcggccaatctggaacgaacccctccttcctttgagtttccccaaaatcactcaaccaaagcctaaatcctataatactttctttttctaaaaccctcttactgagacaccccatgctgccccatggtaagcattctccttcactgcaataaatattaaacccaactctttccactattggtgtgttcctggcagtctttggctagagggctttgacaataccaataaagcctattccgcaaggacctcatttggagagatcagacttatgcccaaatcaattagaaaactaaagtaataacagcttccatttgttgtgcactgactttgtgccagataggctcttagtatacattatcagaatgttaatcctgttatcaggatcttagtcctgtgaagttggtactttttcacctaatttgcagccaggtaaagtgaggatgagagaaactgacctaagtctcttacttccttatactgccagtaattcctataaccaggttttgaatccagacctgattgcaaagcacacaaactctatactttaatcattctaacttgcatgtgaaactagatgtgatgcatgctgttatagccctagatctcttacatttaggtattttggcttctaatagtctgcattgtcattaattatttaaacagttgttaagtgatgatgaattgtagctgtatcatatcattgaacaaggttaacctatcttgataataaatttctaccaatgactgcacaaatttatgttttatacacctgggtgagccattctgtgtttcactaaaacaatatacattcttataaatgcctgaataccccttctggaattgtattcagtatagatctatattcaagaattctcttagaggaggctgcagtcagtgaaaattacgactgcaagatgatacagttatgattatttagagaagtgggcatattacatttccatatggactttataatctacttttactagtcaaatatgtgactttgggcaagttccttaatttccctgagcttctgcacccttatctgcaaatagggaccataacacccacctcccagagttcttaacagatgtgaaagtgccagggcacacagtagatactaatccatgttgtatgccagcctctccacagtgtgcctcaccgggctcttgatatcacttccttgctctcatgatagtgagaaataaaaagaaaatagcacttggaaagaagtaaaatccaccagcgttctttctgtatcataaggaaaccttgtgtcaaggatcatggaaagtatttgctttaaaggtctcttatcgcatattgagtgatattaatatacattgttattatttatttaagggatgtgatttattatactacttttttccatcttcattctgcacctccttttgtgtaaacaaatgttctggtaaactctaaatcagaaacttatgtaatagttttgaataattccttcttcatagtatacctttctattggagaatagacacgtttcttcttttttttttttttttccgagacacagtccccgctgtcagccaggctggagtgcagtagtgtgatctccgctcattgcaacctctgcctcctgagttcaagtgattcttccacctcagcctcccgagtagctgggattacaggcatgtgccaccacacctggctaatttttgttttatttttagtggaggcagggtttcaccctgttgcccaggctggtctcgaacttctggcctcaagcgatctgcccgcctcagcctcccaaagtgctaggattacagtcgtgagccactatgcctggcctctgttggagaacagacacctttctattgtagaagaccatgtaagaataataaaattctgaaatttccttatgaaaaactgtagtgaagccaaaatagatcaagcctacagacctttagattagaaagaatattttcagtacaaccttcatgtatagatttaattatctgtaactaccataataagtacccatgtaaatccacattaccaacttatacccattttaaaaatatttatattattgagatgttactttagcaagaatatcatagaagtcatcatttaatctctgtgttttgtgcttgtataattttagctactaagatttctgagggtattaaatagcttttaaatgtcagtctaaataataacactgggtgtaaattcctgacttatgaaaatattttcccagtctttcaggtaagatattaaaagctgagctttatttttgtctgtaaaataacttccaattcctttttataaatatagggataaatttctggtcaaaggccaattctggttcatgtctactgatggtaatctgcccctgaggtttaaatttggcttagtattcttttgctgccttaaattgctgtgtcacgtttctatactcttgtgactttcatatccagttcttttggtaagtcaagtttgcctatatctcttaaactttgcaattaatgtggggatagaataagtaattttaaatgtcttagaggaaggagcaacttaaatgagttttaatagtttgagagcatttgtgaccctcagaattttaccagtgattttaaaaaataagtactgtaaaaacttcttcagtagttggttacaagcagtaacataaattcagccacaaactagtttgagttttttcattgattgtcagatgttatgtgttcctcttatttatgccttgtattattcacatactcaaaaactacagttatgccttgtttttaaatatttccttagtttttttatacaaacatattagcatatttttatttattgagatacacatttcttaaaatataaagatttatttattagttaatggatttaaatctaactgtgctggtctaaaaacagttttgaaacttgcattaaaagtgcaagccttatatttcttagtttcatagctgttggaaattacaagtgggacaaacaagcatgcacagaaggtgctaagagtttcttggaaagtagaaggtgaaaagaaaggtgtagcaaagaatcattttgcaaaagatttaagcttaaggagtactataaaattcctattaggtccaacttatttgttttaatattgcagatgttcagtgacctcttttttaaatatactaaatccattctcattttaaaaacctaattattacttctactgtattttgttgatttctcacaactgatactgattcttacatgtcacaaacatgtgtttctctttttaaaatgtgcattagcattacactgactctgaaaccctggtctgccaccactttgaaggaaaaatgcctttgatttataatagcagttataactatgggcatatttgtgtacttgctttcagtcaaagaaagttaaaaagactcaggaataatttcataatgtctatacttgctttgtcaagggtaaaagtatcctaaaagtaagagtgaaacatttcatcactggttttctttggtgtatgtcgttgttattcttatatactaaaggtaaataagcttaagcaccaatcttgtatctgagtgctaatagcttgtgttctcattttattcaatgagtatctattatgtgtttattatatattcagcaatttcccagatcctgggaagtacaatataaaaagtacgcatggtctctgcccttaagaggttataatacttttgaagaggagtaaaactttgagactactataatttcgggcacaagttgaagtaggaactgactatacagccaaaattcaaagaagaaaaaaatctcgtgtgaagacatttcatgtacatcatttcatttaatttttataaccttatagatagataatactgtccttattttcctattgagtcttagaggttaaataagttacccaaagctgtactagttagaaatggcagagcacagtcaaactctgggctgtcttgtctccaacacccaacttcttactgctactactttttctcattcacacttcatcaatgagaaacctaagtctcagagaggctaagttacttacacaggttcacacagctgtaagtggcagaatggagacataaccccaggtctccaaagtattagactgaaacatgtgaagttgctgagttttcaactacaaaaacaccagttttatctggttcagttttatgcatgccctgtgcactacgccgtattatctttaggtgaatatgaggtcaggattaaaaactgcaagggaaacaggggcatgaggaattttaagaggagagaaaatccagatgggcaaggtaaacctgctgatggagagtcatgaatgccagagtgagaatttcagaattgattcagtaacaatcagtaaacgaacattttgcctgcagtacactgttaggcactccatgtcctcaaacacaaggtctggccttgtacacaaacaaccagagaagtggcaagaatcaccacataatgtagaagaaaacctgagctgggccttacagggtggggaaggattaacaaggagaagaaaagaacagaatgagcaatcttatatggagttaaaaattggttatggtgtagaaaagctttttggaatttctgaagcaatttcagtgggtacccaaaatgaaagtcatatttcatcagtttttcttcaaagttaatttatgatttttttctctgaaattgttaggaaagtacctttcactaaaagtataattagattgtttgtaacacaaaggataaatgcttgagggaatgggtaccccatttttcatgatgtgattattatgcattgcatgcctgtgtcaaaacatctcatgtgccccataaatatgtacctactatgtacacacaaaaattaaaaattatttttaaaaaaacagaaatgagaggaaaacaaagtacctgtcactgtttattatcctgaatccattgtggcttttcaagacctaaaatcatataattttagcactatatggaacacttctcatcacattcttaacccagccccaacccctctccagataaagagaggttgaagtgatctgaagcagacattacagcataattagaactcacatacgatggattctactcaaaggtacttttgtattgcatttcattttacttgttgcagtcttgaatttgagtgtttgtatatatgttgaagctagatataagattcttcatgaatttattttaagttttattttctataactccatgttcttttttaagtctcttctttggtactcagtaacacatcaagaaaaaaaaggtgctttttaaaaagtccttatgaggccgggcgcggtggctcacgcctgtaatcccagcactttgggaggccgaggcgggcggatcacgaggtcaggagatcgagaccattctggctaacacggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaaaaaaagtccttatgaaacccattttagtttctgtgtcctttgaaaggctttaatatatgaaatataaatatgtagacaagaatgtatataatgtataagttatgaaaataaaatgagcacttgtgaacccaccacccagcttaaggaatggaacattagcaatcccagtgggggttggtccctgtgtgttcctcgcctgtggccttccctgtcatttccccaccaaccctcagtgccatgttctgtcatatgtcatgtttccagatatcataaataccttttatctgattaagaagtcctcttcccactgggcacaggggctcacacctataatcccagcacgttaggaggctgaggcaggaggatcgcttgagcccaggagttcaagaccagcctgcacaacacgggcgagaccccgtctctacacaaattttttttaaaattagccatgcatggtgccgtgagcatgtggttccagctactgaggaggctgaggtgggaggattacttgagcccaggaggtcaaagctgcagtgagctgtgttggtgccattgcacaccagcctgggcaagagaacaagaccctgtctcaaaaaaaaaagaaagaaagaaaaagaaattctcttctcatacatggaatttaagtttgttaaatgtcttttttataagtagatgttaaatgttgtcaaatgctttttctgcatctgttgaggttttgtcctttaatctgttgatgtgattaattttattaatggaatttcctaatgtcagatgagtgacctttgcagtcatttgcaaagttggataaactaaactttttaaatggtttttattgcttctacactgccacattatatttgctaatataatttttagaaattttgacttttgtgtctttttatttttattttatttttttggaagtgaggttcagttgtaactttctttctcacactgtccttacatattgatttttactgccttcacagaatgggtcagaaagtttcttctttctttgtttaggataatttaagattggaaaaatccttatcttgaatgtttgatagaacttacctgtaaaaccctcctctgtgcttggtattttctataatgtataggaatttttgaaacttttttttaaagaatgtgttcatttttatagtattgtctccgatttcaaaatactatcttttactatttttcattttgggaggcaaattcttttttttaactaagttagatctctagcttataaattgtcagtgtttctggttttttcatatatatatttagaattaaatattttcctttaaatgctcttatagtcacatccccaagtattagcatgattcacgttaaaagtcagttcaagtactttctaatgtcccttttgttttcttctttgaccaatgagttatttagaagtgtttttcaaaacaaaagatttttaaaggttttgaaatcagtataaaaagtaattaagttatgatactgaaattttttttaactttgagatttgctttatagcttagtacataatcagttttcattagtgtcccatgaatgcttaaaaagaatgtgtattcttcatttgctaggcgtaaagtcacttatgtttagattaagcttgttttttatggagttcaagttttactgtgtgtgttttgttttgtttttttggtctccttttatataatttacagaagaatattaaaatatattactgtggggctgggcacagttgctcacacctgtaatcccagcactttgggaggccaaggtgggaggatttcttgaagccattaggtcagcctgggcaacataacaagatcccatctctacaaaaagtttaaaaattagccaagtgcaatatcatgtaactgtagtcccagctactcaggaggctactcaaggaggatcacttgagcccaggagtttgacgatacctccttgagcttttttactttatgtgtttatatgtacagcatataaattttgaattgttggccaggcacagtggcttatacctgcaatcccagtgctttgggaaactgtggagggaggatcacttgaggccaagaggtagagaccagcctgggaacgtagcaagaccctggctctacaaaatattttaaaattaactgggcatagttgtgtgtgcctgtagtcccagttactcgggaggctgagatggaaggatcgcttgagcccaggagtttgagggtacagtgagccatgatggtaccactgcactccagcctgggcaacagagcaagaccctgtctttaaaaacaaatctcactgtgatggtggatatgtcctttttccttgcagttttttgatttatctatttgtatgtacagcatataaattttgaatcgttggccaggcacagtggctcatgcctgtaatcccagcacttagggagactgaggcaagagggtcacttggggccaggagattgagagaagcctggtcaacatagtaagacccatttctacaaaaaaaaattagtttttaaaaaataaattttgaattgttgtattctgaattgaaccacttatcatattatctctttctctagtaattttttggaccctaaaatacattctctctgatattaatataggtaccttatttggggtagtttttgcctggttttctttttttatcctttaactttctgttttctctgtctctgtaaattagatatgtctcttataaatagcatttaattcatcctgacaatctgatttttttttaaatatcttaactggagagtaattcatttacatttattgtggttactgataagtttgctctcttatgttttatttctctttcttttctttcaagttttgagttgaataaatttattcttcattttattattttctttctggtttgggagttatatattaattactacttttagtaaatacctttgaaattttaacattcatgcccaacctagtaaagatctgtaccctcatcctgaacaatatttaaaacaaggagttttaagtcagtgcttttcatgcttgtgctattgttattataattttagtgccatcttgtttgtttgataattctataaattcactgtttctgtcactgaatgttttcagtgtgtagatttatttccctgtttatcactattccttattgcatcttgatccttctatcaagtaaaatttttcttcttccaaaaatacatgcttgaaaaacttatgtggtaagaatgtatggaaggtaaactcagtttttgcccatctaagaatgttattttggcctctatcttcaaattttgttggctagacaattctagactggcagttatttttcagcactttgaagatattgttctgctttcttctggctgctttttctgtctcctgttgattgtttcctagaatttgaatgtatacgttccatgttgaactcaatttgtgagcttcctcctatttcttatgctggggatttgttgtggttggaatttgttgtaacctgcatccaatctggaaattttttgtggattcacagttaatacatttctcccttccacccagagccactaacccaagagagacaaatttgtttcctgtctgcttttgtaggtcagattttttttttcctagttgagtgaccttttctctgagagtgaagcctttgctgagttttagctttaagcagaggtttctccagtcttacttccatcctacaaaggcccaaggctttatggtccattcctctgagtgcagcagcctgtgaaaacagtagctctaggccattggtgtttagttgaaattccgagggctgtcagcttaagcacttactagtttcctgatattgttttgtttctaatctcagagtatttcttagtttcttgcaagctcatcagtttttaataggtatcatgcgtgagtgaatataaatttttacatatatataagagaggatttattttgttgtttacaagagttttggggggatctctaagtctcttcttgccttttaatggaaacgttctcgtcattttttttaatcaaaaaatcacattttgtttctcctgtgacttcttcctgtaggtgagcagtaggtcatccagtcccagtgtcagaatgattactacctcaggaccaacctcagaaaagccaactcgaagtcatccatggacccctgatgattccacaggtgaccagtctgtttcttcatacttatgaagttgaatcagtcatgtttatattcatttggccatgtcattactctaatgtttacaaaggcaggcattatactgttgtttagatttttatattaaataaactatttagtaatacatgttaaaataccattttgaatacagagacagagactgccttgccttctgtattttttttaatccagatactaaacatgtattttaaagattgtctgtttggggtttttttccagttgcgaagcgtattgaattcttgatacttcagcctgtgattttcctactagattcatcctactagatgatagtagtaaagtcattttttcagtaaccaaaatcggagaatggtaaaaatcatccccatcatcttcatctcaatcttttaaggacacgagatgtcatgtaccttaagttgaaaaaaattctgaccattgaccttttgaattgtttttaactgataagagacaccattttcagttatacaaatattctattagacctttagaaacctgtgatgagttattaaagctccccaacatgaataactaactgttcacaatattagtattaatgtctacctgcctaaaggtagtgacggcatcgtttcattatgggcaaacaggaaatgatgtgccatagtagaattaacttttccctaactttaagagaataccttgataaatgcttttaagtgtacttatgaaattttttatttatattatattaagtcacgaagggaaagatgatctcttagcccttggaaaattaaagcatttgatattttatataagatcgactatgttattaatagtaacaattagattgaagtttaaaagccagctttctgtctttacaaactaaaatacaactcaagtatttatagttatctgatgtggtttggtcaagtttataatttaatttaaaaaattaactgggtggtttttctgtgtgtcatgtaagatagaactatgtttagccagggtgtactctctagttttagtaagtttaaatttagtggcggcaaaaactcctgtttcacccctagcacagcccaacctaggactgtccagagcattcaccactacgcagcacatgtgtagaattcattatagacttgctcctccccagtggtagacagggcaatgctcttgcccagttttatcattaacattcaggtgatagcagctctttttgatttctgaaccccctggcaagggagtacgttctctgacattacagcatttgcccgggtctggtactcaactcagcagagccttctgtcttcagtctacactaatctgtatatgccagtcaatagtgtggcagattgtgacttcatgggggtaaaataaaaaatgtttaaggctctctctcacataactgctacatttctgcctcatatgttgcttctaccttccaactcccgtcccattgttttctttttctgtacctagaaacaccacaaaataccaattgctagaaataatttgcaatatcagctgaattttgtctttgccttgaaatatattgcacatgtgtggctataattttgaatacattttaaaaatggatgctctggtttaagtttataattaattcagctgtgcagtatttgtaagaaaaatattgataaccaagctaatagaataaattagggaacagataggtaaagtctttttctttgaaggcccactgaccaaggaaaaaattaagagtgtaaatgtaagttaaagtgacctaattaaatttttttaatttgagaggtttttgtatattttcagagaaagctaaagagcataacaatttaataatcatagccgataataagcgctcttcagttcctatttataatataatgggtattcaaaaagacacacatactgagaggatctagtgagagagagatctagacgcagtagagggagccgcagagggggaaactcactaaagaattttcacctttgcttagtactttgcaaacatgtattaatataaagtgtaagacatggcccattccttgcagtctggttagagtcataatactgacacattaaaagtaaacttatactatataataacttactaaatttatagtacaagctgagtgttttgatagttgtaagagaaatcagttcaacaagacttggcatagtctctggccttttcataaaatgatgagacttttctttagccataaagcagaaaggagaaggcagcattccactgaagggaatgcatactcaaagaatatgagatagtaacaagtgttgtgtttgaggggtcagaaaagagagtttgccttaatttaaccaaaccaacatgagctttgacattcaggagaagcaattagatttgattagcaattgaaacacacacacacacacacacacacacacacgcaaaaaactttcattaaataatcttccgatctgtgaccaattattgctagtagagattggaagttcaatatcaatttagtgtaaagtgagaaagtgaaatcccacttctttttttagagagaagatgaaattcaatgaaggaccttaagttccccaccatacaagggctttaattatttgaataacacaatccttggactttttttctgctcccagaataccacgcaacactgatgtattaagcttaattctaaaatacatatcagatacagggtgctgatataatgagatatataatgtatcagtgatttaagaaagaataataggaatggaaatcttaaattgaaactttttcaagacacttaaatttttctagtaaatcaggaggaaatcagtcatttttaatcagttttagttttgtggaaagcagtgtttatgtgggagcgtagtttgaaaccactgttggggtgggagaagagttggtcagagaaataacaaattaagtatatttcttgtttagccacttcagaaaaacacacatttatgttagtactgtatatgagccttaagggtaagggtaagtgccttaagtctctactgtttttctgtattgccctgcaatatttaataaacattactttttcaatatggaattcatactatactattttaaattgttctttctaattctccatttagtatgaataataatgataactaccgtcatgtattgagtgcttaatatacgccaggatttgcatggtgttcctcacatgcactggctcatttggtctgatttcgctaattagcttttggagtttcttgagagcacgttctcagtggctttaaaaaaacaaaaacaaaagcaaaaagaaaaaaaaacacctggattatcagttgacaataaattagaagattactgagccagcaacccttcttgagtttttttggattgcatacagtgcgtctgctgtcttcctgacttgcctttatccacaccactccttcaaggagttattcgtcagaaaaaggctgaagagctcactcatttagctctttttttgtctactaacagtgggaaagcaactacttctgaagtagaaaagtctgtattgcttcagagttactctgtttacttctggaactgttctacataaccataaatgttgagaagagactgtcccacgcatctcagtcaagttgtatggcagttttacctcttttgaaatataaacaaaagcattctattcaaataattttataaaattgactgattgtttgaattaatcaacttaactgttttcggcatgacattgagccacaggtttcaacctcattttggttccttactgttcgtatttgtaatatactctcatcaccaacatctcgttttctgcagtgattcttactgggaagggcaggatgagtggtggaggtcacattataatctatataaattgaaaatgatccactggaagagaatgtgtctctgctttctccctttccctgttaaggaacattgatattagcggagttgatatagccttctataaaataaacttagcatgataaagaaaagagatggggagtttgattagatagggtcaattaagactgaatttaaaatataaaggtctcatcactgtttttgtttttaattaagagcttagaagctctaatatattgtgttctattcagtttatagccaacttaaattataggtatgagaatataattgcattctaatatctgataattgaatatcctttttttaacctttagaattcagaaatagactcttcaattaccaatagctgtaacttttaatttacatattatttactttagggaaaaaaagcatttcattcatgctttcttgctgttcgtttataattatttgtgacagaaaatcaataaaatacatgcttgaattccagataccaatggatcagataactccatcccaatggcttatcttacactggatcaccaactacaggtaaaggagtactttcttattgaaagttgacttttttcttcttagagagtttaagttgacaattgtgttgctacctgtcattgtatagtcactccttaatttatccttttagttggcctccttaaactttttagaatcaaatcaaaataattcttttggttaagttaatcaaactttaaattggcagaatcatattcttatcttttcagtcatcttaaaatcctccagtatctttctttagtactgctaagcattacattttcactctttaattttagtgcattaaaacaaaactcataagcttatttctatttaatacatttgtgatacattctcatgttcatagtgactgaaaatgtaaataatatacttcagtgccccctcatgagtatgagggctataaacatcatttagtttgagcctgtttgcagcctgaaatgtcataccagagactacaactccaacaatcatgattctctgtaacagactgttaaaacagcaagaatagatttaaatgctgagttaattctgacaaaaggacactgagattttctagggcatggtttaacacttatttttaaaagatcattgctttagtgctataaaaatatatcacagtctctgtcttgactctcatcttagctagatattgaaatttgatttaattatgttttaacattcctgattattttcagcctctagcaccgtgcccaaactccaaagaatctatggcagtgtttgaacagcattgtaaaatggcacaagaatatatgaaagttcaaacagaaattgcattgttattacagagaaagtaagttattttttatgaataaaaataaaaatacattagtattttgagtttaaaatatgataaggtgcaatgaaaacgtagtttttagaattagtcattaagtatactttcaacttgtttaagctttaagcacccttttactaaaaattttttatgcaaaactcaatccttttgactatcatattagtgctatggaaaataaactggtgctttatacttgttgttttatgttctcagagctgtttagacttattattataaagatttattgttttcttgtaaatagataaaataatttgatttattaacattcagttgtgccttatcttagaaacatttttgtagatacattttttccaggtgtatgtttagaattggattacttattaaaagactgtatttcataactgagtgtttttctgaggagttatagaaactgccttcctccctttttaaagaaacacagcctaatttccttactactgcattcacagttcttaaatatgtatgtatcttcagttttcttaagcatgacctccatgaaattttatacttaggtaactgaattgttggtggtaactaaaatgaagtgataaggaaaaaattttggcaactttatatatgtatgataataggattcccttcattaattttaatctaaataaatgaaagttgtttttttctgaatttgcgaaaagctttctgtatgtacttcaaaaaaaagagagaaaaaattgttttatcataatttattgatacagtgatttaaatggaaccaacctggtatttgaaaggtaagcctaaataggaaattaaatactacagtttggaaatcgtagaagtaattatcaaactgctggcacttttatgttgaaaaagcttgatttcttatttcacttatttaacctatacttttgccatactttaatcatttgaaagaagtattctatgctggaaaaaacaaatggtggattagggtgttggctgtgaaaactatgacagttttaatcaattttaaatactttcagaagtagtattagttagttattttgcttgaggactttttattaattattcatttatatccagtaacctcactttaggaaatgcctaaagatgcatctttttcgggaatacttaatagttcccaaataagagggacttaaataagtttatcagactataaaagaatgagggtctttcctgaaagtgcttgcaaatgtaagtgttttaaaagaagtggtactttgtcatttttctcactgctttaaaatgggaaaaagctttaaattggatagcatttattttaattagattgcaaatttgctattagcttaccactctctgctatagttaagtaggattgtgacttcagaatgtgaatcagtataaaagtagaatgtgaaggataaaaacttcatgatattttcccatagccacatagaacccttcccagccttttttcatccttcctacacaaaaagaggatagaaaatgaaattttctgaaacttttattttaccattttatctgcttcgctaattatccaagtacagttacttaataaaaggattatgttatttgtatgattacactagaagtagatgagagttccatcccagcccataattatatttgattagtgtacctaagatgcaaaatgataaaccaagaataaaaattctcattaattgagcttccatcatcagctactaaggtatgaatttttccatcatgtgtaatattatgtggtatttgtttgtaggcaagaactagttgcagaactggaccaggatgaaaaggaccagcaaaatacatctcgcctggtacaggaacataaaaagcttttagatgaaaacaaaagcctttctacttactaccagcaatgcaaaaaacaactagaggtcatcagaagtcagcagcagaaacgacaaggcacttcatgattctctgggaccgttacattttgaaatatgcaaagaaagactttttttttaaggaaaggaaaaccttataatgacgattcatgagtgttagctttttggcgtgttctgaatgccaactgcctatatttgctgcatttttttcattgtttattttccttttctcatggtggacatacaattttactgtttcattgcataacatggtagcatctgtgacttgaatgagcagcactttgcaacttcaaaacagatgcagtgaactgtggctgtatatgcatgctcattgtgtgaaggctagcctaacagaacaggaggtatcaaactagctgctatgtgcaaacagcgtccattttttcatattagaggtggaacctcaagaatgactttattcttgtatctcatctcaaaatattaataatttttttcccaaaagatggtatataccaagttaaagacagggtattataaatttagagtgattggtggtatattacggaaatacggaacctttagggatagttccgtgtaagggctttgatgccagcatccttggatcagtactgaactcagttccatccgtaaaatatgtaaaggtaagtggcagctgctctatttaatgaaagcagttttaccggattttgttagactaaaatttgattgtgatacattgaacaaaatggaactcatttttttttaaggagtaaagatttttaattctgtgattgtgtgtatgtgtgttgaaactgtaaagcttttatgactctaatattaatctcttaaatgaaattaaaaggcaaaagaacatgattgagcttaaatgatcatttcttcctgcagtgattcttggattgttttctcatgtatttgaaaaaaaaaaaatgaagaaaaataatggaaaatggaagtaattactccagctaaaaaaagcttggacttagatttctttttatgataccaaatgagaaataaaccaggcaaatcagaaggaagttaaagaagcaaatataaattcaacaagtgtcctaattatcctggatattggaatatttgattttccttacaatcccgttctagaatgcctgccgcctttcaacactttcaagagaatttcaacacttacagagtatttatattgttaacagtaattttgctaccaaaaccttcagaataactttaataataaaatgacactgaaataatagactatacaaactctatattttttcagttggtgttaaaataagtcacattttgataccagtacaagatgtcttttaaataaggatgtcatcagtctgatttttatagcattaatgttttatgaagaaaaagttcaaaatgaaagcattaattgctgtgattattagaattctatcatgactgtattgtagtttttgctctatttcagataagcaagatctaagaagttatcaaaactattctttaaaatgctaaagcaggtaactttttcttccattattttttcctcctaccactgagttttgtaatgaattccttgtgtatacaagcaatacaggtgaatactaaactgttatttttagcttcttcaaaagctattttagaaagcttcctggaaataaatgtcttctgtcatttaatttaaataaaaggagtgttaattgttcccaaatttgattacctagctgaaacagatattggattcagcatagtaatagtaaaataaaattggcagagaaaataactgtagactaggataaagcatgactcctccatagcattgttgcttgtatgtacatctgtcactccactgaaagggacctagtcactttaaagaggccttttatctcagcacgagatatccaagcgtgaatgctaaggcttgatgtttccattaggatttagcattcgagatttcagattttatttatagtcattgatgtgttttgctgtattataacacatttaagggaaattttattatggtttttacatgtagtcatttcataaaaatatccagataggtaaatggaagaaaatagtagattttagtcatggtaccaaatgcaagaggctgttgaacagttgcttgtttgtttacagtaagttccttgagattttcagtactgtagttgccctggacattgagtacagttcagccttactctgtttttaagtagttgtgttgtcaatttcatgcttttaagtcctgatgatccttggagatgggagaaaaagataccagggataattaaaatccacagccagtttcatcagtttcctcatccatcctgcaaataaaaatgttaacaaggagccaaacttattcgttctggttttacaatttattttgaccgttttttgggtgaaaattgcaaacagccaagcaagtggctggaatgccccagtctaagaaattcaaaaacaatcactgagtaagccctaattacattaattacattttactcttgactccaggaaaagaaagcaagcttttatctaatctagagggaagtattcgtgagcaataaaaatcacttttttgagttgaataataatcagttaagaatatttaccgcatagcaacacaacatataaagatttgttacaagttgtttacggatgtttgactatttttgctgaagtattttagagtattgaatgtcttctctcttcaagtttctttcatgttcctaatttcagctcctgtagccagagatcacaggtcttccctgtgaaactttggtttctttctataaatgtgtgtggttttcagcgctcaactcctgtcttcaaatggtagtaagttctacttctacttctgtcattcagaacattttatgtcaaatgatgtaatgcagaaattcttgtgcatatttgtaactgaaggaagctttttagatttatttttgtttttaataaaattcagattcctattctaaactggtacataaaagtggtgaatgacttgtatcagc

SEQ ID NO: 12256 - DNA, 302 bp, Homo sapiens
tcttttggctgcataaatgtcttcttttgagaagtgtctgttcatatcctttacccactttttgatggggttttttttttcctgtaaatttgtttaagttctttgtggattctggatattagtcctttgtcagatgggtagattgcaaaaattttctcccattctgtaagttgcctgttcactctgatggtagtttcttttgctgtgcagaagttctttagtttaattagatcccatttgtcaagtttggcttttgttgccattgcttttggtgttttagacatgaagtccttgcccatgcc

SEQ ID NO: 12257 - DNA, 686 bp, Homo sapiens
gctgatgaggagttgtgttcctttggaggaggagaggtgctctgatttttagcgtttccagtttttctgctctgttttttccccatctttgtggttttatctacctttggtctttgatgatggtgacgtacagatggggttttggtatggataacctttctgtttgttagttttccttctaacagtcaggacccccagctgtaggtctgttggagtttgctggaggtccactccagaccctatttgcctgggtatcagcagcagaggctgcagaacagaggatatttgttaacagcaaatgttgctgccttatcgttcctctggaagttttgtctcagaggagtacccagccgtgtgaggtgtcagtctgcccctactcgggggtgcctcccagttaggctactctggggtcagggactcacttgaggaggcagtctgtccgttctcagatctccagctgcgtgctgggagaaccactactctcttcaaagctgtcagaccgggacattgaagtctgcagaggtttctgctgccttttgtttggctatgctttgcccccagagttggagtctacagatgcaggcaggcctccttgagctgcagtgggctccacccagttcgagcttcccggctgctttgtttacctactcaagccttggcaatggcaggcacccctcccccagact

SEQ ID NO: 12258 - DNA, 453 bp, Homo sapiens
tgggaggctgaggcaggcagatcacctgaggtcaggagttcaagaccagcctggccaacatggtgaaaccctgtctgtactaaaaatataaaaattacccgggtgtggtggcaggtgcccataatcccaattatttgagaggctgcagcaggagaattgcttgaacctgggatgcagaggttgcagttagcagagatcacgccactgcactccagcctgggtgacagagcaagactccatctcaaaagaaaaaaaaaagaatatttctattgggtctcatcttacagataatgctgaaataaatatttacacacgtgtgtttttgtcttggactggtttcgttattatttatgaaaaaaaatcctagaattggaatcgttaggtcaaagaatatttgtattctaaattttaattgatatttgcatatgccacaaagaggttgcaccaatttgc

SEQ ID NO: 12259 - DNA, 376 bp, Homo sapiens
attggttattctagttatccattcgtctaattttttttcaaagtttttaacttctttggcattggttcgaacttcctcctttagctcggagtagtttgatcttctgaagccttcttctctcaactcgtcaaagtcattctccatccagctttgttccattgctggtgaggagctgtgttcctttggaggaggagaggtgctctgatttttagtttccggtttttctgctctgttttttcccccatctttgtggttttatctacctttggtctttgatgatggtgacgtacagatgggtttttggtattgatgtcctttctgtttgttcgttttccttctaacagtcaggaccctcagcagcaggtctgttggagtt

SEQ ID NO: 12260 - DNA, 905 bp, Homo sapiens
ccccagtgtgtgatgttccccttcctgtgtccatgtgttctcattgttcaattcccacctacgagtgagaacatgtggtgtttggttttttccttgcgatagttggctcagaatgatggtttccagcttcatccatgtccctacaaaggacatgaactcatccttttttatggctgcatagtattccatggtgtatatgtgccacattttcttaatccagtctatcattcttggacatttgggttggttccaagtctttgctattgtgaatagtgccgtaataaacatacgtgtgtatgtgtctttatagcagcatgatttatagtcctttgggcatatacccagtaatgggatggctgggtcaaatggtatttctagttctagatccctgaggaattgccacactgacttccaccatggttgaactagtttacagtcccatcaacagtgtaaaagtgttcctatttctccacatcctctccagcacctgttgtttcctgactttttaatgattgccattctaactggtgtgagatggtatctcactgtggttttgatttgcatttctctgatggccagtgatgatgagcattttttcatgtgtgttttggatgcataaatgtcttcttttgagaagtgtctgttcatatccttcacccactttttgatggggtcgtttttttcttgtaaatttgtttgagttcattgtagattctggatattagccctttgtcagatgagtaggttgcaaaaattttctcccattctgtaggtcgcttgttcactctgatggtagtttcttttgctgtgcagaagctctttagtttaatttgatcccatttgtcaattttggcttttgttgccattgcttttggtgtttgagacatgaagtccttacccatgcc

SEQ ID NO: 12261 - DNA, 1079 bp, Homo sapiens
tcttttttttttattattatactttaagttttagggtacatgtgcacaacgtgcaggtttgttacatatgaatacatgtgccatgttggtgtgctgcatccattaactcatcatttacattaggtatatctcctaatgctatccctcccccttcccccaccccacaacaggccccggtgtgtgatgttctccttcctgtgtccaagtgttctcattgttcaattcccacctataagtgagaacatgtggtgtttggtttttcgtccttgcgatagtttgctgagaatgatggtttccagcttcatccatgtccctataaaggacatgaactcaccattttttatggctgcatagtattccatggtgtatatgtgccacattttcttaatccagtctatcattgttggacatttgggttggttccaagtctttgctattgtgaatagtgccacaataaacatacatgtgcatgtgtctttatagcagcatgatttataatcctttgggtatatactcagtaatgggatggctgggtcaaatggtatttctagttctagatccctgaggaatcaccacactgacttccacaatggttgaactagtttacagtcccaccaacagtgtaaaagtgttcctatttctccacatcctctccagcacctgttgtttcctgactttttaatgatcaccattctaactggtgtgagatggtatctcattgtggttttgatttgcatttctctgatggccagtgatgatgagcattttttcatgtgtcttttggcttcataaatgtcttcttttgagaagtgtctgttcatatccttcacccactttttgatggggttgttttttttcttgtgaatttgtttgagttctttgtagattctggatattagccctttgtcagatgagtagattgcaaaaattttctcccattctgtaggttgcctgttcactctgatggtagtttcttttgccgtgcagaagctctttagtttaattagatcccatttgtcaattttggattttgttgccattgcttttggtatttcagacatgaagtccttgctcacacc

SEQ ID NO: 12262 - DNA, 172 bp, Homo sapiens
aggcagtctgtccgttctcagatttcaagctgcatgctgggagaaccactactgtcttcgaagctgtcagacagggacacttaagtctgcagaggtttctgctgccttttgtttggctatgccctgcccccagaggtggagtctacagaggcaggcaggcctccttgagctg

SEQ ID NO: 12263 - DNA, 123 bp, Homo sapiens
attctcctgcctcagcctcccgagtagctgggactacaggtgcctgccaccacacctggctatattttttgtatttttagtagagacggggtttcaccatgttatccaggatggtctcaatct

SEQ ID NO: 12264 - DNA, 178 bp, Homo sapiens
gagatggagtctcgcactgttgcccaggctggagtgcagtggcacgatttcagctcactgcaagctccgcctcccaggttcacaccattctcctgcctcagcctcccaagtagctgggactacaggcacccgccaccacgcccagctaatttttatatttttagtagagacgaggttt

SEQ ID NO: 12265 - DNA, 832 bp, Homo sapiens
ttcgtgaaccacgaatgctgctgtctgatcgttcctctggaagttttgtctcagaggagtacctggtcgtgtgaggtgtcagtctgcccctacttgggggtgcctcccagttaggctgctcaggggtcaggggtcagggacccacttgaggaggcagtctgctcgttctcagatctccagctgtgtgctgggagaaccactgctttcttcaaagctgtcagacagggacatttaagtctgcagaggttactgttgtctttttgtttgtctgtgccctgcccccagaggtggagcctacagaggcaggcaggcctccttgagctgtggtgggctccacccagttcgagcttcccggctgctttgtttacctaagcaaacctgggcaatggcgggcgcccctcctccagcctcgctgccgccttgtagtttgatctcagactgctgtgctagcaatcagcgagactctgtgggtgtaggaccctctgagccaggtgcaggatataatctcctggtgcgccgttttttaagcctgtcggaaaagcgcagtattggggtgggagtgacccgattttccaggtgctgtctgtcacccctttctttgactaggaaagagaactccctgaccccttgcacttcccgagtgaggcaatgcctcgccctgctttggctcgtgcacggtgtgctgcacccactgtcctgagcccactgtctggcactccctagtgagatgaactcagtacctcagatggaaatgcagaaatcaccagtcttctgcgtcgctcacgctgggagctgtagaccggagctgtttctattcggccatcttggctcc

SEQ ID NO: 12266 - DNA, 715 bp, Homo sapiens
agtccccagagtgtgatgttccccttcctgtgtccatgtgttctcattgttcaattcccacctacgagtgagaatatgcggagtatggttttttgtccttgcaatagtttactgagaatgatgatttccaatttcatccatgtccttacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttataatcctttgggtatatacccagtaatgggatggctgggtcaaatggtatttctagttttagatccctgaggaattgccacactgacttccacaatggctgaactagtttacagtcccaccaacagtgtaaaagtgttcctaattctccacatcctctccagcacctgttgtttcctgactttttcatgattgccattctaactggtgtgagatggtatctcattgtggttttgatttgcatttctctgatggccagtgatggtgagcattttttcatgtgttttttggctgcataaatgtcttcttttgagaagtgtctgttcatatccttcacccactttttgatggggttgtttttttcttgtaaatttgtttgagttcattgta

SEQ ID NO: 12267 - DNA, 519 bp, Homo sapiens
tggctgagggagggaggtccctttgcaccatgcagctcccaggtgaactgtcaccccaccctgcatttctttgttctccatggatgatgccatccacctagtcagtcccaatgacccagagaaaatctgtgtacctcagttggaaatgcagaaatcacttgccttttgcattcgtctcagtgggagctgctgaccagagctgtttatactcagccatcttgggcccttctccagttcataattttatgtcttctattgtacagctttacttattttgtctctgttttttgttattgaaagagtgttgctgaaatctttgactgtaagtatgcatatccctatttacaattgtggatatgcctatctcattgaagttctatcacagtatttttgttattattattgtttattaatatactgcagggttcaccttgacaatttttcattattgtttatgattgaacaataattttctcattattgttttgttatgttgaactcattaaatcagtttggata

SEQ ID NO: 12268 - DNA, 218 bp, Homo sapiens
gccagttttcccagcaccatttattaaatagggaatcctttccccattgcttgtttttctcaggtttgtcaaagatcagatagttgtagatatgccacattacttctgagggctctgttctgttccattggtttatatctctgttttggtaccagtaccatgctgttttggttactgtagccttctagtatagtttgaagtcaggtagcatgatgcct

SEQ ID NO: 12269 - DNA, 675 bp, Homo sapiens
agctcggagaagtttgatcatctgaagccttcttctctcaactcatcaaagtcattctccatccagctttgttccattgctggtgaggagctgcatccctttggaggaggatatgcagtctgatttttagaattttcagtttttctgctctgttttttccccatctttgtggttttatctacctttggtctttgatgatggtgatgtacagatggggttttggtgtggatgtcctttctgttggttagttttccttgtagcagtcaggaccctcagctgcaggtctgttggagtttgctggaggtccactccagaccctgtttgcctgggtatcagcagcggaggctgcagaacagtgaatattggtgaacagcaaatgttgctgcctgatcattcctctggaagttttgcctcagaggaatacccggccatgtgaggtgtcagtctgcccctactggggggtgcctcccagttaggctacttgggggtcagggacccacttgaggaggcagtctgtctgttctcagatctcaagctgcatgctgggagaaccactactgtcttcaaagctgtcagacagggacatttaagtctgcagaggtttctgctgcctcttgtttggctatgccctgcccccagaggtggagtctacagaggtaggcaggcctccttgag

SEQ ID NO: 12270 - DNA, 191 bp, Homo sapiens
ctcttggcgatttcatcataaaatctttgcccatgcctgtgtcctgaatggtattgcctagattttctttcagggtttttataattttgtgttttacatttaagtctttaatctatcttgagttaatttttgtgtaaggtgtaaggaaggggtctagtttcaattttctgcatatggctagccagttctcc

SEQ ID NO: 12271 - DNA, 274 bp, Homo sapiens
ctgctctgttttttccccatctttgtggttttatctacctttgctctttgatgatgatgacatacagatgaagttttggtgtggatgtcctttctgtttgtcagttttccttctaacagtcaggaccctcagctgcaggtctgttggagtttgctggaggtccactccagaccctgtttgcctgggtatcagtagcagaggctgcagaacagcgaatatttttgaacagcaaatgttgctgtctgatcgttcctctggaagttttgtctcaaag

SEQ ID NO: 12272 - DNA, 275 bp, Homo sapiens
ctgctctgttttttccccatctttgtggttttatctacctttgctctttgatgatgatgacatacagatgaagttttggtgtggatgtcctttctgtttgtcagttttccttctaacagtcaggaccctcagctgcaggtctgttggagtttgcttggaggtccactccagaccctgtttgcctgggtatcagtagcagaggctgcagaacagcgaatatttttgaacagcaaatgttgctgtctgatcgttcctctggaagttttgtctcaaag

SEQ ID NO: 12273 - DNA, 368 bp, Homo sapiens
ctcattgtggttttgatttgcatttctctgacggccagtgatgatgagcattttttcatgtgtctgttggctgcataaatgtcttcttttgagaagtgtctgttcatatccttcgtccacttgttgatggggttgtttgttttgttcttgtaaatttgtttgagttctttgtagattctggatattagccctttgtcagatgagtagattgcagaaattttctcccattttgtaggttgcctgttcactctgatggtagtttcttttgctgtgcagaagctctttagtttaattagatcccatttgtcaattttgtctcttgttgccattgcttttggtgttttagacatgaagtccttgcccatgcc

SEQ ID NO: 12274 - DNA, 328 bp, Homo sapiens
tttttaaatataattttatttcattttctgcattacttagaagcatcagtaggatgaaaacaatatttgtttcttaaacctgtgcacaaattaattgatgtgacacacattaattcatgattattttcttaatgaattgattctaaagcttctctaagataggaaggcataagacaaccaaaaagaaatattgatttataactgttctaatactgctcagcatttttaaagtacactatagccagaaagcatgttataattactaataagataatccacagaatgccttgctgagccaggtaggtgtagaagaaataaattgtttcat

SEQ ID NO: 12275 - DNA, 711 bp, Homo sapiens
aggacttctctgcattggttattctagttatccattagtctaatttttttcaacgtttttaacctctttgccatgggttcaaacttcctcctttagctcagagtagtttgatcatctgaagccttcttctctcaactcgtcaaagtcattttccatccagctttgttccgttgctggtgaggaactgcgttccttggaggaggagaggcactctgatttttagagtttccagtttttctgctctgttttttccccatctttgtggttttatctacctttggtctttgatgatggtgacataccgatggggttttggtgtggatgtcctttctgtttgttagttttccttctaacagtcaggaccctcagctgcaggtctgttggactttgctggaggtccactccagaccctgtttgcctgggtatcagcagtggaggctgccgaacagcggatattggtgagcagcagatgttgctgcctgatcgttcctctgaaagttttgtctcagaggagtacctggccgtgtgaggtgtcagtctgcccctactggggagtgcctcccagttaggcttctcgggggtcagggacccacttgaggaggcaatctgtccattctcagatctccagctgcgtgctgggagaaccactactctcttcaaagctgtcagacacggacatttaagtctgcagaggattctgctgccttttgt

SEQ ID NO: 12276 - DNA, 1855 bp, Homo sapiens
atatatatattttaaactatactttaagttctagggtatatgtgcacaacgtgcaggtttgttacatatgtatacatgtgccatgttggtgtgccgcacccgttaactcgtcatttacattaggtgtatctcctaatgctatccctccccattccccccaccccacaacaagccccagtgtgtgatgttccccttcctgtgtccaagtgttctcattgttcaattcccacctatgagtgagaacatgcggtgtttggtttttttgtccttgcgatagtttgctgagaatgatggtttccagcttcatccatgtccctacaaagaacatgaactcattttttatggctgcatagtattccatggcgtatatgtgccacattttcttaatccagtctatcattgttggacatttgggttggttgcaagtctttgctattgtgagtagtgccacagtaaacatacgtgtgcatgtgtctttgtagcagcatgatttatattcctttaggtatatacccagtaatggaattgcggggtcaaatggtatttctagttccacatccctgaggaatcgccacactgtcttccacaatggttgaactagtttacagtcccaccaacagtgtaaaagtgttcctatttctccacatcctctccagcacctgttgtttcctgactttttaatgatcgccattctaacaggtgtgagatggtatctcattgtggttttgatttgcatttctctgattgccagtgatgatgatcattttttcatgtgtctgttggctgcataaatgtcttcttttgagaagtgtctgttcatatccttcacccacttgttgatggggttgtttgtttttttcttgtaaatttttttaagttctttgtagattctggatattagccctttgtcagatgagtagattgcaaaaattttctcccattctgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaacatttaagtctttaatccatcttgaattaatttttgtataaggtgtaaggaagggatccagtttcagctttctacatatggctagccagttttgccagcaccatttattaaatagggaatcctttccccatttcttgttcttgtcaggtttgtcaaagatcagatagttgcagatgtgtggtattatttctgagggctctgttctgttccatttatctatatctctgttttggtaccagtaccatgctgttttggttactgtagccttgtagtatagtttgaagtcaggtagtgtgatgcctccagctttgttcttttggcttaggatagacttggcaatgcaagcttttttttggttccatatgaactttaaagtagttttttccaattatttgaagaaagtcatttgtagcttgatggggatggcattgaatctataaattaccttgggcagtatggccactttcacgatattgattcttcctatccatgagcatggaatgttcttccatttgtttgtgtcctcttttatttcattgagcagtggtttgtagttctccttgaagaggtccttcacatcccttgtaagttggattcctagttattttattctctttgaagaaattgtaaatgggagttcactcatgatttggctctctgtttgtctgttattggtgtataagaatgcttgtgatttttgcacattgattttgta

SEQ ID NO: 12277 - DNA, 558 bp, Homo sapiens
ttttaattatactttaagttctaggatacatgtgcacaacatgcaggtttgttacatatgtatacatgtgccatgttggtgtgctgcacccattaacttgtcatttacattaggtatatctcctaatgctatccctccccactcgccccaccccacgacaggccctggtgtgtaatgctccccaccctatgtccaagtgttctcatcgttcaattcccacctatgagtgagaacacgtggtgtttgattttctgtccttgtgatagtatgcacagaataatggtttccagcttcatccatgtccctgcaaaggacatgaactcatccttttttatggctgcatagtattccatggtatatatgtgccacattttcttaatccagtctatcattgatggacatttgggttggttccaagtctttgctattgtggatagtgctgcaataaacatacgtgtgcttgtgtctttatagcagcatgatttataatcctttgggtatatacacagtaatgggatggctgggtcaaatggtatttctagttctagatccttgagg

SEQ ID NO: 12278 - DNA, 314 bp, Homo sapiens
ttgaggaggcagtctgtctgtctcagatctcaaactgtgtgctgggagaaccactactctcttcaaagctgtcagacagggatgtttaagtctgcagaagtttctgctgccttttgttcagctatgccctgccctcagaggtggagtctacagaggcagacaggcctccttgggctgcggtgggctccacccagttagagcttcccagctactttgtttacctactcaagcctcagcaatggcagacacccctaccccagcctcactgctgccttgcagtccaatctcaggctgctgtgctagcagtgagcgag

SEQ ID NO: 12279 - DNA, 368 bp, Homo sapiens
ctcattgtggttttgatttgcatttctctgatgctcagtgatgatcagcattttttcatgtgtctgttggctgcataaatgtcttcttttgagaagtgtctgttcatgtcctttgcccactttttgatggggttgtttgtttttttcttgtacatttgtttaagttctttgtagattctggatatcagccctttgtcagatgggtagattgcaaaaattttctcccattctataggttgcctgttcactctgatggtagtttctattgctgtgcagaaactctttagtttaatgagatcccatttatcaattttggcttttgttaccattgcttttggtgttttagacatgaagtccttgcccatgtc

SEQ ID NO: 12280 - DNA, 333 bp, Homo sapiens
atgttgaaccagccttgcatcccagggatgaagcccacttgatcatggtggataagctttttgatgtgctgctggatttggtttgccagtattttactgaggatatttacatcgatgttcatcagggatattggtctaaaattctctttttttgttgtgtctctgccaggctttggtatcaggatgatgttggcctcataaaatgagttagggaggattccctcttttcctattgattagaatagtttcagaaggaatggtaccagatcctctttgtacctctggtagaattcaactgtgattccgtctggtcctggattttttttgttggta

SEQ ID NO: 12281 - DNA, 96 bp, Homo sapiens
cctttggtctttgatgatggtgacatacagatggggttttggtgtggatgtcctttctgtttgttagttttccttctaacagtcaggaccctcagc

SEQ ID NO: 12282 - DNA, 374 bp, Homo sapiens
atcctttggtgtagatgaggcactctgatttttagaattttcagcttttctgctctggtttctccccatctttgtgattttatctacctttggtctttgatgatggtgacctacagatggggttttggtgtggatgtcttttttgttgatgttgatgctattcctttctgtttgttagttttcctcctaacagtcaggaccctcagctgcaggtctgttggagttcgctggaggtccactccagaccttgtttgcctgggtatcaccagcagaggctgcagaacagcaaagattgcagaacagtaaatgttgctgcctgatccttcctctggaagctttgtctcagaggggcacctggctgtatgaggtgtcag

SEQ ID NO: 12283 - DNA, 440 bp, Homo sapiens
ctgaaactctgcattctttaagcaatagcccttccttaatctcttctcccagtaactgggaagcatcattctacttttggtttctatgaatattacatgctagatatctcatataagtggaatcaggcagtattagttttttgtatccagcttctttcacttagcattatgtcaaagtccatccatgttgtaacatgcatcagaatgtccctttttaaggctaagtaatattccactgtatatctgtaccacattttgtttatccattcctctgtcaatgaatgcttccaccttttggctatcatgaataatgttactatgcacatgaatttgcaaatatctgttgaagtccctgctttcaagtcttgtgggtttaaacccagaagtggacttgctgactcatatggtaattctatgtttcatttttatttatttattta

SEQ ID NO: 12284 - DNA, 376 bp, Homo sapiens
ctcattgtggttttgatttgcatttctctgatggccagtgatgatgagcattttttcatgtgttttttggctacataaatgtcttcttttgagaagtgtctgtctgttcatgtcctttgcccactttttgatgggattgtttgtttttttcttgtaaatttgtttgagttctttgtagattctggatattagccctttgtcagatgagtaggttgcaaaaattttctcccattttgtaggttgcctgttcactctgatggtagtttcttttgctgtgcagaagctctttagtttaattagatcccatttgtcaagtttgccttttgttgccattgcttttggtgttttagacatgaagtccttgcccatgcctgtg

SEQ ID NO: 12285 - DNA, 717 bp, Homo sapiens
cttttgtttggctatgccctgcccccagaggtggagtctacagaggcaggcaggcctccttgagctgtggtgggctccacccagtttgagcttcctggccgctttgtttacctactcaagcctcggcaatggtgggcacccctcccccgcctcgctgccgccttgcagctcaatctcagactgctgtgctagcaatgagcgaggctccatgggcgtgggaccctctgagccacgcgtgggatataatctcctggtgtgccctttgctaaggccattggaaaagcacagtattagggtgggagtggccctattgtccaggcgccatctgtcacagctttgcttggctaggaaagggaattccctgaccctttgtgcttcctgggtgaggcaatgcctctccctgctttggctcatgctcagtgcgttgcacccactgtcctgcacccactgttcgacaagccccagtgagatgaacccagtacctcagttggaaatgcagaaatcacccatcttctgccttgctcatgctaggagctgtagactggagctgttcctatttggccatcttcaaaaagggaactcttatacacagttggtgggatgtaaattaatacaactactgtagaaacagtatagggatttctttaaaaaaataaaaaactaaaaataatcctacgatatgatccaacaatgccattactgggtattcatccgaag

SEQ ID NO: 12286 - DNA, 268 bp, Homo sapiens
actgtggagtctgaggagggagtgggagcgctgcttccatgcctgtggaggtggtgccagcagcaccatggtccttgacactgctgccactgtccctggcttgctcacttgctgcatgctgtgttcctcttgcaaacttttgggttctaccgaaaatggtctctcagtgcaaactaaggtgttttcccatattatgttattgatgctacaatttaaatcttttatatattgtgtattcattaccaaattattgcagctatggttattt

SEQ ID NO: 12287 - DNA, 378 bp, Homo sapiens
tattgattattctagttatactttcatctaaatttttttcaaagtttttaacttcttccccttcggtttgaatttcctcctgtagcttggagtagtttgatcgtctgaagccttcttctctcaactcgtcaaagtcattctcagtccagctttgttccgttgctggtgaggaactgtgttcctttggaggaggagaggtgctctgctttttagagtttccagtttttctgctctgttttttccccgtctttgtggttttatctacttttggtctttgatgatggtgatgtacagacgggtttttggtgtggatgtcctttctgtttgttagttttccttctaacagacaggactctcagctgcaggtctgttggagtt

SEQ ID NO: 12288 - DNA, 908 bp, Homo sapiens
cccagagtgtgatattccccttcctgtgtccatgtgttctcattgttcaattcccacctatgagtgagaacatgaggtgtttggttttttgttcttgtgatagtttactgagaatgatgattttcaatttcatccatgtccctacaaaggacatgaacccattattttttaaggctgcatagtattccatggtgtatatgtgccacgttttcttaatccagtctatcattgttggacgtttgggttggttccaagtctttgctattgtgaatagtgccacaataaacatacgtgtgcatgtgtctttatagcagcatgatttatagtcctttgggtatatacccagtaatgggatggctgggtcaaatggttttctagttctagatccctgaggaatcgccacactgacttccacaatggttgaactagtttacagtcccaccaacagtgtaaaagtgttcctttttctccacatcctctccagtacctgttgtttcctgactttttaatgattgccattctaactggtgtgagatgatatctcattgtggttttgatttgcatttctctgatggccagtgatggtgagcattttttcatgtgttttttggctgcataaatgtcttcttttgagaagtgtctgttcatgtccttcgcccactttttgatggggttgtttgttttttcttgtaaatttgtttgagttcattgtagattctggatattagccctttgtcagatgagtaggttgcaaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcc

SEQ ID NO: 12289 - DNA, 210 bp, Homo sapiens
caattttgctgatcttttcaaaaaaccagctcctggagtcattgattttttgaagggttttttgtgtctctatctccttcagttctgctctgatcttagttatttcttgccttctgctagcttttgaatgtgtttgctcttgcttctctagttcttttaatttcgatgttagggtgtcaattttagatctttcctgctttctcttgtggg

SEQ ID NO: 12290 - DNA, 748 bp, Homo sapiens
attggttattctagttagccatttgtctaattttttttcaaggtttttaacttctttgccatgggtttgaacttcttcctttagctcagagtagtttgatcttctgaagccttcttctctcaactcgtcaaagtcattctccatccagctttgttccattgctggtgaggagctgtgttcctttggaggaggagaggtgctctgattttcagagtttccagtttttctgctctgttttttccccatcttcatggttttatctacctttggtctttgatgatggtgaagtacagatggagttttggtgtggatgtcctttctgtttgttagttttccttctaacagagaggaccctcagctgcaggtctgttggagtttgctggaggtccactccagaccctgtttgcctgggtattaacagtggaggctgcagaacagcggatattggtgaacagcaaatattgctgcctgatcgttcctctggaagttttgtctcagaggagtatctggccatgtgaggtgtcagtttgcccctactgggggatgcctcccagttaggctacttaggagtcagggacccacttgaagaggcagtctgtccattctcagatctgcagctgcatgctgggagaaccactactctcttcaaagctgtcagacagggacatttaagtctgcagaggtttctgctgccttttgtttggctatgccctgcccccagaggtggagtctacagaggcaggcaggc

SEQ ID NO: 12291 - DNA, 1088 bp, Homo sapiens
atttatttatttatttatttattttactttaagttttagggtacatgtgcacaacgtgcaggttagttacatgtgtatacatgtgccatgttggtgtgctgcacccattaactcatcatttaacattaggtatatctcctaatgctatccctcccacctcccccaccccacaacaggaccctgtgtgtgatgttccctttcttgtgtccaagtgttctcattgttcaatttccacctatgagtgagaacatgtggtgtttggttttttgtccttgcgatagtttgctgagaatgatggtttccagcttcatccatgtccctacaaaggacatgaactcttcattttttatggctgcatagtattccatggtgtatatgtgccacattttcttaatccagtctatcattgttagacatttgggttggttccaagtctttgctattgtgaatagtgccgcaataaacatatgtgtgcatgtgtctgtatagtagcatgatttataatcctttgggtatatacccagtaatgggatagctgggtcaaatggtatttctagttctagatccctgaggaatcgccacactgacttccacgatggttgaactagtttacagtcccaccaacagtgtaaaagtgttcctatttctccacatcctctccagcacctgttgcttcctgactttttaatgattgccattctaactggtgtgagatggtatctcattgtggttttgatttgcatttctctgatggccagtgatgatgagcattttttcatgtgtcttttggctgcataaatggcttcttttcacaagtgtctgttcatatccttcgcccactttttgatggggctgtttgtttttttcttgtaaatttgtttgagttcattgtagattctgggtattagccctttgtcagatgagtagattgcaaaaattttctcccattctgtaggttgcctgttcactctgatggtagtttcttttgctgtgtggaagctcctgagtttaattagatcccatttgtcaattttggcttttgttgccattgcttttggtgttttagacatgaagtccttgcccatgcc

SEQ ID NO: 12292 - DNA, 360 bp, Homo sapiens
ggagctgcattcctttggaggaggagaggtgctctgatttttagagtttccattttttctgctctttttttcccccatctttgtggttttatctacctttggtctttgatgatggtgatgtttttggtgtggatgtcctttctgtttgttagtttttcttctatcagtcaggaccctcagctgcaggtctgttggagtttgctggaggtccactccagagcctgtttacctgcgtatcagcagtggtggctgcagaacagcagatattggtgaaccgcaagtgctgctgcctgatcgttcctctggaagttttgtctcaggggagtacctggttgtgtgaggtgtcagtctgcccctact

SEQ ID NO: 12293 - DNA, 625 bp, Homo sapiens
aacttctttgcaatgggttcaaacttcctcctttagctcagaaaagtttgatcatctgaagccttcttatttcaactcgtcaaagtcattctccatccagctttgttccattgctcgtgaggagctgcgttcctttggaggaggagaggtgctctgatttttagaattttcagtttttctgctctgttttttctctatctttgtggttttatctacctttggtctttgatgatggtgacatacagatggggttttggtgtggatgtcctttctgctcagtttttctgctctgttttttctctatctttgtggttttatctacctttggtctttgatgatggtgacatacagatggggttttggtgtggatgtcctttctgcttgttagttttccttctaacagtcaggaccctcagctgcaggtctgttggagtttgctggaggtccactccagaccctgtttgcctgggtatcagcagcggaggctgcagaacagcaaatattgctgaacagcaaatgttgctgcctgatcattcctctggaagttgcgtctcagaggggtacctagctgtgtgaggtgtcagtctgctcctactgggggggtgcctcccagtttggctactcg

SEQ ID NO: 12294 - DNA, 199 bp, Homo sapiens
tttgattggccacatgttttaaagcatgtatttgaacatacaattggctaatatatctgagcactgcctgtaaatgacagatggttctaactttcttgaacccatcttccacagggagtgaagtggatagcagggaaggttacaaatcagtggattgagaatggcaaacaggaataactcactactgattctgcccagc

SEQ ID NO: 12295 - DNA, 389 bp, Homo sapiens
aagctttgtctcagaggggcacccagctgtatgaggtgtcagtcggcccctactgggaggtgtctcccagttaggctactcgggggtcagggacccacttgaggaggcagtctgtccgttctcagatctcaaactccatgctgggagaagcactactctcttcaaagctgtcagacagggacgtttaagtctgcagaagtttctgctgccttttgttcagctatgccctgcccctggaggtggagtctacagaggcaggcaggcctccttgagctgcagtgggctccacccagttccagcttccaggctgctttgtttacctactcaagcctcagcaattgtggacgcccctcccccagcctcgctgctgccttgcagttctatctcag

SEQ ID NO: 12296 - DNA, 148 bp, Homo sapiens
ggccattttcacgatattgattcttcctacccatgagcatggaatgttcttccatttgtttgtatcctcttttatttcattgagcagtggtttgtagttctccttgaagaggtccttcacatcccttgtaagttggattcctaggtat

SEQ ID NO: 12297 - DNA, 608 bp, Homo sapiens
agctcggagaagtttgattgtctgaagccttcctctctcaacttgtcaaagtcattctccgtccagctttgttccattgctggcgagtggctgcgttcctttggatggggagaggtgctctgagttttagaattttctgcttttctgctgttttttccccatctttgtggttttatctacctttggtctttgatgatggtgacgtatagatggagttttggtgtggatgtcctttctgtttgttagttttccttctaacagtcaggaccctcagctgcaggtctgttggagtttgctggaggtccactccagaccctgtttgcctgggtatcagcagcagaggctgcagaacagcgaatactgctgaacaccaaatgttgctgcctgattgttcctctggaagcttcgtctcagaggagtacccagccgtgtgaggtgtcagtctgcccctactggggagtgcctcccagttaggctactcgggggtcagggacccacttgaggaggcagtctatccattcttagatctcaaactccgtgctgggagaaccactactcttttcaaagctgtgagacagggacatttaagtctgcagaggtttctgctg

SEQ ID NO: 12298 - DNA, 88 bp, Homo sapiens
cctcgctgccgccttgcagtttgatctcagactgctgtgctagcaatgagcgaggctccgtgggcgtaggaccctccgagtcaggcgt

SEQ ID NO: 12299 - DNA, 141 bp, Homo sapiens
ttattttattattataccttaagttttaggatacatgtgcaccatgtgcaggtttgtaacataagtgttcatgtgccatgttggtgtgctgcacccattaactcgtcatttagcattaggtatatctcctaatgctatccc

SEQ ID NO: 12300 - DNA, 559 bp, Homo sapiens
ccagtttttctgctctgttttttccccatctttgtggttttatctacctttgatctttgatgatggtgatgtacagatggggcttttatgtggatgtcctttcttttgttagttttcattctaacagtcaggaccctcagctgcaggttgattggagtttgctggaggtccactccagaccctgtttgcctggatatcagcagcagaggctggagaacagcagatattgctgaacagcaaatgttgctgcctgatcgttcctctggaagcttcatctcagaggaatacccagccgtgtgaggtgtcagtctgcccctgctggggggtgcctcccagttaggctactcgggggtcagagacccacttgaggaggcagtctgaccattctcagatctcaaactccgtgctgggagaaccactactctcttcaaagctgtcagacagggacatttaagtctgcagaggtttctgctgccttttgttcagctatgccccgcccccagaggtggagtctctagaggcaggcaggcctccttgagctgcggtgggccacacccag

SEQ ID NO: 12301 - DNA, 221 bp, Homo sapiens; identical to SEQ ID NO: 12249

SEQ ID NO: 12302 - DNA, 171 bp, Homo sapiens
aggcagtctgtctgttctcaggtctcaagctgcatgcgggagaaccactactgtcttcaaagctgtcagacagggacatttaagtctgtagaggtttctgctgccttttgtttggctatgccctgcccccagaggtggagtctacagaggcaggcaggcctccttgagctg

SEQ ID NO: 12303 - DNA, 710 bp, Homo sapiens
aacttctttgcaatgggtttgaacttcctcctttagcttggagaagtttgatcgtctgaaggcttcttctctcagctcatcaaagtcattctccgtctagctttgttccgttgctggtgaggagctgcattcctttggaggaggagaggcactctgagttttagaattttcaatttttctgctctgttttttccccatctttgtggttttatctacctttggtctttgatgatggtgacgtacagatggggttttggtgtggatgttctttctgtttgttagttttccttctaacagtcaggaccctcagctgcaggtctgttggagtttgctggaggtccactccagaccctgtttgcctgggtatcagcagcagaggctgcagaacagtgaatattgctgaacagcaaatgttgctgcctgatcgttcctgtggaagttttgtctcagaggggtacctggccgtgtgaggtgtcagtctgcccctacagggagatgcctcccagttaggcttctcaggggtcagggacccacttgaggaggcagtctgttcattctcagatctcaaactccatgccggaagaaccactaccctcttcaaagctgtcagacaggcacatttaagtctgcagaggtttctactgccttttgttcggctatgccctgcctccagcggtggagtctacagaggcaggcaggcctccttgagc

SEQ ID NO: 12304 - DNA, 193 bp, Homo sapiens
attctccatccagctttgttctattgctggtgaggagctgtgttcctttggaggagaagaggcactctgacttttagaattttcagcttttctgctctggtttctccctatctttgtggttttatctacctttggtctttgatgatggtgatgtacagatggggttttggtgtggatgtcctttctgtttgtt

SEQ ID NO: 12305 - DNA, 302 bp, Homo sapiens
tcttttggctgcataaatgtcttcttttgagaagcgtctgttcatatccttcgcccacttgttgatggggttgtttttttcttgtaaatttgtttgagttctttgtagattctggatattagccctttgtcagatgagcagattgcaaaaattttgtcccattctgtaggttgcctattcactctgatgatagtttcttttgctgtgcagaagctctttagtttaattagttcccatttgtcagttttggcttttgttgccattgctttgggtgttttagacatgaagtccttgcccttgcc

SEQ ID NO: 12306 - DNA, 171 bp, Homo sapiens
aggcagtctgtccattccagatctccagctgcatgctgggagaaccactactctcttcaaaactgtcagacagggacatttaagtctgcagaggtttctgctgccttttgtttggctatgccctgcccccagaggtggagtctacagaggcagccatgcctccttgagctg

SEQ ID NO: 12307 - DNA, 218 bp, Homo sapiens
gccagttttcccagcaccatttattaaatagggaatcctttccctattgcttgtttttctcaggtttgtcaaagatcagatagttgtagatatgcggcgttatttctgagggctctgttctgttccattgatctagttctctgttttggtaccagtaccatgctgttttggttactgtagccttgtagtatagtttgaagtcaggtagcgtgatgcct

SEQ ID NO: 12308 - DNA, 1279 bp, Homo sapiens
tattggttattctagttatacattcagctaaatttttttcaaagtttttaacttctttgtctttggtttgaatttcctcctgtagctcgtagtagtttgatcatctgaagccttcttctctcaactcatcaaagtcattctctgtccagctttgttccgttactggtgaggaactgcgttcctttgaaggaggagaggtgctctgctttttagagtttccagtttttctgctctgttttttccccatctttgtggttttatctacttttggtctttgatgatggtgatgtacagatgggttcttggtgtgcatgtcctttctgtttgttagttttccttctaacagacaggaccctcagctgcaggtctgttggagtttgctagaggtccactccagaccctatttgcctgggtatcagcagcgctggctgcagaacagcggattttcacgaaccgcgaatgctgctgtctgatcgttcctctggaagatttgtctcagaggagtacccggctgtgtgaggtgtcagtctgcccctactgggtggtgcctcccagttaggctgctcgggggtcaggagtcagggacccacttgaggaggcagtctgcccattctcagatctcaagttgcgtgctgggagaaccactgctctcttcaaagctgtcagacggggacatttaagtctgcagaggttactgctgtctttttgtttgtctgtgccctgcccccagagatggagcctacagaggcaggcaggcctccttgtgctgtggtgggctccacccagttcgagcttcccgactgttttgtttacctaagcaagcctgggcaatggtgggcgcccctccccgagcctcgctgtcactttccagtttgatctcagactgctgggctagaaatcagcgagactccatgggcgtaggaccctccgagccatgtgcgggatataatctcctggtgcgccgtattttaagcccgtcggaaaagtgcagtattagggtgggagtgacccgattttccaggtgccatctctcacccctttctttgactaggaaagggaactccctgaccccttgcgcttcccgagtgaggcaatgcctcgtcctgcttcagttcacgcatggtgcgctgcacccactgtcctgcgcccacggtctggcactccctagtgagatgaacccggtacctcagatggaaatgcagaaatcacctgtcttctgcgtcgctcatgctgggagctgtagactggagctgttcctattcggccatcttggctgccc

SEQ ID NO: 12309 - DNA, 908 bp, Homo sapiens
ccccagagtgtgatattccccttcctgtgtccatgtgacctcattgttcaattcccacctatgagtgagaatatgcagtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcgttggacatttgggttggttccaagtctttgctattgtgaataatgccgcaataaacatacgtgtgcatgtgtctttatagcagcatgatttatagtcctttgggtatatacccagtaatgggatggctgggtcaaatagtatttctagttctagatccctgaggaatcaccacactgacttccacaatggttgaactagtttacagtcccaccaacagtgtaaaagtgttcctatttctccacatcctctccagcacctgttgtatcctgactttttaatgattgccattctaactggtgtgagatgctatctcactgtggttttgatttgcatttctctgatggccagtgatgatgagcattttttcatgtgttttttggctgcataaatgtcttcttttgagaagtgtctgttcatgtcctttgcccactgtttgatggggttgtttgtttttttcttgtaaatgtgtttgagttcattgtagattctggatattagccctttgtcagatgagtaggttgcaaaaattttctcccattttgtaggttgcctgttcactctgatggtagtttcttttgctgtgcagaagctctttagtttaattagatcccatttgtcaattttgtcttttgttgccattgcttttggtgttttggacatgaagtccttgcccatgcc

SEQ ID NO: 12310 - DNA, 410 bp, Homo sapiens; identical to SEQ ID NO: 12254

SEQ ID NO: 12311 - DNA, 406 bp, Homo sapiens
gctggtgaggagctgtgttcctttggaggaggagaggcgctctgattttgagtttctagtttttctgctctgttttttccccatctttgtggctttatctacctttggtctttgatgatggtgacgtacagatggggttttggtgtggatgtcctttgtttgttagttttccttctaacagtcaggaccctcagctgcaggtctgtcggagtttgctggaggtccactccagaccctgtttacctgggtatcagcagcggaggctgcagaacagtgaatattggtgaacagcaaatgttgctgcctgatcgttcctctggaagttttgtctcagaggagtacccagctgtgtgaggtgtcagtctgcccctactggggggtgcttcccagttaggctactcggggg

SEQ ID NO: 12312 - DNA, 731 bp, Homo sapiens
ctctaaacttcccttcttgcttcatttcattcatttcatcttccacaactgataccctttcctccagttgatcgcatcggctcctgaggcttctgcattcttcacgtagttctcgagccttggctttcagctccatcagctcctttaagcacttctctgtattggttattctagttatacatttgtctaaatttttttcaaagttttcaacttctttgcctttggtttgaatttccttctggagctcagagtagtttgttcatctgaagccttcttctctcaactcatcaaagtcattctccgtccagctttgttccgttgctggtgaggaactgtgttcctttggaggaggagaggcgctctgctttttagagtttccagtttttctgctctgttttttcccccatctttgtggttttatctacttttggtctttgatgatggtgatgtacagatgggtttttggtgtggatgtcctttctgtttgttagttttccttctaacagagaggaccctcagctgcaggtctgttggagtttgctagaggtccactccagaccctgtttgcctgggtatcagcagcagtgtctgcagaaccgtggattttcgtgatccgcgaatgctgctgtctgatcgttcctctggaagttttgtctcagaggagtacccggccgtgtgaggtgtcagtctgcccctactggggggtgcctcccagttaggctgctcagggg

SEQ ID NO: 12313 - DNA, 366 bp, Homo sapiens
ctcattgtggttttgatttgcatttctctgatggccagtgatgatgggcattttttcatgtgtctgttggctgcataaatgtcttcttttgagaagtgtctgttcatatcctttgcccactttctgatggggttgtttgattcttcttgtaaatttgtttaaattctttgtagattctggatattagccctttgtcagatgggtagattgcaaaaattttctcccatgttgtaggttgcctgttcactctgatggtagtttcttttactctgcagaagctctttagtttaattagatcccatttgtcaattttggctttagttgccattgcttttggtgttttagacatgaagtccttgcccacgc

SEQ ID NO: 12314 - DNA, 368 bp, Homo sapiens
ctcattgtggttttgatttgcatttctctgatggccagtgatggtgagcattttttcatgtgttttttggctgcataaatgtcttcttttgagaagtgtctgttcatgtccttcacccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctgttcagtttaattagatctcattggtcaattttggcttttgttgccattgcttttggtgttttagacatgaagtccttgcccatgcc

SEQ ID NO: 12315 - DNA, 368 bp, Homo sapiens
ctcattgtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttgtcttttgttgccattgcttttggtgttttggacatgaagtccttgcccatgcc

SEQ ID NO: 12316 - DNA, 899 bp, Homo sapiens
atgttccccttcctgtgtccatgtgttctcattgttcaattcccacctatgagtgagaatatgcagtgtttggttttttgttcttgtgatagtttactgagaatgatgatttccagtttcatccatgtccctacaaaggacatgaactcatccttttttatggctgcatagtattccatgatgtatatgtgccacattttcttaatccagtctatcattgtcggacatttgggttggttccaagtctttgctattgcgaatagtgccgcaataaacatacgtgtgcatgtgtctttatagcagcatgatttatagtcctttgggtatatatccagtaatgggatggctgggtcaaatggtatttctagttctagatccctgaggaatcaccacaccgacttccacaatggttgaactagtttacagtcccaccaacagtgtaaaagtgttcctatttctccacatcctctccagcacctgttgtttcctgactttttaatgatcaccattctaactggtgtgagatggtatctcattgtggttttgatttgcatttctctgatggccagtgatgatgagcattttttcatgtgtctgttggctgaataaatgtcttcttttgagaaatgtctgttcatatcctttgcccactttttgatggggttgtttgtttttttcttgtaaatctgtttgagttcattgtagattctggatattagccctttgtcagatggatagattgtaaacattttctcccattctgtaggttgcctgtttactctgatggtagtttcttttgctgtgcagaagctctttagtttaattcgatcccatttgtcaattttggcttttgttgccattgcttttggtgttttagacatgaagtccttgcccatgcc

SEQ ID NO: 12317 - DNA, 366 bp, Homo sapiens
ctcattgtggttttgatttgcatttctctgatggccagtgatgatgagcattttttcatgtgtgttggctgcataaatgtcttcttttgagaaatgtctgttcatatcctttgcccactttttgatggggttgtttgtttttttcttgtaaatttgttggagttcaatgtagattctggatattagccctttgtcagatgagtgggttgcaaaaattttctcccattctgtaggttgcttgttcactctgatggtagtttcttttgctgtgtggaagctctttagtttaattagatcccatttgtcaattttggcttttgttgccattgcttttggtgttttagacatgaagtccttacccatgcc

SEQ ID NO: 12318 - DNA, 172 bp, Homo sapiens
aggcagtctgtctgttctcagatctccagctgtgtgcttggagaaccgctactctcttcaaagctgtcagaaagggacatttaagtctgcagaggattctgctgccttttgtttggctatgccctgcccccagaggtggagtctacagaggcaggcaggcctccttgagctg

SEQ ID NO: 12319 - DNA, 218 bp, Homo sapiens
gccagttttcccagcaccatttattaaatacggaattctttccccattgcttgtttttctcaggtttgtcaaagatcagatagttgtagatacgtggcgttatttctgagggctctgttctgttccattgatctatatctctgttttggtaccagtaccatgctgttttggttactgtagccttgtagtgtagtttgaagtcaggtagtgtgatgcct

SEQ ID NO: 12320 - DNA, 377 bp, Homo sapiens
tattgattattctagttatacattcatttaaattttttttcaaagtttttaacttctttgccttggtttaaatttcctcctggagctcagagtagtttgatcgtctgaagccttcttctctcaacttgtcaaagtcattctccgtccagctttgttccattgctggtgaggaacagcattcctttggagcaggagaggaactctgcttttttagagttgccagtttttctgctgttttttccccatctttgtggttttatctacttttggtctttgatgatggtgatgtacagatgggtttttggtgtggatgtcctttctgtttgttagttttccttctaacagacaggacccttagctgcaggtctgttggagtt

SEQ ID NO: 12321 - DNA, 902 bp, Homo sapiens
atgctccccttcctgtgtccatgtgttctcattgttcaattcccacctatgagtgagaatatgcggtgcttggttttttgttcttgcgatattttactgagaatgattatttccaatttcatccatgtcccttcaaaggacatgaactcatcattttttatggctgcatagtattccatggtgtatatgtgccacattttcttaatccagtctatcattgttggacatttgggttggttccaagtctttgctattgtgaatagtgccacaataaacatacgtgtgcatgtgtctttatagcagcgtgatttatagtcctttgggtatatacccagtaatgggatggctgggtcaatggtatttctagttctagatccctgaggaatcaccacactgacttccacaatggttgaactagtttacagtcccaccaacagtgtaaaagtgttcctatttctccacatcctctccagcacctgttgtttcctgactttttaatgatcaccattctaactggtgtgagatggtatctcattgtggttttgatttgcatttctctgatggccagtgatgatgagcattttttcatgtgtttgttggctgcataaatgtcttcttttgagaagtgtctgttcatatccttcacccaattgttgatggggtagtttgtttttttcttgtaaatttgttagagttcattgtagattctggatattagccctttgtcagatgagtaggttgcgaaaattttctcccgttttgtaggttgcctgttcactctgatggttgtttcttttgctgtgcagaagctctttagtttaattagatcccatttgtcaattttggcttttgttgccattgcttttggcgttttagacatgaagtccttgcccatgcctgtg

SEQ ID NO: 12322 - DNA, 218 bp, Homo sapiens
gccagttttcccagtaccatttattaaatagggaatcctttccccattgcttgtttttgtcaggtttgtcaaagatcagatagttgtagacatgcagcgttatttctgagggctctgttctgttccattgatctatatctctgttttggtaccagtaccatgctgttttggttactgtagccttgtagtatagtttgaagtcaggtagtgtgatgcct

SEQ ID NO: 12323 - DNA, 575 bp, Homo sapiens
tattggttattctagttatacattcgtctaaatttttttcaaagttttcaacttctttgcctttggtttgaatttcctcctgtagcttggagtagtttgatcttctgaagccttcttctctcaactcgtcaaagtcattctccgtccagctttgttcagttgctggtgaggagctgcattcctttggaggaggagagccactctgctttttagagtttccagtttttctgctccgtttttttccccatctttgtggttttatcaaagacttttggtctttgatgatggtgatgtacagacaggtttttggtgtggatgtcctttctgtttgttagttttccttctaacagacaggaccctcagctgcaggtctgttggagtttgctagaggtccattccagaccctgtttgcctgggtaccagcagcggtggctgcagaacagcggattttcatgaaccgcgaatgctgctgtctgagcgttcctctggaagttttgtctccgaggagtacccggccgtgtgaggtgtcagtctgcccctactggggggtgcctcccagttaggctgctaggggg

SEQ ID NO: 12324 - DNA, 374 bp, Homo sapiens
tattggttattctagttatacattcgtctaaatttttttcaaagttttaacttctttgcctttggtttgaatttcctcctgtagctcgtagtttgattgtctgaagccttcttctctcatctcatcaaagtcattctccatccagctttgttccattgctcgtgaggaactgcgatcctttggaggagaagaggtgctctgctttttagagtttccagtttttctgctgtgttttttccccatctttgtggttttatctccttttggtctttgatgatggtgatgtacagatggctttttagtgtggatgtcctttctgtttgttagttttccttctaacagacaggaccctcagctgcaggtctgttggagtt

SEQ ID NO: 12325 - DNA, 238 bp, Homo sapiens
cccacaagagaaagcaggaaagatctaaaattgacaccctaacatcacaattaaaagaactagagaaacaagagcaaacacattcaaaagctagcaaaatgcaagaaataactaagatcagagcagaactgaaggaaatagagacacaaaaaacccttcaaaaaatcaatgaatccaggagctggttttttgaaaagatcaacaaaattgatagactgctagcaaggctaataaagaa

SEQ ID NO: 12326 - DNA, 218 bp, Homo sapiens
gccagttttcccagcatcatttattaaatagggaatcctttccccattgcttgtttttctcaggtttgtcaaagatcagatagttgtagatatgcggcgttatttctgagggctctgttctgttccattgatctttatctctgttttggtaccaataccatgctgttttggttactgtagccttgtagtatagtttgaagtcaggtagcgtgatgcct

SEQ ID NO: 12327 - DNA, 566 bp, Homo sapiens
tattggttattctagttctacattcgtctgaatttttttcacagttttcaacttctttgcctttggtttgaatttcctcttgttgctcggagtagtttgatcgtctgaagcctttttctctcaacttgtcaaagtcattctctgtccaccattgttccgttgctgatgaggagctgcgttcctttggaggacgagaggtgctctgctttttagagtttccagtttttctgctctgttttttccccatctttgtggttttatctacttttggtctttgatgatggtgacgtacagatgggtttttggtgtggatgtcctttctgtttgttagttttccttctaacagacaggaccctcagcttcaggtctgttggagtttgctggaggtccactccagaccctgtttgcctgggtaccagcagtggtggctacaggacagcggattttcgtgaaccatgaatgctgctgcctgatcgttcctctggaagttttgtctcagaggagtacccggccgtgtgaagtgacagtctgcccctactggggggtgcctcccagttaggctgctc

SEQ ID NO: 12328 - DNA, 914 bp, Homo sapiens
agtccccagagtgtgatgttccccttcctgtgtccatgtgatctcactgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagcctttgctattgtgaataatgccgcaataaacatacgtgtgcatttgtctttatagcagcatgatgtatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtccttcgcccactttttgatggggttgtttttttcttgtaaatttgcttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttgtcttttgttgccattgcttttggtgttttagtcatgaagtccttgcccatgcctgtg

SEQ ID NO: 12329 - DNA, 218 bp, Homo sapiens
gccagttttcccagcaccatttattaaatagggaatcctttccccattgcttgtttttctcaggtttgtcaaagatcagatagttgtagatatgcggcattatttctgagggctctgctctgttccattgatctatatctctgttttggtaccagtaccatgctgtttcggttactgtagccttgtagtatagtttgaagtcaggtagcgtgatgcct

SEQ ID NO: 12330 - DNA, 908 bp, Homo sapiens; identical to SEQ ID NO: 12309

SEQ ID NO: 12331 - DNA, 908 bp, Homo sapiens; identical to SEQ ID NO: 12309

SEQ ID NO: 12332 - DNA, 1049 bp, Homo sapiens
agggtacatgtgcacattgtgacggttagttacatatgtatacatgtgccatgctggtgcgctgcacccactaacttgtcatctagcattaggtatatctcccgatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtatatatgtgccacattttcttaatccagtctatcattgctggacatttgggttggttccaagtctttgctattgtgaatagtgccacaataaacatacgtgtgcatgtgtctttatagcagcatgatttatagtcctttgggtatatacccagtaatgggatggctgggtcaaatggtatttctagttctagatccctgaggaatcaccacactgacttccacaatggttgaactagtttacagtcccaccaacagtgtcaaagtggtcctatttctccacatcctctccagcacttgttgtttcttgactttttaatggttgccattctaactggtgtgagatggtatctcattgtggttttgatttgcgtttctctgatggccagtgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcaaaaattttctcccattttgtaggctgcctgttcagtctgatggtagtttcttttgctgtgcagaagctctttagtttaattagatcccatttgtcaattttgtcttttgttgccattgcttttggtgttttggacatgaagtccttgcccatgcc

SEQ ID NO: 12333 - DNA, 919 bp, Homo sapiens
cccactgtcaacattagacagatcaatgagacagaaagttaacaaggatacccgggaattgaactcagctctgcaccaagtggacctaatagacatctacagaactctccactccaaatcaacagaatatacatttttttcagcaccacaccacacctattccaaaactgatcacatagttggaattaaagctatcctcagcaaatgtaaaacatcagacattataacaaactgtttctcagaccacagtgcaatcaaactagaactcaggattaagaaactcactcaaaaccactcaactacatggaaacagaacaacctcctcctgaatgaccactgggtacataatgaaatgaaggcagaaataaagatgttctttgaaaccgacgagaacaaagacacaacataccagaatctctgggacacattcaaagcagcgtgtagagggaaatttatagcactaaatgcccacaagagaaagcaggaaagatccaaaatggacaccctaacatcacaattaaaagaactagaaaagcaagagcaaatacattcaaaagctagcagaaggcaagaaataactaaaatcagagcagaactgaaggaaatagagacacaaaaaactcttcaaaaaaattcgtgaatccaggagctggttttttgaaaggatcaacaaaattgatagaccactaacaagactaataaagaagaaaagagagaagaatcaaatagacacaataaaaaatgataaaggggatatcaccactgatcctacagaaatagaaactactatcagagaatactacaaacacctctacgcaaataaactagaaaatctagaagaaatggataaattcctcgacacatacaccctcccaagactaaaccaggaagaagttgaatctctgaatagaccaacaac

SEQ ID NO: 12334 - DNA, 1093 bp, Homo sapiens
tctttttttttattttattattattatactttaagttttagggtacatgtgcacaacgtgcaggtttgttacatatgtatacatgtgccatgttggtgtgctgcacccattaactcatcatttagcattaggtatatctcctaatgctatccctcccccctccccccaccccacaacagtccccggtgtgtgatgttccccttcctgtgtccatgtgttcttattgttcaattcccacctatgagtgagaacatgcggtgtttgctttttgtccttgtgatagtttgctgagaatgatggtttccagcttcatccatgtccctacaaagggcatgaactcatcattttgtatggctgcatagtattccatggtgtagatgtgccacattttcttaatccagtctatcattgttggacatttggcttggttctaagtctttgctattgtgaatagtgccacaacaaacatacgtgtgcatgtgtctttatagcagcatgatttacaatcttttgggtatatacccagtaatgggatggctgggtcaaatggtatttctagttctagatccctgagaggaatcaccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgaccgccagtgatgatgagcatttttttatgtgttttttggctgcataaatgtcttcttttgagaaatgtctgttcttatcctttgcccactttttgatggggttgtttgtttttcttcttgcaaatttgtttgagttcattgtagattctggatattagccctttgtcagatgagtaggttgcaaaaattttctcccgttctgtaggttgcctgttcgctctgatggtagtttcttttgctgtgcagaagctctttagtttaattacatcccatttgtcatttttggcttttgttgccattgcttctggtgttttagacatgaagtccttgcccatgcc

SEQ ID NO: 12335 - DNA, 410 bp, Homo sapiens
gctggtgaggagctgcattcctttggaggaggagaggtgctctgatttttagagtttccggtttttctgctctgttttttccccatctttgtggttttgtctacctttggtctttgatgacagtgacgtacagatgggtttttggtgtggatgtcctttctgtttgttagttttccttctaacagtcaggaccctcagctgcacgtctgttggagtttgctggaggtccactccagaccctgtttgcctgggtatcagcagcggtggttgcagaacagcagatattggtgaaccacaaatgctgctgcctgatcattcctctggaagttttgtctcagaggagtatccggccgtgtgaaatgtcagtccacccctactggggggtgcctcccagttaggctactcggggg

SEQ ID NO: 12336 - DNA, 448 bp, Homo sapiens
caaacttatgctgagaaaaattccaccttcctgtttttaattgctctacattttaccccaattacaaacatcaaactgtgttcattatggaatgtatggaaaatatgtaagtatttaaagcagaaataacaacaacaatattaattctgctttctacaaaacaccatcagtttttagtgtatttccttagtcttttctatttagacatgctaacagatgggaagtatagtcatatttttatatacttaagattatatgcagtattgtatcctgatttttttccacttccttcataagtgtttctccacatcatcaaaaccttttatgtagtttctttatgctatgtatacagtataatttaggtatactttcctttatatttaaacattgatattgcttttacttcctgccattgtaaaaactgttgtgataaacatctttctgcata

SEQ ID NO: 12337 - DNA, 218 bp, Homo sapiens
gccagttttcccagcaccaattattaaatagggaatcctttccccattgcttgtttttgtcacgttcgtcaaagaccagatagttgtagatatgtggcattattactgagggctctgttctgttccattggtctatatctctgttttggtaccagtactatgctgttttggttactgtagccttgtagtatagtttgaagtcaggtagcgtgatgcct

SEQ ID NO: 12338 - DNA, 760 bp, Homo sapiens
attggttattctagttatccatttgtctaattttttttcaaagcttttaacttctttgccattggttcgaatttcctcctgtagctcggagtagtttgatcatctgaagccttcttttctcaactcgtcaaagtcattctccgtccagctttgttccgttgctggtgaagagttgcattcctttggaggaggagaggcgctctgatttttagagtttccagtttttctgctctgtttttttcccatctttgtggttttatctacctttgttcttcgatgatggtgacgtacagatgggtttttggggtggatgtcctttctgtttgttagttttccttctaacagacaggaccctcagctgcaggtctgttggagtttgccagaggtccactccagaccctgtttgcctggatatcagcagttgaggctgcagaacagcgaatattggtgaacagcaaatgctgctgcctgatcgttcctctggaagttttgtctcagaggagtacccggccgtgtgaggtgtcagtctgcccctactgggggatgcctcccagttaggctacccaggggtcagggacccacttgaggaggcactctgtccattctcagatctccagctgcatgctgggagaaccactgctgtcttccaagctgtcaggcagggacatttaagtctgcagaggtttctgctgccttttgtttggctatgccctgcccccagaggtggagtctacagaggcaggcaggcctccttgagatg

SEQ ID NO: 12339 - DNA, 914 bp, Homo sapiens
agtccccagagtgtgacgttccccttcctgtgtccatgtgttctcattgttcagttcccacctatgagtgagaatatgcggtgtttggttttttgttcttgtgatagtttactgagaatgatgatttccaatttcatccatgtccctacaaaggacatgaactcatcatttttcatggctacatagtatcccatggtgtatatgtgccacattttcttaatccagtctatcattgttggacatttgggttggttccaagtctttgctattgtgaatagtgccgcaataaacatacatgtgcatgtgtctttatagcagcatgatttatagtcctttgggtatatacccagtaatgggatggctgggtcaaatgctatttctagttctagatccctgaggaatcgccacactgacttctgcaagggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtccttcgcccactttttgatggggttgtttgtttttttcttgtaaatttgtttgagttcattgtagattctggatactagccctttgtcagatgagtaggttccaaaaattttctcccattttgcaggttgcctgttcactctggtggtagtttcttttgctgtgcagaagctctttagtttaattagatcccatttgtcaattttggtttttgttgccattgcttttggtgttttagacatgaagtccttgcccatgcc

SEQ ID NO: 12340 - DNA, 848 bp, Homo sapiens
agggtacatgtgcacattgtgcaggttagttacatatggatacatgtgccatgctggtgtgctgcacccactaactcgtcatctagcattaggtatatctcccagtgctatccctccccccccaaccccaccacagtccccagagtgtgatattccccttcctctgtccatgtgatctcattgttcaattcccacctatgagtgagaatatgtggtgtttggttttttgttcttgcgatagtttactgagaatgatgatttccaatttcatccatgtccctacaaaggacatgaactcatcattttttatggatgcatagtattccatggtgtatatgtgccacatgttcttaatccagtctaccactgttggacatttgggttggttccaagtctttgctattgtgaataatgccacaataaacatacgtgtgcatgtgtctttataacagcatgatttatagtcctttgggtatatacccagtaatgggatggctgggtcaaatggtatttctagttctagatccttgaggtatcgccacactgactttcacaatggttgaactagtttacagtcccaccaacgtgtaaaagtgttcctatttctccacatcctctctagcacctgttgtttcctgactttttaatgattgccattctaactggtgtgagatggtagctcattgtggttttgatttgcatttctctgatggccagtgatgatgagcattttttcacgtgttttttggctgcataaatgtcttcttttgggaagtgtctgttcatgtccttcgcccactttttgatggggttgtttttttcttgtaaatttgtttgagttcattgta

SEQ ID NO: 12341 - DNA, 1086 bp, Homo sapiens
tcccgttttgttttttttttttaattatactttaagttttaggatacatgtgcacaactttcaggtttgttacatatgtatacatgtgccatgttggtgtgctgcacccattaactcgtcatttacattaggtatatctcctaatgctatcccttctccctctccccaccccacaacaggccccagtgtgtgatgttccccttcctgtgtccaactgttctcactgttcaattcccacctatgagtgagaacatgcagtatttggttttttgtccttgcgatagtttgctgagaatggtggtttccaggttcatccatgtccctacaaaggacatgaactcatcttttttatggctgcatagtattccatggtgtatatgtgccacattttcttaatccagtctatcattgttggacatttgggctggttccaagtctttgctattgtgaatagtgccgcaataaacatacgtgtgcatgtgtctttatagcagcatgatttataatcctttgggtatatacccagtaatgggatggctgggtcaaatggtatttctagttctagatccctgaggaatcgccacactgacttccacaagggttgaactagtttacagtcccaccatcagtgtaaaagtgttcctatctctcgacatcctctccagcacctgttgtttcctgactttttaatgatcgccattctaactgatgtgagatggtatctcattgtggttttgatttgcatttctctgatggccagtgatgatgagcattttttcatgtgtcttttggctgcataaatgtcttcttttgagaagtgtttgttcatatccttcacccacttattgatggggttgtttttttcttgtaaatttgtttgagttcattgtagattctggatattagccctttgtcagatgtgtagattgcaaaaattttctcccattctgtaggttgcctgttcactccgatggtagtttcttttgctgtgcagaagctctttagtttaattagatcccatttgtcaattttggcttttgttgccattgcttttggtgttttagacatgaagaccttgcccatgcc

SEQ ID NO: 12342 - DNA, 1310 bp, Homo sapiens
ttctctaaacttcccttctcgcttcatttcattcatttcatcttccatcgctgataccctttcttccagttgattgcatcggctcctgaggcttctgcattcttcacgtagttctcgagccttggttttcagctccatcagctcctttaagcacttctctgtattggttattctagttatacattcttctaaatttttttcaaagttttcaacttctttgactttggtttgaatgtcctcccgtagctcagagtaatttgatcgtctgaagccttcttctctcagctcgtcaaagtcattctccatccaggtttgttccgttgctggtgaggaactgcgttcctttggaggaggagaggcgctctgctttttagagtttccagtttttctgttgtgttttttccccatctttgtggttttatctacttttggtctttgatgatggtgatgtacagatgggtttttggtgtggatgtcctttctgtttgttagttttccttctaacagagaggaccctcagctgcaggtctgttggagtaccctgccgtgtgaggtgtcagtgtgcccctgctgggggggtgcctcccagttaggctgcttgggggtcaggggtcagggacccacttgaggaggcagtctgcctgttctcagatctccagctgcatgctgggataaccactgctctcttcaaagctgtcagacagggacatttaagtctgcagaggttactgctgtctttttgtttgtctgtgccctgcccccagaggtggagcctacagagacaggcaggcctccttgagctgtggtgggctccacccagttcgagcttcccggctgctttgtttacctaatcaagcctgggcaatggcgggcgcccctcccccagcctcgctgccgccttgcagtttgatctcagactgctgtgctagcaatctgtgagactccgtgggcgtaggaccctccgagccaggtgcaggatataatctcgtggtgtgccgttttttaagcccgttggaaaagcgcagtatttgggtgggagtgacctgattttccaggtgccgtccgtcacccctttctttgactcaggaagggaactccctgaccccttgcgcttcccaagtgaggcaatgcctcgccctgccttggctcgcacacggtgtgcgcacccactgacctgcgcccactgtctggcactccctagtgagatgaacccggtacctcagatggaaatgcagaaatcacccgtcttctgtgtcgctcacgctgggagctgtagaccggagctgttcctattcggccatcttggctcc

SEQ ID NO: 12343 - DNA, 218 bp, Homo sapiens
cccactttttgatggggttgtttgtttttttcttgtaaatttgtttgagttcattgtagattctggatattagccctttgtcagaggagtaggttgtgaaaattttctcccattttgtaggttgcctgttcactctgatggtagtttcttttgctgtgcagaagctctttagtttaatcagatcccatttgtcagttttggcttttgttgccattgct

SEQ ID NO: 12344 - DNA, 914 bp, Homo sapiens
agtccccagagtgtgatgttccccttcctgtgtccatgtattctcattgttcagttcccacctatgagtgagaatatggggtgtttggttttttgttcttgcggtagtttactgagaatgatgatttccaatttcatccatgtccctacaaaggacatgaactcataattttttatggctgcatagtattccatggtgtatatgtgccacattttcttaatccagtctatcattgttggacatttgggttggttccaagtctttgctattgtgaataacgccgcaataaacatacgtgtgcatgtgtctttatagcagcatgatttatagccctttgggtatatacccagtaatgggatggctgggtcaaatggtatttctagttctagatccctgaggaatcaccacactgacttccacaagggttgaactagtttacagtcccaccaacagtgtaaaagtgttcctatttctccacatcctctccagcacctgttgtttcctgactttttaatgatcaccattctaactggtgtgagatggtatctcattgtggttttgatttgcattcctctgatgaccagtgatgatgagcattttgttgtgtgttttttggctgcataaatgtcttcttttgagaagtatctgttcgtgtccttcgtccactttttgatggggttgtttgtttttttcttgtaaatttgtttgagttcactgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcc

SEQ ID NO: 12345 - DNA, 1183 bp, Homo sapiens
tattggttattctagttatacattcatctaattttttttcaaagttttcaacttctttgcctttggtttgaatttcctcctgtagcttggagtagtttgatcgtctgaagccttcttctctcaactcgtcaaagtcattctctgtccagctttgttccattgctggtgaggaactgcattcctttggaggaggagagacactctgctttttagggtttccggtttttctgctctgtttttccccatctttgtggttttatctacttttggtctttgatgatggtaatgtacagatgggttttttgtgtggatgtcctttctgtttgttagttttccttctaacagacaggactcccagctgcaggtctgttggaatttgctagaggtccactccagatgctgtttgcctgggtaccagcagcggtggctgcagaacagtggatttttgtgaaccgtgaatgctgctgtctgattgctcctctggaagttttgtctcaggggagtacccggccgtgtgaggtgtcagtctgcctctactggggggtgcctcccagttaggttgctcaggggtcaggggtcagggacccacttgaggaggcagtctgcccattctcagatctccagctgtgtgctgggagaaccactgctctcttcaaagctgtcagacggggacatttaagtctgcagaggttactgctgtctttttgtttgtctgtgccctgcccccagaggtgaagcctacagaggcaggcaggcctccttgagctgtggtgggctccacccagttcgagcttccctgctgctttgtttacctaagcaagcctgggcaatggtgggcgcccctcccccagcctcattgctgccttgcagtttgatctcagactgctgtgctagcaatcagtgagactccgtgggcataggaccctccgagccatgtgcgggatataatctcctggtgcgccgttttttaagcccgtcagaaaagcgcagtattagggtgggagtgactcaattttccaggtgccgtctgtcacccctttctttgactaggaaagggaactccctgaccccttgcacttcccgagtgaggcaatgcctcgccctgcttcggctcacgcatggtgtgctgcacccactgtcctgcacccactgtctggcactccctagtgagatgaacccggta

SEQ ID NO: 12346 - DNA, 1087 bp, Homo sapiens
ttattattattattattattatactttaagttttagggtacatgtgcacaacgtgcaggtttgttacatatgtatacacgtgccatgttggtgtgctacacccattaactcgtcatttagcattaggtatatctcctaatgttattcctcccccctccccccatgccacaacagtccccggtgtgtgatgttccccttcctgtgtccatgtattctcattgttcaattcccacccatgagtgagaacatgcggtgtttggtttttttgtccttgcgatagtttgctgagaatgatggtttccaacttcatccatgtccatacaaaggacatgaagtcatccttttttatggctgcaaagtattccatggtgtatatgtgccacattttcttaatccagtctatcattgatggacatttgggttggttccaagtctttgctattgtgaatagtgccgcaataaacatacatgtgcatgtgtctttatagcagcatgatttatagtcctttgggtatatacccagtaatgggatggttgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatcattctaactggtgtgagatggtatctcattgtggtttcgatttgcatttctctgatggccagtgatgatgagcattttttcatgtgttttttggctgcataaatgtcttcttttgagaagtgtctgttcatatcctttgcccactttttgatggggttgtttgtttttttcttgtaaatttgtttgagttcattgtagattctggatattagccctttgtcagatgagtagattgcaaaaattttctcccattctgtaggttgcctgttcactctgatggtggtttcttttgctgtgcagaagctctttagcttaattagatcccatttgtcgattttgcttttgttgccattgcttttggtgttttagacatgaagtccttgcctatgcctgtg

SEQ ID NO: 12347 - DNA, 410 bp, Homo sapiens
gctggtgaagagctgcgttcctttggaggaggagaggtgctctgatttttagagtttccggtttttctgctctgttttttccccatctttgtggttttatctacctttggtctttgatgatggtgacgtacagattggtttttggtgtggatgtcctttctgttagttagttttccttctaacagtcaggaccctcagctgcaggtctgttggagtttcctggaggtccactccagaccctatttgcctgggtatcagcagcagtggctgcagaacagcagatattggtgaactgcaaatcctgctgcctgatcgttcctttggaagttttgtctcagaggagtacctggccatgtgacgtgtcagtctgcccctactggggggtgcctcccagttaggctactcgggag

SEQ ID NO: 12348 - DNA, 914 bp, Homo sapiens
agtccccagagtgtgatgttccccttcctgtgtccatgtattctcattgttcagttcccacctatgagtgagaatatggggtgtttggttttttgttcttgcggtagtttactgagaatgatgatttccaatttcatccatgtccctacaaaggacatgaactcataattttttatggctgcatagtattccatggtgtatatgtgccacattttcttaatccagtctatcattgttggacatttgggttggttccaagtctttgctattgtgaataacgccgcaataaacatacgtgtgcatgtgtctttatagcagcatgatttatagccctttgggtatatacccagtaatgggatggctgggtcaaatggtatttctagttctagatccctgaggaatcaccacactgacttccacaagggttgaactagtttacagtcccaccaacagtgtaaaagtgttcctatttctccacatcctctccagcacctgttgtttcctgactttttaatgatcaccattctaactggtgtgagatggtatctcattgtggttttgatttgcattcctctgatgaccagtgatgatgagcattttgtcatgtgttttttggctgcataaatgtcttcttttgagaagtatctgttcgtgtccttcgtccactttttgatggggttgtttgtttttttcttgtaaatttgtttgagttcactgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcc

SEQ ID NO: 12349 - DNA, 571 bp, Homo sapiens
tattggttattctagttatacattcgtctaaatttttttcaaacttttcaacttctttgcctttggtttgaatttcctcctgtagctcggagtagtttgatcatctgaagccttcttctctcaacttgtgaaagtcatcctccttccagctttgttgcattgctggtgaggaactgcattcctttggaggaggagaggcactctggtttttagagtttccagtttttctgctctgttttttccccatctttgtggttttatctacttttggtctttgatgatggtgacgtacagatgggtttttggtgtggatgtcctttctgtttgttagttttccttctaacagacaggaccttcagctgcaggtctgttggagtttgctagaggtccactccagaccctgtttgcctgggtatcagcagcggtgtttgcaaaaccgcggattttcgtgatctgcgaatgctgctgtctgatcgttcctctagaagttttgtctcagaggagtacccggccgtgtgagttgtcagtctgcccctacttgggggtgcctcccagttaggctgctcggggg

SEQ ID NO: 12350 - DNA, 1098 bp, Homo sapiens
tttttttttatttttttattttattataattatactttaagttttagggtacatgtgcacaacgtgcaggtttgttacatatgtatacatgtgccatgctggtgtgctgcacccattaactcgtcatttagcattaggtatatctcctaatgctatccctcccccctcccccaaccgcacaacagtccccaaagtgtgatgttccccttcctgtgtccatgtgttctcattgttcaattcccacctatgagtgagaacatgcagtgtttggttttttgtccttatgatagtttactgagaatgatgatttccaatttcatccatgtccctacaaaggacatgaactcatccttttttatggctgcatagtattccacggtgtatatgtgccacattttcttaatccagtctatcattgttggacatttgggttggttccaagtctttgctattgtgaatagtgccgcagtaaacatatgtgtgcatgtgtctttatagcagcatgatttgtagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctttccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtccttcgcccactttttgatggggttgtttgttttttttcttgtaaatttgtttgagttcattgtagattctggatattagccctttgtcagatgagtaggttgtgaaaattttctcccattttgtaggttgcctgttcactctgatggtagtttctcttgctgtgcagaagctctttagtttaattagatcccatttgtcaattttggcttttgttgccattgcttttggtgttttagacatgaagtccttgcccctgcc

SEQ ID NO: 12351 - DNA, 218 bp, Homo sapiens
gccagttttcccagcaccatttattaaatagggaatcctttccccattgcttgtttttctcaggtttgtcaaagatcagatagttgtagatatgtggcattatttctgagggctctgttctgttccattgatctatatccctgttttggtaccagtaccatgctgttttggttactgtagccttgtagtatagtttgaagtcaggtagcatgatgcct

SEQ ID NO: 12352 - DNA, 902 bp, Homo sapiens
atgctccccttcctgtgtccacgtgttctcattgttcaattcccacctatgagtgagaatatgcggtgcttggttttttgttcttgcgatattttactgagaatgattatttccaatttcatccatgtcccttcaaaggacatgaactcatcattttttatggctgcatagtattccatggtgtatatgtgccacattttcttaatccagtctatcattgttggacatttgggttggttccaagtctttgctattgtgaatagtgccacaataaacatacgtgtgcatgtgtctttatagcagcgtgatttatagtcctttgggtatatacccagtaatgggatggctgggtcaatggtatttctagttctagatccctgaggaatcaccacactgacttccacaatggttgaactagtttacagtcccaccaacagtgtaaaagtgttcctatttctccacatcctctccagcacctgttgtttcctgactttttaatgatcaccattctaactggtgtgagatggtatctcattgtggttttgatttgcatttctctgatggccagtgatgatgagcattttttcatgtgtttgttggctgcataaatgtcttcttttgagaagtgtctgttcatatccttcacccaattgttgatggggtagtttgtttttttcttgtaaatttgttagagttcattgtagattctggatattagccctttgtcagatgagtaggttgcgaaaattttctcccgttttgtaggttgcctgttcactctgatggtagtttcttttgctgtgcagaagctctttagtttaattagatcccatttgtcaattttggcttttgttgccattgcttttggcgttttagacatgaagtccttgcccatgcctgtg

SEQ ID NO: 12353 - DNA, 3056 bp, Homo sapiens
gatgatttacaaaattttatttttcaaggttgaacaatgattcattgtaggctttcagatgaaacaattagcagtcttgaagtacacattgaatacaaattaatttgatttcagtaggcacatttcttggaacaaactgaagagtacttaaaagatcccattgaatgcatgtggcattattcctagtttacggatactgtttgaactaaatgaatcttgggagagggcagttagtaattaatgcatttagaaactgatagcgctaaaatattaaaacttatgcattccaatgtttacatgtgtatgtgtgtgtgcacatgtgattctgctttgcctgttttactatcttaatgattatcccttcttactgtttcctctgaggatcttatctcacttctactgacagtcagaaattttcttatcagcccttttatccatcatttctagttttcaaatatttccaataatgccttttattttagacaagggctttgttgaaaacctaattacaccaaaataaaaccatactttatccctagtgctgctcataacctgccagaactttcatgcttcaaatcacaagggctagggaaattgtctagtcaggagcccccctccacacttctgtgatgggctggggcttccaggtactgctgctacaaggtaatgtatagatataatttcttctgtctcttacaaaataaactgaccatgaaatatcattgtcccttcactttcttgtttcagctggcaaaggatgtaaagattccagatggatttacatctaagtcagaaatattcattacctatgagccactttaaatattttctgtcctttctaaatgattacctaacatttcgatctccctttttgacatgtgcccagcttcctttctttattaacactttatcctttaaagctcggtttatcatttacaatctctcttacttggttactttgggacaccattgtagattcaggtcacttttgcctatttttaccagaataactgccacagagtgcaatgggggttgacttcctaaaatagtttactgtcttactgtcttcaaatatgattttaagataaaacttatttttaagcttaactttgagtaaatattatgaagaaaaaatgaattattaaaagacttgattctacacactacgtatatgaggaaattttctgaaattaaaacatagcaagctccatttgctcagcgatgaggtacttgcacaaagttccccatggccttttggtgtacaaatttataataatgaagactacttctaagaaaaaaaatttgacataaaagtttgtttttaaaaaaaaaaaactactgcattcaaaaagttgtttgagttgtaaacactcaaggataagccagttttaggatcacattattgtgtcacagtaaaagaaatgtgagtcacatttatttccttaattaatggattcaggctttcctaaattctcaataatgagctacactacattcttgatgtaagttgttaggaaaatccaaatcttcatttctagcactaagtgtcaagaaatgtgctattatgaaatcacacatagtcagctgcttttgtattttggttaaccaggtagtttgaaaattattttcccactagcactgtcctcagattttagaagcagaactagaggaattatattgaggtatactttgtggcagttctgttgcttctctattgccccagaatttaccatggtattgaggatggatatgcagaaattatgctcttcatcaggtagcagttaccataggtgaccaaacatcacctgtctatggcgtctataacatatttgggtgatggactagcatgactttcactactctaattttgcaggcttatatatatggtgaaagttgtatattttgtgaaatcttttttttaacctttaacattaagtcgttacacatgaacttatcactgaatatgtttagattaatttctgattttacaaaaaatgaaatctgaaaaacacagatattagcaaagttttttcatagttatgtttaattctttttgtttaatactggaaggaagcttttgtgtagtctaatcttggattgggcaaatatttgatgctgtctgatagtcacactgttggccagataataattttgataaatcaatctatctctgctttggggagtagaatttgacgcctaccttaaggtattaaaaaatactcattctacagtacacgtgtataggagttcagtcctgtattcaggctcacaactgtattatttggtggtttgtaacaacagctattgcacatcttttgggggttctgagaaaaaccaagcgtctggggctttcttcctttcttcttatcaggagaaaaccagcttaaaaatgggtgaaaagaacaaaactggtctttaactgtaggcttaattggcatgaatcagtgagaaaacgagtggtggccttttcccctttgtcgccatagttttctctgggcatgcaggttgttcaaccttagtctgggttataataatctttaagatttttgtttcttgactaaacctttggttctttatatagctttggaaaaatcacacacagtttgccgatgtttttctttttctgaaaaatcttatcccagtgccaattcttttgaaggctgcttgtaatctaattcataacaggtttctttactccatgttgtaaaatctgaatacagatactgtccaaactgtccaaagagtaatgtttgaattcacagtaacaaaagttacaaagtttgtgcaaaagacattgtacaccattggagtacctagagcttgctatagttaattttatacataaagctgcatttctcattaaaactattctgtgctacattaaaagtaaagttttggatttaatctttactaaaaataaaactgaatactcatttaatctctgaaatctgaagatgcagactgcctatacatgatgtttataatgtggtaataaatcactggaaacttttagacatcataattgctttggagctcttcaagttttccaagtgtca

SEQ ID NO: 12354 - DNA, 537 bp, Homo sapiens
gagcctacagaggcaggcaggcctccttgagctgtggtgggctccacccagttggagcttcccggctgctttgtttacctaagcgagcctgggcaatggcgggtgcccctccgccagcctcgctgcagccttgcagtttgatctcagactgctgtgctagcaatcagcaagactccgtgggcgtaggaccctccaagccaggtgcgggatataatttcctggtgcaccgtttcctaagcccgtcggaaaagcgcagtattcgggtgggagtggcccgattttccaggtgccgtctgtcacccctttccttgaccaggaaagggaactcccggaccccttgcgcttcccgtgtgatgcgatgccacgccctgcttcggctggcgcacggtgcgctgcacccactgtcctgcacctactgtctggcactccctagtgagatgaacccggtatctcagatggaaatgcagaaatcacccgtcttctgcgtcgctcacactgggagctgtagaccggagctgttcctatttggccatcttg

SEQ ID NO: 12355 - DNA, 910 bp, Homo sapiens
ccccagtgtgtaatgttccccttcctgtgtccatgtgttctcattgttcagttcccacctacgagtgagaacatgcggtgtttggttttctgtccttgcgatagtttgctgagaatgatggtttccagtttcatccatgtcccttcaaaggacatgagctcatcattttttatggccgcatagtattccatggtgtatatgtgccacattttcttaatccagtctatcattgttggacatttgggttgattccaagtctttgctattgtgaatagtgccgcaataaacatacgtgtgcatgcgtcttcatagcagcatgatttataatcttttgggtgtatacccagtaatgggatggctgggtcaaatggtatttctagttctagatccctgaggaatcaccacactaacttccacaatggttgaactagtttacagtcccaccacagtgtaaaagtgttcctatttctccacatcctctccagcacctgttgtttcctgactttttaatgattgccattctaactggtgtgagatggtatctcattgtggttttgatttgcatttctctgatggccagtgatgacgaacattttttcatgtgtctgttggctgcataaatgtcttcttttgagaagtgtctgttcatatccttcacccactttttgatggggttgtttgtttttttcttgtaaatttgtttgagttcactatagattctggatattagccctttgtcagatgagtaggttgcaaaaattttctcccattctgtaggttgcctgttcactctgatggtagtttcttttgctgtgcagaagctctttagtttagttagatcccatttgtcaattttggattttcttgccattgcttttgttgttttagatatgaagtccttgcccatgcc

SEQ ID NO: 12356 - DNA, 565 bp, Homo sapiens
ttttagaattttcagcttttctgctctggtttctccccatctttgtggttttatctacctttggtctttgatgatggtgacctacagatggggttttggtgtggatgtcctttttattgatgttgatcctattcctttctgtttgttagttttccttctaacagtcaggaccctcagctgcaggtctgttggagtttgctggaggtcctctccagaccctgtttgctggggtatcactagcggaggctgcagaacagcaaatattgcagaacagcaaatgttgctgcctgatccttcctctagaagcttcgtctcagaggggcacccggctgtatgaggtgtcagtcggcccctactgggagttgtctcccagttaggctattcgggggtcagggacccacttgaggaggcagtctgtcagttctcaaatctcaaactccgtgctgggagaaccactactctcttcaaagctgtcagacagggacgtttaagtctgcagaagtttctgctgccttttgttcagctgtgccctgaccccagaggtggagtctacagaggcaggcag

SEQ ID NO: 12357 - DNA, 410 bp, Homo sapiens
gctggtgaggagctgcattcctttggaggaggagaggggctctgatttttagagtttccagtttttctgctctgttttttccccatctttgtggttgtgtctacctttggtctttgatgatggtgacaaacagatggggttttggtgtggatgtcctttctgtttgttagttttccttctaacagtcaggaccctcagctgcaggtctgttggagtttgctggaggtccactccagactctgtttgcctgggtatgagcagcagaggctgcagaacagcggatcttggtgaaccacaaatactgctgcctgattgttcctctggaagttttgtctcagaggagtactcagtcatgtgaggtgtcagtctgcccctactggggggtgcctcccagttaggctactcggggg

SEQ ID NO: 12358 - DNA, 318 bp, Homo sapiens
tcttttcatgtgtcttttggctgcataaatgtcttcttttgagaagtgtctgttcacacccttcgcctactttttgatggggttgtttgtttttttcttgtaaatttgtttgaattcattgtagattctgtatattagccctttgtcagaagagtagattgcaaaaattttctcccattctgtaggttgcatgttcgctctgatggtagtttctttggctgtgcagaaactctttagtttaattagatcctctttgtctattttggcttttgttgtcattgcttttggtgttttagacatgaagtccttgcccatgcc

SEQ ID NO: 12359 - DNA, 913 bp, Homo sapiens
agtccccagagtgtgatattccccttcctgtgtccatgtgatctcattgttcagttcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatcccgtctatcattgttggacatttgggttggttccaagtctttgctattgtgaataatgccgcaataaacatacgggtgcatgtgtctttatagcagcatggtttatagtcctttgggtatatacccagtaatgggatggctgggtcaaatggtatttccagttctagatccctgaggagtcgccacactgacttccacaatggttgaactagtttacagtcccaccaacagtgtaaaagtgttcctatttctccacatcctctccagcacctgttgtttcctgactttctaatgattgccattctaactggtgtgagatggtatctcattgtggttttgatttgcatttctctgatggccagtgatgatgagcattttttcatttgttttttggctgcataaatgtcttcttttgagaagtgtctgttcatatcctttgcccactttctgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccattagtcaattttggcttttgtgccatgcttttttggtgtttagacatgaagtccttgcccatgcc

SEQ ID NO: 12360 - DNA, 210 bp, Homo sapiens
aacttaagtaagtttattataagttaagtgctttaacttcacaataacaaccttgtagggtaggttttaatatctttgttttaccgaggccacagaatgtcccagaagttaatgcagttactgaagtgtgagattggaaagtaaggcctcctagctctgcattcgatgctttttctactgtattctgtggcatagagttattagcatgat

SEQ ID NO: 12361 - DNA, 236 bp, Homo sapiens
tttccccatcttggtggttttatctacctttggtctttgatcatggtgacatacagatggggttttggtgtggatgtcctttctgtttgttagttttccttctaacagtcaggaccctcagctgcaggtctgttggagattgctggaggtccactccagaccctgtttgcctgggtatcagcagcagaggctgcagaacagcgaatattgctgaacagcaaatgttgctgcctgat

SEQ ID NO: 12362 - DNA, 378 bp, Homo sapiens; identical to SEQ ID NO: 12287

SEQ ID NO: 12363 - DNA, 171 bp, Homo sapiens
aggcagtctgtccattctcagatctcaaacttcatgctgggagaaccactacgctcttcaaagctgtcagacagggacatttaagtctgcagaggtttctgctgccttttgttcggctatgccctgcccccaaggtggaatctacagaggcaggcaggcctccttgacctg

SEQ ID NO: 12364 - DNA, 893 bp, Homo sapiens
atgttccccttcctgtgtccatgtgttctcactgttcattctcacctataatgagaacatgtggtgtttggttttttgtccttgcgatagtttgctgagaatgatggtttacagcttcatccatggtccctacaaaggacatgaactcatcattttttatggctgcataatattccatggtgtatatgtgccatattttcttaatccagtctatcattgttggatatttgggttggctccaagtctttgctattgtgaataatgccacaataaacatacgtgtgcatgtgtctttataacagcatgatttatagtcctttgggtatatacccagtaatgggatggctgggtcaaatggtatttctagttctagatccttgaggtatcgccacactgactttcacaatggttgaactagtttacagtcccaccaacgtgtaaaagtgttcctatttctccacatcctctctagcacctgttgtttcctgactttttaatgattgccattctaactggtgtgagatggtagctcattgtggttttgatttgcatttctctgatggccagtgatgatgagcattttttcacgtgttttttggctgcataaatgtcttcttttgggaagtgtctgttcatgtccttcgcccactttttgatggggttgtttttttcttgtaaatttgtttgagttcattgtagattctggatattagccttttgtcagatgagtaggtcgcaaaaattttctcccattttgtaggttgtttgttcactctgatggtagtttcttttgctgtgcagaagctctttagtttaattggatcccatttgtcaattttgtcttttgttgccattgcttttggtgttttagacatgaagtccttgcccatgcc

SEQ ID NO: 12365 - DNA, 518 bp, Homo sapiens
aggtggagtcatactctttattgtaaagctgattttaaatcagggtagcatttcaggaggaagatacgggctgactggcaatcaccccctctctggtctctttctggaagcttccctcatcagttcacatttcctcattgttatttaccaagaccacagatctcttgcagtttatcatggtgcacaaacccaccaggtattcatccaacgtatactccatcgactttttaatcccacatgtactcaagggagagtgggtttgtggttaagcaggtacttgtttaagaggctttcgtcatgccacagggcctcgatgtggttggcttggtcaatcatcatcacctggtgacaggccatgatcagcctgtaaacctccagcactgacccaccaaataaggcccctatataataaaagtccccttcaccctcaggaaaatgggcttgggactgaggctggcattcataggcaaaggtgtcccgatggaacccatagaagccaggatggatggtggcaaaca

SEQ ID NO: 12366 - DNA, 211 bp, Homo sapiens
ttttgatggggttgtctgattttttcttgtaaattgtttaagttctttgtagattctggatattagccctttgtcagatggatagattgtaaacattttctcccattctgtaggttgcctgttcactctgatggtagtttcttttgctgtgcagaagctctttagtttaattagatcccatttgtctattttggcttttgttgccattgct

SEQ ID NO: 12367 - DNA, 569 bp, Homo sapiens
attggttattctagttatccatttgtctaattttttttcagagtttttaacttctttgccattggttcaaatttcctcctgtagctcggagtagtttgatcttctgaagccttcctctctcaactcatcaaagtcattctccgtccagctttgttccgttgctggtgaggagctgtgttcctttggaggaggagaggtgctcagatttttagagtttccagtttttctgctctgttttttcctcatctttgtggttttatctacctttggtctttgatgatggtgacatacagatgggtttttggtgtggatgtcctttctgtttgttagtttttcttctaacagtcaggaccctcagctgcaggtctgttggagtttactggaggtccactccagccctgtttgcctgggtatcaacagcggtggctgcagaacagcggatattggtgaaccgcaaatgctgctgcctgatcattcctctggaagttttgtctcagaggagtacctggccatgtgaggtgtcagtgtgcccctactggggggcgcttcccagttaggctactcggggg

SEQ ID NO: 12368 - DNA, 334 bp, Homo sapiens
atggtgaaccagccttgcatcccagggatgaagcccacttgatcatggtggataaactttttgatgtgctgctggatttggtttgccagtatgttattgaggatttttgcatcgatgttcatcagggatattggtctaaaattctctttttttgttgtgtctctgccaggctttggtatttgatgatgctggcctcataaaatgagttagggacgattccctctttttctattgattggaatggtttcagaaggaatggtaccagctcctccttgtacctctggtagaattcggctctgaatccatctggtgctggactttttttggttggtaa

SEQ ID NO: 12369 - DNA, 914 bp, Homo sapiens; identical to SEQ ID NO: 12339

SEQ ID NO: 12370 - DNA, 821 bp, Homo sapiens
aatgctgctgtctgattgttcctctggaaattttgtctcagaggagtacccggccgtgtgaagtgtcagtctgccgctactgggggtgcctcccagttaggctgctcaggggtcaggggtcagggacccacttgaggaggcagtctgcctgttctcagatctccagctgcattctggaagaaccactgctctcttcaaagctgtcagacagggacatttaagtctgcagaggttaccgctgtctttttgtttgtctgtgccctgcccccagaggtggagcctacagaggcaggcaggcctccttgagctgtggtgggctccacccagttcgagcttccccactgctttgtttacctaagcaagcctgggcaatggtgggcgcccctcccctagcctcggggccgccttgcagtttgatctcagactgctatgctagcaatcagcgagactccgtgggcgtaggtccctccgagccaggtgtgggatataatctcctggtgcaccgttatttaagcccgttggaaaagcgcagtatttgggtggaagtgacccgattttccaggtgccgtctgtcacccctttctttgactaggaaagggaactccctgaccccttgcgcttccggagtgaggcaatgcctcgccctgctttggctcgtgcaacggtgcgctgcacccactgacctgtgcccactgtctggcactccctagtgagatgaacccggtacctcagatggaaatgcagaaatcacccatcttctgcgttgctcacgctgggagctgtagaccggagctgttcctattcggccatcttggctcctc

SEQ ID NO: 12371 - DNA, 148 bp, Homo sapiens
ggccattttcacaatattgattcttcctatccatgagcatggaatgttcttccatttgtttgtatcctcttttatttcgttgagcagtggtttgtagttctccttgaagaggtccttcacatcccttgtagattggattcctaggtat

SEQ ID NO: 12372 - DNA, 366 bp, Homo sapiens
ctcattgtggttttaatttgcatttctctgatggccagtgatggtgagcattttttcatatgttttttggctgcataaatgtcttcttttgagaagtgtctgttcatgtccttcgcccactttttgatgggttgtttgtttttttcttgtaaatttgtttgagttcattgtagattctggatagtagccctttgtcagatgagtaggttgcgaaaattttctcccattttgtaggttgcctgttcactctgatggtagtttctttgctgtgcagaagctctttagtttaattagatcccatttgtcaattttggcttttgttgccattgcttttggtgttttagacatgaagtccttgcccatgcc

SEQ ID NO: 12373 - DNA, 3063 bp, Homo sapiens
cctgaatttgaatgttggcctgccttgctagattggggaagttctcctggataatatcctgcagagtgttttccatcttggttccattctccccgtcactttcaggtacaccaatcagatgtagatttggtcttttcacatagtcccatatttcttggaggctttgttcatttctttttcttcttttttctctaaacttctcttctcgcttcatttcattcatttcgtgttccatcactgataccctttcttccacttgattgcattggctactgaggcttctgcatttgtcacggagctcttgtgtcttggttttcagctccattgggtcctttaaggacttctctgcattggttattctagttagccattcgtctaattttttttcaaagcttttaacgtctttgccattggttcgaatttcctcctgtacctcggagtagtttgatcatctgaagcattcttatctccacttgtcaaagtcattctctgtccagctttgttccattgctggtgaggagctgcgttcctttggaggaggagaggcactctgatttttagagtttccagtttttctgctctgttttttcccatctttgtggttttacctacccttttgtctttgatgatggtgatgtacagatgggtttttggtgtggatgtcctttctgtttgttagttttccttctaacagacaggatcctcagctgcaggtctattggagtttgctagaggtgcactgctgacgctgtttgcctgggtatcagcagcagcggctgcagaacagcggatattggtgaaccgcagatgctgctgcctgattgttcctctggaagttttgtctcagaggagtacctggccatgtgaggtgtcagtctgcccctaatggggggtgcctcccagttaggctactcgggggccaggaacccacttgaggaggcagtctgcccgttctcagatctcaagctgcatgctgggagaaccactactctcttcaaagctgtcagagagggacatttaagtctgcaggggttactgctgtctttttgtttgtgtgtgccctgcccccagaggtggagcctacagaggcaagcaggcctccttgagctgtggtgggctccacccagttcgagcttcctggccgctttgtttacctaatcaaacaactaacttggcaatggcaggcgcccctcccccagcctcactgcagccttgcagtttgatctctgactgctgtgctagcaatgagtgagactccgtgggcataggaccctctgagtcatgtgcgggatataatctcctggtgtgccgttttttaagcccgttggaaaagcgcagtattagggtgggagtgaccagattttccaggtgccgtctgtcactgctttctttgactaggaaagggaattccttgaccccttgcagttcctaggtgaggtgatgcctggccctgcttcagctcacgcacggtgcactgcacccactgtcctgcacctactgtctggcactccccactgagatgaacctggtacctcacctggaaatgcagaaatcacccgtcttctgcatcactcacgctgagagctgtagaccagagctgttcctatttggccatcttggttcctccccctttttcttttttctaattacaaacataattcataaaaatagttacttcaactttttatggtatttaaaaatttacataaaatattttaaataatgttttaaatccattcatatatttatttggcaactatccatgaaatcccagctaagtgctagagtgtatatttcttaaagaaatagacatggcccttgctcttgtaagtgttgtagtccagtcctaggtatattctaactttcattaggactttttatttgatcctttaattatttaacaaagtaggtttatgattttccccaaatctattttcttgtaataattatttttactgatttcaaatataatggcactaaggacatacaacatggtctgaatgatgcttactgaaatttactgagagtttttttatggactgatgtgtgaccaatttttataaagatttcatttatgctggaaaagaaagtatattctcttatcattagaaatgtagggtttgatttgtgcccattagatgaattattaattaatctgttcaaatattctttattcctatcataattttgttttatctgttcatcttgtagaaagcatgttaaaattcagcttattgatggtgaattttatcatcttttcctggcagctttgttaattttttttgctgtatatattatgaggctatgttgatatgtatatacatatttaaaatttgtatatgatcctggtgaattgaactagtcaagttctagataactgcagcattggctgacagtatgacaacctcatgtgagagcctgcattaaaactactcggataagctccttctagattcctcacactctgaaaccatgagaaacaacttatgcttgttgttttaagcagctacattttggggtaatttgttacatggcagtagataactaacacaatctcattttctctattttatctttttggaactctaattgtacaattattagacatttttcaatctatctcccttgtctttaaacatatcattcccaatgctttttctgtctgtgaattagtaagtataatttattcagatcttgctcatagtttaccaattcttctttgtttcattataacctggtatttagattatgtatttattattatctatttataactgaaattctatttatttactttctcacatccttttctcatttttgacaaattctaattcctcatatttggctgatcataattttgttttactactaaatggatgatgataagaatgccctaagttccagaaggatttgtgtttctttttgacaagacccggggtgttatcaacctagaagtgcattcaatttattacattggcttcagagttccaggacttttcagacataggaatgaaccctctacctcccaaccttcttgatgggaagcttagaatttcaaaattc

SEQ ID NO: 12374 - DNA, 410 bp, Homo sapiens
ggaatttgtgtcagaataacctgtggttctccccctccctcacccctccacagagtaagtccgcaagtccccttgatgctaaaccccaaatatctctcgagtcagtctcttttgctccttactcacagtctctgccttagtgggggaaagagagcctataaagcctcacaaaatgaggctcccacctacctctctccatccccatgcctcattgctcaccttagccatattgctttcttcctcttcttcagaggtgaagttccttcctatgtcagggcctttgtgctcatgttcccctctgcaggaatgctcgtccccagagtttcacatgactcgttctctcgcttcatccaggtgtctgctgaaatactactactttagaataatattcttgactgtgttttggtttt

SEQ ID NO: 12375 - DNA, 1087 bp, Homo sapiens
tttctttcttttttttttattatactttaagttttagggtacatgtgcacattgtgcaggttagttacatatgtatacatgtgccatgctggtgcgctgcacccactaactcgtcatctagcattaggtatatctcccaatgctatccctccccgctccccccaccccaccacagtccccagagtgtgatattccccttcatgtgtccatgtgatctcattgttcaattcccacctatgagtgagaatatgcggtgtttgattttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttggcttggttccaagtctttgctattgtgaataatgtggcaataaacatacgtgtgcatgtgtctttatagcagcatgatttatagtcatttgggtatatacccagtaatgggatggctgggtcaaatggtatttctagttctagatccctgaggaatcgccacactgacttccacaatggttgaaccagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcattttttcatgtgtttttttgctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcaaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccatgcc

SEQ ID NO: 12376 - DNA, 1084 bp, Homo sapiens
ttcttttttttttttttttattatactttaagttttagggtacatgtgcacaatgtgcaggttagttacatatgtatacatgtgccatgctggtgtgctgcacccattaactcgtcatttagcattaggtatgtctcctaatgctatccctcccccctctccccacccgacaacagtccccagagtgtgatgttccccttcctgtgtccatgtgttctcattgttcagttcccatctataagtgagaacatgcggtgtttgattttttgtccttgtgatagtttacggagaatgatgatttccaatttcatccatgtccctacaaaggacatgaactcatcattttttatggctgcatagtatttcatggtgtatatgtgccacattttcttaatccagtctatcattgttggacatttgggttggttccaagtctttgctattgtgaatagtgccgcagtaaacatacgtgtgcatgtgtctttatagcagcatgatttatactcctttgggtatatacccagtaatgggatgtctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgtcttttggctgcataaatgtcttcttttgagaagtgtctgttcatatcgtttgcccactttttgatggggttgtttttttcttgtaaatttgtttgagttcattatagattctggatattagccctttgtcagatgagtaggttgcgaaaattttctcccattttgtaggttgcctgttctctctgatggtagtttcttttgctatgcagaagctctttagtttaattagatcccatttgtcaatcttagcttttgttgccattgcttttggtgttttagtcatggagtccttgcccatgcc

SEQ ID NO: 12377 - DNA, 148 bp, Homo sapiens
ggccattttcatgatattgtttcttcctacccatgagcatggaatgttcttccatttgtttgtatcctcttttatttcgttgagcagtggtttgcagttctccttgaagaggtccttcacgtcccttgtaagttggattcctaggtat

SEQ ID NO: 12378 - DNA, 318 bp, Homo sapiens
ttttttcatgtgtctgttggctgcataaatgtcttcttttgagaagtgtctgttcatgtcctttgcccactttttgatggggttgtttgtttttttcttgtacatttgtttaagttctttgtagattctggatatcagccctttgtcagatgggtagattgcaaaaattttctcccattctataggttgcctgttcactctgatggtagtttctattgctgtgcagaaactctttagtttaatgagatcccatttatcaattttggcttttgttaccattgcttttggtgttttagacatgaagtccttgcccatgtc

SEQ ID NO: 12379 - DNA, 218 bp, Homo sapiens
gccagttttcccagcaccatttattaaatagggaatcctttccccattgcttgtttttctcaggtttgtcaaagatcagatagttgtagatatgtggcgttatttctgagggctctgttgtgttccattgatctatatctctgttttggtaccagtaacatgctgttttggttactgtagccttgcagtatagtttgaagtcaggtagcgtgatgcct

SEQ ID NO: 12380 - DNA, 535 bp, Homo sapiens
ctacgtatggctagccagttttcccagcaccatttattaaatagggaatcctttccccattgcttgtttttgtcaggtttgtcaaagatcagatggttgtagatgtgtggtattatttctgagggctgtgttctgttccattggtctatatctctgttttggtaccagtaccatgctgttttggttactgtagccttgtagtatagtttgaagtcaagtagtgtgatgcctccagctttgttcttttggcttaggattgtcttggcaatgcgggctcttttttggttccatatgaactttaaagtagttttttccaattctgtgaagaaagtcattggtagcttgatgggggatggcattgaatctataaattaccttgggcagtatggccatttccacgatattgattcttcctacccacgagcatggaatgttcttccatttgtttgtgtcctcttttactttgttgagcagtggtttgtagttctccttgaagaggtccttcacatcccttgtaagttggattcctaggtat

SEQ ID NO: 12381 - DNA, 302 bp, Homo sapiens
tcttttggctgcataaatgtcttcttttgagaagtgtttgttcatatccttcacccacttattgatggggttgtttttttcttgtaaatttgtttgagttcattgtagattctggatattagccctttgtcagatgtgtagattgcaaaaattttctcccattctgtaggttgcctgttcactccgatggtagtttcttttgctgtgcagaagctctttagtttaattagatcccatttgtcaattttggcttttgttgccattgcttttggtgttttagacatgaagaccttgcccatgcc

SEQ ID NO: 12382 - DNA, 668 bp, Homo sapiens
ggagaagtttgatcgtctgaagccttcttctctcaactcatcattttctgtccagctttgttccgttgctggtgaggagctgtgttcctttggaggaggagaggcgttcttgatttttagaattttcagtttttctgctctgttttttccccatctttgtggttttatctacctttggtctttgatgatggtgacatacagatggggttttggtgtggatgtcctttctgtttgttaattttccttctaacagtcaggaccctcagctgcaggtctgttggagtttgccagaggtccactccagaccctgtttgcctgggtatcatcagcagaggctgcagaacagcaaatattgttgaatagcaaatgctgctgcctgatcgttcctctggaagttttgtctcagaggggtacctggccgtgtgaggtgtcagtctgcccctgctggggggtgcctaccagttaggctacttgggggtcagggagtcacttgatgaggcagtctgtccattctcagatctcaagctgcatgctgggagaaccactactctcttccaagctgtcagacagggacatttaagtctgcagaggtttctgctgccttttgtttggctataccctgctcccagaggtggagtctacagaggcaggcaggcctccttgagctg

SEQ ID NO: 12383 - DNA, 218 bp, Homo sapiens
gccagttttcccagcaccgtttattaaatagggaatcctttccccattgcttatttttctcaggtttgtcaaagatcagataattgtagatatgtggcattatttctgagggctctgttctgttccattgatctatatctctgttttggtaccagtaccatgctgttttggttactgtagccttgtagtatagtttgaagtcaggtagcatgatgcgt

SEQ ID NO: 12384 - DNA, 914 bp, Homo sapiens
agtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcctcattttctatggctgcatagtattccatggtgtatatatgccacattttctgaatccagtctatcattgttggacatttgggttggttccaagtctttgctattgtgaataatgccgcaataaacatacgtgtgcatgtgtctttatagcagcatgatttatagttctttgggtatatacccagtaatgggatggctgggtcaaatggtatttccagttctagatccctgaggaatcgccacactgacttccacaatggttgaactagtttacagtcccaccaacagtgtaaaagtgttcctatttctctacatcctctccagcacctgttgtttcctgactttttaatgattgccattctaactggagtgagatggtatctcattgtggttttgatttgcatttctctgatggccagtgatgatgagcattttttcatgtgttttttggctgcataaatgtcttcttttgagaagtgtctgttcatgtcctttgcccactttttgatggggttgtttgttttcctcttgtaaatttgtttgagttcattgtagattctggatattagccctttgtcagatgagtaggttgcgaaaattttctcccattttgtaggttgcctgttgactctgatggtagtttcttttgctgtgcagaagctctttagttgaattagatcccatttgtcaattttgtcttttgttgccattgcttttggtgttttagacacgaagtccttgcccatgcc

SEQ ID NO: 12385 - DNA, 368 bp, Homo sapiens
ctcattgtggttttgatttgcctttctctgatggccagtgatgatgagcattttttcatgtgtctgttggctgcataaatgtctgcttttgagaagtgtctgttcatatcctttgcccactttttgatgaggttgtttgtttttttcttgtaaatttgtttgagttctttgtagattcttgatattagccctttctcagatgagtagattgcaaaaattttctcccattctgtatgttgcctgttcattctgatggtaatttcttttgctgtgcagaagctctttagtttaattagatcccatttgtcaattttggcttttgttgccgttgcttttggtgttttagacatgaagtccttgcccatgcc

SEQ ID NO: 12386 - DNA, 172 bp, Homo sapiens
aagcagtctgtgcgttctcagatctcaaactccatgctgggagaaccactactctcttcaaagctgtcagacagggacatttaagtctgcagaggtttctgctgccttttgtttggctatgccctgcccccagaggtggagtctacagaggcaggcaggcctccttgagctg

SEQ ID NO: 12387 - DNA, 340 bp, Homo sapiens
acgcagtctgtacattctcagatctcaagctgcgtgctgggagaatcactactctcttccaagctgtcagacagggacatttaggtctgcagaggtttctgctgccttttgtttggctatgccctgcccccagaggtggagtctacagaggcaggcaggcctccttgagctgtggtgggctccacccagttcgagcttcccagcagctttgtttacctactcaagtctcggcaatggcaggcgcccctcccccagccttgctgctgccttgcagtttgatctcagactactgtgctagcaatgagtgaggctccatgggcgtaggaccctccaagccagg

SEQ ID NO: 12388 - DNA, 386 bp, Homo sapiens
ctaaagagcttctgcacagcaaaacaaactaccatcacactgaatgggcagcctacagaatgggagaaaatttttgcaacctactcatctgacaaaggcctaatatccagaatctacaatgaactcaaacaaatgtacaagaaaaaaacaaccccatcaaaaagtgggtgaaggatatgaacagacacttctcaaaagaagacatttacgcagccaaaagacacatgaaaaaatgcctatcgtcactggccatcagagaaatgcaaatcaaaaccacaatgagataccatctcacaccagttagaatggcaatcattaaaaagtcaggaaacaacaggtgctggagaggatgtggagaaataggaagacttttacactgttggtgg

SEQ ID NO: 12389 - DNA, 218 bp, Homo sapiens; identical to SEQ ID NO: 12337

SEQ ID NO: 12390 - DNA, 760 bp, Homo sapiens
attggttattctagttatccatttgtctaattttttttcaaagcttttaacttctttgccattggttcgaatttcctcctgtagctcggagtagtttgatcatctgaagccttcttttctcaactcgtcaaagtcattctccgtccagctttgttccgttgctggtgaagagttgcattcctttggaggaggagaggcgctctgatttttagagtttccagtttttctgctctgtttttttcccatctttgtggttttatctacctttgttcttcgatgatggtgacgtacagatgggtttttggggtggatgtcctttctgtttgttagttttccttctaacagacaggaccctcagctgcaggtctgttggagtttgccggaggtccactccagaccctgtttgcctggatatcagcagttgaggctgcagaacagcgaatattggtgaacagcaaatgctgctgcctgatcgttcctctggaagttttgtctcagaggagtacccggccgtgtgaggtgtcagtctgcccctactgggggatgcctcccagttaggctacccaggggtcagggacccacttgaggaggcactctgtccattctcagatctccagctgcatgctgggagaaccactgctgtcttccaagctgtcaggcagggacatttaagtctgcagaggtttctgctgccttttgtttggctatgccctgcccccagaggtggagtctacagaggcaggcaggcctccttgagatg

SEQ ID NO: 12391 - DNA, 108 bp, Homo sapiens
atttttagtagagacggggtttcaccgtgttggccaggatggtcttgatctcctgacctcgtgatccgcccgtctcagcctcccaaagtgctgggattacaggtgtga

SEQ ID NO: 12392 - DNA, 365 bp, Homo sapiens
ctttgtttacctactcaagcctcagcaatggcggacgcccctctcccagcctcactgcctccttgcagttctatctcagactgctgtgctagcagtgagcaagcctccgcaggcatgggaccctccgagccaggcacgggatataatctcctggtgtgccatttgctaagaccgttggaaaagggcagtattagggtgggaatgtcccgattttccaggtaccgtctgtcacggcttcccttggctaggaaagggaattctccaactccttgtgcttcccaggtgaggcaatgccccgccctgcttcggctcacgctccgtgggctatacccactgtccaacaagccctactgagatgaacccgg

SEQ ID NO: 12393 - DNA, 840 bp, Homo sapiens
ccaaaagtgggcgaaggacatgaacagagacttctcaaaagaagacatttatgcagccaaaaaagacatgaaaaaatgctcaccatcactggccatcagagaaatgcaaatcaaaaccacaatgagataccatctcacacctgttagaatgacaatcattaaaaagtcaggaaacaacaggtgctggagaggatgtggagaaataggaatacttttacactgttggtgggactgtaaactagttcaacccttgtggaagtcagtgtggcgattcctcagggatctagaactagaaataccatttgacccagccatccattactgggtatatacccaaaggactataaatcatgctgctataaagacacatgcacatgtatgtttattggggcactattcacaatagcaaagacttggaaccaacccagatgtccaacaatgatagactggattaagaaaatgtggcacatatacaccatggaatactatgcagccataagaaatgatgagttcatgtcctttgtagggacatggatgaaactggaaatcatcattctcagtaaactatcacaggaacaaaaaaccaaacaccgcatattctcactcataggtgggaattgaacaatgagaacacatggacacaggaaggggaacatcacactctggggactgttgtgggttgcggggatgggggagggatagctttaggagatatacctaatgctaaatgatgagttaatgggtgcagcacaccagcatggcacatgtatacatatgtaactaacctgcacattgtgcacatgtaccctaaaacttaaagtataataataataataataa

SEQ ID NO: 12394 - DNA, 391 bp, Homo sapiens; identical to SEQ ID NO: 12252

SEQ ID NO: 12395 - DNA, 570 bp, Homo sapiens
tattggttattgtagttatacattcatctaaatttttttcaaagtttttaacttctttgcctttggtttgaatttcctcctgtagctcggagtagtttgatcgtctgaagccttcttctctcaactcgtcaaagtcattctccgtccagctttgttctgttgctggtgaggaactgcattcctttggaggaggagaggcactctgctttttagagtttccagtttttctgctctgttttttccccatctttgtggttttatctacttttggtctttgatgatggtgatgtacagatgggtttttggtgtggatgtctttctgtttgttagttttccttctaacagacaggaccctcagctgtaggtctgttggagtttgctagaggtccactccagaccctgtttgcctgggtaacagcagcggtggctgcagaacagcggattttcatgaaccacgaatgctgctgtctgatcgttcctctggaagttttgtctcagaggagtacccggccgtatgaggtgtcagtctgcccctactggggggtgcctcccagttaggctgctcggggg

SEQ ID NO: 12396 - DNA, 1086 bp, Homo sapiens
ttttttattttattattattctactttaagttttagggtacatgtgcacaatgtgcagtttagttacatatgtatatatgtgccatgctggtgtgctgcacccattaactcgtcatttagcattaggtatatcttctaatgctatccctcccccctccccccaccccacaacagtccctagagtgtgatgttccccttcctgtgtccatgtgttctcgttgttcaattcccacctatgagtgagaacatgcggtgtttgggtttttgtccttgcgatagtttactgagaatgatatttccaatttcatccatgtccctacaaaggacatgaactcatcatttttttgtggctgcatagtattccgtggtgtatatgtgccacatttttttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggcatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgtcttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatctcatttgtcaattttggcttttgttgccattgcttttggtgttttagacatgaagtccttgcccatgcc

SEQ ID NO: 12397 - DNA, 846 bp, Homo sapiens
ccaaaagtgggcgaaggacatgaacagagacttctcaaaagaagacatttatgcagccaaaaaagacatgaaaaaatgctcaccatcactggccatcagagaaatgcaaatcaaaaccacaatgagataccatctcacacctgttagaatgacaatcattaaaaagtcaggaaacaacaggtgctggagaggatgtggagaaataggaatacttttacactgttggtgggactgtaaactagttcaacccttgtggaagtcagtgtggcgattcctcagggatctagaactagaaataccatttgacccagccatccattactgggtatatacccaaaggactataaatcatgctgctataaagacacatgcacatgtatgtttattggggcactattcacaatagcaaagacttggaaccaacccagatgtccaacaatgatagactggattaagaaaatgtggcacatatacaccatggaatactatgcagccataagaaatgatgagttcatgtcctttgtagggacatggatgaaactggaaatcatcattctcagtaaactatcacaggaacaaaaaaccaaacaccgcatattctcactcataggtgggaattgaacaatgagaacacatggacacaggaaggggaacatcacactctggggactgttgtgggttgcggggatgggggagggatagctttaggagatatacctaatgctaaatgatgagttaatgggtgcagcacaccagcatggcacatgtatacatatgtaactaacctgcacattgtgcacatgtaccctaaaacttaaagtataataataataataataaaagaat

SEQ ID NO: 12398 - DNA, 714 bp, Homo sapiens
aacttctttgcgatgagttcgaacttcctcttttagctcggagtagtttgatcgtctgatgccttcttctctcaactcgtcaaggtcattctccatcctgctttgttccactgctggtgaggagctgcgttcccttggaggaggagaggcactctgatttttagagtttccagtttttctgctctgttttttccccatctttgtggttttatctacctttggtctttgatgatggtgacatacagatggggttttggtgtggatgtccttactgtttgttagttttccttctaacagtcaggaccctcagcagcaggtctgttggagtttgctggaggtctactccagaccctgttttcctgggtatcagcagcagaggctgcagaacagcagatattggtgaacagcaaatgttgctgccgattattcctctggaagttttgtctcagaggagtaccctgccgtgtgaggtgtcagtctgcccctactgggaggtgcctcccagttaggctacttgggcatcagtgacccacttgaggagtcactctgtccattctcagatctccagctgcatgctgggagaaccactactctcttccaagctgtcagacaggaacatttaagtctgcagaggattctgctgcctttggtttggctgtgccctgcccccagacatggagtctacagaggcaggcaggcctccttgagctgcgg

SEQ ID NO: 12399 - DNA, 902 bp, Homo sapiens; identical to SEQ ID NO: 12352

SEQ ID NO: 12400 - DNA, 85 bp, Homo sapiens
ggaagtggaggttgcagtgagccaagatcgtgccactgcactccagcctgggtgacagagtgagactctgcctcaaaaaaaaaaa

SEQ ID NO: 12401 - DNA, 579 bp, Homo sapiens
atcctttgtaggagaagaggcactctgatttttgtatttttcagcttttctgctctggtttctccccatctttgtggttttgtctacctttggtctttgatgttggtgacctacagatgaggttttggtgtagatgacctttttgttgatgttgatgctattcctttctgtttgttagttttccttctaacagtcaggtccctcagctgcaggtctgttggagtttgctggaggtccattccagaccctgtttgcctgggtatcaccagtggaggctgcagaacagcaaatattgcagaacagcaaatattgctgcctgatccttcctctggaagcttcatcccagaggggcagccgcctataggaggtgtctgtcggcccctactgggaggtgtccccagttaggctacacgggggtcagagaccctcttgaggaggcagtcttccattcttagagctcaaatgctgtgctgggagaaccactgctctcttcagagctgtcagacagggacgtttaagtctgcagaagttgtctgctggcttttgttcagctatgccctgcccacagaggtggagtgt

SEQ ID NO: 12402 - DNA, 374 bp, Homo sapiens
aagcccaggttatccgtggggaaaggcctcatagagagcatgatcactggccagcctcagctttcccacctatcccatccaagaagccaaaagtgtgtgaagaagcatcttagttattccagccctaaaatctgtccattctggccctatccacattgcaaagtcataaaaaatgatacactgttgctgttttagcccctagcttcaggttggtttgttaggtagcaaataggtagctggaaacgttgcaagatatttataaccctttttgattgctgcaagaaggctacagacatgttcttttcattttctcattaaagacaagccaacatttatggggtcaggcaaacattttctccacttttcctgctttt

SEQ ID NO: 12403 - DNA, 3695 bp, Homo sapiens
ttttatctataagcccctgactagggctgctggggaggcaatttttatacacaaaaaataacaattgttattctgtccttcccctccacaaataaaaacagaggcagagcggatcaacaaacaaaactgactacaaccagtgtttattcttgatttgtcaccactcttttcatgtcttgttttcttccacatgttaaatatataataaccaaaactttactaacatacgaatgaagaaaacatgcgcagcatgtatgcatggcaggtagtgaggaaatctggccagctgactggttcctttaccaaggtttgcagagtaggttgtgtttgaacaccttctgtgggtctgtgtcatttccaagttgaagaatttcagccaaagagcaacatgtcacattgattaaagatggttaatgacacagaaacatttctgttaatactaagggaaaaggctgttcttttatttatttatttttcctgagtcctcacttttttcttctctgacaaatgtttgaaattcagtgaaataccaaaggagtcaaggatgaaggggacacaggatggaatcagaaaaaacataaatggaatccaggcagttctatgagacaacactgatatatctccttgataaagaaaaaatgtacagaatatttaatgagtctgtcttgccccaaaagggaaaaacacaagtagctaagccatttgcagagaggaaaaatgtcatggaaaaatgaaaaatctctctaatgtctatagcacatgaaatatctaagtaggtgggtgcagtggttcatgcctgtattgggagaccaaggcaggcagatcacttgacgtcaggagttcaagaccagcctggccaaatggcgaaaccccgtctctattaaaaatacaaaaattagctgggcatggtggtgggtgcctgtaaacccagctacttaggaagctgaggcaggagaatcatgtgaacccaggaggcggaggttgcagtgagctgggatcacaccactgtactccagcctgggcgacagagcaagactccacctcaaaaaagaaatatttagcaaatattaaaggacaagagggaatatctgtttaaaaaattataatgcacgttagatgaaaagtaataggatgagatggttgttgctgaaatagcacttgctatataaattcaaacattccttttcaaattcagcttctcagaggtttgacttcagatgcttgagcactttcaacattatctttgcctttatccttctttatgcggataaacacaactgctaaaattatacctaaaagaaaaaacccagggtcaaataaatgggaccttttaaaatgtactgtcacattcagttataaagtagtattgtggtaggaaaaaaatgactcaacttcatttttgtatgtgattcaacaaaatttcactgtcctagtgaataagggactctagtcgttggccttcttggagaaatgagcttatcatttatcctgttgtatgtatgtatcaagtcccaaatcatagctgacttggtggctctcactggatctcgctgtaagaatataggacctaatgttccacactatggagtgtatatgtcccacactatagagtgtataagcacctgacaaagttcctgaactttatatatacttaatattgattctattcttcccctttcctagagaaaacaatccaattagcacaactagaaagctgttctctgacctgttcacctccctgaagctgattttcatcgtgtccataccaactatcgcatttccttgggcgccttcctcctggatcctgcctatgttgttgtgggaccctgggtagactactttaccttcttggtttctcccacctgatacatcaaaattacactgtgcagctcagcactgattgtgtactgtcagactccactatgaagaaggagttgttttaaggaaattaacctgctagtaagtttataggaggaatcatggcagaaaagtctggatgctcagaaacttataattccaaccctatcttgaaaataaggtcatgaaactgtaaaatcctattacttctatttctggatgtccccaaactcaagcagtctttaacttgtggtaagattatggaattaaattgatacgttaagaaaattgctatctgatttgtaaattcaaaaatcctttcaaggtgggagggcaaatagaataagaaaaggcacagaggcagaagggacctatgtaagtgagtgggacctcaaaaagacagctcaattaccatgaaaagtgtgcagtagatagtggttctcagggaggaaagatgatcaccatgcacacattaggatgggaagtggccatgacatgaaggccctcccatgccatagggagtccagactgaagggtataaagaagtgagaccccctttagatgcatgaatcagagtccagtgtgacacactggatcatgggagaaaagatcagatgctgagagaacaatcaataatacttagaataatcctagtccttcttttaaaagaaaaaggatatgaaaccataaaccccttcactcaggtacacatgaaataatgaagtatctattcctaatgtttaacttgtggtggggacaacagttgaaagagggcaattactatataggttgagtatccttaatctgaaaatctcaaatctgaaacttttggggtaccaacttgatgtcacaagcataaaattctacacctgacctcatgtgacaggttgcaggcaaaactttgtttcatacacaatattatttaaaatattgtatgaaataccttcagactacgtgtataaaatgtttatgaatcacgtgaattttgtgttgagacttgggtctcatccccaagatatctcatcgtgtatttgcaaatgttcaaaaatctggaaaaaacccaaaatctgaaacacttctgctctcaagcattttgggtaaggaaacacttggaataggcactgagttgtttgcaaaaaagaaaaagacagctagatcaggggactgtactgtctagccaagctaggggctatggcagaggctgtggtcatgatgcaatgggttattctgggtagtaaagaatcagggttctatgcatagggaagttctgcactacacatttcaggtatctcagcatcgccactggaaggctaacttctgcctgtaacaacaatggcaggtgagaccataaactctggtgtaggatctgtgtatgtcactctttccccatcaagcacagtgcctgacacatggcacagctactgcatttcttccctctttatcacaaaagctttgtaactaggcataatatatgacaattgatgaccataaagccccttatatttctaaactaataaggcaatagagacagagggtagtactaaagctgtaactccaatcaagaaagtctgatgtaatttgctggtgatctaccttctgggctattgcctgagttgccatttgagcagccaccagaccagtccaggaagacaggccctgagatgagctcacatttctgaggcccaggataagactctttgaattaagaaattacactcaccaatcaccagaagggtggtcagcagtataccaactgccatgcccacagtgggtatcccagtctggtgacctgctggccggaaacaacttccttccacacaactgcagaatgtaactga

SEQ ID NO: 12404 - DNA, 419 bp, Homo sapiens
ctaacagtgaacaaggctctgtgggcacgggacctgccaagccaggcacgggagagaatctccttctctgccagttgctaagatcttggaaaaagtgcagtatttgggtgggagtgtcctgtttttccaggtacagtctgtcatggcttcccttgactaggaaagggaaatcacctcacccttgtgcttcctaggtgaggcgacaccccacccagttcagagccattttaaacaatgaaatcaccaatgaaaagcacagaaacgtgaaaaacagggcactacataaactgcaaaaagtaaaaaaaaacctaactaacttaacaatgtgagagctgggaatatgtgtgtccagtatttttcaccaccctgccagtgtccatgaaagcaaaagcgaaagctcctgtaagtactgacttttg

SEQ ID NO: 12405 - DNA, 338 bp, Homo sapiens
tccgagccaggtgtgggatataatctcatggttcgccgctttttaagccggtctgaaaagggcaatattcgggtgggagtgacccgattttccaggtgcgtccgtcacccctttctttgactcggaaagggaactccctgaccccttgcgcttcccaggtgaggcaatgcctcgccctgctttggctcgcgcatggtgcacgcacccactggcctgcgcccactgtctggcactccctagtgagagaaacccggtacctcagatggaaatgcagaaatcacccgtcttctgcgtcgctcacgctgggagctgtagaccggagctgttcctattcggcc

SEQ ID NO: 12406 - DNA, 374 bp, Homo sapiens; identical to SEQ ID NO: 12402

SEQ ID NO: 12407 - DNA, 115 bp, Homo sapiens
ctcgggaggctgagacagaagaatcgcttgaacccaggaggcggaggttgcagtgagccaagatcataccattgcactccagcctgggcaacaagagcaaaactccatctcaaaa

SEQ ID NO: 12408 - DNA, 616 bp, Homo sapiens
atgagaattgcctgaacccaggaggcagaggttgcagtgatctgagatcacgccactgcactccagcctgggtgacaaagcaaggccctgtctcaaaaaaatgaaacaaaacaaaacaaaaaagaggatgttaaatgacttttcaggtcatgtccacctaggatattctactattctatggcttgaaactggagaaggatcttaattaattaattgattgatttatacaaggctcaatatggtattgattccacgtggagccctgtgccatgtgatggacagttaatgaacaagctcgacctaggcctttcctgaattgagcttgtatctattgcagtgctacttgtctagggtcagttcccattcagtgctttcatctggaacatagagggcatgttaattccacttgtaggatgttcagatctggtagtgttgaccaagacattgtatgacagaatcaggttaaaaaacaaaattaaaaaaaaaaaattctagagtttggaaagatgggccaaggctcacaagataaatacataaggtataactcagtacacacagaaggaaagtcttcaactcaggtttaaaaggcacaggataagaaacatagaatggtagc

SEQ ID NO: 12409 - DNA, 374 bp, Homo sapiens; identical to SEQ ID NO: 12402

SEQ ID NO: 12410 - DNA, 218 bp, Homo sapiens
aggcatcatgatacctgacttcaaactatactacaaagctacagtaaccaaaacagcatgttactggtaccaaaacagagatatagatcaatggaacagaacacagccctcagaaataatgccgcatatctacaactatctgatctttgacaaacctgagaaaaacaagcaatggggaaaggattccctatttaataaatggtgctgggaaaactggc

SEQ ID NO: 12411 - DNA, 569 bp, Homo sapiens
attggttattctagttatccatacgtctaatttttttcaaagtttttaacttctttgccattggtttgaacttcctcctttagctcggagtagtttgatcttctgaagcctttttctctcaactcatcaaagtcattctccatccagctttgttccgttgctggtgaggagctgcgttcctttggaggaggaaaggtgctctgatttttagagtttccagtttttctgctctgttttttccccatctttgtggttttatctacctttggtctttgatgatggtgacgtacagatgggtttttggtgtggatgtcctttctgtttgtttgttttccttctaacagtcaggaccctcagctgcaggtctgttggagtttactggaggtccactccagaccctgtttgcctgggtatcagcagtggtggctgcagaacagcgggtattggtgaaccgcaaatgctgctgcctgatcgttcctctggaagttttgtctcagaggagtacccggccgtgtgaggtgtcagtctgcccctactggggggtgcctcccagttaggctactcggggg

SEQ ID NO: 12412 - DNA, 1326 bp, Homo sapiens
catttttcttctttcttctttttttttaaaaagacatttattcagcatcataatcagactattacatttagcaatcaacagcatgggtgcaaaaaaaaaaacaacctacattaaaacccttcgttggaatgctttacactttccacagaacagaagctaaaataatccgttatacaattagtcacaaatacagtcctcgagtttttttcccatacatatgagtatttgtctaaaacatgtctgctttgtagcagctaggccctgccaccactgtgctttgctaaattcacaaatctgttgtaacctgtagcttccctgccacttctctggctctccgctcctgctaaggtttgtttcctaattaaaatcttctgccactgccacagctactgctactactggaaccatcatagccaccttggttttgtggtttggcaaagaattggcctccaccaccataggggccagagcttctgactccaaagtttcatgggtccataatttgaagactgattgttgtaactgccaaaatcattgtagcttccaccacctccaaaattgcttccatcattaccaaatccattatagccatccccaccgccaccataaccaccaccaccatgactgccaccaaagccaccatgacaactgaagcttcctccacgaccaccacctccatgaccatgatcaaagtttccagaaccacttccacctctggctggatgaggcaatggccaactcttgctttgacagggctttcctaacttcacagttgtggtcattcacactatggtatttctgaatgacagtcttatccatggagtcatggttgtcaaaggttacaaaggcaaaatcccttttcttaccactgcctcagtcggtcatgatttcaattacttcaatttttccatactattcaaaataatctcttagttgatgttcttcagtgtcttctttaatgccaccaacaaatatctttttcaaagttaagtgggcacctggtctttgagaatcttctcttgagacagctctctttggttccacaactcttccatccaccttgtgtggccttgcattcatggctgcatccatctcccccacggtgtcatatgtgacaaatccaaagcccctggagggcttggtgtttggatcactcattaccacacagtctgtgagcattccccattgtttaaaatgactcaaccattttgagccattttcaggttgtttcaaagctcaacccttcaatgaagagcttcctcagctgttcgggccctttaggagatgctgacttagacacgatggcagagtgaagacagactttaa

SEQ ID NO: 12413 - DNA, 1309 bp, Homo sapiens
ttctctaaacttcccttctcgcttcatttcattcatttcatcttccatcgctgataccctttcttccagttgattgcatcggctcctgaggcttctgcattcttcacgtagttctcgagccttggttttcagctccatcagctcctttaagcacttctctgtattggttattctagttatacattcttctaaatttttttcaaagttttcaacttctttgactttggtttgaatgtcctcccgtagctcagagtaatttgatcgtctgaagccttcttctctcagctcgtcaaagtcattctccatccaggtttgttccgttgctggtgaggaactgcgttcctttggaggaggagaggcgctctgctttttagagtttccagtttttctgttgtgttttttccccatctttgtggttttatctacttttggtctttgatgatggtgatgtacagatgggtttttggtgtggatgtcctttctgtttgttagttttccttctaacagagaggaccctcagctgcaggtctgttggagtaccctgccgtgtgaggtgtcagtgtgcccctgctgggggggtgcctcccagttaggctgcttgggggtcaggggtcagggacccacttgaggaggcagtctgcctgttctcagatctccagctgcatgctgggataaccactgctctcttcaaagctgtcagacagggacatttaagtctgcagaggttactgctgtctttttgtttgtctgtgccctgcccccagaggtggagcctacagagacaggcaggcctccttgagctgtggtgggctccacccagttcgagcttcccggctgctttgtttacctaatcaagcctgggcaatggcgggcgcccctcccccagcctcgctgccgccttgcagtttgatctcagactgctgtgctagcaatctgtgagactccgtgggcgtaggaccctccgagccaggtgcaggatataatctcgtggtgtgccgttttttaagcccgttggaaaagcgcagtatttgggtgggagtgacctgattttccaggtgccgtccgtcacccctttctttgactcaggaaggaactccctgaccccttgcgcgtcccaagtgaggcaatgcctcgccctgccttggctcgcacacggtgtgcgcacccactgacctgcgcccactgtctggcactccctagtgagatgaacccggtacctcagatggaaatgcagaaatcacccgtcttctgtgtcgctcacgctgggagctgtagaccggagctgttcctattcggccatcttggctcc

SEQ ID NO: 12414 - DNA, 218 bp, Homo sapiens; identical to SEQ ID NO: 12343

SEQ ID NO: 12415 - DNA, 218 bp, Homo sapiens
gccagttttcccagcaccatttattaaatagggaatcctttccccattgcttgttttcctcaggtttgtcgaagatcagatagttatagatatgtggcgttacttctgagggctctgttctgttccattgatctatatctctgttttggtaccagtaccatgctgttttggttactgtagccttgtagtatagtttgaagtcaggtagtgtgatgcct

SEQ ID NO: 12416 - DNA, 1183 bp, Homo sapiens; identical to SEQ ID NO: 12345

SEQ ID NO: 12417 - DNA, 1084 bp, Homo sapiens
ttttttttttttttatactttaagttttagggtacatgtgcacaacgtgcaggttagttacatatgtatacatgtgccatgttggtgtgctgcacccattaactcgtcatttaacattagatatatctcctaatgctatccctcccccctccccccaccccacagcaggccctggtgtgtgatgttccccttcctgtgtccatgtgttctcattgttcaattcccacctatgagtgagaacatgcggtgtttggttttttgtccttgcgatactttgctgagaatgatggtttccagcttcatccatgtccctacaaaggacatgaactcatcattctttatggctgcatagtattccatggtgtatatgtgccacattttcttaatccagtctatcattgttggacatttgggttggttccaagtctttgctattgtgaatagtgccacaataaacatacgtgtgcatgtgtctttatagcagcatgttttataatcctttgggtatatacccagtaatgggatggctgggtaaaatggtatttctggttctagattcctgaggaattgccatactgacttccacaatggttgaactagtttacagtcccaccaacagtgtaaaagtgttcctatttctccacatcctctccagcacctgttgtttcctgactttttaatgatcgccattctaactggtgtgagatgatatctcattgtggttttgatttgcatttctctgatggccagtgatgatgagcattttttcatgtgtcttttggctgcataaatgtcttcttttgagaagcctctgttcatatcctttgcccactttttgatggggttgtttgtttttttcttgtaaatttgtttgagttaattgtagattctggatattagccctttgtcagatgagtagattgcaaaaattttctcctattctacagaatggttgcctgttcattctgatggtagtttcttttgctgtgcagaagctctttagtttaattagatcccatttgtcaattttggcttttgttgccattgcttttggtgttttagacatgaagtccttgcccatgcc

SEQ ID NO: 12418 - DNA, 1088 bp, Homo sapiens
ttttttttaaattttattattatactttaagttttagggtacatgtgcacagcgtgcaggtttgttacatatgtatacatgtgccatgttggtgtgctgcacccattaactcgtcatttagcattaggtatatctcttaatgctaatcccttccccctccccccaccccacaacagtccccggtgtgtgatgttccccttcctgtgtccatgtgttctcatggttcaattcccacccatgagtgagaacatgcggtgtgtgtttttttgtccttgtgatagtttgctgagaatgatggtttccagtttcatccatgtccctacaaaggacatgaactcatcattttttttggctgcatagtatttcatggtgtatatgtgccacatatttttaatccagtctatcattgctggacatttgggttggttccaagtctttgctattgtgaacagtgccgcaataaatatacgtgtgcaggtgtctttatagcagcatgatttataatcctttgggtatatacccagtaatgggatggctgggtcaaatggtatttctagttccagatccctgaggaatcgccacactgacttccataatggtggaactagttgacagtcccaccaacagtgttaaagtgttcctatttctccacatcctctccagcacttgttgttccctgactttttaatgatcgccattctaactggtgtgagatggtatctcattgtggttttgatttgcatttctctgatggccagtgatgttgagcattttttcatgtgttttttggctgcataaatgtcttcttttgagaagtgtctgttcatatcctttgcccactttttgatggggttgtttgtttttttcttgtaaatttgtttgagttcattgtagattctggatattagccctttgtcagatgagtaggttgcaaaaattttctcccattttgtaggttgcctgttcactctgatggtagtttcttttgctgtgcagaagctctttagttttattagatcccatttgtcaattttggcttttgttgccattgcttttggtgttttagacatgaagtccttgcccatgcc

SEQ ID NO: 12419 - DNA, 408 bp, Homo sapiens
cccccgagtagcctaactgggaggcacccccgagtaggggcagactgacacctcacatggccaggtactcctctgagacaaaacttccagaggaacgatcaggcagcagcatctgcggttcaccaatatctgctgttctgcagccaccactgcagatacccaggtaaacagggtctggagtggacctctagcaaactccaacagacctgcagctgaggatcctgtctgttagaaggaaaactaacaaacagaaaggacatccacaccaaaaacccatctgtacgtcaccatcatcaaagaccaatggtagataaaaccacaaagatgggaaaaaaacagagcagaaaaaccggaaactctaaaaatcagagtgcctctcctcctccaaaggaacgcagctcctcacca

SEQ ID NO: 12420 - DNA, 4103 bp, Homo sapiens
caccccacaacagtccctggtgtgtgatgttcccttcctgtgtccatgtgttcctttgtcaattcccacctatgagtgagaacatgtggtgtttggtttttttgtccttgtgatagtttgctgagaatgatggtttccagcgtcatctatgtccctacaaaggacatgaactcatcattttttatggctgcatagtattccatggtgtatatgtgccacattttcttaatccagtctatcattgttggacatttgagttggttccaagtctttgctattgtgaatagtgccgcaataaacatacatgtgcatgtgtctttatagctgcatgatttataatcctttgtgtatatacccagaaatgggatggctgggtcaaatgatatttctagttctagatccctgaggaatcgccacactgacttccacaatggttgaactagtttacagtcccaccaacagtgcagaagtgttcctatttctccacatcctctccagcacctgttgtttcctgtctttttaatgatctccactctaactggtgtgagatggtatttcattgtggttttgatttgcatttctctgatggccagtgatgatgagcattttttcatgtgttttttggctgcataaatgtcttcttttgagaagtgtctgttcatatccttcgcccactttttgatggggttgtttgttttttttcttgtaaatttgtttgagttcattgtagattctggatattagccctttgtcagatgagtaagtatactcatttttatagacataccaagtgataacatatgaaatgagatgaaatgaacgttaactccgctgtggaaaaattgtcatttttaaagaggtgaccatcatgtaaacaacaaccactgccattattgccgctgctaatgcttagatttactaccagctaatatttatggagtaataattatatggcaggaactgtaatacattgtttaaatatagtttattatttaaccctctgagtccggtttgttactcctattttacagatgataaaattgagacttttaaaacttaagtatagtgcccacggtgacaaggttgaacagccaagattctgatatagaccatctgtctctaaaaccatgctcctaacactgccctatattgcctccctaaatatatatatatatataacatacatatatataatatatatataatatacatataattaattctaaaacttacatgtatatatgtaagttttagaattaattatatgtctaggctatactgcagtagccaattccttccagggaaaggggaaactatagaagagacaacactaccctcaagttgaacttgaaatatgagactctctctaggtaaacaaaaagacaagggcataagggcagaatatcagtatcaacactgtatgttattttctaagagcttgggaagcgtggctatctagctgaaggtaattcagatctgttggagggatagtatgggagggggaattttcataagagaaaagcctaggaagacaatcagaaggcacatcatagtcaagagatataaataattcacactcaagaaaatgggaagctgttgatgatggtgtgctatggagagtcctaatcagttttgtttttgaaataatacccaacctgcagaattaggtcactattatgacatgtttgtagagtgcatgatcattgtttaggaaactggatgaatgccagaaggatgccctgaaaaaatggatgggagtttaaatgttaccttcgtgtagtagatgtaccatcagctgcatctgacctcttactattctttaacttctcagttactgcaaatcagtgttcttaataagagactggagatatttgagaggaagatttttctataaatgcttgattggagccctttattcatttggctcaaaattaagacaatgatatctgaataaatgtagttctataattatatactttattataaaactttcacatatattttcacatatgatactcaaataaccttatgaatttagtagcatagctgttttttgctacaatttgaatatgagaaaagagagcagtagaaaggtgaaactgttgccgtaagtctactaaatggcagagccaagacctcaagtgggcctcttgtgcaaaccactgttacttttacacttgatttagccaaaaggctgagaagcgataccagtgttacttttttctatgctcacatatcaccttgatctgagacaaattatctctcattgttattgtcacaattatgtgatatacttttatttaaagaattacactgctatataattcctattcaaattttctatatgctatatatattccttgtatatctacatactcttttattacttcacagtataaactttctcatgtatatactttttttcactagcaattgtctacatctcaaaaatttcacctgtcaagtgtataaatttcctcagtaaataaaaagctgctgaatatttttatatgagctttaaacttagcttcaccttgtttccattatgctgcaaggtgctttaaaggtagaaatgcatttctggtctgctcacaaacagatgaaaaattattttcctgccttctttgattttactttctcgtatgcactcatttgagttatatctcatctgtgttaaaatggaggtagctgtatatcagcaaagtagaaagaattcttgatactaaagtagtacatttccttgccttgttttcttttccttcatagagtttagtagtgttcattttatttatttgaatgtcaaaattctcagattactgccaaatattgtgattatagcagtttaggtgaataaaaacaagtaatggctgaatttaattatggataataaccatatgagaaagggatgaaagaacccctgaatctcctagagcttcatcatcactatttattttgcaaaataattatttagaattaatgagcttatatcagaattgatgtatgactgattttactttattttttaaaattttattattattgtactttaagttttagggtacatgtgcacaacgtgcaggtttgttacatatgtatgcatgggccatgtcggtgtgctgcacccattaactcgtcatttagcattagatatatctcctaatgctatccctcccccctccccccaccccacaacagtccctggtgtgtgatgttccccttcctatgtccatgtgttctctttgttcaattcccacctatgagtgagaacatgcggtgtttggttttttgtccttgtgatagtttgctgagaatgatggtttccagcttcatccatgtccctacaaaggacatgaactcatcattttttatggctgcatagtattccatggtgtatatgtgccacattttgttaatccagtctatcgttgttggacatttgagttggttccaagtctttgctattgtgaatagtgccgctataaacatacatatgcatgtgtctttataggcacataatttataatcctttgtgtatatacacagtaatgggatggctgggtcaaatgctatttctagttctagatccctgagaaatcgccacaccaacttccacaatggttgaaatggtttacagtcccaccaacagcataaaagtgttcctatatctctacatcctctccagcacctgttgtttcctgactttttaatgatcgccattctaactggtgtgagatggtatctcattgtgattttgatttgcatttctctgatggccagtgatgatgagcattttttcatgtgttttttggctgcataaatgtcttcttttgagaagtgtctgttcatatcctttgcccactttttgatggggttgtttttttcttgtaaatttgtttgagttcattgtagattctggatattagcccgttgtcagatgagtaggttgcaaaaattttctccgattctgtaggttgcctgttcactctaatggtagtttcttttgctgtgcagaagctctttagtttaattagatcccatttgtcaattttcgcttttgttgccattgcttttggtgttttagacatgaagtccttgcccatgcc

SEQ ID NO: 12421 - DNA, 1075 bp, Homo sapiens
tttttttattatactttaagttttagggtacatgtgcacaacatgcaggtttcttacatatgtatacatgtgccatgttggtgtgctgcacccattaactcgtcatttagcattaggtatatctcctaatgctatccctcccccctccacccaccccacaacagtccccggtatgggatgttccccttcctgtgtccatgtgttctcattgttcaattcccacctatgagtgagaacatgcgatgtttggttttttgtccttgtgatagtttgctcagaatgatggtttccagcttcacccatgtccctacaaaggacatgaattcatcattttttatggctgcatagtattccatggtgtgtatgtgccacattttcttaatccagtctatcattgttggacatttgggttggttccaagtctttgctattgtgaatagtgccgcaataaccatacgtgtgcatgtgtctttatagcagcatgacttataatcctttgggtatatacccagtaatgggatggctgggtcaaatggtatttctagttctagaaccctgaagaatcgccacactgacttccacaatggttgaactagtttacagtcccaccaacagtgtaaaagtgttcctatttctccacatcctctccagcacctgttgtttcctgactttttaatgatcgccattctaactggtgtgagatggtatctcaatgtggttttgatttgcatttctctgatggccagtgatgatgagcattttttcatgtgtttgtgggctgcataaatgtcttcttttgagaaatgactgttcataccctttgcccacatttcatggggttgtttgtttttttcctgtaaatttgtttgagttcattgtagattctgggtattagccctttgtcagatgagtaggttgcaaaaattttctcccattctgtaggttgcctgttcactctgatggtagtttcttttgctgtgcagaagctctttagtttaattagatcccatttgtcaattttggcttttgttgccattgcttttggtgttttagacatgaagtccttgcccatgcc

SEQ ID NO: 12422 - DNA, 1152 bp, Homo sapiens
aatgagggaagctgaaggagaaggtagcccatctggagtaacgcactagtaacatgtatcagtagatgagcccatctggctgccacacactagtaacatgtatcagtagatgagcaatgatgtgtgtaaatctacagtagcacatcctgcccttcattgaccttacacacatggaatcaatgtctgtgctatgctcttgcacctgccgcatctcatgtaaaatgtctgttgtgggatatgctgaccagagctatgcaaggaaaggaattctggtaaatgtagttccagtttggcttaaattgacacaactcgaatccaccacaatggcatgacaaaaggagacaaatacaggggcacacacacaaaaacccccaaaatacaacaacaatactcagagagagagagagagagagagagagagagagagagaaagagagagaaagagagaagcaaaaaccacaggggaaaagggcaagaaaatgttgaaagcagaaagtgagtagacgaataggaacaggtaacagattaacataattataatgctgaatcttaatttacatgcagtgaaatccaagaaacaaacaaatccacattacaaaatcccccaaaggcacagaagtaggaatcatcagtcacctttgcaagtgaaggtgaaggtaagataaatacaggaagagtaaatctacatctgtgtaagaagtagttagattatcaatcctctttccagttgtggacacttggtgattgctccttcaccactgagagagaagactggaagtttttcttttggagaaaacacaattcctaaaactgagagaaaacatgtatggttgaagaaggttgtaccatattgaaaatggggtaaggtatgaaaacatttatatagaaagaatgctaagacctggccttcttctcttcagctccgagatattccacagccaagcatacatcctctaaatcatagactctaacaagagcaagagaaagacaaaagacactaacgtgagcatttctcacaaaattcttcagccagataagcctacattaaagtccttggaaggcaaaccacagacatttgtttacaaataccaagtagtatttcagggaccactatcaaatacgagagaacatcccagaaagcactattacatg

SEQ ID NO: 12423 - DNA, 302 bp, Homo sapiens
tcttttggctgcataaatgtcttcttttgagaactgtctgttcatatcgtttgcccactttctggtgggtttttttttttcttgtaaatttgtttgagttctctgtagattctggatattagccctttgtcagataagtagattgcaaaaattttctcccattctgtaggttgcctgttcactctgatggtagtttcttttgctgtgcagaagctctttagtttgattagatcccatttgtcaattttggcttttgttgccattgcttttgctgttttagacatgaagtccttgcccatgtc

SEQ ID NO: 12424 - DNA, 410 bp, Homo sapiens
gctggtgaggagctgcattcctttagaggaggagaggcactctgatttttagaattttcagtttttctgctctgttttttccccatctgtgtggttttatctacctttggtctttgatgatggtgatgtacagattgggttttggtgtggatgtcctttctgtttgttagttttccttctaacagtcaggaccctcagctgcaggtctgttggagtttgctggaggttcactccagaccctgtttgcctgggtatcagcagcagaggctgcagaacggtgaatactggcaaacagcaaatgttgctgcctgaatgttcctctggaagttttgtctcagagtagtacccagccgtgtgacgtgtcagtctgcccctacttgggggtgcctgccagttaggctactcggggg

SEQ ID NO: 12425 - DNA, 374 bp, Homo sapiens; identical to SEQ ID NO: 12402

SEQ ID NO: 12426 - DNA, 348 bp, Homo sapiens
tcattgtggttttgatttgcatttctctgatggccagtgatgatgagcattttttcatatgtctgttggctgcataaatgtcttcttttgagaagtgtctgttcatatccttcacccacttttgatggagttgtttgatattttcttgtacatttgtttaagttctttgtagattctagatattaggcctttgtcagatggttagattgcaaaaattttctcccattctgtaggttgcctgttcactctgatggtagtttcttttgctgtgcagaagctctttagtttaattagatcccatttgtcaattttggcttttgttgccgttgcttttggtgttttagtcat

SEQ ID NO: 12427 - DNA, 617 bp, Homo sapiens
tattgattattctagttatactttcatctaaatttttttcaaagtttttaacttcttccccttcggtttgaatttcctcctgtagcttggagtagtttgatcgtctgaagccttcttctctcaactcgtcaaagtcattctcagtccagctttgttccgttgctggtgaggaactgtgttcctttggaggaggagaggtgctctgctttttagagtttccagtttttctgctctgttttttccccgtctttgtggttttatctacttttggtctttgatgatggtgatgtacagacgggtttttggtgtggatgtcctttctgtttgttagttttccttctaacagacaggactctcagctgcaggtctgttggagtttgctagaggtccactccagaccctgtttgcctgggtaacagcagcggtggctgcagaacagcggattttcgtgaaccgcgaatgctgctgtctgatcgttcctctggaagttttgtctcagaggactacccggccgtgtgagatgtcagttggcccctactgtgggggtgcctcccagttacgctgctcaggggtcaggggtgacggacccacttgagaaggcagtctgcccgttctca

SEQ ID NO: 12428 - DNA, 148 bp, Homo sapiens
ggccattttcacgatattgattcttcctacccaagagcatggaatgttcttccatttgtttgtgtcctcttttatttttttgtgcagtggtttgtagttctccttgaagaggtccttcacatcccttgtaagttggattcctaggtat

SEQ ID NO: 12429 - DNA, 411 bp, Homo sapiens
atcagattgttaccgtgtctgtgtagaaagaagtagacataggtgactccattttgttctgtactaagaaaaattcttctgccttgggatgctgttaatctataaccttacccccaaccccgtgctctctgaaacatgtgctgtgtcaactcagggttaaatggattaagggtggtgcaagatgtgctttgttaaacagatgcttgaaggcagcatgctccttaagagtcatcaccactccctaatctcaagtacccagggacacaaacactgtggaaggccacagggacctctgcctaggaaaaccagagacctttgttcacgtgtttatctgctgaccttctctccactattatcctatgaccctgccacatccccctccaagaaacacccaagaatgatcaataaata

SEQ ID NO: 12430 - DNA, 302 bp, Homo sapiens
tctgttggctgcataaatgtcttcttttgagaagtgtctgttcatatgctttgcccacttgttgatggggttgtttttttcttgcaaatttgtttgagttctttgtagattctgggtatcagccctttgtcagatgagtagattgcaaaaattttctcccattctgtaggttgcctgttcactctgatggtagtttcttttgctgtgcagaagctctttagtttaattagatcccatttgtcaattttggcttttgttgccattgtttttggtgttttagccatgacgtccttgcccatgcc

SEQ ID NO: 12431 - DNA, 674 bp, Homo sapiens
agcttggagaagtttgattatctgaagctttcttctctcagctcgtcaaagtcattctttgtccagctttgttccattgctggtgaggagctgcgttcctttggaggaggagaggcactcgatttttagaattttcagtttttctgttctgttttttcctcatctttgtggttttatctacctttggtctttgatgatggtgacatacagatggggttttggtgtggatgtcctttctgtttgttagttttccctctaacagacaggaccctcagctgcaggtctgttggagtttgctggaggtcccctccagaccctgtttgcctgggtatcagcagcagaggctgcagaacagtgaatattgctgaacagcaaatgttgctgtctgatccttcctctggaggtttcgtctcagaggggtacccggctgtgtgaggtgtcagtctgcccctactcgggggtgcctcccagttaggctacttgggggttagggaccctcttgaggaggcagtctgtccgttctcagatcacaaactccatgctgggagaaccattactctcttcaaacctgtcagacagggacatttaagtctgcagaggtttctgctgccttttgtttgtctgtgccctgcccccagaggtggagtctacagaggcaggcaggcctccttgag

SEQ ID NO: 12432 - DNA, 405 bp, Homo sapiens
gctggtgaggagctgcattcctttggaggaggagaggtgctctgatttttagaatttcagtttttctgctgtttttcccccatctttgtggttttatctacctttggtctttgatgatggtgtcgtacagatggggtttgggtgtggatgtcctttctgttttttagttttccttctaacagtcaggaccctcagctgcaagtctgttggagtttgctggaggtccactccagaccgtttgcctggttatcagcagtggaggctgcagaacagcaaatattgctgaacagcaaatgttgctgtttgatcgttcctctggaagtttcgtcttagaggggtacctggctgtgtgaggtgtcagtctgcccctacttgggggtgcctcccagttaggctactcggggg

SEQ ID NO: 12433 - DNA, 336 bp, Homo sapiens
atgttgaaccagccttgcatcccagggatgaagcccacttgatcatggtggataagctttttgatgtgctgctgaattcggtttgccagtattttattgagaatttttgcgtcaatgttcatcagggatattggtctaaaattctctttttttgttgtgtctctgccagactttagtatcaggttgatgctggtctcataaaatgagttagggaggattccctctttttctattgattggaatagtttcagaaggaatggtaccagctcctccttgtacctctggtagaattcggctgtgaatccgtctggtcctgctggactttcttggttggta

SEQ ID NO: 12434 - DNA, 410 bp, Homo sapiens
gctggtgaagagcttcgttcctttggaggaggagaggcactctgatttttagcatttccagtttttctggtctgttttttctccatctttgtggttttatctacctttggtctttgatgacgttgacatacagatggggttttggtgtggatgtcctttctgtttgttagttttccttctaacagtcaggaccctcagctgcaggtctgttggagtttgctgaaggtccactccagaccctgttttcctgggtatcagcagcggaggctgcagaacagcagatattggtgagcagcaaatgttgctgcctgatcgttcctctggaagttttgtctcagaggagtacctggctgtgtgaggtgtcagtttgctcctactggggtgtgcctcccagttaggctactcggggg

SEQ ID NO: 12435 - DNA, 218 bp, Homo sapiens
gccagttttcccagcaccatttattaaatagggaatcctttccccattgcttgtttttatcaggtttgtcaaagatcagatggttgtagatatgtggcattatttctgagggctctgttctgttccattgatctatatctctgttttgataccagtaccatgctgttttcgttattgtagccttgtagtatagtttgaagtcaggtagcatgatgcct

SEQ ID NO: 12436 - DNA, 337 bp, Homo sapiens
ttaccaaccaaaaaaagtccaggaccagatggattcacagccaaattctaccagaggtacaaagaggagctggtaccattccttctgaaactattccaatcaatagaaaaagagggaatcctccctaactcattttgtgaggtcagcatcatcctgataccaaagcctggcagagacacaaccaaaaaagagaattttagaccaatatccttgatgaacatcgatgcaaaaatcctcaataaaatactggcaaaccgaatccagcagcacatcaaaaagcgtatccaccatgatcaagtgggcttcatccctgggatgcaaggctggttcaacatag

SEQ ID NO: 12437 - DNA, 271 bp, Homo sapiens
cctgagttctagtttgattgcactgtggtctgagagacagtttgttataatttctgttcttttacatttgctgaggagtgctttacttccaactatgtggtcaattttggggtaggtgtggtgtggtgctgaaaagaatgtatattctgttgatttggggtggagagttctgtagatgtctattaggtctgcttggtgcagagctaagttcaattcctgggtatcctggttaactttctgtctcgttgatctgtctaatgttgacagtggg

SEQ ID NO: 12438 - DNA, 218 bp, Homo sapiens
gccagttttcccagcaccatttattaaatagggaattgtttccccatttcttatttttgtcaggtttgtcaaagatcagatggttgtagatatgcggcattatttctgagggctgtgttctgttccattggtctgtatctctgtttttgtaccagtaccatgctgttttggttactgtagccttgtagtatagtttgaagtcaggtagcgtgatgcgt

SEQ ID NO: 12439 - DNA, 913 bp, Homo sapiens
agtccccagagtgtgatattccccttcctgtgtccatgtgatctcattgttcaattcccacctatgagtgagaatatgcggtgtttgattttttctccttgccatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgatattgtgaatagtcctgcaataaacatacgtgtgcatgtgtcttcatagcagcatgatttatagtcctttgggtatatacctagtaatgggatggctgggtcaaatgatatttctagttctagatccctgaggaatcgccacactgacttccacaatggttgaactactttacagtcccaccaacagtgtaaaagtgttcctattactccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgtttatgtacttcgcccactttttgatggggttctttgattttttcttgtaaatttctttgagttcattgtagattctgaatattagccgtttgtcagatgagtaggttgtgaaaattttctcccattttgtaggttgcctgttcactctgatggtagtttgttttgctgtgcagaagtctttagtttaattagatcccatttgtcaattttggcttttgttgccattgcttttggtgttttagacatgaagtccttgcccatgcc

SEQ ID NO: 12440 - DNA, 911 bp, Homo sapiens
ccccagagtgtgatgtcccccttcctgtgtccatgtgatctcactgttcaattcccacctatgagtgagaacatgcggtgtttggttttttgttcttgcgatagtttactgagaatgatgatttccaatttcatccatgtccctacaaaggacatgaactcatcattttttatggctgcatagtattccatggtgtacatgtgccacattttcttaatccagtctatcattgttggacatttgggttggttccaagcctttgctattgtgaataatgccacagtaaacatacgtgtgcatgtgtctttatagcagcatgatttatagtcctttgggtatatacccagtaatgggatggcagggtcaaatggtatttctagttctagatccctgaagaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtccttcgcccactttttgatggggttgtttttttcttgtaaatttgcttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttgtcttttgttgccattgcttttggtgttttagtcatgaagtccttgcccatgcctgtg

SEQ ID NO: 12441 - DNA, 172 bp, Homo sapiens; identical to SEQ ID NO: 12262

SEQ ID NO: 12442 - DNA, 1044 bp, Homo sapiens
tcttttttttttattattatactttaagttttagggtacatgtgcacaacgtgcaggtttgttacatatgaatacatgtgccatgttggtgtgctgcatccattaactcatcatttacattaggtatatctcctaatgctatccctcccccttcccccaccccacaacaggccccggtgtgtgatgttctccttcctgtgtccaagtgttctcattgttcaattcccacctataagtgagaacatgtggtgtttggtttttcgtccttgcgatagtttgctgagaatgatggtttccagcttcatccatgtccctataaaggacatgaactcaccattttttatggctgcatagtattccatggtgtatatgtgccacattttcttaatccagtctatcattgttggacatttgggttggttccaagtctttgctattgtgaatagtgccacaataaacatacatgtgcatgtgtctttatagcagcatgatttataatcctttgggtatatactcagtaatgggatggctgggtcaaatggtatttctagttctagatccctgaggaatcaccacactgacttccacaatggttgaactagtttacagtcccaccaacagtgtaaaagtgttcctatttctccacatcctctccagcacctgttgtttcctgactttttaatgatcaccattctaactggtgtgagatggtatctcattgtggttttgatttgcatttctctgatggccagtgatgatgagcattttttcatgtgtcttttggcttcataaatgtcttcttttgagaagtgtctgttcatatccttcacccactttttgatggggttgttttttttcttgtgaatttgtttgagttctttgtagattctggatattagccctttgtcagatgagtagattgcaaaaattttctcccattctgtaggttgcctgttcactctgatggtagtttcttttgccgtgcagaagctctttagtttaattagatcccatttgtcaattttggattttgttgccattgct

SEQ ID NO: 12443 - DNA, 376 bp, Homo sapiens
tattggttattctagttatacattcttttaaatttttttcaaagttttcaactcctttgcctttggtttgaatgtccttccatagctcggagtaatttgatcgtctgaagccttcttctctcagctcgtcaaagtcatctccgtccagctttgttctgttgctggtgaggaactgcgttcctttggaggaggagaggcgctctgctttttagagtttccagtttttctgctctgttttttccccatctttgtggttttatctacttttgctctttgatgatggtgatgtacagatgggtttttggtgtggatgtcctttctgtttgttagtttcccttctaacagacaggaccctcagctgcaggtctgttggagt

SEQ ID NO: 12444 - DNA, 910 bp, Homo sapiens
agtccccagactgtgatgttccccttcctgtgtccatgtgttctcattgtacaattcccacctaggaatgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagactatgattgttggacatttgggttggttccaagtctttgctattctgaataatgctgcaataaacatatgtgtgcatgtgtctttatagcagcatgatttatagtcctttgggtatatacccagtaatgggatggctgggtcaaatggtatttctagttctagatccctgaggaatcgccacaccgacttccacaacggttgaactagtttacagtcccaccaacagtgtaaaagtgttcctatttctccacatcctctccagcacctgttgtttcctgactttttaatgatcgccattctaactggtgtgagatggtatctcactgtggttttgatttgcatttctctgatggccagtgatggtgagcattttttcatgtgttttttggctgcataaatgtcttcttttgagaagtgtctgttcatgtcctttgcccactttttgatggggttgtttgtttttttcttgtaaatttgagttcattgtagattgtggatattagccctttgtcagatgagtaggttgcaaaaattttctcccattttgtaggttgcctgttcactctgatggtagtttattttgctgtgcagaagctctttagtttaattagatcccatttgtcaattttggcttttgttgccattgcttttggtgttttagacaggaagtccttgcccatgcc

SEQ ID NO: 12445 - DNA, 1092 bp, Homo sapiens
ttttttcttctttttttattattattatactttaagttttagggtacatgtgcacaatgtgcaggtttcttacatatgtatacatgtgccatgttggtgtgctgcacccattaactcctcatttagcattaggtatatctcctaatgctatccctcccccctccccccaccccacaacagtccccagtgtgtgatgttccccttcctgtgtccatgtgttctcattgttcaattcccacctatgagtgagaacatgcggtgtttggttttctgtccttgtgatagtttgctgagaatgatggtttccagcttcatccatgtccctacaaaggacatgaactcatcattttttatggctgcatagtattccatggtgtatatgtgccacattttcttaatccagtctatcattgttggacgtttgggttggttccaagtctttgctattgtgaatagtgcagcaataaacatatgtgtgcatgtgtctttatagcagcatgatttataatcctttgggtatatacccagtaatgggatggctgggtcaaatggtatttctagttctagatccctgaggaatcaccacaccaacttccacaaaggtcgaactagtttacagtcccaccaacagtgtaaaagtgttcctatttctccacatcctctccagcacctgttgtttcctgactttttaatgatcgccattgtaactggtgtgagatggtatctcattgtggttttgatttgcatttctctgatggccagtgatgatgagcattttttcatgtgttttttggctgcataaatgtcttctttttagaagtgtctgttcatatccttcgcccactttttgatggggttgtttgtttttttcttgtaaatttgtctgagttcattgtagattctggatattagccctctgtcagatgagcaggttgcaaaaattttctcccattctgtaggttgcctgttaactctgatggtggtttcttttgctgtgcagaagctctttagtttaattagatcccatttgtcaattttggcttttgttgccattgcttttgatgttttagacatgaagtccttgcccatgcc

SEQ ID NO: 12446 - DNA, 405 bp, Homo sapiens
gtgaggagctgcgttcctttggaggaggagaggtgctctgatttttagagtttccagtttttctgctctgttttttccccatctttgtggttttatctacctttggtctttgataatggtgacgtacagatgggtttttggtgtggatgtcctttctgtttgttagttttccttctaacagtcaggaccctcagctgcaggtctgttggagtttactggagatccactccagaccctgtttgcctgggtatcagcagcggtggctgcagaagagcggatattggtgaacggcaaatgttgctgcctgatcgttcctctggaagttttgtctcagaggagtacccagccgtgtgcggtgtcagtccgcccctactggggggtgcctcccagttaggctactggggg

SEQ ID NO: 12447 - DNA, 410 bp, Homo sapiens
gctggtgaagagctgcgttcctttggaggaggagaggtgctctgatttttagagtttccggtttttctgctctgttttttccccatctttgtggttttatctacctttggtctttgatgatggtgacatacagattggtttttggtgtggatgtcctttctgttagttagttttccttctaacagtcaggaccctcagctgcaggtctgttggagtttcctggaggtccactccagaccctatttgcctgggtatcagcagcagtggctgcagaacagcagatattggtgaactgcaaatcctgctgcctgatcgttcctttggaagttttgtctcagaggagtacctggccatgtgacgtgtcagtctgcccctactggggggtgcctcccagttaggctactcgggag

SEQ ID NO: 12448 - DNA, 218 bp, Homo sapiens
gccagttttcccagcaccatttattaaatagggaatcctttccccattgcttgtttttctcaggtttgtcaaagatcagatagttgtagatacgtggcgttatttctgagggctctgttctgttccattgatctatatctctgttttggtaccagtaccatgctgttttggttactgtagccttgtagtgttgtttgaagtcaggtagtgtgatgcct

SEQ ID NO: 12449 - DNA, 193 bp, Homo sapiens
attctccatccagctttgttctattgctggtgaggagctgtgttcctttggaggagaagaggcactctgacttttagaattttcagcttttctgctctggtttgtccctatctttgtggttttatctacctttggtctttgatgatggtgatgtacagatggggttttggtgtggatgtcctttctgtttgtt

SEQ ID NO: 12450 - DNA, 910 bp, Homo sapiens
agtccccagagcgtgatattcccctttctgtgtccatgtgatctcattgtccaattcccacctatgagtgagaatatgcggcatttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttccagttctagatccctgaggaatcgccacactgacttccacaatggttgaactagtttacagtcccaccaacagtgtaaaagtgttcctatttccccacatcctctccagcatctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtccttcgcccactttttgatggggttgtttttttcttgtaaatttgtttgagttcattgtagattctggatattagccccttgtcagatgagtaggttgtgaaaattttctcccattttgtaggttgcctgttcactatgatgatagtttcttttgctgtgcagaagctctttagtttaattagatcccatttgtcaattttggcttttgttaccattgcttttggtgttttagacatgaagtccttgcccatgcc

SEQ ID NO: 12451 - DNA, 1052 bp, Homo sapiens
agggtacatgtgcacattgtgcaggttacttacatatgtatacatgtgccatgctggtgcgctgcacccactaactcgtcatctagcattaggtatatctcccaatgctatccctccaccctccccccaccccaccacagtccccagagtgtgatatcccccttcctgggtccatgtgatctcattgttcaattcccacctatgagtgagaatatgcggtgtttggttttttgttcttgcgatagtttactgagaatgatgatctccaatttcatccatgtccctacaaaggacatgaactcatccttttttatggctgcatagtattccatggtgtatatgtgcgacattttcttaatccagtctatcattgttggacatttgggttggttccaagtctttgctattgtgaataatgccgcaataaacatatgtgtgcatgtgtctttataacagcatgatttatagtcctttgggtatatacccagtaatgggatggctgggtcaaatggtatttctagttctagatccctgaggaatcaccacactgacttccacaatggttgaaccagtttacagtcccaccaacagtgtaaaagtgttcctatttctccacatcctctcaagcacctgttgtttcctgattttttagtgattgccattctaactggtgtgagatggtatctcatagtggttttgatttgcatttctctgatggctagtgatgatgagcattttttcatgtgttttttggctgcataaatgtcttcttttgagaagtgtctgctcatgtcctttgcccactttttgatggggttgtttgtttttttcttgtaaatttgtttgagttcattgtagattctggatattagccctttgtcagatgagtaggttgtgaaaattttctcccattttgtaggttgcctgttcactctgatggtagtttcttttgctgtgcagaagctctttagtttaattagatcccatttgtcaattttgtcttttgttgccattgcttttggtgttttggacatgaagtccttgcccgtgcc

SEQ ID NO: 12452 - DNA, 302 bp, Homo sapiens
tcttttggctgcataaatgtcttcttttgagaagtgtctgttcatatcctttgcccactttttgatggggttattttcttcttgtaaatttgtttgagttctttgtagattctggatattagccctttgtcagatgagtagattgcaaaaattttctcccattctgtaggttgcctgttcactctgatggtagtttcttttgctgtgcagaagctctttagtttaattagatcccatttgtcaattttgtctttcgttgccattgcttttggtgttttagacatgaagtccttgcccatgcc

SEQ ID NO: 12453 - DNA, 238 bp, Homo sapiens; identical to SEQ ID NO: 12325

SEQ ID NO: 12454 - DNA, 914 bp, Homo sapiens
agtccccagagtgtgatattccccttcctgtgtccatgtgatctcattgttcaattcccacctatgagtgagaatacgcggtgtttggttttttgttcttgcgatagtttactgagaatgatgatttccaatttcatccatgtccctacaaagggcatgaactcatcattttttatggctgcatagtattccatggtgtatatgtgccacattttcttaatccagtctatccttgttggacatttgggttgattccaagtctttgctattgtgaataatgccgcaataaacatacgtgtacatgtgtctttatagcagcatgatttatagtcctttgggtatatacccagtaatggggtggctgggtcaaatggtatttccagttctagatccctgaggaatcgccacactgacttccacaatggttgaactagcttacagtcccaccaacagtgtaaaagtgttcctatttctccacatcctctccaacacctgttgtttcctgactttttaatgattgccattctaactggtgtgagatggtatctcattgtggttttggtttgcatttctctgatggccagtgatgatgaacattttttcatgtgttttttggctgcataaatgtcttcttttgagaagtgtctgctcatgtccttcgcccactttttgatggggttgtttgtttttttcttgtaaatttgttggagttcatcgtagattctggatattagccctttgtcagatgagtaggttgcaaaaattttctcccattttgtaggttgcctgttcactctgatggtagtttcttttgctgtgcagaagctctttagtttaattagatcccatttgtcaattttgtcttttgttgccattgcttttggtgttttagacatgaagtccttgctcatgcc

SEQ ID NO: 12455 - DNA, 134 bp, Homo sapiens
ctgtttttattattattattatactttaagttctagggtacatgtgcacaacgtgcaggtttgttacatatgtatacatgtgccatgttggtgtgctgcgcccgttaactcatcatttacattacgtataactc

SEQ ID NO: 12456 - DNA, 3825 bp, Homo sapiens
gaccaagtcaagaatggcaccaatatgaagtccctgaatctggagatgcaagagttggcggtagctgcgtccctgtcacagactggggcgtccattggcagtgccctggctgcaatcatgcttctacttctggtgtttttggtggcttgttttatcaacaggaaatgccagaaacagaggaagaagaagcccgcagaggacattttggaagaatatcctctgaataccaaggtagaagtgcccaagaggcacccggaccgggtggagaagaacgtgaatagacactactgcactgtgcggaacgtcaacatcctgagtgagcctgaggcggcttacacgttcaaaggtgctaaagtcaaaagactgaatctagaagtcagagttcacaacaatttacaagatggaacagaagtttaatggaggagacctatgtgtatttttttctaaaatcatttttataaaatggggggaaatactggtatttttataatctcgcagataaaaaagggaaaactatagctttgagtggcagacagcacacatcacatgcatcaactcacaactgagctacctcattcagcaaagaaccactgagaaccccagagtattacagttatttccgtagatccctttaatagtgtcaacaactgtacacagctccttctgtaaggctggtcttagaaaacaagtactttagtatcaggacaggagttgaacaattaggttagcagatggagatgagaggactgggtagagtaccatggcagatctcagagagaagaagtaggtacgggcctttggttccctcccccagccccagctttctcctacagggcttttcctgagtccccagacagcagagtatgaactgctgacacccagattccattaaaaattctgctaatcgacacaacacatatatttgctcatgatttcacttgacagcgtatgctccttggcctctaattgtactttgcttttccagagccctttttacctggggatttcagtgtgcttaagtaaaatcctctgaaaaccacgggagcctctgcctcctcagccacagagaactccctcctacaaagggggagactgaaacccgagttaaggaggggcctggcaggcgtatcagagcacattagtgatgcccttcaccccagggaggtgtctgttcccaactagtttatgtggcactgagacatccatccctgaccaaggatgctgcgaaacaggatcaatgtactacggccttttaattcaacattgccataaatgctttaaagaaaacccaccacactttcctcctactccggtctttgcccgttcctgtaacagacaatcccatgtcctaggtatggttttttattctgttagtgcttcgggaaagtaagtgattcatttgaataaggcaaattaggagaaagcccaggttggggtgaaatcagacttaacagatacatgctggttctccttgctgtgtgtgacacagcagacagaggcactattcctggtgcagtatttcagggatttctctttgaggggttcttttctggtagctcaggcaattatttttaccatatcagcacatgacaaggccatgaacacatggctctaaaataatttagtgttcaagtatcagcttaactattttgtgtaggctacacacagcttgcttttgtttctcttctgtttctgccttattggcggaaacataagcgtgcatgccatgttgttttgaattggaggcacaatttcattattcgagagtaaaagacatgtcctcttttgatgcatggcacaccatagtcaccaagcaaataacagagccttcacattgtgtaatatttgtatgagaatgactcaagctctttgagaacattccaaactagtaacatttcgctactaaaagctagaaaggatgaactgtgaaaggttctaggcagctctgtgagactccaagctccttgaaagtaggacctttgtgagccacgcctttcattcttcaacagtgccttgcatgtaacaagcactccagaaatgtttgttgaatgaatgaatggtgtcatgggtgaatgatggggagtaaatttaggaaggggaagtgagagagtatggtggcaatatcacaagggaggagagaggaaaacaattatcttctctacttggattatgagataaccttttcttggaggaaagaaacaccgctttacaaaggcatgactctggcggtggtcctaaggaagcatgagcagaaaattcataaaaatgtatcatcagcaggagatgagactatgaattggcatccagaacaggagatttagagcaaaatctaatttagcattctgagatgagtgtcaggttttcaggagagaatgagttggggtgagcccagagtctgaaactcctgactggtcaggtgctacttaagaccagcttgggcaattcagggcagaactcctgtatcagcctcatggacacccagaattggtatctcatggctggagagctgatcagccaggcacagaatctccagaacaacctagagagtgaatgctaatttgtagagcgaacttccatttggcccattatttgtaactgtgtaactgctccaagtgccagaatgcttacacgttaaagcagcacctttccatttgcccacatattcttcttgcacaccccttccattactgctgaataggacattgcatgggaagagtacagaggtggcagaatgaagctagagtgggaaggactaaagactgagccccagagtgctcccagcaaccgccacgtacaaggtttgaaatgacaagggcaagagtgagataggaaactgtgtgtgaaaggaaagcccttgcagtatttctgcctccctttctttctgcctttcaccccactaaatgtatgttattgaatgccagtacttctctagtggatgcacacttgttaaatagtgttaagagatgtggagatgagatatacccctttgatgtagaattattcatttggtttgtttcatacttcattataggaatcaagtaatttgatgactaatgtggattatatttcagtcaaagctctgctttcaatttctctgatttgctcactaatgccttgtgtgtgttttactaaccttttatatcttgccttcaagtgagaaggaacaaacaactctcagtggttactacttgcttttatatgctggctgtgaaggttaaaagaaagaatggtctgtaccattctgctttgctgcccttttattgtaccccaggcctcctagaggactcctgcagattctattgttgggtgggaaatagtgttggaatgtgtttgcacagtcttatgatattcagtctcagtctgctataggtatttgttattcttggatactacacacctgctcagactgagtaaacatttgtggtgctgtcaacctgatttcttgactctcaaatgatttttgtatttccaatatgaatttgtgtgttatgaatttctgatttctccaatagtatatgccactatataaatttgtattaataaatgacagtcttgttggttttttgtttgttttcctatgttctttttagattatatctcttatgaatatagacattgccattaagatgccaaaattcattctaaatttgaagcggtcttctggagaaaacccttctaatgagggtgaatctgagacgctcattaactgtgttcagagtaagatgctgaataaattatatgtttccagattatcataggtctttggcaatcagttgaaattctgagacaaagaggaataattaaaatttccatgtgccatataat

SEQ ID NO: 12457 - DNA, 292 bp, Homo sapiens
gatgagtacttttctcctcccagtcactgccacctaccaatatagtggaaccatctttctaaatcttgcatttcttttttctgaaatcctaggaccgcaatcagccagaggtaactgataagtacttccatgatgtgccttttgaggctcactttgcctctgagttgcctgatttccatgtggtcagtaacatgccaggtgtggatggatttactctaaaagtagatgcactttataaggtgagtttggtgagaagaacagaagcttaagaccaagtttactttaaagcttg

SEQ ID NO: 12458 - DNA, 685 bp, Homo sapiens
ttttttttttttttttttttgctatgaagaacatacaaagaacaactggcaaaacatgaatgacacctgaatttcagatggtcaaaatgaactggtgttaatctcctgacttttatggttgtattgtggttatgcaggagaatgtccttgctgggaggaaatacactgaagcatttggggatcgtgggtatatcagtttggcaacttactatcaaacagttcaggcgagggggaagctctttgtattataattgcaacttttctgtaggtgtgagattgtttcaaaataaaacaaaattatgtatttgaaaaataatcctcatcctcctttccaaacacataagattactgaagttaccttaggtgatagcagccctgggaattaatcatccacagctgatacttggaccaacacccctataagcaacactattccattcttagtaggaagggaggctcagttgagtgcagagccttctgagtttgggcccgaggcatttcaaggtagcctcttctctttttctactcataagcacaggcttagatgaaaaagagaaggaagaaaaagaactttgaattaatttgtctacacaatgggacagattgagaaaaaatttaaaatctgtgtcaagttcattgcattagaaacagtgaatcagcctgatataataaaagtacaattggt

SEQ ID NO: 12459 - DNA, 140 bp, Homo sapiens
ttatacacttgagctcatttaattcccataataatccaataaattaggcattataagtattcacattttgtaaatgaggatactgagactcagaaagctttattaacttacccaaagacccatattcagagtctggattc

SEQ ID NO: 12460 - DNA, 5431 bp, Homo sapiens
gggctggctgctgtcagaacctaggccctcccctgccttgctccacacctggtcaggggagagaggggaggaaagccaagggaagggacctaactgaaaacaaacaagctgggagaagcaggaatctgcgctcgggttccgcagatgcagaggttgaggtggctgcgggactggaagtcatcgggcagaggtctcacagcagccagtaagtgaacagctggactcgggctgcctgggcggcagggagaagcgggcaggggaagggtcagcagaggagcgaggccccagaggagccctggggtggagcacagccaagggctctgttccctttcctggactcggcttccacaggccctgacctgcctcccccaccctccggtcctgcccctgtgcctggcagcagccccacctgtgtgacatcccagcacaccccccctctccttgcaaaggagaagggagcggcctaggggaggccaggggcccacctgggctggggctgtggagagggagtggctgggacgggaggaaaaagagagacggagattagatggaagaagagggatttcaagacaaattgccagagatgcagtcagagagactgactgagagacacaaagatagaaggaattagagaaagggccacacagagccagacagagagagaagagtggagatggagacagggacgaggacagagaaaggcagacagacacatagggacagaaagagaaaaatcacacaaagtcagaattactgaatgacagggaatgacacatagaacgagacacagattcagagactcagggcagggaaaggaaggctgcagacagacagacagacagagggaggctgagacacagggagaagaggggcttggagaggtggcacaggcaggcagccagtgcctcagaggcctccggggagggccctcacacacaccccgccccggggcattaaggcagggcttggaggccagtcatcctgggcccgcccagggccgcccccctgccagcccgcctgcctggtgcctggcacctggcgctccaacccagcctacctgctgtagctgccgccactgccgtctccgccgccactgggcccccagagccccagccccagagcctgtgagtccaggaggaaagggaagctgcccctccccgtccaggtgtcagccctccccaaggacacctgtcccactcgggcacccatttctccctctgctctgtccttctctgcttgggtgggggttcctggcctctctctacacctctcacctccgatggctgtccgcagcctcagttacctctaatctccatggcttcagctgctgagctggccctctgctcccacccccgctggccagggcagcggagggcactggccctcccctcgaccagccccgcccagctttgcttggctgtccttcaaaagggcaggggtttggcggacagggcttcagcaagccgggtgatgggggtcccagacattgtctggggctgagccccctactcccctccagcagacctcaaaggctccatatcgctctgctgcgaagacaatgaaaaaggggtggctacggaacggtgtctggttccccttgtccttccaccccaagctgctggggcctggccagctctcaaggcaagaaggaaaacatcctctgacatgtgccggggaggtcccatggctgacttgaacagggccgaaccatggcttgacagctcaaagcccctcccaacgacttccacatggttcttggtatctcggaagcttctagctgtgaccaggccctctccaaggccaccctagacacctaagatatattttaagtgtttggagatctgagtgctgtgagaaacaggggatttccccaaccttgtttctcccaagtggggagcgggagcaggtgagggagagaggagagggcatgagccagcccccccctcccgatttccccgtaaagtgatgcggccccatgtccctccttgttcccagaggaacctggggcccgctcctcccccctccaggccatgaggattctgcagttaatcctgcttgctctggcaacaggtacgcaggggatgggggcagggcaggatcctccctcttgaatctctgggatcccctaaccctctgtgtctggacagtgacagggctgattccaaattacagaacaacccataaggcacctgaactggagcagtggtcatgagggcctggatgcccttctagataatccctttaaatgccaaaggaggagaggtcaagggggtcgtaaagggtcccgtggaggggctgaggaagctggagttgggggagcagtcactcaaagcgcccaggacaggggctactgaccaaccagtatggaagtatttccttttttttttttcccagagacaaagtcttgctctattgtccaggctggagtgccgtggtgccaacacggctcactgcagtcttgacttcccgggcttaagtgatccttaagccatctcagcttccccggtagctgggaccacaggcacctgccaccaagccaggctaattgtttaattgtttgtagagatgggggaggaggtctcactatgtttgcctaggctgatctagaactcctgggctcaagtaatcctcccaccttagcctctcaaagtgctgggattacaggcatgagccactgcatttgaccttatggaagtattttcatcctttaatacccgaccccagcatccagggcaacccagagggacaccagaccagggcccagaccacccactctctttctctcctccccacccccatttctgggagtcctcctggtctaccacctctccttcctgagccccttcttttgctctcaccccctccagggcttgtagggggagagaccaggatcatcaaggggttcgagtgcaagcctcactcccagccctggcaggcagccctgttcgagaagacgcggctactctgtggggcgacgctcatcgcccccagatggctcctgacagcagcccactgcctcaagccgtgggtgcgggggctggggcggtgccggggtggggggctgggaatggggagatggatggagagaagctcagggataggggtgctggtaaggggattagagatggggatgggtagtgtcagcaaggttgatgggctcgagttggtattgaaggtggggggatgaatggggttgggatggggctatggctgggaagggggcttcggtgggagacgtggaagaggttggaagcagagcgatgtttcttcatcctcaaaggtgtcactcacctctcccacccatgtctcccccgacctttcctcctccaactactgtctctcccacctcagccgctacatagttcacctggggcagcacaacctccagaaggaggagggctgtgagcagacccggacagccactgagtccttcccccaccccggcttcaacaacagcctccccaacaaagaccaccgcaatgacatcatgctggtgaagatggcatcgccagtctccatcacctgggctgtgcgacccctcaccctctcctcacgctgtgtcactgctggcaccagctgcctcatttccggctggggcagcacgtccagcccccagtgtaggagcaccagaggggaacctggcagggggtggtgaggagggagtggtcaggattgtggaagggttcagggcatcagagatgcggttcacagtgacgatgtgggataagttgagaggatgtgtggaaaacgtcaggataggggggtggggacaaaagttggggccttggagtcagacggacgggatatgcaatcatacatccataacctcctggttgtaagaccttaggcaagcagcttcacctctctgaatcttgattttcttctctataaaatgagaatgattatacccacctgtcaggattggattagagataatgtatatcaagcaactgacataaatcatttattggatagcaggctgggcaccgtggctcacgcctgtaatcccagcactttgggaggccgaggtgggaagatcacctgaggtcaggactttgataccagcctggccaacgtggtgaaatcccatctctactaaaaatgtgaaaattagttgggcgtggttgtgtgcgcctgtaatcccagctactcgggaggttgaggcaggagaatcgcttaaacttgggagacggaggttgcagtgagccaagatcacgccactgcactccagcctgggcaacagagcaagactctgtctcgaaaaaaaaaaaaaaaaagctggatagcattgctgttgctattgttacaagaagagaggtgagttggctgcgtctaaggacagggattcccccaggggcgggatcacagcaagcactgcattaggggaggtggcagggggctcattcccacagcccctcacgctgtttccacagtacgcctgcctcacaccttgcgatgcgccaacatcaccatcattgagcaccagaagtgtgagaacgcctaccccggcaacatcacagacaccatggtgtgtgccagcgtgcaggaagggggcaaggactcctgccaggtcagtgtggtctccaaccacagccccatccccatccccagcttcaatgacatctttaccgacatccacaatttcatccccaacctcaacccgccgacccctgcaactcccaatccatctcttcccctgttcccgtttctgacctcagcacaaacttcagctccatccccgtttccacaccatttccagctccaaccatccccaaactcgtttttgagcctaaccccatcctttatcccacccataatcccagctttatcgctaaacctatcacctttcccagtgcctacccatcctgtctcggccccactcctaagcaccgtccccacctcctccctggctaacaccatgctcaacgctttctctgaccgacattctctctccccgtgcccagggtgactccgggggccctctggtctgtaaccagtctcttcaaggcattatctcctggggccaggatccgtgtgcgatcacccgaaagcctggtgtctacacgaaagtctgcaaatatgtggactggatccaggagacgatgaagaacaattagactggacccacccaccacagcccatcaccctccatttccacttggtgtttggttcctgttcactctgttaataagaaaccctaagccaagaccctctacgaacattctttgggcctcctggactacaggagatgctgtcacttaataatcaacctggggttcgaaatcagtgagacctggattcaaattctgccttgaaatattgtgactctgggaatgacaacacctggtttgttctctgttgtatccccagccccaaagacagctcctggccatatatcaaggtttcaataaatatttgctaaatgagtgaa

SEQ ID NO: 12461 - DNA, 5791 bp, Homo sapiens
ggacggagagatagcagcgacgaggacaggccaaacagtgacagccacgtagaggatctggcagacaaagagacaaggtgagaaggaggtaggcgactgccaatgagggagtgacacacaggggagcaggtagagagaggacaagcaggtcatccccttggtgaccttcaaagagaagcagagagggcagaggtggggggcacagggaaagggtgacctctgagattccccttttcccccagactttggaagtgacccaccatggggctcagcatctttttgctcctgtgtgttcttggtgagttctcccggagcagggagagggcaggactgcgactggatcccttcacccccatgaggaggccccaccaccctccccatctcagctctggcccccagcctggtggtgaggaggagaggggctttctctgtgcctccatttacctgcagctctcagggtactgctcacctcggtctcccctattttttgatccctcttcccttctgtccctctctgaatctctgtctctccatttccctcctatgtgtaagcatctttctccctgggtgtctttgatgtttcatggtctttttctatcactgggtctctctctctttctctctctttctcgtctctctttctcctctctctctcctgcctgtttctctctctcactctgtgtgtctctccatctctgtatcttttcttcctctctctgacccatgcccctgtctgtctccagggctcagccaggcagccacaccgaagattttcaatggcactgagtgtgggcgtaactcacagccgtggcaggtggggctgtttgagggcaccagcctgcgctgcgggggtgtccttattgaccacaggtgggtcctcacagcggctcactgcagcggcaggtaagtcccttcctggggtgggcgaagggaggactatgggaaggcaagcgctgggggtaggatcacaagggagggtggtgcccactgggaagaagctgatcctgcaacaagagagtctgaggttagaccaggagtggaacttccttagcagtgggcctggggtggtgctgggcagggtgaggtatgttgggtggagggccggggagggtcctggaacctgccctcctgcctctcccattcctgcatgtaccctttctttcctatatgacatctgccactcaccccagccattccttgacccagtctgggcccggggcccaggtctcacccaagctctttttctttttcttttttttatttttttgagacagggtctcgctctgtcgcccaggctgctgtgcaatggcgtgatcacagctcactgctgtctctgcctcccaggttcaagtgattctcctgccccagcctcctgagtagctgggattacaggcacccgccaccatgcccagctaatttttgtattttttgtagagacagggttttgccatgttggccaggctggtctcgaactcctggcctcaaatgacctgcccgtcttggcctcccaaagtgctgggattacaggtgtgagccactgcacccggccaacatgacccaaactctttgtgcaacttcagaatctatgcctggcacctctctgggcctcagtagactgatgttctggaatttttttctttttctttctttttttttttttttggagacagagtcttgctctttctgtcatccaagctggagtgcagtgatgctatcttggctcactacagcctcaaccacctgggctcaagtgatcctcacacctcagcctcccaaggagctaagactacaggcctgcgccaccacacctggctaatttttaaattttttttgtagagacagggttttgctatgttacccaggctggtctcaaactcctcagctcaagcaatcttcctgccttgacctcccaaagtgctgggattacaggcatgagccactgtgcctggcctggaactttttttgtgaaaggggagatcagatgcaaagaaacagagactcagggagagagagggccagcagcaggatgcagagaggccattcatcaacccactcgttcaatcatgaacccactcgtccacgcatgagcatggagggcacatgctccgtgccaggcggtgggaataaggcagtgaacaaggtccactgatgtccctgccttcatgggcttcaccagccgagagaatcagaaagagaggcctggcgcggtggctcacacctgtaatcccagcactttgggaggccgaggcgggcggatcacttgaggtcaggagtttgagaccagcctgacacacatggtgaaaccttatctctactaaaaatacaaaaattagctgggcatggtggcatgcttctgtaatcccagctacttgggaggctgaggcaggtgaattgcttgaacctgggaggtggaggttgtagtgagccaagatggtgccactgcactccagcctgggcgacagagcgagactcggtcttgaaaaaaaaaaaaaaaaaaaaaaggagagagagagacacagatgcagggacatggtaggagaaacagggaacacccaagatggaaagagggtgatggaggttgggaataagagcctgtaagagagactcggagaatgagagttgcgggtgagaggacagacagtgaggggcagaacagtggggagcggcaggagcgcctgagtgtccgtggaggggtgcaaggtgggggactgcgtgcctgccacccgctcagccgtcgccaccggcagcaggtactgggtgcgcctgggggaacacagcctcagccagctcgactggaccgagcagatccggcacagcggcttctctgtgacccatcccggctacctgggagcctcgacgagccacgagcacgacctccggctgctgcggctgcgcctgcccgtccgcgtaaccagcagcgttcaacccctgcccctgcccaatgactgtgcaaccgctggcaccgagtgccacgtctcaggctggggcatcaccaaccacccacggagtaaggggcccagggccaggggtcaggggtcaggatgggtacaagtctgggatgcagggcgagaggtcgaatcatgacacctcagaggaaggatgggtaaagggtcagggtgtgggatgggacatcaggatcatggtttggggtcagagattatggtggattggggtcttgggagccaaaggggttaaaggactgggtatgaagtcagggatcagaggtcagaggtcagagtgtgtcagaggtcatcacactggagcaaaaggcatatatatatatatatgtatgtataggatatgggcattgtgggtcatgggtctggggttagaggtcaccgtagaattaaggtcatgggatccagaggttgtacaatctggtcaaaatctgaggatggaaattgggattctatccaaaatcacatatctgagattggaggtcatagcgtttggggtgtggggcccgaagtttggggtcatggaggctggggcccaataaactaggatcaggggacactggcgttggaagcagtgaggtttggaagatgcagagctgaggttggaggttaaggtaaagacagggacatggggtcaggagacagaagatatgagatcaagctgggatcataaggtaataagacagaaggtcaaagatcacagtagctggcattgaagagggtcaggtctggattcgttgtctctgacgctggagagacaagaaagttcttgagttatgccactcaaagtcaaatgtcaaagatcaaagagaccgtcaatcatctggggtcatgattcatatgaaattaagtcataaatatgtaacttggaggtttcgggattgtagtacaggtcggtgaggggcaggggtattgacatggatgggccacatccagggaagagggacgtggcctcaaagtggggagatttaggggaccctgcagcacgcatgttctctctccagacccattcccggatctgctccagtgcctcaacctctccatcgtctcccatgccacctgccatggtgtgtatcccgggagaatcacgagcaacatggtgtgtgcaggcggcgtcccggggcaggatgcctgccaggtgagccagtgcaggcagcgtgcgtggtcaccaggacaggaagtgaaggggaggggctggaagcaggaggggaactgatggaggatgaatcagggaaaggggatgctgcagagagacggggtcaaaaaggaagggagaggctggttacggaggctcacacctgtaatcccagcactttgggaggccgaggcgggcggatcacttgaggtcaggagttcaagacaagcctggccaacacggtgagactctgaatctactaaaaataccagaattagccgggggtggtggtgcaagcctgtggccccagctacttggaaggctgaggcaggagaatcgcttgatcccgggaggcggaggttgcagtgagctgagatcacgccactgcactccagcctgggcgacagagccagactctgtctcaaaacaaaataattaataataataataataataataataataataatggaggagaggcccaggataagggagggagagagacagggagtaaaagggaggaccggggaatggaggagggggaggggcagggagagagagggaggaagggaacagagaaggaaagatggggcaggggttacagagagagacagcaaaacagacggagaggactgggagcccagacagggaaccagctgtttctggggctctaagtctttcccataccatcctccagttggtgctgtcccagactgagagagatttgaggatggcggtctctcccctcattggtcagggccccagccattgtccttgagagaactctgtgcttttgatggagtcctgcccaccttccctgggattggtcatttttgatggcactctctcccctcattggtcagaaccccaggcattgtccttgagagaacctctatcctttatggagtcccaccctcctcccctgggattggtcattgataatagtgttctctctcctcattggtcagggccccagccattgtccttgagagaatgctcgactctttatgttgtcttgacagcctcccctgagattggtcattaatgactgtgctctctctcctcattggtcagggccccagccattgtccttgagagaacctctgtcctttatggagttccacccttcttccctgggattggcccctagagacagtggttcttctcttttggttagccattgccattgtcctccgggaaagtgattatactcttttgtctaatgaccagacttggagccctccccaaggcccaggactgggttgaagggttggggaggaaaacagaaataagatgtctcccttgttcagacagtacttctcttcccttccagggtgattctgggggccccctggtgtgtgggggagtccttcaaggtctggtgtcctgggggtctgtggggccctgtggacaagatggcatccctggagtctacacctatatttgcaagtatgtggactggatccggatgatcatgaggaacaactgacctgtttcctccacctccacccccaccccttaacttgggtacccctctggccctcagagcaccaatatctcctccatcacttcccctagctccactcttgttggcctgggaacttcttggaactttaactcctgccagcccttctaagacccacgagcggggtgagagaagtgtgcaatagtctggaataaatataaatgaaggaggggc

SEQ ID NO: 12462 - DNA, 2456 bp, Homo sapiens
ttatttacctctcttgtttctttttgcctgttatgtcctctgagccttcctactcctttctcctcacctctttcacaacaggacgtgtattcgcaaacactacttggagggccggtacctccaaggaagtctcctttgcagttgatttatgtgtactgttcccagagccagctcgtacccatgaagagcaacataatttgccggtcataggagcaggaagtgtcgaccttgcagcaggatttggacactctgggagccaaactggatgtggaagctccaaaggtgcagaaaaagggctccaaaatgttgacttttacctctgtcctggaaatcaccctgacgctagctgtagagatacttaccagtttttctgccctgattggacatgtgtaactttagccacctactctgggggatcaactagatcttcaactctttccataagtcgtgttcctcatcctaaattatgtactagaaaaaattgtaatcctcttactataactgtccatgaccctaatgcagctcaatggtattatggcatgtcatggggattaagactttatatcccaggatttgatgttgggactatgttcaccatccaaaagaaaatcttggtctcatggagctcccccaagccaatcgggcctttaactgatctaggtgaccctatattccagaaacaccctgacaaagttgatttaactgttcctctgccattcttagttcctagaccccagctacaacaacaacatcttcaacccagcctaatgtctatactaggtggagtacaccatctccttaacctcacccagcctaaactagcccaagattgttggctatgtttaaaagcaaaacccccttattatgtaggattaggagtagaagccacacttaaacgtggccctctatcttgtcatacacgaccccgtgctctcacaataggagatgtgtctggaaatgcttcctgtctgattagtaccgggtataacttatctgcttctccttttcaggctacttgtaatcagtccctgcttacttccataagcacctcagtctcttaccaagcacccaacaatacctggttggcctgcacctcaggtctcactcgctgcattaatggaactgaaccaggacctctcctgtgcgtgttagttcatgtacttccccaggtatatgtgtacagtggaccagaaggacgacaactcatcgctccccctgagttacatcccaggttgcaccaagctgtcccacttctggttcccctattggctggtcttagcatagctggatcagcagccattggtacggctgccctggttcaaggagaaactggactaatatccctgtctcaacaggtggatgctgattttagtaacctccagtctgccatagatatactacattcccaggtagagtctctggctgaagtagttcttcaaaactgccgatgcttagatctgctattcctctctcaaggaggtttatgtgcagctctaggagaaagttgttgcttctatgccaatcaatctggagtcataaaaggtacagtaaaaaaagttcgagaaaatctagataggcaccaacaagaacgagaaaataacatcccctggtatcaaagcatgtttaactggaacccatggctaactactttaatcactgggttagctggacctctcctcatcctactattaagtttaatttttgggccttgtatattaaattcgtttcttaattttataaaacaacgcatagcttctgtcaaacttacgtatcttaagactcaatatgacacccttgttaataactgaggaatcaacaatttgattccccgaaaacatgggtggtgaatgtaatgcccaacattgtttttactaaccctgtttttagactctcccttttgctctcttaatcacctagccttgtttccacatgactaaaactctcgcttagctgagaaagccggacgaactccatctggcccccttgatttgtaagacattaaggactccttacccacccccttcttcaaggagttaacttgtgtaaacagattctcaacatatcaaaagagtccaattaactgataaggtactgaaacaaacaatgtacgaagttcccaggattttgctcaaaagataacaccacaaagccttgagtctgtgtccggcatagcacccatatctaacatcttatgaaggatttagagcccccgcacctgctaccgttgcttttctgtaaacatttgtcttttaaattgtctgtttctctgtaatcatttgtccttttaatttttgcatgtttttacttctgtagaattgttgcgtttgagctcccctccccttcctaaaccaaagtataaaagaaaatcaagccccctcctcatggccgagagaattttgagcgttagcggtctctttggccaccggctaaataaaggactcttaattcatcccaaa

SEQ ID NO: 12463 - DNA, 3955 bp, Homo sapiens
gacctgccgaggtcggcagcacagagctctggagatgaagaccctgttcctgggtgtcacgctcggcctggccgctgccctgtccttcaccctggaggaggaggatgtgagctgggttggcgtgggcggatggaggagccaggcggactcctgggcagggggcagtgccaggggccctgctttaggaggtgtcactgaaggctggcttctgaccccgtgctcccagcctggggtggtggtggaggggtcctattgttcctccagcagacacggccccccgaggcccagggccggagcaggctcgtctcaggggttcctgctgcactgacgcctgaagcccgaaggtctcgcagggttgggccctgtggagggagggctcacctggtgctggggcccgggggtccatggggtgcagacatgccctccttccactgggggctgggagccctgagcagggggctggctctaactcactccagctgagctctaactaaggtgcaggaacacagcctgcctttaagggcagcagccgggcaccatgggtgtctggttatagctgcaggcctgagtgccagggtcagagtagaatctgggccacccatggtgggctcacggccttggcctgctccagatcacagggacctggtacgtgaaggccatggtggtcgataaggactttccggaggacaggaggcccaggaaggtgtccccagtgaaggtgacagccctgggcggtgggaagttggaagccacgttcaccttcatgtgagtgttgcccactgcagggcccctcaggccactttcgctcccctccccagacccacctggtgcccattgccccatccacgtttcgggtgttgggaagagtcaccccctgccttggagggaaacagcctgggcatcctgaagctcggtggggtgggggacagtggaattttcaggttgccgggtcagggccatgcaccaggtgagctgaggatgggccatgggtgtcctgggagccgctgcccgcgtgtctcctgttttccaggagggaggatcggtgcatccagaagaaaatcctgatgcggaagacggaggagcctggcaaatacagcgcctgtgagcccctcccccactcccacccccaccctcccccaccgccaaccccagtgcaccagcctccacaggtagagagtgcccaggctgcccttttgccagggccccagctctgcccacctccaaggaggggctggcctctccttcctggggggctggtggccctgacatcagacaccgggtgtgacaggcttgtccgcagtcgagatggaccagatcacgcctgccctctgggaggccctagccattgacacattgaggaagctgaggattgggacaaggaggccaaggattaggtacggggaggctgagggttagggatggggaagctgagggttaaggatggggaagctgagggttaaggatggggaggctgagggttagggacgggggccaagggttagggatcgggaagctgagggttagggatgaggaggccgagggttagggatggggaggccgagggttagtgctgcggaagctgaggattagagatggggaggctgagggggaagatgagggttagggacagggaagtggggcaggagcagctgctggagctgggaaggccggactctagtcctggacgtgctctggccttgtggctccattacttgcattgggaccttcctgagaggaggctcctgcctccgtgtccgggtccacactgtgcggagcagccaggcctggctcaggctgtccagggcacctgggtgaccgctgaaacattcccgagtgtttcttcatgtggccccgagtgttctctctgggaatgacccattttctctgtcatctacagatgggggcaggaagctcatgtacctgcaggagctgcccaggagggaccactacatcttttactgcaaagaccagcaccatgggggcctgctccacatgggaaagcttgtgggtgaggggcttgctggggtctgcgtgtcctgccccacggtctctgcctctggaagccggtggaaccagcaccaccatgccctggcatgggggaaaaggaagccccctgtgccggctttcatgtgccgggcaccgctgggcagccggtccaagtacctgaagtgggaatgggatgggccaggcagggacagacatggccctcagtgacatgaacctgccaagggccacttctggggtctcgggtgtaggagggtcaccttaagggggagggtcaccttaagcgtcctaagagagctcttcatggggcagggaccctccagggcaggagggtggccggtgcctctgggagacaaggtccctccaggtgagggctgtgaccctgcagggtggcattgggagctgcccaggtcccctggggttgccgagtggcttggagagtccccgccactgtcccccttcctggggacctctcatctgggcagtgactgtctcctctgtccccagtcccacccctgagctctcatccattctcaagtctcctctcctgcttgtccggtgctgggctatggccatctcttctgtccccggccccaccccagagctctggtccactcttgggtctctccccttgtcctggtgctgggcagtggccatctcctctgtccccagccccacccccgagctctgatccactctcaggcctctccccctgtcctggtgctgggccgtggtcgtctcctttcggcatctgctccctgcagggccgtgccgctgtccccacgtcggctcacctggccacctcacctgcaggtaggaattctgataccaaccgggaggccctggaagaatttaagaaattggtgcagcgcaagggactctcggaggaggacattttcacgcccctgcagacgggtgaggatggctgtgcccagtcccctgtgtccctctgctgtgtctgtctgctatctccagtgtcccatgacccccatgtcctcccatgtcccccgcattccccatgtgccccgagtctcctcgcaggggctcccgggccctgtttagcgtcctcctcattggaggctctgtgctctgggctgcgatggggtctggggctccgcgctctgggctgcgatggggtctggggctccgcactctgggctgcgatggggtctggggctccgcgctctgggctgcgatgggctctggggctctgagctctgggctgtgatggggtctgggccctggtctagggcgccttctaatccctgggtttttcttggtctctgcaggaagctgcgttcccgaacactagggtgagtgagcctttaggagggcactggacaagcccagagtcctgggttcccggggttcgagggtacatctgctctggcccctcccatcccacacagccagggagacccccccagggtcaggcacgaggttggcacctcagagtctgcccacccacagttcctgggacattcgggaagtcctttgttttatcattcctgcacctgccagcccgagtgagggtcctcctcggcctttccacagcgaggcctccctccggctccctcaggtgtcagctcagcccatcgccccctgcacctgtccccacgcggtccactccccaccatccacccaccaaggatgctcagaggcctgcccagtcattggaggagctgaggtcgctctggagccccgaggttgcccagcagtggccgatgtgggggctgcagagcctggggagggagctctggccctggcctctgccctaccctgcagcctccctgacctctgctcctcttcccagcacagcagcccccgggtctgcacctccagagcccaccctaccaccagacacagagcccggaccacctggacctaccctccagccatgacccttccctgctcccacccacctgactccaaataaagtccttctccccca

SEQ ID NO: 12464 - DNA, 13135 bp, Homo sapiens
cttccaaagagcgactcttactgtttctcatggtgagaagacaatatttgctttctctttttcctttcttccggatgagaggctaagccataatagaaagaatggagaattattgattgaccgtctttattctgtgggctctgattctccaatgggaataccaaggggtaagtgcaggaaattgattagagcctgggctacaacgcatgggaggagcggggctgaatcgctgagagtggtgagtgggcatgcagggagagtactctcccagagaaaggggtgcagtgcctgtgtgtgtgtgtgtgtgtgtgtgtgtgtgtgtgtgtgtgtgtacatgtgtacatgtgcacactcgcacatgcacatatgggcacgtgggaagacgggagaagtactgcaaagtataaggaactgcagaggttgggatttagtggaaggaaagggagacaacatgaatgaagaaatattccaactgcatgttcttaacgtattgtggtcagaaaagggcaaacaaacaaacaaacaaaaaacccttaaaatctgttctggccaactcaaggcatctattctgagaaattctgaagaagaagaagaaaaaagagatgtgcctcatagatttatatgtaaatgtgtttattacagaagtatttataatatagtaaaatctgaaccaacatacatattcaacaggtggggaatagacaaacaatgcatggttcagtcataaaacatgttccatgtaaccattaggaatcataattttaattaagtgaaattctttataattttaataacactggatccttatattaaaccatttttggtatcttttagggatagtacttggttttctttccattcatcatttccccaaaacctaaagcatgatttcccatggttacaagctactacattgtatgaatatataattattgggagtctctgtgagcctactctgactcagaaagccgctcctaaagaagaaaaaagaacaaacaaacaaataaaaaacccgaattatttttaaaactctttattttggatttttcagtttctacattttgttactgtagattttactagattgaacagccttatccataaatatttgcatcaatctctaaatttttttcttcaacactaacttttatagttggaattttgggggcaaataatacaacattttaaaggcacttgccatgtgtacatggccaaatgcttccagaaacatttccacttccattagcaaagtatataactacagagtatttaaggttttattcctttatatttttttctttggcaaaattgtctatagtagaaagaatgaataataaataacctaaaaaataaaagttctccctctgaggacagcagagaaatttttagcttagcttaataatacctccttctccttaggagaataaagagcagtttcgaggagcagaagatgtggtgaaatataatgtttagtctgatggtggatgcaagatccaggcaggggtggagcatgaccagctgcacagacctctgttcccttgcttcctctacatctctccccacctccatctgcagaccttgttctcagaggccattcccagacccacagcagctggtatgatggctgcaggcctcatgctcctttgttttgggagaaactgttgaggagttagtatttactgagcagctaatatgttccagtcactattattcctcataataattagttattaactaatacatgaaaattttaaacttaaagcattccaataattttaaaagtaaaggaagcaaaaggccaaagcgtcctttcactcacttaacctccaattttcagtttagcatccatcattttagactttttcaggcatttacatatatagttatgcagaaatgtatagctttgcttttgtttttcaattgaatcattagtatagttctgcaaggtgctttttaatcacttagtatatctccattatccaggctagtgacattaaatcactctttttaactgctgcattgaatttcctcctagggatgagccatcattcctctaaccagtctcttgtgagtggctggttcagttggtaaccacttttatactttaaaaatagtgctgcagtgtcattcccacagaggcttctctctgcacccatgcgagtacttcgctgaagtaaccatcaggaagtggaattgctgggccaattgtgaacattctaagtctcatactcgatatttttgagtaactaaagttgaaatggttttgtcccatgactgagatcatcaagcttgtgacttgtagagcctttacctattgtctaccctctttgtgttcctaactctaccatagtgggtccagcccattgtgggtgctcagtaaatatttgttgaataactttatgaagggaagaaagaaaagatgagtaaagcctggtcttattcaaagctctcctaatcaatatctttgtgattaaacgtggtgggttcagcccctgactgacttcagagcctctgccaggcagtctgcctggatcccaccaggagccaccaggccataagttgactgtagtaatggccaagagtttgacgcttgaggagtccatagtgttggacacccacagagctgaacaagggtgggaccagggaatccagtgaagagggtccttcatgaatcagagggggatgatggaagcttggacctggcaagggaagtgtggggaagtgataggattatgaatattttaatattttaatgcagtagagtcagagatgtcctgatcagataacagatattatttttacagatggttttccatactggaacccaaaggtaaagacactcaaggacagacatttttggcagaggtaagatcttcttcggtcaccatatttgagttagccctggggaagtggacatttccatgcagaatcctaaagcttcttccaggccatagtgtctgtcccacaccttctggtatctcttgatatgcagcatagatgaaaatggcaagttccctggctttccttctgctcaactttcatgtctccctcctcttggtccagctgctcactccttgctcaggtagggaatgattccatgattccacatttatgtttctgaagcagacaattatctcaattacctaattaagcagacaattacctaaatgccctcttagaacctttaactcattcccatacctggaagtccatcccaacctgaaggatcacctgtcacaaagagacaaatggtccttctgttaggattgtgttcccctctaggttctctgtatctcgccttccctgtctgagaaggacccttcctctcatgaccccaactccaaaaccctctgatggagcttcccccttgtgctgacagctcagttttctgtgcttggaccctctgggcccatcctggccatggtgggtgaagacgctgatctgccctgtcacctgttcccgaccatgagtgcagagaccatggagctgaagtgggtaagttccagcctaaggcaggtggtgaacgtgtatgcagatggaaaggaagtggaagacaggcagagtgcaccgtatcgagggagaacttcgattctgcgggatggcatcactgcagggaaggctgctctccgaatacacaacgtcacagcctctgacagtggaaagtacttgtgttatttccaagatggtgacttctatgaaaaagccctggtggagctgaaggttgcaggtgagcctccaggttttgttctgagaacatttctctgtaggatctagagcagatgcagagtccctcttgcaaaagcactgcagacactcctggctgctcactagcaattgcctgcactgcctcccaacttagcttctctgaggcccttgagtaagacacaggttttcctttaggaagaattcctgctgtaccctacatgctcaagtaaagaactcctttcctctggccaccagagatataagcgaagtgaaggacgagggataggaagcataagaaaccatctcttcagtgactggtacacagtcattttggtttagttgtgtaacagatggcttctgttgtgtctccaagtgcacactaccatgggtcctgggaggtggaatagtgactgtatctgctgccagtgttctccaactagccatccccaggaatactcctgtagtagaactagctgtatttcttacgtgttgcagtgaggaagaacacacatcatggggagctgtggcggggtctcagtaagaaggtgttagagcagacttggtatacaatttgggcttgtgttaggggattggggccgggggagttcatagacttagccctctgctctggatgagattccatcaggaaggtgtgggcaggttaattctgagtgagagccttaatcaatcttatgtaggaagaaggagaccagggtgagacaaaagctgtaattgatgaaggggcagcaatccctcattgctgaggggggatgtttggtcactgctgtggtttggacaatgttcatgtttttctctatgctcacatatgatgtggggtggtattgtttttcccatgatccatcatagtcacaaagtgccattgtctgtgttctgtgaaattgcttatgttcaacaggatgacacagagacccggtgtcagtttccatatgttgggacagcttttctctttctcagtgcaatcccttgccctgtggctgctggttaggtttggtttaaggggatctctagcagacaatcataggaggaagagaaaaggaagaagtctgggtgcttattcactggcttccttactgcaagttaccctcaggctggctgcattgccttgctgaaggtaacagctcctctaaaggaagtcctcaatgcatgaatctcttcttttttgtgttcaaaacagcttcctctcctcctccctctggtaattggggtgggtgggaatagccccactgtttctgaccctgggatactgcactagcaaatttagttttcccctcatcatgaccacacttttgtaaacagctcctgaatgaaatatctcttgaattatcaaatctgagcctgacattgattcccattgagaccctccctaatacaggagctatccagaatttaggccaaattatccttccacagcactgggttctaatcttcacgtcgaagtgaagggttatgaggatggagggatccatctggagtgcaggtccaccggctggtacccccaaccccaaatacagtggagcaacgccaagggagagaacatcccagctgtggaagcacctgtggttgcagatggagtgggcctatatgaagtagcagcatctgtgatcatgagaggcggctccggggagggtgtatcctgcatcatcagaaattccctcctcggcctggaaaagacagccagcatttccatcgcaggtcagtacctgcttggcctcaggttttctgagctgagctgtggcagttgaatgaagggggatgtgttaatatctgtggtcgacctgggtctctgcactgaatataaggcccaaagcacagacctggaggctcctctttgtgccaggggagcttctttcctccataaaggtgttcgtaacacaaacattttctgaacatttcctatctgccagaaagtatgacaggcaatgggaattggaggaaaaacattaagataagctccttatataatgtgaaatgacaaaatggttatatatatatatttacaaactcatatcatagagaaagagctgatctccttgaatcagaaggagattctaaaaacctagtaaaaagttttggccaggcatggtggctcacgcctgtaatcccagcactttgggaggccgaggcaggcagatcattgaggccaggagtttgagacctgcctggccatggtgaaactccatctcttctaaaaattcaaaaaattagccaggtgtggtggagtgcacctctaatcccagctactcaggaggctgaggcacgagaatcacttgaacccaggaggcagacgttgcagtgagtgagagcagaccactgcactccagccaggattacagagcgagactctgtctcaaaaaataaataaaataaaataaaatagaaaccaagtaaaaaaaatgttaacaaagcccatgaattatcaattcacagaaaaggaaataactcacaaaagggtgctcattctcactcactgggtaaacatatgaaataatttttcacttatgatatttgcaaaaatcaaaactgctttggcttataatacatgattctcataggaatgtaggaaggcagtgactctcagtcatttgctcatgtaacttcctgtatttttgatgtgcattaggtcaacctctgttgggggctctatagcaatatctatccaaactacacacttatcgatccaaacttccacttctaggaatttatctgatagataagcttgcatttgtatgagatgatccatgtgaaaggtttctgtttttcgttgtgtgtgtgtcttttttttttttagacaaagtctcactctattgcccaggcttgagtgcagtggtgcaatctcagctcgctgcagcctctgcctcccaggttcaagtgatcctcctgcctcaatctcccaagtagctgagattacaagcatgtgccaccacacccagctaatttttgtatttttagtagagacaaggttttaccatgttggccaggctggtctcaaactcctgacctcaagtgatccacccgcctcagcctcctaaagtgctgggattacaggcgtgagccactgcaaccggcctgtaaaaggtttcttatagcactgattactattgcacaaggttagaaactgtgcagatgttcactgccagggaacttccatacaagggaatactgcacagtttgtaaaaggaaaaagaagcaattctctctatactaatatggaaagatctccaagatacactttacacagaaaaagcaagatgcagagggacgtgtatagaatgctatttttagtttaaacaagaggaaaaataagaatatattttaatttacttttttttagttctcaattgggttagtttacatttttaaacttcaacaagcaattttgtaacacttactgtacatcaggcactttataagtattaattcaattcttctaacctcaggaaataggtattatcattaccctcattttacattagtagattaggccactacaaacagagaggttatgtaagtagtccaacatcacactgctagtcacatgggggagccagcattgaaacccataccctctgactccacaggttatgttcctaagcatcatattaagtggactaagaagttaatacatggagggagggaggacagggtgaatgagagagttgcgtgactttatgtgtatgtagttttgaacgatgtaaatgtgttacctattgaaaaaatatttagaaaaaatgtgtatgactttgctcaagttactttccatgtgagaggcagacatctcaagataagtaatagtagtagcttgtagtgagggtttaccaaagtcttatctatagtcctctgagactttagggagagaatccttatttaacctcatgagatagattccccacccccgacctgagctgagcagctaaagcttggggtgctgcaggctggggaggctgagcgcaccagcgcccatgacctacagctctccccttcgcagaccccttcttcaggagcgcccagccctggatcgcagccctggcagggaccctgcctatcttgctgctgcttctcgccggagccagttacttcttgtggagacaacagaaggaaataactgctctgtccagtgagatagaaagtgagcaagagatgaaagaaatgggatatgctgcaacagagcgggaaataagcctaagaggtatccaacgcaagcagagaatctaagctcttggcttgcatgccccagcctgaaaacctcacctctctcccctaccctggcactgcatcatgtttaaggtttatttcccgaaacaccaacctcacccataacagttcatctttttttttttttttttttttttttggttattttccagagagcctccaggaggaactcagtaagttaccattcccccagagatccagacatgtcttcctatcctcgctttgagcaccttgatgactcttccctgttcattccattgcagagaggaaaaaaatccagtacttgactcgtgagtggctttgacattttctctgaattcaaatctgttactctctctctgcttcattattttccagcccataagtcatagcccagggttgaaaagtggtcttggatccctttacccagaaaaagaaaacaagtgtggctctttggagaaaccacccagtgctttttctctctagaaaaaaaaaaaaaaaaaaaagaggtcttcaatctctttgtactaggggctacagacccttaagctctaaaaagcactgaggaatatccaggggtacacttcaaaaggaagagggaagagaaggatgaggtgcattttctatggcaggaaacttacttgttgtttcccataatctagaggctgttgaaaggaaaacaagaatggaagatttaagaaataagaaaatcagaaaagagagagggagggagaaaagtgtgtctaataaagaggagtagctacagtggctcagttggtacagatagatcataactgctttcaaaaactagtccctgaaattgctcattaaatttcccaaattctttttagagcaaggtacgaaatgatacagattgagaaggatgaatcttgtactcctaggcatacacatatagacatggtgacacctatgcccaggtacacattcaaaacagatgagctggaccccattgggaaggaactctcacagtgcctgccctgccactagcgttcaaccgatgttcccagacttgatattaagaagaggtgaagaaagaattgtacctgaagatggagaccatggggaagggtgggatggtaaaaaaaaaaaaaaaaaaaaaaaaaaaaaaaaaaaaaaagactagatggatgcaaaaagaaggggaaggggccaacacagaaaaggcagagttctggtgacacctctacctttctttcattgtaggtggagaggagtcttcgtccgataccaataagtcagcctgatgctctgtaagtttgctgggtcacatgccctgaatatttcaactttttctccactgtgacccgtggatgttctcagctggattaattagatctaatctaaagactcaatttctgtgtggtgggggttcacctccgcttttctggagcctctgagaaactcctgatcctgcacacccccttgtaaagcctggccatgcatcctgcaccccccatgacacagggagccaagcctgacatttttgagaaggtgccacctctgatccatcagagctgtagaggagggaagctggaccctggaagagactctaaagaaaaggagagaaaacatgtagtgagaggagaatggagtgggaaaagtacaaaaatactgacctttttcttatctgtgtctccttcctttcagaatggaaaaatggccctcttcaagcctggtgagtaaatcactgcatgttccctggaccaacaacctgagggactatattcctttttccttttttcttctccaactcttgtgatttggagcagaaaagttcccttgacttccttcgtgggtaggaagacgcataaagggtggaggtgaagggaaggagacacacactgagtaatactgcagggagagtgaggatggaaatgccaaggagaggaggtgatgcctgcccaaagaactttgtccttcccaggcttctcatgccacctactgcctgtatctcctcaaaggatttaatgcttccaagctttggcctccacatttttagatgatgattgcaatctgtttttcatgggggttgaggtgaagactgaaggaataatgaacatgcttggcagaaacctagcaagaaatagatggtgagctcaaactgggtagttggacaaggtttccagaaagaagggttaagggaaagcaacaaggaaaagtgcagtgcccccatggttcccaacagtggggagctgtctccacccctagcctgggagggctaaaaaggggaggcaattactggaacccagagaaagaggtagcttaacgagggagcttcctgagaagagtcctcgggccttgttagagcaccaccagctgctgctggcagggaggaagcaggaaattaaacggtgtgtatctcctttctttctccttctaatcttctatcagggcctcccattggccaaacacagcagcaaaccagaggacaagggagcccagtggcactgtccatagaggacagattcctggggtccagaagagggtggagaaagctgaaggctggagagtgaatctagggcatataaggccccacacagagcccagcacagagacggccttgcagctatcaggaagatgaggagcttccttcatggcctgctgtgggctgagtaaataatatgattgccttctacagcgctagagattcatatgtttatccccatttttcaggtgaggaaatgcttcagatgaggctccaccttgttaaataaattggatgtatggaaaaatagactgcagaaaaggggaactcatttagctcacgagtggtcgagtgaagattgaaaattaacctctgagggccagcacagcagctcatgcctgtaatcctagcactttggaaggctgaggagggcggatcacaaggtcaggagatcaagaccatcctggctaacacggtgaaaccccgtctctactaaaaatacaaaaaataaaaaattagccgggcatggtgacgggcacctgtagtcccagctactcgggaggctgaggcaggagaatggcatgaacccggaaggcagagcttgcagtgagccgagatcacgccactgcactccagcctgggagacagagcgagactctgtctcaagaaaaaaaaaaaaaaaaaaaaagaaaagaaaattaacctctgagtataaagcatcagtgggcagaatcaatgtggggagggaaacaacaaaaatgtagaaagaggatccttgttgcttcttggggccgcatcagggtattgggttaggcagatactgaccttactttcatttcccctctggtcactagacccctggggctttcaccaatgacattgatgagagaatcacattcagggcaggctagggacacggggttctggaaggacctcctcagcatggcccaagccttgcatgctgtggctcttaaatccaggaaaaatggctgaccccatggacacctcctcaaactctctgcagcagatgtaattctgtatccagacatggcaaatgccatcctccttgtttctgaggaccagaggagtgtacagcgtgctgaggagccccatgacctaccagacaaccctgagagatttgaatggcgttactgtgtgcttggctgtgaaagcttcatgtcagagagacactactgggaggtggaagtgggggacagaaaagagtggcatattggggtatgtagtaagaacgtggagaggaaaaaagtttgggtcaaaatgacaccggagaacggatactggactatgggcctgactgatgggaataagtatcgggctctcactgagcccagaaccaacctgaaacttcctgagcctcctaggaaagtgggggtcatcctggactatgagactggacatatctcgttctacaatgccacggatggatctcatatctacacatttctgcacgcctcttcctctgagcctctgtatcctgtattcagaattttgaccttggagcccactgccctgaccgtttgcccaataccaaaagtagagagttcccccgatcccgacctagtgcctgatcattccctggagataccactgaccccaggcttagctaatgaaagtggggagcctcaggctgaagtaacatctctgcttctccctgcccagcctggagctaagggtctcaccctccacaacagccagtcagaaccataaagctacaggcacacactgaagcactttactgatattcattcaattattccataggacagttgtttgagtttggtgccaccttattggcccctttatacagataaggaaactggggtgtagaaaagtgtattgactttacaaagcagacaggaatagtgaacaacagagctgggatctgaacaacaatgactaacattaatggagaatttaaaacgttctgagtgctgtgttatgagctttggtgggtgtcactcctttaatcctcacaacaccctgtcaggtagtctcatttggcaagtatggaagcagaggcagggcaacattaagtagcttacataactcacacggtaatttgtgcagttgggagatgttcagcttcagtccctggccaattgcccgttcttttccagcctgatttttcctgcatgggaagagcccacatgtagccctgaggttcccttcccaggacagctccaggatcgagatcactgtgagtggttgtggagttaagacccctatggactccttcccagctgattatcagagccttagacccagcactccttggattggctctgcagagtgtcttggttgagagaataacgttgcagttcccacagggcatgtgactttgaaagagactagaggccacactcagttaataatggggcacagatgtgttcccacccaacaaatgtgataagtgatcgtgcagccagagccagccttccttcagtcaaggtttccaggcagagcaaataccctagagattctctgtaatattggtaatttggatgaaggaagctagaagaattacagggatgtttttaatcccactatggactcagtctcctggaaaaggatctgtccactcctggtcattggtggatgttaaacccatattcctttcaactgctgcctgctagggaaaactgctcctcattatcatcactattattgctcaccactgtatcccctctactgggcaagtgcttgtcaagttctagttgttcaataaatttgttaataatgctgactcttcaa

SEQ ID NO: 12465 - DNA, 16038 bp, Homo sapiens
ctctgcatctgcctgcctcgggcagaggagggctaccctggggctgagagttcacctgtctcaggaaccacctgaggtaggcatggggctgggctggtacaccacttccaaggaggcttggcttctctatctgttcagtggggatgctacctccagccaccctctgcagaagggtccttccacccctggccttgctgtaggacctgggcaagtgccgccatcctgggtctcagcagacccacctgagccgcagtccctcactcctgcctggctccctctccctgagtcagacacagatctgcctatttggccagactgagtcaggagaggatgggggccatgtgagaggcctactcttaggccatttaccacctggccaggaggggatgaggacaggagccaccctgggtcctcccctggctgaatttggtggacagctggacaccaagctggctgtcacacggggctggactccggcatcaggtgatacagtcctgggcatcttcttgggacaggaaactaccctcagtctccccgtttgggagtctcaccatccttctatgccatggcttgggtcctgcacctggtcccagtccactgtgtggccctaggcaagaccatttcttctctgggcattgcgggtcatttccagaagggactcccccatgattcctgatgaagcaagcaaggcaaggtgatggttcccaatgcagagatgcaaaaactgatgtctgtgggcctggggcagggctgggatcaccagtcagggcttgttccctccaggctggagtggggttcgggtggctcaggggtgggctgttttggctgagctccctgatgctcatttctaccccagcccacagatcctgtgggcagcggccagggcagccatggcttgggcaagtaggctgggcctgctgctggcactgctgctgcccgtggtcggtgcctccacgccaggcaccgtggtccgactcaacaaggcagcattgagctacggtaagcggtgtgttacccagtgagtgtctgtgagcctgtacatgcgtgtgcaatcctaagtgtgtgtgcgtagctgtgaactcaaaaggcccatgaggacccagattttaattggaagttgtgtccctggcacccagacagtgcctgacacatggcgctgctcaacaaatgcttattacataaatgcgtgaggggggagtacgtcatgtggccagtgtgcaagtgtgcacatgtgacttgctcacatgctttggtgatgtgggcataggtcggtttgaggggctatttttacctgtgtgtgtctacttatgagtttgaaatttcatagagctgtgcccacgtgtgtacttaagtgtcggggagggtgcaagcccatgatgctgcctggatgtgtgtgcacaggtacggctgttcaccctgggtgtacacgtttgcgtatgtggtgtgtgcacgcacgtgtgttcttgggagaggtctgtctagcaccgtgatgcaaggagtgttctaaagttatatcccttctgagctcagcgtgagagaaccatccgctctctgggtcccacttgtgcgagggctctgtcttacggctgtgctgctagatccttccaagtcttgccccaatcccctaaggagggcacaatgaagaaacttagccccagggagggacagacattgccaaggtccaggacgccagcacaaacatgtttattcacctcgagttgcctcccggtgagaatttggtttcccaccaaagccaggagatcagaagcggtttcccccaaggccaaactcagattacagtgtgagaaagtcaggtcagacagtagatgggaccttcagtggcccaggacatgaagcagtggctcagggaagtagcaggtttcccccacccctgggtaaacacagccttccgggacctcatatccgggctgatgggcaggcaatgaaaggggtcagtgatccgtgccagagcatgacatggagccattcatggatgcctgcaggtagggccatgaggcccgcgccctccgccgccttcctgccctctgcccatcctgtgcaagcctcctttgtccccagggagccctccccagcttgcctgcctgtgtttgtttttggcagaaatctggctggaggcccacgctggacgcattgctccccaggctgggctgagtggctacttccagtgtcctccccaccccatcctgcaagccccagagttcaaaccctgcgtcaagggagcactgtagatggagtctgaggtctgggtgtgagttccagctcagctgcagatggttaggtgggagaggggtgctgggaaacatggaaaccaccgcctttatgcttcttgttgggggagactaagaaccagagaggtgcagggactcctcaagttcccacagtgagtctgagcagtgggcaggcctcttgactcctcatttgaagctcccttccagcaccatcacctcttattctaattcaactcctgcttaattagcacctctctggggctcagcagcacaggtgagtgaggatgcccagaggctcgggagccaggtccctcggtccaaagccagctttccctggccaggtgccctcacctctctgtaaactgggcacgataacaggaaaagtaaagcactcagaacagggcctggcactacaggatcacaacataaacgattgccgctattattacaaaaataaatagcaatggtagaagctagcatttgctgtgcactgagtgtttacaatgatcctatgtgacagataccattagaatcattgcagatgtatagatggggaaactgaggcacagagtagccacacaggcagtgagtagcagtgagcactgcggtttgaaaccaggatctgagagactcttgagtcctcagcccccaggtgaggctgtcccctcccctcccaagggacgtcccctctgctcccatgggcgcctccacagcaggccagggatgactgggagatgccccttctgcttgggaacttagggaaggctcccagaggagatgggatctggttggaaccttgcaagagggcaaaggattttgttgcttttgaaggacggggtaaatcagcaggattttgagaggcagagtgggagaaggaggtcatgcccaggtggagagagcctgatgcgagtggtgcacccaaggtgggctcatggggagtcagctgccctccccatatgcttggagtaagcctaccccttccagtctgagtaccctctgcccaaggtgcagggtagatggcaggcagtgtgttcttgctacttggtggttcccgagggcaccctgacctcactctaccctggccccacagtgtctgaaattgggaaagcccctctccagcgggccctgcaggtcactgtccctcatttcctggactggagtggagaggcgcttcagcccaccaggtgagtgctcccctcctccagagaaggtgctcctgccaccaagtggagtgttcctgcttgccaggtgggtgcttcagtccaccgggcatgtgctcctgcctgctgggcagatgctcctatccacggggcaaagtgttccagtccaccagatgagcactctccactgaaggtgagtgctccctcccacaaggtgagtggtcacaagatgatttaagagagggacccaagatggagaagccgggcctggtgcctctgaattagtgaatttctgccctcaagggctaagagtggctcctgggtccccagggctggcaggaccctctgtttctagaaactggatactgaatttagacacgaatctgagcctcctttacctccaccctactctgcttaatgcagaaactaaaggcatagggatgtggagcatcccaaacttagacacccctgggctggtcaacagtcaccttccacataggaactagggctcactactgtcagatctttgggtttccaagagaagatatacatctagaatccatcaaatttggaatgatagcaactaatgaaaaaacatttaaagcccaggcgcagtggtccacgcctgtaatcccagcactttgggaggccgaggtgggtggatcacctgagatcaggagttcaagaccagcctggctaacatggtgaaaccccatctcaactaaaaatacaaaaattagctgggagtggtggcgtgtgcctgtaatcccagctactcaggaggctgaggtgggagaatctcttgaacctgggaggcagaggttgcagtgagccaagattgtgccattgtactccagcctggacgacaagaatgaaactctgtctcaaaacaaaaaaacaaaaacaaaaacaaacaaacaaacaaaaaatatttaagactttaagaccctggaacaatgggtggatggtgaaaaaaacatctggcttgggggccaccagtttgagatcccttaggaagagctgaaatgcagttcatggcatggttaataaaggtggagaactggacataaatacccagcgaccaaagatgcctaaatcacttgtggtctggccacacaatggacaccatggggctgtttgaaaacagtgcccggggctcttgtttgtagacacaggattgaacccaggattgttgagtgcacagacgcagcttctgtacggggacctgaactgtacagtgcagaaatgactttcatttaggaaataaaataaatcacaggttagctggagagtgcttggagctttgaagtgggggagcttctgttgctgtaggctacgagctgcagacattgactaggataccagagagaggatttctgccttctgtggttcctgaagtttttcttttccaaccttcccaactttccaggcaggggtcggaaactgtcaaaaacctgagcaatcatctcacccaagtcctgcccgaagcgggggcccctctgcatgttctccctaccagctggtgtccaaccttggtttgcatgccccgtggtgatggagaactcaccatcttccccttacctcatggttccaattgtcagaaagcccttctttataacatcgtgtgggtatggctcagagcacccaccccagagttgatcccatggtttaatgggggccactctgtcaccttgattactaccctgcaggatccggattctgaatgtccatgtgccccgcctccacctgaaattcattgctggtttcggagtgcgcctgctggcagcagctaattttactttcaaggtctttcggtgagcggatctccttgttagggggtgagaagggttttggggatgctccgagggatacagtgaggggacggggggtagcaactcctccagggccctcatccaggcctcttgactctctgtccagttgctctctctcccctcacgcttggaggggagcaagatagtgagaacatttctgagaaccctgctcaacagctctgcaactgggcagagtcacttggcttgtttaccccctcagcttcctcatctgtaaaatgggatgaacttctgtaaagtgccaatgacggtttggtgaatgggttcattgctgtgattataatgactgtcctctctttcccagggcaaggcacatgagagacgctcaataagcataacgatcagagttatttttgtgtgcctggcatcttgtatgttactgcatttaattttcacaccatgagctgtgcagtcagaggggtctcttatctagcttctctaccctgacactatgattttatgattgcttcctgtgggccaggctctgtgctgggtgttttcacatgattatctcacaggaaactcagcacagccctgcgaaataggtcccaccaaccttatgtccattttacagaagaggaaactgaggctcagcatggtaaatgactggcccagggtctcacagtgagaggctccggacagccagtgctcacacccactgctgcaacgtctatgaccccaagtggagtcttgaggctgggggctgtgggcctgccccaggtagggccatctcactctgggagtggggggcctgcctgggccaagtggagggcaggcaggggctggggaatttgtaagatctatcatcagtcatggtgggctctgctgggcggtgctgctcgggctcaggactggcatccctacagcgccccagagcccctggagctgacgctgcctgtggaactgctggctgacacccgcgtgacccagagctccatcaggacccctgtggtcagcatctctgcctgctctttattctcgggccacgccaacgagtttgatggcagtaacaggtgggtgcctggtgagggcagggtcacaggaatcccagatgccaaagctgtgctgctgtttcctgagctgcccactcaggactttaaccaatggccacaagggcctcaggggcccccattattgtgcttgttttatgtcggaggacactgaggctcagagagggggagaggcatgcctgaggtcacacagcaagtgagcggccagagcctgggacctttccatcccctgcaccacttgacaatacacactagctattagcacactctttggggagggattttgggtggatcagactggctgtgaggacctcggagacccacccctcctagcagagatgagggaaaggaagccagggagggcctgggacccaccaatagccagctctcgcaggccaggccgctcccttctgcataaaggctgatggcagctcccgcctccagagcacttatgtgtgctgagcattgttcaggccctttccatagatcatttcgtttgatcctcacagtatcctaccaggtaggtgttaagtatttcctgcattttacaggagcgcaaatggaggcccagagcagttaagtgacttgcctaaggccaccggctgacaaatggtgtaaccacattcaggcccaggcagcccgactaatcccatggcttgcaaatccccctagacgatgtctgcaccttcccaatgtgagcggggcttgctgaggtgttgagcatcttggaggcttagaagaatgcaacgtatgcatcaagactgagctttctccccagagagggatgtggctgcgtaaacccattcacacttgtgtcgcatgatcaccacgtgtgactcacgacccctcactgtccttacaggcaggggatgctcacagcttattgaaggggaaatggaagcccagaggctttgggaacacagaggccaccctcccacctcccccccagggagctggttcagcaaggttgggctgtggcttggatcgacatttttgcaaatcaaggaactataggtgcctatggagcactgttgagttgtttagaggggaaacggaggcccagagtcaggaagggattttattaggtgtgtcacagaaaattggacccaaagcatgaagcagacccaggatcccagctctaccccctaacccaacctttactgggcttagagtggccacgaagccagctggccaaggtcatggccaagtctggcttttgcaacgccctctctgtctcacgcgccacattcttggccatttccaaaccttgagataaatgaccctctcttttgagactcaatttcctcatctatggggccagttatgccagcactgtgtctggcagatggcagggcatcgaatggaattgattggcctcctggctgaggatagagacttctcttcccagacgtgcgactgtgctgagtgacgggacttaatatgtttgggagcccaggaactctttctgtgtttctccctcagcacctcccacgcgctgctggtcctggtgcagaagcacattaaagctgtcttgagtaacaaggtaaagggcttgcagatttctcagaaaggagggcatggcttcaccgagaaggcacagtgaagaaagagtgggatttcaggcagggggtactttgcttgggattaaaaaaaaaaaaaagacgccccttcatggtccccatgaaggcagggaaaaggctggtgccaggtccaggggagtgatggggaggcacaaatgagggcagagtttatggggttggaggggagggggaggttcatcctcttagggcagccccaatttcatgctagagggtggatggagtggggttcatgggcctgtggtttgtgaaaagaagacagaacgagagtgaacgagggtgtgggcatggggccacctgtggcctggacgggtcctggtcctttccagatgtgcagtctctgctcctggttccacatctgtactgaaagagacaaagcccctcctccgtggggtggttgcaggcatgaaatgcattaacatttcagaagagttcgggacagtggttggcagagtgggtgctgctattattattactattttagctcttgtcattgtctgcgtggagctgacttggtgagagagggtagcccaggggctagggtcccactgcccagggggagctcattttctctctgccctatcccatcccaaccccactactgctttaaggggcagtagtagagacgaagtcaacctcctgcatgccaccccacaccccccagagggcgactgcaacatgcccaccttacagatgagaaaaccgaggctcgaggggtgaaggtggggcagctcctcttgagagtcctgcgggatgcccaagtggacagcttaactttgtctgttggtccagcctcttcctctccctgtagtccccctgctgccctcatagccagcctcttctgggcaaggggcttcaggcagcactgcaggaaggaagacccaccctctcctcttcctctcgacctcgccctgcccagtctcgccagctcttgcctggttaaggctgcgagtgcccctggccttgcagttcctcctctgcccccatcttctatcacactgatcccaacataatgtacttctctggctgcccatggtgcccagggaaaacctctgtagctccctggcctggcatctgaagcttggcctggtctggcttgctgatcactgcctgcctctgcatgggcaccaccctctcaccagctgagcttcaagactgagctctcagccccgttgcagcagattccctgcctccgttgctcaggcccagctacgaccacctgggctgggctccacggcctctgttctttcttccgtgcctggggacctatgctcacactgccatcagcctttgggttgcttctcctctgtttcttcggtgcctggaaggggtcccaggagatgcccactggcgggtggaggaagggattccaggcatggtgtatgggttggggaggcttctagacagggactctagacccctctcagccttgtgccctccagccccagggctgccctaaccccagcctccttctctctgtcttaccacagctgtgcctgagcatctccaacctggtgcagggtgtcaatgtccacctgggcaccttaattggtaagatctgggagccaggggagggggctggggcctctgggaccccctggagcccctagaaccctccaaaggctccactctggatcacggtcgacctctaggagagtcagttgtagggtgactgaattgtgagctcccaaaacagtgtaattattcatgaaatctgggaatctccaaattctagaaccaaaaccaagtctttgattctagaatctgtgtatcttagatcaaaaaatctgaaaaacaaaatacaattttgaaatcatgagtcttaacattggagaatccaaggaccattgacacttagaatctggaatcattctagaatctagactcatcattccaaagaccagctcttgcctcggcctcccaaagtgctgggatcacaggcatgagccaccacccctggcctcgccctttgaaacttccctgcaagagtattctgaggctcagaggagttgggctctgagccatgcctccctgaaggctgctcggagggtctgttagggaagctggacttctgtgatcttgcataactggccccagtggtgtgtgctcttggagttctcataggagacagtgtgatgaggtgggaagagcatagctttggggtcagactgaccaggtattacaatcctgggcaagactgaacctcaccagactgcgtgtgcgtgtgtgcgtacgtgtgagtgtgcatgtgtgcatacgtgtgtataaaataaccctacaggattgtaacgaggattgaatgagatgctgtaagtcaagcatctggaccttgataagtgagagttctcttctttttctgtggttgcttctcacctttgtcaggggatatttgtgcctggactgggcccttctccttccttctaacttggggtcactagtctcccaccaagggggaaagcagaaagcatacctgttagaattgtgcctaaactaagagtcagcaggctgtgagtagctcaatcctggccatgtgcactttgccacttaaatttgcttattcagaggcttgctctgcctcttttgtttcgtggcctggctctggctaatcagggtaatcagacaataaataaacttttctggatagatgaaacgttggtgagcagtgctaaatatgccatcttttcttctctaccctggtttcatgaaggcctcaaccccgtgggtcctgagtcccagatccgctattccatggtcagtgtgcccactgtcaccagtgactacatttccctggaagtcaatgtaagtgcctcctggccagcccagagctgggggcttgctgcctctggagtccttggtgttccagaagattcctaaaggagcgggggagtgggaaaggagaggaggagctggaatagtgtcccagccgggagcatgccacacaggcgaaagtgtgaactacacatgtggcatcttgcaggggctggggggcagggagtggcatctaggagtccaggttctgccatggagccacctccgtgctgaggccctgctgcttttctcccacttccccctcccacccctacaggctgttctcttcctgctgggcaagcccatcatcctgcccacggatgccaccccttttgtgttgccaaggcatgtgggtaccgagggctccatggccaccgtgggcctctcccagcagctgtttgactctgcgctcctgctgctgcagaaggccggtgccctcaacctggacatcacagggcagctggtgagggcccgacctgcagcccagggcctgtggggcaagagctccctgtggcccagcctagggagacctcccagaggccaaatcatgggtgggtggggccgctgaagctggcgccacagggtggctgttggaagggttaaacgggggctatggggagcgattgctcagggggaaagtggtgatctgtcttggggagcagctgtcctaaaacctgttgtggcctggggtgctgatttcagaggtcggatgacaacctgctgaacacctctgctctgggccggctcatcccggaggtcggtgatgtttctgatcattccagggactgagacaagggactggggtgggggttctctgggtcatgggatctctgctggctcttatctgtcccaagtgaagttcagcatctgtccttaaacctactcctccatcttggggaggctctaacttctgcccagacatcacactctgtctctctgtgcctttgcttgagcagtgtctgctgtttggaatgtctttctcctccctttcccttatccttcttcaagaccaagctcaaggtcacctcctcggggagatccaaccccctcgtcttgtccagcggcctgtaagacccactggcttacacagaggggggacccacctctgtgcccagtcacatacagcgccatggtggcccaatcagcatttgaggagtgactgaccagagagcccgccagccgctgcctcagcagggcctcctccgcctctgcctccccaggtggcccgccagtttcccgagcccatgcctgtggtgctcaaggtgcggctgggtgccacacctgtggccatgctccacacaaacaacgccaccctgcggctgcagcccttcgtggaggtcctggccacagcctccaactcggctttccagtccctcttctccctggatgtggtgagtgcggtggggctggtcggaaggcaggcaactgtcacagagacctccctccctgcttcactgtcccctcatctttgctctactcacactattgtcttcgctgttccttgaatgtgtcaggacactcccgccccaggacctttgcatgtgctgagccctcggcctaggactctcccaccctggctcttggcatggccagctccccctcctcttccaggcctcagcttaaatgttgcagccttcctggtctaccctgagtaagaaggtccccatcagccttctcggcacctcctctctgcatttgtggcccctgccactctctgaaaggatggcgcctggttactgtggttacggtccccctctcccacagctggcggctcgttcccagggcagggagctggtctgccttgttcacactgtgttgttgccaacattcagcgtggggcctggcacatagcaggggctccacagacacctgctgcctgaatgagtcgggggatgggtgggaggctgggtggctggtgcccccctcatggctctgtgccctctgaccctgctctccccatgtgcccaggtagtgaacttgagactccagctctctgtgtccaaggtgaagcttcaggggaccacgtctgtgctggggtaaacgagcccacctggacccagcagcctcagtgtgttcttctgtgccatgggtccatcaccaccctgggtcacggtgttagccagggagcctgggcgtagggaggtgccagaccctgtcctgaattctcctgcttctctttcagggatgtccagctcacggtggcctcctccaacgtgggcttcattgatgtgagtgtggggctggggcctctagaaacccccgtcctgggtagggcacaccttgagcctggggaagagatggctgtgtacatgtgctgacccgtgtgcctgtgtgtgccactatagtcaggcttccccgggctgcttggggacagtggccagtcagtccatctgcctgatactctgcctggcagtcgatgacttgtcacccagccctcaccccaaaagtccattggtcagttggacaaagaatgtcagctgtcccttcagccaggtgatgtgattgggtcatcggccaccatacatccacttgtcagccggcatgccatcaacatgccccccttctacccagccgtcagtctgtctgtctgtcggtcatctgcgtcaggcagtctgctggccagtccacctgttggtcacacagtgcgtgagtgtccacagtcagtgcctgtccctcagcctccactccggtgagcactgctgctgggtgtgatcctgcgaaggctgagccaaccatgggggtatttctgggccccacttgaacccaggacatgggtgatctgccttcctccctgtgcctcagcctctgccatccatctgttgtctgtctgtctctgtgtatatttatgtatgtgcctgactgtccatctctcctggcccctcggctgggacgggcccatctccctggctccgtggccacagacagatcaggtgcgcacactgatgggcaccgtttttgagaagcccctgctggaccatctcaatggtaagccctgccctccaccccagcagggcccctctggccccctccatatcccacatctgctcggtgctcaatcccagcccccttcccacctcccaggctcacagggtgagagggggcctctggagtctagcagcccatgtgtgcatgccccttggcacatatctgtgtagcagctgtgtgatcttcaccaagcagctgtgtgatcttcaccaagttcctttttctctctgagccccagcttccccttctgtaaaaggggtataacaataatggcatccatcttccagatgcctgcgaggactcagtgctgtgatgcacatgagggcttcagcacaggctggctccaggggacgatcctttcttctttctcgcctgcagctctcttggccatgggaattgccctccctggtgtggtcaacctccactatgtcgcccctgagatctttgtctatgaggtgagagcctttgggtgtgaccagaggggcctccttcactcagagggactgattgaggtgggggtcacctctctccctccccctctgtggctgccaaaaccatgccatgaatccttaactgcaatgaaatgaaaagtccaggatgccaagagatgctgggtcaaaggtttcacccttcctttagtcctcataaaatatcacaccagaccacactcggacaattggggccttcacttgtcccgtgatcctgtgccctggaatgggcacaacccctttgatatctggagcagatgacagtgggactccttccactttgtagacaaactgtgcaggctggatgggagtagggaacttcctgaactttctaaaattgctttccctggacctgaaattgtgggcccagggtgagcttcagtcacaacactgcccagggtgagatgcgacagctgctttcttctgtacctgggatataaaaggaaattcagtcagcaagacatgcctaggacagaaagctgaacccaggtctctcaagcccaatgtctcacgtgctgttcatacccgatgagtgtgacctgctgatgtaattccagggaggatgcccttgttccttaagaactactctctcaaggcacttgggtgattatccgcccccatgagaaggaacgattggtacacagaggagcagggctctgtggggatttccctaggacttcccaaaacaggcagttagtggctgacccaccttggcacttgacccagccactgggtcagaggtgaaaagtccctagtccagtactgttaccaatggaactttctgcaaggatggaaatttatactgtccaaagcagcagccatgataagccacaggtacatgtggctactgagcactgaaatgtggctagtgcaactgtggacctgaattttttattttgtttcattttaatgaatttccatgtaattagccataggactaattaattagccatagccactaattgtggctgccttattggaccacagagccctaggctacgagctacactggggcaggaactgggtctggcttgttctctgctggctccccagcacctgccacagggcttggcttatagtagaggcttgatgaagatttactgaatgaatgaatgaatgatcggcagccctccagaatgctcctgcagtggagtgtagcataggggagctatggggggtgcctgagtctgctggagagagttggacttggagaagatgctccatggttctgggctcccattcataaagcatcagtggtatccaccatcggagcagcaaccagtgccttccatgggggtctcactgcatcctcacagtgaccttgtgaggtggaggctgttactacccccaaagtgacagactggtaaactgaggcccagagaggcaaaggactctcctcacaacccacagcaagaatggcagagcagaactcagagccaggctgagggggcggctggggtcctgcctgtgcctcctctgacctggtccatggtttcctttgcccttcagggctacgtggtgatatccagtggactcttctaccagagctgaggcaagaccactgggaggcctgagagtgggccagctcgctgctcaggcgaatttctcatttcaagccactggggaaactgaggcaaaaccatacttagtcatcaccaacaagctggactgcttagctgggctgttttatcttccctgagtgcctgggtctccctccctcacttctgccctttcccttcctcctcctcttctcctccctcttccctcatctcccccctccttcctctgccccaccccagcggggagcagactgctcctccaggctgtatagacctgccctcttgcattaaacaacttctcttgagctgcaactttcagccaagcccagca

SEQ ID NO: 12466 - DNA, 676 bp, Homo sapiens
gccgcatggatgagcctgaagttagagcaccatggtggcactttgggcacagtgccccttgcctggcagcttgccccgtcttgtaactagaacctcataggagccccatgaatcaggcaggcagagactggagttccattttatggatgtggggactaaggtccactgaggaggggaatgcacggtgcctcagagctggatggtgacatgaccttccttcaatccagacatgagatgtctggttccctctgccattctccggctcccagagctggaccttgtccctgagtcatgaacttcaggtgatggggagttcattgctcttctaggcagcttctccatctttggtttctctgcctttggttttacgagcaagttttttgttctaaggaggcagcatctgcttcctgggcctctgcccttctggtcacactgaacatgtctaacccctttagcctctgaatgcccttcacacccagtgaatcacacagaacaagatgacctagggaacaccaagggatgtaaatgctggcaagtcaaagccatgtgattttctacccctgataagctaatctcttagccagagataggattccttcctgcctagatatatggtgtttatgttctgtttatgtttcctttggggagtaaaaggtgcctcaatttttaccaccag

SEQ ID NO: 12467 - DNA, 1245 bp, Homo sapiens
tttgggttatagcaagagttctgagatacaaatgtgttcattttatcttccagtgactacattcacatcaatggcttaggacatgtatttacaaattcctgtgaaacacatgttacactcaggttatcaggctacctttttttcccccaagataggatgttcaagcattctagtttttgtttgtttgcttgtttttttgagacagagtctggctctgttgcccaggctggagtacagtggtgctatcttggctcactgcaatctccacctcctgggttccagcgattctcctgcctcagcctccccagtagctgggattacaggcatgcaccaccacacccagctatttttttgtacttttagtagagatgggattttaccatgttggccaggctggtctccaactcctgacctcaggcaatccaccctcctcagcctcccaaagtgctgggattacaggcatgagccactgcgcccggcccaagcattctagttttaagtgagaataagttaaaaatatttgcagaacaaagtacaattacattcttgaataatcaaattagtgctttaaaaatatttgagactatcaaatgctctcaaatccaagcttatctcaagaactaatcaacataatataatgtatgcagctttggttgagaacatcataaattaataggatctggaatataaataccagaaattgttatatgttgcatggtttgtcttttagtgggaatgaaaagtacagctgggagcagtggctcatgcttgtaatcccagcacttcaggaggccgaggcaggaggatcacttgaggtcaggagttcaagactagcctggccaacaaggtgaaaccctgtctctactaaaaatacaaaattagccagatgtggtggtgtatgcctgtagtcccagctacccgggaggctgaggcacgagaatggcttatacccgggaggtggaagttgcattgagccgagatcatgctactgcactcagcctgggtaacagactgagactccatctcaaaaggagaaaagtacagctcctaatttaatactcctaaaatattttttggcacctaccacagacaaggtactttgataagtactggggacaccatatcctgtctaggtctgttatgttcatctgcagctagagaggggattgcaatatgcaggattctgaagaaacacaagcataaaggggccaaattatacatttaggtctcacatgtagatctcga

SEQ ID NO: 12468 - DNA, 391 bp, Homo sapiens
caggctgttgcccctctctgtaggtttctggatttctacttttctttacttgtacttctgtggattttcttctgtgtccctctgccttgtattctctttccctcagtgtctatccatctctgttatatatacacatatgggcatgcatacatatatacatattctatatgtatatatacatgtacattcatttttttcctctgttctttaattttttgtaatatagaattgaaaagtatgttttgcatttcttaattagtatggtttcttgaatatatttttcttgttttcaaaaaatataaaggaggtaagtgaaattatttaaatttctttataattaaaacaacccaaggaattggagtggccatctatgtgacatctgtttttttgc

SEQ ID NO: 12469 - DNA, 1927 bp, Homo sapiens
ggcacacccagagaggttcttcaaaaatttgaattagatcatgtatctccttcgtttaaaaatctttaatgattttctacccatgaaataactctgctagactgcaagctctaaagatgcaaggactagatttgccttatttgtttctgtttatgcagagcctagccttgcatttagtaggaagttaacacattgatctagatcttgtccacctcctcagcctcacctctcatggaagcactcatagacctcagtccagttactctttcctcagatccctgagctggcgtggtccagggctgcctgggccgtgatgcattcactcctgctttgttggctggtatctgcttatattcttgctactgtaactgatgtccaaggcagtcacataggcatccctgggagcttgctagagctcaggcaccaccctagatccaatgaatcagaatctgcttgttgacaaggtgcccaggtggttcatatgcacattcaagattacgatgctttgctctaaatcccagcctgagtattagttctttaaagagacctttcccaactggccaaatcgtattaggtcatgtgatggattcacccacacggtctgtgatacagaagggaaaaggagttgaggcctattgatcagaagctgctcactttacagttttacctaagggtgatcctatcgaaagttctggattttgtagagaaggatacaaagtagtgaatagtttgatttgagaaaattgaaaattgccagttttctttgctttaaccaatatgtttgctctccctctgaaaatcccttgttacaagtccttagttttagtttgccacattatgacacgatgggaataatgcacagcagtgatcctcagttggtttgggttttcaatacacaattgatccatggttgtggcatgcattgtagaatgtccagctagaacacctattctttcagttactttcattactttcaatggcaaaaccacaattacttttgcactaacctgatagctttgctacaagtcagttgttcagtttttttttttgttgttgttgtttgtttttatttttgcaaacactttagatactgcatagtggatggattagtttgtggttcctgggatcttctgtgttttgtgttgaagctcaacaaccacattactgcagacctccaaaattttacaaaagactgcatagtgagtattcagccgataaactaaaccacagcttattactgtgagatgaaagaaagcacaccaatgaaaagtaaacactgtttaaacgtatctcaatgaatgtctaaagtgtcatacatttattatattctctacttgtaaaatattttgttgtgtgtattgccaagtatttcaggattttatgggtataaagtattctattaatttaactggaaaacttgtagttattcaacaagcaaactaaaagtgttggcagagatgtaattttaaagcacaattccacacattccttcagtattacagctgctccttgtttgtttaataacagaactgatgagtagttaatttgagaggaaatctggtgcaggtgtagtgctatttagatgtcatggaggacacatgtgacatctgcagctagctatatggtaaaagcaaaacagaagttaaaatcagccctgtgtcaaatctgcatagttttaggcttcagagagtttctctgtatgttgaggccggaagtttagtagaattccaagggaataagagaggaaccaacatttgtagattttgccttctatgggggaactcattcaattatcaggagaactcttcaataggttttatttgctccagttaacctagatgaaaaattgagacccagaatccatgcttttctttcctggttacacattagaatcaccaatgtgatattaaaaacacacacacacaca

SEQ ID NO: 12470 - DNA, 260 bp, Homo sapiens
aggaaccacaagggggaaacaacctaaaaagtctattgagggacgatggataaacaaaatgtggtatagacataaaatggaatattagtgatctttaaaaagggagggaattctgatacttgctaccacatagataaaacttaaaaacattatgctaagtgagacgtcaaacacagactacgtgattccatctatatgaagaacctggaacaggcaaattaatagagacacaaagtagaatagaggttttcaggactggc

SEQ ID NO: 12471 - DNA, 2250 bp, Homo sapiens
tttttttttcttttgctttaagtttcaggatacatgtgcagaatgtgcaggtttgttacataggtatacgggtgccatggtggtttgttacacagatatacctgtgccatggtggtttgctacacctattgacccatcctctaagttccttcccctcactcgccacccgctaacaagccctggtgtgtgttgttccctccctgtgcccatgtgttctcattgttcagctcccacttatgagtgagaacatgtggtgtttggttttctgttcctgtgttagtttgccgaggatgatggcttccagcttcatccatgacatagcaaaagacatgatctcattcctttttatgagtgcatggtattacacgtattttaatagctttgaaatttatcgatttcaatttacatttattgagtactcactatgggtcaaacaccatgcttctttaccaggggtacaataaacagagccaaaattttatttaacttgtatatacaactttactatcaacattagccattgaggtgtaaaaataaagaagcaatttgtattaaaagtcaatttccacataatcacgtcttataaatgccatttacttttattatacataactcaggaaggtgagttttagtaaacagctgaaaagctatttactgaaatttattaattgctttagaatgaaaacaaaacaaaatgcttgtaagcaattacagagaaaagagaggtacacatggtaaaatatttaaaataaagttcatacaattaaaaatattatcataccactgacctttggtttaaaaaaacaactatgattcaaggataaaatatgttaaatccataaaataatacaacataatttctagagaatttggctttttctactactctaaatgtgtcacatcctaatagcatcacaaaatttaattatgatactaataattattctaattattattaaagcattataattctattattagaattacttggcactcattcaaagagatataaacatatcaattaaaaaccatgtatttttcaaaaaataaaactgaactaattataaaaaataaagattcctgtaacggattttaatcttaataccctggagaaccttaatgttaatcacattcagaatttgttttttcagctctcccttctgactggagctgaggctaagataggaaaaaaaagtccacttcccagtcatgccctggtttctgctgcttttgtcttcacactgtatctttagttttatgcagcagtccaaggcttgtaattcttctgatgacacatccatgccattgcggctgtctccgaactccaccaaagagcatggagactctgtaagactgtttcggagcttgtcaacatccttctctctgtgctattgtggtagcatgaattttgtgaagcatgatgccttttaatctactcttggtttcccagacataaaaaggacctagtatgcttccctttgcagaagcaataggaaagcaaaggaagcaatgtacagctcaggatccaaaccaacctcggagaaagtctctttgctcatttctaacagtctccagcctactctccagctaaaaagtcaagaagagaccaaacccattggttcttccccattgcatctccaattcactttctgttgtagactgggaaaataactttttaagttaaaagttaagaatttgactggccgcagtggctcatgcctataatccaagcacttcgggaggcacaggcaggcggatcacctgaggtcaggagttcgaggctagcctggccaacatggtgaagccctgtcaccactaaaaatacaaaaatcagccgggcgtggtgacacatacctataattctagctaatggggaggctgaggcagcaggagaactgcttgaacctgggaggtggagattgcagtgagccaagatcacgccactgccctccaggctgggcaacaaagcaggacactctgtctcaaaaaaacaaaaacaaaaacaaaaaaaacagttaacaatttgataattgtgctcttcttctaaggtgaggtttttactcccaaccaccatataggagaatgattagaaaacaatcatttttaaagaacaaaaagaaaaatccactagcattttgttttatattgtgttttgttacaagatacatcgtactctaggccaggcgcggtggctcacacctgtaatctcagcactctgggagaccaaggcagactgatcacttgaggtca

SEQ ID NO: 12472 - DNA, 2250 bp, Homo sapiens; identical to SEQ ID NO: 12471

SEQ ID NO: 12473 - DNA, 2250 bp, Homo sapiens; identical to SEQ ID NO: 12471

SEQ ID NO: 12474 - DNA, 34367 bp, Homo sapiens
gaagctctgtgtcccaagtgggcaagcaggtgcctcatgaattcatttcctcatttaaagtaggtagatttattctcatttttttccaatggggaaattaaggcacagggtcttaagcggcttgcccaggaccacacagccagctggattcacactccgggctgtgctatgtctgagctatgttggatgaacctgggggtccagtggcttcctgtaggcgtgttctgactgggggcttccacactgtagacccacagccagtggtcagcctgctaatcatcttggagaggaactcctgagctggtccttgctctgaggagaaggcagccccagaggcaggcggtgaagacagagctgagaaaattgacccatctctggctgccagagcccaggtgtagcagagctgttggggatcagttgccagtgaggggaccccagaccagaccttataggaggaatgtagactgcctaactgtgggaggttcttggaccccagggagctgggatagaggcagtgaatgggcaggagtggaattgaggggctatcagggtgcaagtgggataggggcgcattaccgtctctgcccctcccttgtttgcgtgtgcccactggggtagtcccatctgtgcgtgtgcccactggggtagtcccatctgttccttgttaggcactcaacagacaggcctccaggacattaattaatgccaagctgctggcacaaccagcagcatgcctgtcccagggccccgttctggcagcacagatacccagctgaccccagaaatgctgctccgttcccacccgctgatcctgaagacacaggggccacattgctggcataaccctgcccccgaggatggatggcagggaaggcttaggtggtggcaggcagccagagacggcagcaggatgttccccccacagactggtctccatcaccaccctggaccttctccttcatccctggctctgccccaggcctgctgtgtgaccttagtcatgtagcttaccctctctgggcaacttttctttctccatctataaaatgaaggggttagactgggtcaacactgagcctccccctgagtctgagtctttgttgtctgtagatctgcctgatttggggtggctctgctggtactcccacttcctgctccatatctacctccccttggtatcccacattgtctcctgcatgtcttgttgccccagggccctgactggtactcctataattaactcctgcccatgctcaggacatggagggcctgcttggcttggccagacccagtggcctgttggggcccgggccccaccctcacggactggccagcgttcccaaccccagggccagggcaaggcgtctgctcccacagtggctacctccagccggcccagcacattcctcaggcttatctggaggcccgccccactggactctgccctcccacccaggaagcagcacccagagctgcgtgcggaagagttgcagggcctgggaacaggccctgcgtgagctcgaggtagtgattcttagcctggggctggagagaaacaggtagaggaccgggtggggcaggagggtagaggggtttgtgggggctgctgagctgaccaggcaaattgtctttaacattgcagagcatggggttcactcagacacgcaggggtcatctcctgcgaccctcctcctccatctctgggaagcgcttccctgctacccctgggagctcttgtacccaggaaggggcttttgctcttggcaagttgacctaaatttgcaccagagttatcacagttgatggggccacgatcccaaagtgctgagggacagcagctccctgccacttcccttcctgggtccccacctccacagtaggagccagagccagtcctcccaggaaggggttaactgccagccccagccgtgagggaggggactgggctggaccattttcctcactgccgcctccacctcggttttcctgaatggttctgtcgtcctggggtggggagggaagggaaggaagaagggcgggaggaaggagggagggaagagggagagaggaggagtgtgggaagaggaaggaaaaaagagagcgagacagcgagaggaagagaaagatgtcactgtctctaatctccctgtcatttttatttccagcaggcgcggggcgaaggagctgctagaacaatgctgaggcgggtgaggtgaggagcagcccctcgcggcagccccgacagagtgtctggaacaggtgattggaggagccggagacccaggcacctgggcatccttcccctcgcctctgccaggccccgcgcccctaaaaggtgggaaaaccatggcgaccaatttcagtgacatcgtcaagcaaggctacgtgaagatgaagagcaggaagctcggggtgagtgaccctgagctgcggaggggccctgccaagggatgggggcccgaggactcggtcccaggcttggaggcatggcgcgtggggcacgcggctgccctccggctgccgggcatcgtgcatctgtggtctcggggctcctcgccagcgtgctgcctggcatgtgcctgggctgggttctgcctgctgcagcccccgccccagagggctggctggcatcccaacagctgggccagtggtggtggtagtggcagcaatggtggccaccgatgggcaggcggctcccctgctattgttgaagttgtcaccacagcagcagcaggggcggctggcaaggccgggctgtgtctgagctgagaagcagcgtctcacttcccctggcctcctctcccttccgtttgccccccacccccggcctcccctcacctctcctggcctcttttcttttaggtcatcctctccccttgcttctgactgctttccgtgtgcagatatttagtaaatttttggttgtcgagtttaatgttaaagaagtgtttgaaaaggggagtggttggctgggcgagacggggtggtgtgaggcactgaagctgatatttatgtggtttccaaatgagaactttgggcagaatggtccagtgctctgggacaggctgcttccctccaagttgttggtgggtgactctgtgcttgcttggtgcttggccctgaactgggggcttggaggggctacagagaagaggtcttactgggcatgcatcctgtcctaccctctgtagacccccaactggtgaagaccccctagaagacaggagcagaggggatcaacttcatgatctcggcgaggctgtctgagagctgcctctattcctctgccaggcccccctgccaaagacaggtctggcagttgccccttcccctgtaggaaggacagccctggtgactgaggtcacccaagtcttgtgtttgacccaggactcctgtccccttctcccttctctctcccattgccttgaagggggcgggtcggctcaggctgctcaaggatccctggctcagcctgagtggggttggggggcatgcggagtgggagagggatctgccacccagcttccctacctgggtaccagacagagcagggctggtcttggagaaggtggttctggccccacttcccctcctgtgcctccctgccctggggctcaacctagttgagactgggccctggcagccatcggctactttgctcttcctctgaaagggggatcagcccactgacttggagcacagaacaaagagagaagctgaggctgaggtagggaggccaaggaagcagaggcttcgcttctaacatcacttctcattcctatggccccagacttagcaggtccccaggggccagctgggctgaggccttgcccagggcagagtgtgccaggaaggcaccagccacaagggcagccacttgggctcagtatcaaacctgttccagagggagactgagtggctgacaggtgggcacagcctggatggggaggtggggcatagccaggccctatccatgcagggaattctcttccctctgaagccaggagcctcacttcccctggtgtgagaggctgtggtccctccccagcagccattctcatctcagcccacagaggtgaggggggaggggctgaaagagatcaggagccggctctcctacctgccagggcctttctcccgcggcagagctgtggcagagtgtttctgaagcactgatcaaagccctgtgcgaagtgggaaggagggctcttgagcgcgtggctccctggggctgtgaatgtgtatcctgtaaccaggcaaccggcatgctcaggcccccaggccttctgcccctgatgctgcgggctgcatggagcccaccctggcagggtgtatctgggtcggcagcatccatccattcatccatccattcattcacggttccttcatatggtcattcacttgtttagcatggctgttaatgaggctaccaggatatgagtgaggattctgtggataaaattcagtgtctgtcttaagggagcgctgcagctgagagctgagggctgctgtggtttaggtgggtaggacaggggccaagccagggtcaggggtgcaggagcagacatgcctcctagggtcccagataggagccagaaatggcctggctctgagtggtatcttgaaatgggggctgcctagggccactgcaccctgggaccctgcctgccaaggacctagtgtacgcatggcacagtagggccgaggaggggtggggcctagaggccccctggcctcctctgctgtgctctcggccaccactcagtctccctactgtttccagtaagaggaacaccagagatgcctggggaacaggctctgtcgggcttttggaatgcccgctggaaggagtaggtaaaccccagccacagactttgggcagaaaaaagtctaggcaggagggaggggtcatgcaagggcagctctggctggtggctggggccaactccctctccaccacccatgaatgataggccagtctgtcccttcaatcctagagtggtcactcccctctgctccccacccccttgggggagtccctgaagctacagagaatgtaggtagtttaaggtacaggggcatcagcagtggccagggccaggagggaaggcaccatgctgtgggaggagcctcagattcctagctccacccctttacctcaaacagctttgggttcccagctggagcagggccccttacatttcagggttggtaagagaatgaaaagagagggtgagtgaaagccccaggagacaagagtgggggttacctttgtaaagaccctcacctgactcagagaactaggggcacggggatgtacaggtgggcagggggaagggtctaatccctatccccaggagacccctctgttgtggctggcactgcctgagccctggccagatcctgcagtgggctgtgagggtctgccctggatctagacagcctgctgcaaataccagcatcaccattccttagtgttttgatgcctccctttccccatctataaaatggggatgataacagaactgatctcaggagtggccctgagactgtgcacagtgctaataacaggtgtgagcaggaagcactcaggaacgttggctactcacactaaactcagcggtgcacacagtacatggcaggtcaggagagcaccctttgtggaacagcgttttggagccagccaagaagtcaatgacttttcaatttggggaggaggcttctctcccagggaggtgacactgctggtgactcccacccccggtgtccccaggctggggctccagggaaggctgtgcggcaccgccccctgtggcaggcaggggtggctgcagggccatgctggtggggtgggagtggtccagggaggcctgagccctgtcatctcgctccacagatctaccggaggtgctggctggtgttccggaaatcctccagcaaggggccccagcggctggagaagtatccagatgagaagtcggtgtgcctccggggctgccccaaggttaggaggcctgggccctagctcccccaagtggcagggctgtgggggatggagagagagagagggagagaggggagagagggagagaggggagaaagggggagagagggagaggaggagagagaaggaggaggggggagagagggagggaggagagagagagagagagagagagagagatgcactggcctggctaagtcccttgtggatgctgtcccaggtgactgagatcagcaacgtcaagtgtgttacgcggctccccaaggagaccaagcggcaggcggtggccatcatattcactgatgactcggcacgtaccttcacctgcgactcaggtgaggcgcgagtatgggcctccatctgcctcccctggggtggtcttggtcagaggtccagctaggagcgggcagagcagggctaaccctgggtggagatggtggtgtggtgtgtgtggggttgggggtgctttcagggagcaggccctcagggttgaggcaagacaggcaggcagaacccactgtccttaccctccctgctgtgcatggtggcataagtcaggctgggcagacggggtgggctaccgggctccggagctgcatgatgaagtagcattttcttcagagctagaggcagaggagtggtacaagacactatctgtggagtgtctggggtcccgcctcaacgacatcagtctgggagaacctgacctcctggccccaggggtgcagtgtgaacagacaggtgaggccgggccctggccctgggggtggggagggggaggaggaagagaggaagggagggaggaagtccccatctggggcaactctggtcccacttgtccaccctcccccactccagatcgcttcaatgtcttcctgctgccctgccccaacctggacgtgtatggcgagtgcaagctgcagatcacccacgagaacatctacctctgggacatccacaacccccgtgtgaagctcgtctcgtggcccctctgctcactgcgccgctatggccgggatgccacacgctttaccttcgaggctggccggtaggaccctctcgcctcccagccctgtcctactatggtgtgatggtggctgccattcactctgtgttgggcactgtgctaggagcttggtttacttattggcctagcaatcccaagggggaatgtaatgttcccattttacagacgaagaaatgaaatggaggcttagaggagtaacttgcccacagcatgcaggtcaagtgaagctatttaccaaaaatcatatactactttggcttaagtcaaatgcaggttcaggcacttactacttctgtgactgtggatctgagtctgggtttcggggataataaagtacctaacctcctagaattatagtgaagactgggtatcccctcacttgaactctggagtcagtctgcctagactgaaattccatataatcctctgcagaaccttggttgagttacttagcttctgtatgcctcagtttcctcatctataaaatggtttgggaaaatgcataacaatgaggaaaccattaatggtacagagaccagagggaggtggtagagaaaactgaatgggttaattcttataatgcatttcaagcaccagctggtatagaatatgctcagcacatttgcaccgtgtggtcggacccccagaccacagccctacctgtcctcccggcctggaatgcaaccacaacttgcagttgcaagagagcctaactaatcacatgcatgtctgtggtgggtccccaccatcttgccctctgtgctgtgtccccaggatgtgtgatgctggggaaggactctataccttccagacacaagagggggagcagatttaccagcgcgtccacagtgccaccctggccatcgcagagcagcacaagcgggtcctgctggaaatggagaagaacgtgagggtgaggcagcgggcatcagtccagggtacggggggaggggggaacgggcgggcaggcagggccaagtgcctggggtacacagtggaggcaggtagggtcttggggtggctgctcagggatactgtaagccactaatgggagtgaccccttcctttgccccacagctgctgaacaagggcacggaacattactcgtatccctgcacacccacgaccatgctgccgcgcagtgcctactggcaccacatcactggttcccagaacatcgccgaagcctccagctatgctggtgagtcgcttccatgccccacacccacctgccaggaggctttgtggaggatgaggcctattgggcaggggtcttttgacctagctctgagttctgagcctgcttctgtgcccacaggtgaggggtatggggcagcccaggccagctcggaaacagacctcctcaacagattcatcctgctaaagccaaagcccagccagggggacagcagtgaggccaagaccccatcccagtgaccacagtgctggcgagcaccgatgactgctgggggctgcctgctgccgggctggctgcagtgtaccgtggacagcctcagggggctgtcggccaagagcctggagaaagggagcaagctgccccctccttgcccccaaggatgaggctggactgaggcaaagggctggccacaccacctgagcatgtgtgaggggttggagctaccgtgggactatatactgttaatgattttaatatatatggcttatgacatactctgtatcaatgagatcccctcaccctcaccccatccttccccaccaatacacacaaattttttaatcccatgaccaggccacggtcaaggctgtttttgagtatgagtgcagtcgtatccatcctccatggcacagccctcctgctgccaggacctgcttgaactaccagggccacaggagggggataatcagagcttgaggctggcactctgactgctggcttttcccaaacagcccaagggccggaacagcaggtggcttctcagttcctctgggcctggagtgacacaggaaggatctgcacttcctctgtgctgcttgccagccttgcagttggagttttaagcagaggtgacatctggttgacgcctcaggtgaaaatctggttttaaaatgtaacttctgcacaggctccttcctgctttgtaggctgggaagatgcccctggggtaggggtgctgattacctcagccatgtggaggaaggctggagcttgttcctgccccaggaataggccaggagggaaggccgcagcaggactgccgtggggagcacccctgctgcccccctctcactgaccaggggtggacaatgcccaagcagagggagcccccttgccctgtttggccaccctctggccagccaaaagcactctgaaaccaagaccttcccatttcctcctccccacatggtgctgaggctccctgctgcaatgcaattaaagcaattgattttctagtgctggtatttgttgactaccatgcagaagggctatctttctattcacgtcaaacttttggttgtgtggggttttttgttgttttttgggttttgttttttaatactttagggtcctgatttgtgggaacagaccttcttgtaaataaccactatttgagttgtggcaggaggatgataaagcacgcggcccctcccaaaggagcccttgagctagggaggtggtgcagtcagcctcgctctcaacgtgacccggggaatgaccacccagagggatgagctagcctgtagaggggaactggggtccaaaggtctttggggagggaggcagagctggctggctcagctaagtggcacgatgacgcatgaaggagattatgttgtgctctttattgccaaaaataaacacttttaaaaagacaacttctgttaatcaataaatatcctttcctttctgtactggatctctggttttctccaggctgcctaattaactgctttgtgcatgttcctatctggagacagtgctgaggggttagggccagagccttcattaaggagaaatgaaatactcctcctgtgtatgtgggaggggcccttgctcctgcggctgcttccacccccacccccacccccacccccacccccaccaaactaaatgatcaggtcattggaggtgaaggggttcatgactgctggacagagaatgaaatatcatgtttatttggtggggaggggacagccagggtctaatgctattccaaaaggttacttctcaaattagggacacctgggaatttgaagcgctagcaggccagccctggggcaagaactggaagggtttataggccccctgaataaaggctatggcacttgatcctcaacaccagacatctaaggtacaactgaaaatgactcattttggacagaaagggtttagagtaaagagctggactaaccaggagagaagtctagttggttccctacaggtgcactggaaacactccagcagggaccttctgggatctggggagcactgctgccaattattaacagcagtcagggccagtaaagacctatcctgcctaaacaccactgcatccctggtaatctatctatgacccacttctagttggtactgatgtcctgccaagaagctcaaccaacagtagactagattctcagaaacgagaagagtctgaagagagacccccatatccagctgctggcctgaatctccgtttttgctgaagcaggcaagctgcagttaatttatggttagcacatcactctggatctcgtggcttaattgagtttgtaaatcactcagtttcttcttcaatcctgagagggctgacaggacaatggtttcaggacgcagagagccacaggactccacattgtagtaaaacctaggaggcaagagtccagtgagtgcactgcgaggcaggctggccgacccgagctctggccatggacaacccttcctccttccgggtcttggctctgttcccacatggaacttgaccttgggccagggctaacttcctttcatgtaaaacctcttacatagggtagtttcaacacactttgcacaacctcaaggaggctacaactacctcataaggtacctgtgaaaatcctaaagttctgtatgtatgcatgccccctgaggagagagtggaaaaccaagtgagcagtgaccagtgatagacctttcacagtcaccctgtggaacttgggtccaaatctctgcccctagcgttgacctgaagaatctcttctttgggggctgaaaatcagaacaggaaccacctggataaatggagggtcctctttgtcagtgaccaaaaggggctgacgacctgcccctgggatgtgcacataccacaggtctagtttagcagtcagcagcccctcctcagcttatgagaactgcgaggtgggggagagggaatgcctaactcacggcctgaaccaaaaccatcccttcttccacacttcaccttcccatgtccaaccaggctcttacctttctggcttgccgttggggtcatagggagcctgcgactcatcctcatccagctccgagtactcactctttggcctgaggtcaaacacaggtcagcacaaggttgccactgctccttttggggcacccaagttcctagagagcctgccacatctcagtcaacaacagccatttctatgccacacccaccccaaatgcctgccatcactcctaaggggaacataccattcctcgggcttggggtacactgtgtgcctcagggcattgtctggatcgtattcaaaagccacccctgcagtagggttccacttggcatgctccttgccaaagccctttttggcataggctcgaagtctcagctcctggccctttctcaacttgacgatgaggatgtctgcagggagaggcacaagtcagtcaagggccaggagagacatgcttctccaaattctgacttggagtgccactgcaagaccacacacatctggaaaaatggtctaaagccaattttcgaggagaccaggcagcacgagaggctgtgtctggtccctccttcccgctggcccacacggtgacaggtcaggaagacttaccatcctgctccacgtagtcattggggtcattatctcggttccgggatgtcacctgtagggagtccaccaggcattcattagctgctcacctccccagtcacctcctctggcatccatatcccagcacctctagactgcaatctgtcaaccagggaacgaacacctgacgaggtggtggcacagatgcccccaggactccaacccccacttcagggtgtggtggtagcctcaggcaaaacaattccatggcctttaaaagagtccctgggtgatagagggtgcgcagcaccaacgatgctaacgatgcccaagaagaatccagaattagcacttctagggatcagattaaggcagagggtaacagggaaagccaacattttctaaggatcaaccccagtctggcccacttggagccagccagagaagagaaaagatcccagggaaaagaggatgctctcccgcactgaccggaatgacccgggggctgttggagatgaggtctcgagacgtgacatgtcgcgtctggtcttcattgcaccgcacatcgagggtgaactccaccgagcactcggggcagaactcctcacatgtgcagtcctaaggcaggaagggaagcaggaatgagtcaaagggagatggcaactcctgccttggctccttgtcttggcttcctgcatctaatgcccagttccttaagtttcttcacctgtaaaaaggggttcatcagtatccaggttcttgtgggctgtgacaatctggtataccattctcatggactgcccaagtttagagacaacttatacatacactggcacgcacatttctttcccactcccaccagctgccaggccacctctggggacatattgctaacatctccctctggcccttgaactactcttcctcagagaaccaaggctatgaggcacaggagaatgctttcacactctatagttcagcttcccaagaactaagaggaccagcttgggaatgtaaccatcatttaaaataaaaccaccaaggaacagaaaaaagtacctttcaagttctacactaaccttttctaaaaaatcctttctattatggaaaatttcatacatatacacaaatagagaagcacgtaagaaactgccatcccataaccatcaaccaccttccataattattaacattttgccattcttaaaacaactgactcattcccatgttagggactattaattgcagtttcacttcaggcaagaagacagttactaggatgcaatcaagcaagctgttctctccctcacaccagtgaggaaaacccaacactcttgatgtttgcatgctgaggaagaagcagcagctagaggtcccacctaggtcgtctgcagtcacacacaggtgaggtaggaaggcaacccagacccttgagacagaatcacttttagaaatatgaaatggggctgggcacagtggctcatgcctataatcccagcactttgggaggctgaggtgggaggatcgcttgagcccaagagttcgagactagcctgggcaatatggcaagactgtctctacaaaaaatacaaaaaaattgtattttttgggtgtggtggtgcacagcacctgtagtcccagctacttgggaggctgaagcaggagaatcatttgagcccagaggctgaggtcgcagtgagccaagatcatgccactgcactctagcctgggtgacagagcgagacctgtctgaaaaaatagaaaaataaagaaatatgaaatgggagaatcaaaatgtaatggaagataaaaatatgaaaaggtatttaacctaaaaaaaatgtactgaaaggagaggagtctgtttgagatgaaaagagactaaagtgctatgaggaccaaatgaatcttcactggatcaagactgacccacaaacaaacagaaaaacaataaaggatatttggggaaaaactaggaaaatctgaatattgatattacagattaatgctaactttcttaggcacaatgaaagtgtagttatgtaggaaactattcttattaggaaatgcatgctgaagtacttggaagtgttaggatgtctgcaactttcacacagttcagcaaaaataacaatttgcatatgaaaaataaagcaaatgtaaaatattaattggtaactataggtgaaaagtaaagggtattattttagtttttcaacttttctacagattttcagaaaaagccagagagagagagagacagaccatgccatctttgtgcaataaatactagaaaaaattttaatgaaaggaactgctaggtgatagagcatgcgtatctttatgtaagatatcgccaaattgctcttaattggttgtacaacggtccccaccaatatctatgttttatttattaaaaaacaaaaatctggagatctgaaacaaatagggcaaaatgttaaaatgtgacaacgtagtattaggtagaagcatgagtatttattacactagctccatgcttttctgtgcttgaatatttcttttttttgagacggagtctcactttgtcacccaggctggagtgcagtggcgcaatctcggctcactgcaagctccgcctcccgggttcatgccattctcctgcctcagcctcccgagtagctgggactacttgggagcgggaccacgctcggctaatattttgtatttttagtagagacagggtttcaccgtgtcagccaggatggtctcgatctcctgacctcgtgataaacccgcctcggcctcccaaagtgctgggattacaggtgtgagccactgcatccagctgaatatttcttttttaaaaatacacacatatttataagatatatcaaattagccatcacaaaaatgacatggcccttgagaatattagaaaatggactgattctggatcacccaaagccatcaagagggagtagccttaagctgctgtgtaatgcagcctagtgaaaggatgaaggtaaccgactcctatcctactctctccaaactctgaaggcctgttaacatgccatcagggagcaaacacgaccaggaggaagggggtgagacactaagagtgtggccatgtttaagcagcatcacctgcgagggaggggacagcatgaatctgcagacaccaggactagtcccccaggagctgctcttgtgagacagctcccattccctctgctccttgcctaccccaaccttctgttgactcctgtagcatcctaaggcccctgctactgggaagagatgctttggaaggaagaacctccactctaagtataaatgggcactgtggtggagctgcctaacaacactccctgatgttctgcgtgctaatcaatctgaagccccatcagaacgcaggaccaaggcctgcccaggctctagacaacatctccacgttgttgttccagaactacaacagtattcaagctggatgccaaatgtcaggaaaaatccctttgagaaccaaagcctccccaccaaacctcacattccacccaatcacacaacatacccgagagtactgcagcttgtccacaatgtcatcactaatgaggggaattaatcctgtaaaaaacagaaaagcactttaaagaaaaccaaacagccaagccaaaatgagaacccagaagccttctgggggtgaggctggaaggaggccccctcctgacactaggcacaataccctccctttaacctcctagtaaaaggagtactcaccaagcctgtgagcaatgaattcatcatgaaggactgaggaattggcatcaatctgaacccagtcaatggctaaaaaatgaaagaagcagacacggagtttagccatcaaatttacctacagacttaatgcagtggttctcaagatttaggaatcacctgacactaaactgcagattgctgggctgattccacagcattagagtggggcccaggtacttgcattttaataagacccacacacaccacacctcacctccctgcccaggtgaatttaatgcagggggctccctgcttcacagaaaacactgacttatagaatatcatagaagtggaaacatgtttatttgagctgagtatttgcatgagaagcacttaaatctgctacctgtgccaccactaaatccaagaacatgaactatttgagcacttcaaagtcagggaaaccctcacagaagcaacacagacttatggggccatacctcattttaggatataatgactggactgcccaacttagcactttttaaacactcaatcaacaaatgtttactgaattcttttaatgcgcaaagtatactaaatatagaacccaatccctagcagcaatgagctcgtaggagggtaaagactgtattatcgatcacacatgcttgacttaaacacacatttattcattcataaacatttgcatggaaccaactaaatccaggaatcaaatggcactggagcccaactgccaaacgagggacacagacactaggaacagcggtcggaagaggacctccccctgccaggcctccacctgctctgtcctgctatgcttcccattgcttccccagtccaagccaactgagagaaccctgacccaagcttttctgcctctttaatcccccagcccttccctccagcacacccttcccctccttgctgtacaggttaagatcctctgtgcctcctgaaaactaagccttgcctgctctctatgctacagatgtgacattccctccctttcaactcctctctcacaaaactctgttcagacttccctgaagacacttgtcatagtgtgccttgtgtcatatttgtgtatgttatgtctatacctcaagcttcagaaattccttcacgcaggtcctgggatgtctttgtattcctagcatgggtgctcaatattatttgtagaactgaatttgttgggaaagaggcatttagactcagaatggcagggctgcatcatgaagtacaactccctcacctgactcctgatgaaactgaggtccagaggcatgaagtgcttaggcagggggaggtccagcactccaagctgaatttaagaagtgactggggggcgggggggtggggtggtggtggtagtggataaactacaatgttctcttgcctaatcatttggcctgcttatttccttaaaagtctgaatatttgatgccacagctatgacttatatttattttgcctaatccaaactctctgagctgactctcagaaatgcttgaagtatttcatacaagtataatcaatgcattaagcacctggagcagagtggctggaaccagaccagaaattgatcttccctcctctaagagccaagtgcaccacagctatgcttctcctgaactactgatcaaaatctaccttgctttagtgttgtctgtggattcatctctcccctacaacctcactgtggactccatgagggcaaaaaccctgttctctacagctttgcattcccagagcttaccaccatgcctgccactttcatgctccataaatgctgttgaaggaatagattaataaaaaagccatctaccagcactgagcactcactaaacacaaagcacttatatggattacctcacttaatccttaacattaccctgataaggatcattagtggccgaatgttacagatgaggaaactgcagcacacagaagtttaataacttgcccaagtttcacaaaagcagtaagtgatgcagccataagaacgaacgaaatcatgtcctctgcagcaacatggacgtggctggaagccactatcttcttttttattttcttttgtttgagaaggagtctcactctattgcccaggccagagtgcagtggcatgatctcggctcactgcaacctccaccttctgggttcaatcaattctgcctcagcctccccagtagctgggattacaggtgggagccaccacacctggctaatttttgcatttttagtagaggcgggctttccccatgttggccaggctggtctcaaactcctggcctcaggtgttcctcagtcttggcctcccaaagtgctggaattacaggcgcgagcgcggcctggaagccattatcctaagagaattaacacaggaacagaaaaccaaacaccgcatgggagctaaaactgggtacgcacggacataaagatgacaataaacacactggtgactactagagctggaagggaggcagtggggctaggggtgaaaaactacctattgcgtactatgctcactacctgggtgaaaggatcatttataccccaaatctcagcatcacgcactatacccaggcaacaaacctgcaccaatgtaccccttgactccaaaataaaagttgaaaacattttaaaaacttttgtaacaatagtagtgaaaacagtatttgaacccaagtctgcacactgctaaacccatgcttctcagcaatgcatacccaggacaagggtggacctaagtggcccgtgggcgccagggaggcggccactgagccaagggcacagggtatggtcaagtctccagcaatgcacttttctcagcactaccaccctcagcccgaaccaaggactggaaggagccccaaagagtgtgtgggtggagagcggggcaggaacccgtgggcgcgggaacgaggaaggggagtcgcttacctattatgggaacctcagcgatgaagaccctccgaatcgaattggccaccctgaaagatgaaaagccaaggggcgtgaaggcgctgcagcctcgacaggctgggcccgcgccgcaggctcccaaagctaaagccctggtgcaggggggcagctctggaaggacatcgcccccaccccaccccactacacccccgccccctgccccggggccccggcttgggcctcccggcgccccagagccgccagcctcttccctcggtagccttacgccaggtcggtgttctcgatgatgaacttgacattctcgtcagtgagctccgtgatccgcacggtaggctggttggcgtacggcatctcgcccaggggccaccagcctccgcgtctgctccgcggtgactgcgcggcgccaccgccaacaccggaagtcagtcagcgaggcctccgcggcttccgcaaagacgactcacagcgccgcctgctgctcggaggccagaaccgccgagcgtcttctgcggcctcctgctttaaaatgtaccagattcagctatctcggagggtagtttggcaaaacacgcatacgtccttcacttaacagtaacacttctaagaattcatactgcagaaacacttgcagttgtaaacaaagatacgagtgcagggacgttcgtggtagtactgtttgtactgtccattgataagagacctggtggagtatacacacatggaatactatgaagcacttaaaaagaacttgtacatctatagaaaaacaaaagtatattttaatatgaatgtatattttagcaaagtatacctgaattataagtaaataccctttcccttgcagtctcaagtatggaccatgcacttctgaaaacttcaggaaaagatacaatgttctttaacctaatgcttcctctacagtctgtgtagctgtggtgggtgagtgggaactctttgtctctgcatccccagtgcctggcagtgggcaccatgtggggtgcatgctcaacaaagaactactgaagtcccctaaacagactggagagaggtttaaatgggcctcaaaaaaagtggctgctgctccaacagagaaaagctctaaaatagaacgtggcaggaaatacatttaagagttgggagaagagtaaccagataaagaggagtttgcctttgcaaagagtgacacctcttcctgaaacagagggtgggcactgatggaaccctgctccataacctgtgtcatcttggtaaattaagaattatggttgtctgctgagtgtaagatggatgctatgaaggaaaaaggagaatgcaatgaaaactggaacagctactgcgaaaacttcacaggatgtcaagagatacaaggaattgagaggtgcaaaaaagatccagtggaagacccacaagagatctgaaattcaattagttgctgactttcccccattaatattcagctgacaggcagaagagagcaaagcagaaaacagagctaaccagacgtgcaaagggaacccagccagtgtagaggctgagaaaattactggggctaaagaatgtaccactaaaatcgtcagacaagagcagccaagggagctgatggtctgtgggaaggcttctgttacccgtattttactgatgggaagacttgagcccagagacgcagaggtactataattaccactatgtattaggcagtggcagcgccagaacacaggtctcctggctgccataacttaacctgtctccctctggggtcctggatacctatcatgattgataaggaaactaactacacaatgggaaactacttcaaacatatttattatttttacagactcaaaatacactaataatcctgcaatgcatgctggtgtcatgtgacaccaggcctggaatcacacctctgtccagcaggcacttgtctcaggtgaggcagttttctgagggggctcccaggagcagcatctcaggacacctgagagggagggggcttcaaggaacacctctgtgtgcacacgcctgtgctgtgctggagatgagctgtcaccttgaggtggcgtcagaccttgactctggcttgggagccccaaggttaagggaaggttaagacatgatcaaggtgcccatgagattgtgacagggacatgctgggtttctgtggcttgactgcttggatgaacatctcatttttcaatcacacagttgcagtgcagaaaggcatcaggaggcttggtctggtattaggaactgaagaagcagcccaatccctgaccagaacggtagcatcaaatgccttgtggtttccaggtggctgtggtagtgactcaggagtcctttagtgtgttctcgtgaacaccaggttatgtggatggcaccttatacttttcaaagctctttcaatctgtccgctcattctcttctaggcattgtagcttataccccttcctctcaccgacgctggtttagacctgtcaagttcttgagctgacacgggaatggaaataaagagaatagtgagggcttaccttgcctctagactctaatagaaaagacctagcttttctttttctctttttttttttcttttttgcatagagacagggttttgctatgttggccagactgtcctcaaactcctgggctcaagcgatcttcccaaatcgctgagatgatatgcatgagccactgcacctggccaagatccaggtttgcaaggtggcaggtgtggctatgatacagagacttgatataccagggtcccaggagtcagtgatatctcctgatgacaggaaaaaataaagaagtggggtttttggaatcaagacactagggctgaaccattgtcagccttattattagattattgtttccaggttagggctacaaaatgatgtgaagtcagtaacacatgtatcacagagccggaatgggagagaggaggggcagggatgtgctgggcagtactcaccgtcactgctgcacccatgagtccttgcaccagtgcctctcctgtggactttacctagaaggagtcagtgtcaggttcccttaggccaccaacacaaagttaaacttgagacaggcaggacaaatcaggaggcctatgagccccaaaaggtgaagacaagggggccacgttactggaaggagagctttggacaacacaatcacaaatgagcaaagtgtggctcttagggaagggctggcctgaggaagaaccagccaggcccttgggaaggccctcaggactgtcagctgaggccaaaagggagcaagaccagctgtgacctgaggagaataggtatgccttctaaagagggttccccaatggctagtccccacctacctgcttggcagtgtggcccatgttcattgcatcattaacccggttttccaggaagcgccaagtgtcctcaaagtctggagaggagtcctgcatcatcaccagctctgttgtgttgtagatggcagccagcatggctcggcgggtgtaccagttaaactgtaaagaaacccacactaccgctgtgggctggtgcaagtctgaggcagttcctacccaaggccatgggaactcctgggttccctcttgactacttcttgactgtcacagatacatctggccctctggacaacactaccatctcaaacttgactgagcatcagaattacctacttgattaaaaatgcaagctcctgggcccaacctcttaagagtagagtcaatggatctaaataaagtgccaggaatcaggaaacttaataagtatcccagatgatttggctacatccaatccattttggaactgctagtagaaagcctacatcttaagacatctgagtcccagaagacgctgtaatcagccagctatgaccgaaccttggtgtgttcatcaataaagtgagggctgagagaggctcatggacagattacaatacctgggcaaagctgagagttcaagtccctcagcaacttctgattgttctagcaaactactcttcagaggaccagctcagctgcttggtgttttattcctttaatttctttgctttctaatttcattttcctaccgtctctgttggcattatattcccacatggaggaagtttattaaaacactttgttataactatggtgggagtatttctgtgcctcctcatccaggattccacaaagtatcatcacattttcttttatgaaggtgtattttttaaaatttcctaccagaaatatgatagcattaacaagtcggattctttcctggtgctgtttaaagagccttattgatcacttagcaaagcaggccaagatgggctggggaagggaatttctttttaaagcaatgggtgcctccatggcatttctttttttcaaaagaggaattttgctgcagaatctacatcttaggagagagggaaatgataataaaatggcagcccaattagctttcgccaatgctaaaggatctctgacacctggtgtcaccacaagctggaagaaataataactggtttgtggctagaatgctggtccctgaatgaagatgacctagatcccactttggcttcttgacggaccttcctcataccttagatgggaatgacactgcagcccccctgcaggggcttatgatcaaagcaatttcacaagcttcttgaagaaatgcttaacacaagcctttcccagcctcctgtgggcctgcagaaagcactcacatcagtggactggtccccagcgtaatgccacatgtcatccaccatgctggtgagcaggctcaggctggacgggatgttgtgagggagcatgaggatgctgagggcctggagagagaatggcagaggagtaagctctgctcacaggtaatggtgcatagttgaccagcatctacctctccaagaggtgtatgagggggcctgccaagctctggttctctgagaccagcatcttcacccactggcgtgagttgtgggcagctagcaatactgactacagctgaggagagccaggggcatagccccgtcttatgcaagcccaagcacattctccatccctagcatttggaactgggaatgcagagggccagagggtctagactggtctaagcaaggatgggcaaagataccccagtctgtcacacaaaggaagaagcagagataggagtccgttcacacacatcagctcctactgacaaacagaacaaggtccttccactttaccaatgctacatccactggggaggtgatcagagaggtcctggattggctgtaaggttttctcttagtgaagcagcccagaagaaaacactatgctgaatcaggaaggcagttgagggcctcatacgtgcacttccactgctttaactgcaaggtggaatgagtcacactcggcctggggttaggcaccaccataagtgttcaaatgtctatcaactgaatgactgaaactacgtgctcagtagtcttccagctgagcaaaggacacaagatgtctgagtccctctcacttcgggtgtactttcactctgtactttcttcactcagagaatggcccatactgtgatatgctttaaaacagaggaaaaaggaagcttcagaaaaggtgaaaaaaccccttgcaacgaatatgccagtccccaagcatcacattgacaattgacaaatcccagtgctcgagatctaaaatgccacagggctgttattcaagtgaagacagccaataaaatcttctgactcttctaacctcctgcatggattcctcctccctgcagacctggtggcacactcagaccactaggagaaccccacccaggatgggatccagtacccggaccactcacatttccaagaactgagacacagatggctcagtcactctctttggtatgtccaagtttgaaacccagctttaccaagtgtactaagtattgtcgggtttatagagattgagaagctaagttctgaacagtgtacaaagtcatctgagtgaaaggtgctgagaatgataaatattaggattattgttgctctggggcctggatatagacttggtacccggggccagtgctcaatgtatgggatcagcattctcagtctggtttccactgcatccctcaggaactggtctgtcttcctcttcctggaagagggaaaagaaaacagtgtgtctctgagtgaaaggcaggggctcagtgctccacggtttactcagccctagggaggagggtcccaccagctcctgacgctggcctgactaaagctgtcagagacaggctgccaggtttcagtcccatcacagcagcagggctgcccaatgctgctctctttgggttctgcttggattggcctcctgggcatagctggtagggcccaagttccctgatccttagctgccaccctgagtagtaatgccatgggacttactccgcctggcccaactgtaccagcttctgctcctcttctagcacacgtgtgagccgggtattgcactgggtcacaaaatgcagtattagctcactgccatccttcccgaacatgctggctgctgcactggagagacccagagactacaaaaggggagacagaaaacagaaaagcggtgcccaagtgtagggtacatttgttgcctgttcatcactagagcctcttcctagtgacagcagcttgatttcttcactctgggtccatgtgattttggtgaaactgaccaccaccggtccctccaccctgcaaagccccttggtgtgtgtgcaagagtgggatctaggcttgaataacaagttcacagagactagctcagggatgaacatatcaacaggtcttctttcttttttagaaactaagcctgcagctgctttctccaactttgcacctaacacatctaaggccagtccttccaactgttgtccagatcccacaattcttgccttcaaggaacctcatcctcttgattttgactattttctcttgtaaattcaccctcactcttgtttctttcttttttctttttactttttttttgagacagtgtcttgctctgtcactcaagcagtggcatgactgaggccttgacctcctgggctcaagcaatcgtcccatcttagcctgggaccacaggtatgcgccaccgcatctggctaatttttaaatgtttttgtagagatggggtctcgccatattgcccaggttggcctcaaactcctagtgtcaagcaatcctcccgcctcagcctccccaagtgctgggattacacatatgagcctggtccactcttgtttctgtactcttcccatttgtgttcaatcatgtccaaacttccatctgtttctcctgcttggtgcaccctagttctacccctcgcagccaaacgcctcgccacttcctcgccttctatgcacacctcgatccactccagttgatttctgatccagttctccacccaaacggttgttgccccagtaaccaatgtctagctgcttaatccacactctcctgctttgcctccaacatcaggatgctctgacttagactttgacggcccatcctattctactctccccttaaatgtccgcgttccttgagagtctggactcccctctcatatgacattatattcttgccctggacaatctcactgacttccataattattttatatatatatatatatataaaatcagcgtgcatatatatactgtatatatatatatatatgcccaaatgtgtatctctagtccagctgtttcctccagttcctgacctgtatgcttgatgcctccactggttgactcaaaaactcctcatactcaacaaggatcaagactgtacccttccccaaagctggtcctcttccaatggccttcaccttagaaaacaccaccattgggtacccacacatgcaaacttgcaactctggtgccatcctgtcactctctcccatgtccaagctattcctgaacttacccactgccattactctaagccagaccacctcatctctcctgtatgtctggcagcagcccccaatgagtctctctctgcctccaatccacttttcatctggcagccaaaatgagcattttgaaatgccaaatttaatccaatatcttcaattgttcttagaagaaaagcttgactcctcatcatgacctttaggaccttgcctgatttgacctcgactgacctttccagccttgctcatctcaaatctctcttcctgcactctctgcatggtggttctctgtggttcttctaacgtaccatccttctttttctttccaccttgcctgtgcagtttctgtatttggacttgtccatctcctacccacaaagtcaggtaaagcctattcattcttcaattctcagctcaaaagcctttcctgaccaccctgttacccacctcatatatggtttcagacaaggtctcactctgttgcccaggctggagtgcaatggcatcattatggctcactgcagccttgacctaccaggctcaagagatcctcccaccccagcctcccaggtagctgggaccacaggcaagcaccaccatgcctggctaatttttgtattttttgtagagatggggtctctccctaggttgcccagactggtcccaaactgctgggctcaagcaatccctctgccttggcctcccaaagtgctgggattataggcatgcgcgactgtgcccagccctccaaccctttaataggacaaattagactatttgtcatagtttaacaggcaacatgttttctttttttactgatgcacttaaaaatggtgcttcttacaaccaatggcatcttagagtcaatgaaatatggtagttttgatcacagacaattcttgccaataggttgcctttagaacacaactctcaagaaccaattccatggttcattacttttatatctacaaaataaagccatttccaccctattgagggaaaaaaaccagtcaatctcgcagctgtgacctgatctaatgatcgggtccctccattatacagcccaacagcacctttccttgatagcacttaccacatcttctaagtaaacatttgtatatattttattaatgttgctagactggaagctcaacaagggcaggaagcagatccatcttgaccaccttgacccctgtcatgtctcttggactagcacagtgcctagggcacattatttgctcaataaacatttaaagaatgaatcatataaagggttttaattggaaagatctaggcataaatgttgatagtatgatctttggtgtgattataggtgttttctacattcttttttatatttgtttgtattgttcagttttcacaatgagcctacagtggagtcagagcacccacatttcactaatgagacttctgttaccaaatgtgcacttgggagtgagagaagacaaggaaataacagttaaatttcagtaaagcagcaaccttgcccattgtccatgggtagatgccctgcagcaagcctgggatggaagatgcaactctgtcatcccctcagtctcttggaggatggtatcttgctatgctggaggattctctacaacatggcctgaacatgagcctgctgcctaatctaaagcagcagtctgtactaatgcagaaaatgctattagagtttctgggaaaataagatgtgttggtctccaaagtggtgccttcttgggggttttcaaacaccatatgtcattaattctaagatgcagatatatttttcattttaaaaaatcagtgtgaatcacagaagtgctttgtcatagttcgaagggcagtatgttttcttttttactgatgcatttaaaaatgatgcttcttacaaccaatggcatcttagagtcaatgaaacatgggagttttgatcacagacaattcttgcctaatagattgcctttagaacacaactcccaagaaccaactccatggtatgttctttataactacaaaataaagccagttccaccctattgggggaaaaaaaccagtcaatcttgcagctgtgaggggctctgagctagactggaagaaggcatgaggccccccgctctgcctggtgtgactccatcctggctcatcttggttaggtggccccaccctcacctatacacacctgggctccttctgcaatcgcctctgctgtccacccgtgggcgggcacaaactcaagggctgccgtcaggatgcggtgctgcaactgctcctcactttcatagtcctcctcctcctcgccgccctggtctgtatacctgagacaagaggacacagcccagcatacttcatctcctggcatgtacaatgggcatgaccagaaactaggggctctggatctcctctaagcacatgctgggaagacatttactcttgtgtcactatcaatgtggttttcttgtttgttttttgtttttgagacagagtctccctctgtcgcccaggctggagtccagtggcgtgatctcagctcactacaacctccacctcccgggttcaagcaagtctcctgcctcagcctcctaagtcgatgagactacaggcgtgtgccaccatgtccggctaatttttgtatttttagtagagacagggtttcaccatgttggccaggctggtctcgaactcctgacctcaagtgagccgcctgtctcggcctcccaaagcgctgggattataggcgcgagccaccgcgcccagccagtatcaacgttttaatgccaacagagtaaaaactagatcatccttcccctccccataggcacggagaggaatccagcaaatgaggccatgtggtatgaaggcattgctgcaccctggagttccctgttttcagcccttagcacactgtgctcagagggtttcttcatctaaacttacaccagactacctccctgagggcaggagtaatgctatattactcacagggcctggcatgatagtagggcctcaaaaaatatttcttgaattgaaatgaaaagtactttagttaggaaatcagaaaaatgaaaaggaacacgctaatttcagatatagagaaacttttcaatggcaggattaggaaaaaaaaacactaatggaaatgtaaattagtattacctttctggagggcaactggcccacataagtaaaaaatctttaaatgtacatatcctttgactcagtgctcccacttctaaggagagattcacacactttatcatattatttcttatactagtgaaggaaatctaaatatccatcaataaaagacaggttaaataaattttggcacagctatttgctggaatgttatacaactattaagctatgaaaagacattacaaatgtactgttgagtgaaaaaacaggttctagaacagcatgtagagtttatacacattatatctattctatacaaaaatttacatatgaaataagcttagagaaacatctaaaaggatattcacaaaaatgttagcagggttatctctgtaattttggataaaactgctttatttttgtgaacttctctatactgtttaggtgttttagaacaaacaggcaccaattttataaaaacaataggttctttcctaagacagccttgtggctgggtgcagtggctcacacctgtaatcccaacactttgggagatctaggcggaggacagcttgaaatctaggagtttgagaccagtctggtcaacgtagcgagaagccatcactacaaaaaataaaaaattctaaaaaacaaagatggccttggaaatgaaggaaggtacaaaaggggatggagaggagagaggaagtgaaggaggaacagacataatgaagcatatgaagtggccagaaataggtggattggtgcctacctggggggtgaatgagaagactctggatcaggtttttctgccccctgtgtctcagaatgctgctgagaaaatgagttgggaggctgctgcttctgctcatctgaagaccttagccccacagctgaagcatggaaggcacgtggcaccagggcttgtcggcaacgggccactgaaacagaaactggtcagtcagggacattcaatagagaagaccctttcagacccagagtggtaacacagataaggaggaggaaaagcaggccagagactcctgtagaaccacttatccaagtgttgggtcccacacaaaaatattgggtaaactgggaactttgggacacgaagtggtagcaaaagtggtaagccaggaaaaatgatctacctagcatcttgacctgtttctaccacttgttacctgggtaactggcaaacaatttcaccccaatgtgcagatttttaaatctgcaaatttagagtaataatctctacttgctcaatgagagcactgtgtggcccaaacaaaaagtaaaagtggcttgcaaatgttacagatttatatatattatggcaagagctctggaatagtaatttaatgtctcagccctactcccccagtgtttatatggtatctttggacaagtcactaatctctatctgctttctcatctgcaatatctgcaacatctccatttactttaagaaagatgagaagtatgtttcctaagcataaactcatagtattttttatttcccaacattttttattctaaaaattttctttttttttttttttttgtcagagtctcactctgtcggccaagctggagtgcagtgagattatctcggctcactgcaacctctgcctcccaggctcaagtgattctcgtgcctcagcctcccgagtagctgggatcacaggcacccgccaccactctcaggctcacttttgtatttttagtagagacggagtttcgccatgttggccaggctggtctcaaactcctgacctcaagtgatcgcccgtcttggcctcccaaagtgctaggattacaggcgtgagccatcatgcccagcctattataaaaattttcaaacacgcaaattgaaagaattatggaatgaacacctgtatatctgccactaggttcaacacatctgtcatgttcttcattcatccatcttgattttcagtgcatttgttgcagatatcagtattattcacctctaaacattttagcatcaaagacttctatgttcactgttttgttattcagatgccatttacacacaatgaaatgcataaatcttaagtgtaccattctatgagttttgacaaatgtatacacttgcacaacctaaacccaatctaaacagagaacattactgtcaccccagaaagttcccttatgccttttcagtcattccccattcatactgttctgaatttttcactctaggttagtttttgcttgtcttagttttgcctgtcctaagatttcatctatatgtacatgtttcagtaaagcttctttcacttaggactatatatgtgtgtgtatatatatatatttatttattttaagtttaaatagagacagagtcttgctatgttgcccaagatggtcttgaactcctcggctcaagcaaccctcccacctcagcttcccaaagtgctgggattacaggtgtgagccaccacacctggaccacttagtatatttttgagattgatccatatttttatgcctatcagtatatctggcaaagattctctccttgatcaggctctaaccaggctcctctgagccctcttcttatctaggcctcaaccttggcctataaagacttgaacacacactaacataagcatcactcagggccacatcccttaagataaccctacccccctttaaagtgcctgcctgagaaaactcaaggctgtcaaaaaaaattttactgtttgttcaggctaacacttaagaaggatagggcttgtctccctgtgggaaaacagaatcctaactttgttaactgccagctagcagaccaatcttatttataattattcactatcctgactctactgagtccccacctgccttcctccctcctccctcattttttctttgaaacacccagtgacttctgcatgctctaaactcaaggttgggctccgttcatgctagactcttttccctattgcaatagttattactgattaaaaatggtccttatcactttagtgtccagctttctctttgactgatttttagtttttattgcagaatagtattccataaaaaaaatactattctgttgctagacaactggactgtttctgtgtttggctactatgaataaaattgctatgaatatacttgtactaacttttttgtagacacataccttcatttctcttggtggatttgcggggtcatagacattacttttactacacatctttagtttggaattttgtataaatacaacaaaagggggctaggcggtggctcatacctgtaatcccaacactttgggaggctgaggcaggcagataacttgaggtcaggagttttggactagcctggccaacatggtgaaaccccgtctactaaaaataaaaaattagctgggcatggtggcacaaccccagctactaggaaggctgaggcaggagaatcacttgaacccaggaggtagaggctgcagtgagccgagattgtaccactgcactccagcctgggtgacagagtgagactctgtctcaacaacaaaattaagccaagtagggtggcacgcacttgtagtcccagctccttgggaggctgaggagccagaccctgtctcagaaaaaaaaaaaaaagaaaaaaaagaaacagaatagtatgtgccaaaatatcaatattttaatacatgtactgaaagatacggcacaaatatccgcaaaactttgaaaaggaaggagcagatgcaaagtatgactgtagtaccactgagggtcatgagaagattttaggtgaaatacaggtgaacgtttcatcagttatgtatgtatgctaaagtgttaatgcatacgttctaattaaggaaggcgatattagttttccatttatgacaatgatataaagtttcctctttaagaactcctatttaaaaataaaaatactgagtacatagtggcaaaggtggtaagagagtatcacagaattcgtgaagtggtgaggaaacggctggctttcgggaaacaatggactaggctctctgtggccgtgtccacctgtccttccagtggacttggcaatggacttgagaatgggtctgcgactgccagttctgtaaccaacaggctcaggctgcgtgactttcgtaccccgagccctctctgaggctctgccaactccatgaaatgggggtgacaggccctgccccgctgcatctgcccctcacaggcagcggagcagggccgaagctagccaggcggctcgcccgagcccgcgccgatgcccttcacctcaccttgctcgtgggccgccccaacggcctcttccccccaccgtcgaacccagctgaagccggcctcgcgccccctccgcgctccccgcctctccccggcttggcagccccctcaccgggcaggcatcgcagctgcaggagcctccagcccgcccggccaagcgcaccagataccgccgccgccgccattttggaagcgggcacgtcgcccacggcgacg

SEQ ID NO: 12475 - DNA, 282 bp, Homo sapiens
agaagccgggagcgagcccaggcggcaggtgagagtggtgggggccagctgagcgccagagctccctcaactgtcccctcccggcccaccctcgttcccacatcctctcattttctcttcccaccccgttcctcgatgggaacgcagccacggccgccccgctgaaagccccggctggtttattcctgagaagtcggtgtgaggggccagggccggccctaacctccctggggtcctgactgggaatttctgccgttccccggctgcctcgtcccttgcgta

SEQ ID NO: 12476 - DNA, 2096 bp, Homo sapiens
tggcctggcaccaggcaggtactgtccctgggtaagcagcagtattggtaccaggctgggaggtgggatgcggggggcccttgctcccctcctccctcactggaaccctgagagcgactgctggacaccgtgcttagctgggagctcggagctcacagtgctggggaaggacccaagacctcaggtcctctcaaagtagcaagcattcttcctgctgcaggcctgttggggacaagggcctgagggacaaacagggcaggggctacttcaacccaattcctggcctgcctagcctcagctgccctccaatttttgtatttttttaattgatttttttgaaattttttagaaacagtctcactctatcacccaggctggagtgcagtggcttgatcatagctcactgctacctggaattcctgagctcaagtgatcctcccacctcggcctccccagtagctgtgactacaggcacgtgccacatgcccagcttattttttcattttttgtagagacggggtctctctatgttgccggatctggtcttgaactcctggccccaagtgatcctcccactttggcctcccaaagtgttgggattacaggtgtgagccactgtgcctggtctgctctccacttcttgctgtcctattgggccttcacaggctcagcttgggggccgcctcgcttgcttaacacagtgcattccttctggaggatggtgggttggttctgggcccccccctcaccacttgaccccactgcctgtcaaatttgtgggtccacctattggccctgacctttccctccccttcccaacccctctttgcccaccattttgggtcctaggttaggtcttgctcttgcaaacatcattagggactaagtgtggccaggggtccctgtgactcagggccggagtgagctggcaggactttggcacccagccttccccgtgaaggtcactcttcccgctggggacctggggtatgggacggggtggggcctatggacagacgcagcaggagcactcctgcgagcttggggccacagtccctggtggggcaacactgggaaggagcaggctggcttctggtggtttcaccgccctgtctgggcagcaactcttgaagaaaactatatatatatacatacacacagcccttggagttttcaaggcagaagctctggccaggcgcagttgctcacacctgtaatctcagcactcagggaggccgagccttgtggatcacttgaccccaggagttcaagaccagcctgggcaacatggtgaaaacccatctctaggggccgggcgcagtggctcacgcctgtaatcccagaacgttggaaggccgaggcgggtggatcacaaggtcaggagatcgagaccatcctggctaacacggtgaaaccccgtctttactaaaaatatgaaacaattagccgggtatggtggtgggctcctgtagtcccagctactcgggaggctgaggaaggagaatggcgtgaacccgggaggcggagcttgcaatgagccgagattgggccactgcactccagcctgggcaatagagtgagactccgtctcaaaaaaaaaaaaaaaaaaaaacaaaagccccatctctacaaacaagtttttaaaaattagctgggcatggtggtatgtacctgcggtcccagctattcaggaggctgaggtgggtggatcacttgagcctgggtggttgaggctgccgtaagccgtgatggcacccctgcactccagcctgggtgacagagcaggacactgtctcaaaagaagaaaaagaaggccgggcgcagtggctcacgcctgtaatcccagcactttgggaggccgaggcgggcggatcatgaggtcaggagatcgagaccatcctggctaacacggtgaaaccccgtctctactaaaaataccgaaaattagccgagcatggtggtgggagcctgtagttccagctactcgggaagccgaggcaggagaatggcgtgaacccaggaggcagaggttgcagtgagccgagatcgcgccgctgcactccagcctgggcgacagagggagactccgtctcaaa

SEQ ID NO: 12477 - DNA, 405 bp, Homo sapiens
gcctggccaatttttcctccatctgtgagtcagcgtaagtatgcctactcttttttcaaacctcccctgactcactcatgcagaatagaagtcctgctttctgttttctccttatgtacttactgtgcacttgtgtaacaagagttcttttaagtataatcttcaatttgataagggcctacctctggagttggcatgatgttacaccatgtgtaagagtaggaattaccccagtttatcttttcctatccagtgctgcacacaatgccaggcatatagtaggtactctctaaatacatgataaggaatgggtggatgcatgactttgtctttaagctataaagttagttgttaaataacataatgattcctggtagtgaacttctggaacatgtctacaatgta

SEQ ID NO: 12478 - DNA, 405 bp, Homo sapiens
gcctggccaatttttcctccatctgtgagtcagcgtaagtatgcctactcttttttcaaacctcccctgactcactcatgcagaatagaagtcctgctttctgttttctccttatgtacttactgtgcacttgtgtaacaagagttcttttaagtataatcttcaatttgataagggcctacctctggagttggcatgatgttacaccatgtgtaagagtaggaattaccccagtttatcttttcctatccagtgctgcacacaatgccaggcatatagtaggtactctctaaatacatgataaggaatgggtggatgcatgactttgtctttaagctataaagttagttgttaaataacataatgattcctgggagtgaacttctggaacatgtctacaatgta

SEQ ID NO: 12479 - DNA, 405 bp, Homo sapiens
gcctggccaatttttcctccatctgtgagtcagcgtaagtatgcctactcttttttcaaacctcccctgactcactcatgcagaatagaagtcctgctttctgttttctccttatgtacttactgtgcacttgtgtaacaagagttcttttaagtataatcttcaatttgataagggcctacctctggagttggcatgatgttacaccatgtgtaagagtaggaattaccccagtttatcttttcctatccagtgctgcacacaatgccaggcatatagtaggtactctctaaatacatgataaggaatgggtggatgcatgactttgtctttaagctataaagttagttgttaaataacataatgattcctggtagtgaacttctggcacatgtctacaatgta

SEQ ID NO: 12480 - DNA, 2315 bp, Homo sapiens
gccacctcacttggtgtctgctgtccccgccaggcaagcctggggtgagagcacagaggagtgggccgggaccatgcgggggacgcggctggcgctcctggcgctggtgctggctgcctgcggagagctgggtgaggtgtgggacccacaggggagctgggacggagggagatgccacccactgacattcacactgttcccgggagggcgccccaggaaggggcctcagaggcaggagaagccagagctgtggggccgggggtgtggcccccccgccataaggaggggagggtggaaacggagagaggggctggcggtgagggggacgcctaatgagggtgagcagagggtggccttcgaggtgggcgggggcccagccagccacacccctgagcaccagcctgggtgtcacactttatggggggctatgggcacccagaagggccttgagcgggggaaggaaggcaaccccagggaggctctgaggctggggtggcagtagagatggagaggagtggggaaaccagacacatggggtggggtgactccctgatgtggagcctgaaacaaccatcaggggcaatgtcctggactcaaccagaagcagcttggcccagaggcccctggcagatggctttgcccatttcccagaaacaggtgcaccagagaggggcagaggccccgctgcatccccacagtggggacagaggagtcgggcctagctgtgcagctggctgccctggccagctggaaccagccagacccacctgggctgctgcggttggggccggggtcaccggagcaggagggaattggagcctctccggtccccgtccctgccggtctgcaagtccctgtgggagaggagtgggcacccagacacagcccggatgcagcctggcacaccctgcattccatgggcctcctggcctgatcccttgacctccacagcagcacttccctgatggggaaactgagggggtaacctgcccccagccacgcccccacccaaggcttcctgcccgaggtgcctcttgctatgaagatgccagggccttggtccccctgagtctcccaaacacttccaaaggggcttggcttggctcctcccaggccttgcaggctggatccccacccccagcagccgactctgcctctgggatgcaaggttccgaggctgagcccggcctgtccccagctgcaggctcctggcattgctcctgagttttggctggtaggcatctctaccctggccagtgtcactgtcctcttcagacctgggcttccaggacagactgtctctgggcttgggaggggtggagcctgcctgaccgcccttgtcccttctccccagcgccggccctgcgctgctacgtctgtccggagcccacaggagtgtcggactgtgtcaccatcgccacctgcaccaccaacgaaaccatgtgcaagaccacactctactcccgggagataggtcagtgggcacagaaggcgggcagggccgggttcccggtcagagccacctccagcccagtcacactctactcccaggagatagggcagtgagcacggaaggcgggcagggctgggttcccggtcagagccacctccagcccagtcaccaccagccagcttggccccagtgcacagccaccacctcacccatctccagaaatggctttctgcccgagctaggcctccctctgccctccccttccttcctctctccctcatgtccttcggtgggaacatatctgcaacctcgttttggggggactggagaagctgggcacacttacaggctttggtttcaacagtcacctcggggcgggaactgccccatcaggccgggtgcctggcacatggtagacacccggacaacgtcggtgggaggagagaggaagaggagggcactgggccaggagggacggagacccgggtgggtgaccccagagtggggcctgcatgaggtggtactggcagggaccagggcttggaggcagtgaccagccctgacggctgactcttcccacaccccacagtgtaccccttccagggggactccacggtgaccaagtcctgtgccagcaagtgtaagccctcggatgtggatggcatcggccagaccctgcccgtgtcctgctgcaatactgagctgtgcaatgtagacggggcgcccgctctgaacagcctccactgcggggccctcacgctcctcccactcttgagcctccgactgtagagtccccgcccacccccatggccctatgcggcccagccccgaatgccttgaagaagtgccccctgcaccagga

SEQ ID NO: 12481 - DNA, 86 bp, Homo sapiens
  misc_feature (21)..(21): n equals a,t,g, or c
  misc_feature (65)..(65): n equals a,t,g, or c
  misc_feature (74)..(74): n equals a,t,g, or c
  misc_feature (76)..(76): n equals a,t,g, or c
  misc_feature (85)..(85): n equals a,t,g, or c
taaaaaaaaaaaaaaaaaaanaaaaaaaaaaaaaaaaaaaaaaaaaaaaaaaaaaaaaaaaaaanaaaaaaaananaaaaaaaana

SEQ ID NO: 12482 - DNA, 165 bp, Homo sapiens; identical to SEQ ID NO: 11543

SEQ ID NO: 12483 - DNA, 143 bp, Homo sapiens; identical to SEQ ID NO: 11520

SEQ ID NO: 12484 - DNA, 151 bp, Homo sapiens; identical to SEQ ID NO: 11427

SEQ ID NO: 12485 - DNA, 195 bp, Homo sapiens; identical to SEQ ID NO: 11552
  misc_feature (3)..(3): n equals a,t,g, or c
  misc_feature (30)..(30): n equals a,t,g, or c
  misc_feature (32)..(32): n equals a,t,g, or c
  misc_feature (37)..(37): n equals a,t,g, or c

SEQ ID NO: 12486 - DNA, 364 bp, Homo sapiens
aaccaccatcaaacaggattttcgcctgctggggcaaaccagcgtggaccgcttgctgcaactctctcagggccaggcggtgaagggcaatcagctgttgcccgtctcactggtgaaaagaaaaaccaccctggcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgc

SEQ ID NO: 12487 - DNA, 247 bp, Homo sapiens
gaatggcagaaattcgacgacacagcgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcaca

SEQ ID NO: 12488 - DNA, 686 bp, Homo sapiens
  misc_feature (95)..(95): n equals a,t,g, or c
caccaaggccagtttggaagcgaacggctaccccgaaattaagatactacagcgtgagttatgagaaagcgccacgcttcccgagggaagaaagncgggacagttatccggtagccggcagggtcgaaccagaagagcgcacgaggagcttccaaggggaaaacgcctggtatctttatagtcctgtcgggtttcgccacctctgacttgagcgtcgatttttgtgatgctcgtcaggggggcggagcctatggaaaaacgccagcaacgcggcctttttacggttcttggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgaattcgagctcggtacc

SEQ ID NO: 12489 - DNA, 364 bp, Homo sapiens; identical to SEQ ID NO: 12486

SEQ ID NO: 12490 - DNA, 288 bp, Homo sapiens
attaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactctt

SEQ ID NO: 12491 - DNA, 288 bp, Homo sapiens; identical to SEQ ID NO: 12490

SEQ ID NO: 12492 - DNA, 1012 bp, Homo sapiens
  misc_feature (5)..(5): n equals a,t,g, or c
  misc_feature (21)..(21): n equals a,t,g, or c
acacnatagcaaatactgttngacttcagaagatgattggttatttccctttaaaatgattaggtatatactgtaatttgattttttgctcccttcaaagatttctgtagaaataacttattttttagtattctacagtttaatcaaattactgaaacaggacttttgatctggtatttatctgccaagaatatacttcattcactaataatagactggtgctgtaactcaagcatcaattcagctcttcttttggaatgaaagtatagccaaaacataaaaaaaaaaaaatcctcagtatagcttgcaattaagacctagatcacagtatttaagtgttttgcgttttatacatgaggtcagtgctacagccacctagcatgaactaacccagcttccacctccataaagttacctagagttgttgagttggaatatgttctggcatttacctgacctgccaatcattagggagaggcaacaaggtaattcagcctttcctcctatcagcacaaagaaactcaaagctgttttttccctttctgttccaaagcagtcttatcctgacaggagcggtctatactagtgcagatttcaacacttttttttaacgttttaattactatagtgttatgtagagatttgattgagcagctaatgtttctgaactttacttactaattttcagtgtccttaagggttctgtagtgttatcaaagcaaaaagaaaatgctgcataaaaataccaaacttcagcaactgttaatactcagatcatatacctcttaataaatagcatcttatgctaattagccctgctaaactatgtacagaggaaactgttcaagtattggatttgaaagtaagtgacttatgtttaacagaactaatgatgtattgaaacactgtattatgaaaagctaaattatacatcattgtaactatgtagaaagtgtagactaatgtataatcaaaatgctaaggatttttatatggccttgtagatggggag

SEQ ID NO: 12493 - DNA, 1207 bp, Homo sapiens
cacagcctcatagtgtaatttcttttaatgtataggattgtttccaactcatcaggtctggtgcaattctgtcacgatttaacatggaacatccgggctgcccttcctgaatagtccagggcaagagcagtagtgagtgattcttctcttttctcgggttcactttgacctgaagcaagttgctatcttcggagagtatgtatggaccccaacagaatggggcccaggggtcttcatcccttacaaatcctggactgtatcaaagggaaggcctcggtaattcgtgctcacccagcccattcggatcctggtcctccctctcttggggttcagggggttcctagagttttcttgttcccacccaggcatggggggctagtgtccagctgagagttctctctccactgggcgggggtccgtgcctggatggccagcgcatggaccggacctcccagctcctcggccagcgctgcgtggaccagccggtgtcgttgtagggggctcagtccctcgaaacgagagctcaccacagccacgcggaagtgagtctcactgccaggcgggaccgcgtggccaccgctctcgttgcgaagctctagcacctcggggctcagggcctcctccaacttcgtgcgaatggcggcctccaccggaccgatggccccggatcccgcgctgccctggcacaaacaaacgcggccagccatggagaccagacccaggaccagccgcccactcagcatgggctacgccagagactcagacgccaggagtgagggtcggggcgatccgcctggtgagagcacaatgtcaacacccgccccgcgatccccgcatccgccctaaccccacgcccggacgtccacaccagctcctatagggagcccgccttgatgccacacggggagacccgagacaccgccccttttctctacgtgacgtggtgaattcgacctccagctgtggaagtgaagggacaagcgaagattagaaaggcccgcacgcgaggcgcgttcgttccttaggggatttgcaaagaatgggcaaaagtagggcatgtgcaactgcgtacttgtggttgggccgaagcccctgtgttccctgtgaagccccggagacgccccttctacctgccgctcagcctcggccactgcgattcccgctcagggccaggactctggacgctccggagcaaaatgcagtcctg

SEQ ID NO: 12494 - DNA, 1207 bp, Homo sapiens; identical to SEQ ID NO: 12493

SEQ ID NO: 12495 - DNA, 3901 bp, Homo sapiens
gggagtcaagtcaggccctgttttcaaggagacaacagagcactgaagactaacaagtgagcggacaattgcaatactgggtactaggtgctacgatgagataaacacaggatgctaaggaggcaagttacccagacttggccggggttggagaggtggaatgggaggcgggcagagaatatttccgagatttagggaaacagttcagcagaaacaacatgagaatccatttctcagtccctcatagtgaggttttggctttggtagctgcatgtgtaaaggacaggaggagagagaattttgagggagtctttccttctggtgtagttagggtgtggttatgtgtggttggagcctagggggcagctgatggtgatgagtagggtaccaggaggagaggaacgggccagaccaccccaggccttgtagcccttgttaggcaattttgtctttatcctagaagtagtgggaagctactgaggttttaagcagggatgtaacaggatgtaatttttccaggatgattcttaacttgtaaaattatttaaattttattttgtatccttaatatatttacatatttctaaatgtttttccccaacttctcattttgaaaaatgtcaaagccacagaaaagttgaatagttcaaagcaacaccctctacctttcacttgacccaccattttttgcatttatatttattttatacttgtacatatatactcatatatttaagtactttacatatactttaaaatatatttatatgcttttttggatgaaccatttgaaagtaagttgcagatagcatgacatttcacccctaactactccaatatgtatctcctaagaacaaagatattctcatacataaccacaataaccttatcacactcaagaaatttaaactatgacatacactgttttccctagcctttaaaaaaaattaaaacttccagaaaatttgcaagattaatacaatgagcaacccatttatccactcttcacctaggttcactgataagattttgccagacttggctttgtatctcttttaatgtatgtgtgtataataataatgaaataataataattatttctgctgaatcacttgagttaggtgcagaaatcttatttatttatttttttttgagatggagttttgctcttcttgcccaggctggagtgcaatggcgtgatcttggctcactgcaacctctgcctcctgggttcaagcaagtctcctgcctcagcctcctgattagctgggattacaggcatgtgccaacatgcccggctaattttgtatttttagtagagacggggtttctccatgttgatcaggctggtctggaactcccaacctcaggtgatccaccctcctcggccacccaggattacagggattacaggcgtgagccactgcgcctggcccaaaattctttttttttttttttttaaacagagtctcactctgttgcccagactggagtgcagtggcgccatcttggcccactgcaacctccaccttctgggttcaagtgattctcctgcctcagcctcctgagtagctgggactacaggctggtgccaccatacctggctaaatttttttgcatttctagtagagatggggtttcaccatgttggccaggctggtctggaactcctgacctcaagtgatcctcctgctctggaactcctgacctcaagtgatctgcctgcctcagcctcccaaagtgatgggattacaggcgtgagccactgcacccagccacaaaattcttttttttttttttgagatggagtttcgctcttgttgcctaggctggagtgcaatggtgcgatcttggctcacagcaacctccgcctcctgggttcaagcgatttgcttgcctcagcctcccatgtagctgggattacaggcgtgcgccaccactctggctaattttgtgtttttagtggagacggggtttctccatgttggtcaggctggtcttgactcaggtcatcagtccgcctcggcctcccaaaatgctgggattataggcgtgagccactgcgcctggccccacaaaattctttacacttaattgctatgtactttcaatgtgtatctcctaagaacaaggacattttcatacatatccacaataccattaccacatccaagacatttaacattcatacaatactataatcacatacagttgatattcagatttccccaactgtctcattggtgtctactatagtttgaatatgtctcctccagaattcatgttgaaaattaatccatggtgttggtattaagtggtggggcctttaggaggtaataaggctatgagggctccaccctcaagaatggactaacgccttttgaaagagcttgagggggtaagttggccccttctgtcccttctgccatgtaaggtcacctcgatggcgtatctatgaggaactggccttcactagataccaaacctgccagtgccgtaatcttggacttcccagcctccagaactgtgagaaaatacatttctgtttataaattacccagtcagtggtattttgtaatagcagcacagtctaagtaaacattataaatgtttaattttcagaaaccaatcaaggatcatgcattgcatttagctgactttaagtttgtattctgcaaagatcactggcttcagggtggagaatggattgtagaggaggcaagagtggaaacagggagacaagttgggaggttactgtagcagtctaggtgagagatgatgatgatttggaccaaggtggtggtggtggtggtggaaatggagagaaattgtggctacaggatgtatattaggaaagtaaaacctacagggtgtggtaatggcttggttgtgggagggaaagtgtcaaggataattacaaggtttgtgcatctaaagttaaaaaaaacagttcaaataattcctgtatatcctttatcctgatacctagattacccaaatattaacaattcactgtttgttttatttgtatgtacctatctacaaatatataattattttctggactgtttgagactaagtttcagagataaagcctattaaactctacctgtgatggttaactttttttttttttttgagatggagtctcactctgtcgcccaggctggagtgcagtgatgcaatcttggcttactgcaacctctgtctcctgggttcaagtgattcttgtgcctccgcctcctgagtagctgggattacaggcgtggacaatggcgcctggctaatttttgtatttttagtggagaggggggtttcaccatgttggccaggctggtctcaaactcctgacctcaggtgatccacccacctcagcctcccaaagtgctgggattagaggcgtgagccaccacgcacggcctgtgatggttaatgtcccaacttctagaggattggtgctcagatatttggccaaatatgggtgcttctgtgagagtattttgaatgagattaacatttgaattggagactgagtaaattgccctccctaatataggtgggtcccatccaaccagttgaaagcttgactagaacaaaagactgacccactccggagtaagagagacttccttctgcctgactgctttgagacccggacattggcttttctcagccttcagactcagaagtaaacactggctccatctgggtcttagactcggcctttggactggaactacaccattggttctcaggcctttgaacttggactggaactatatcatcagttctcctgggtctccagcttgccaacttaccgtgaagatcttggggatcttgggatttattagcttccataatcaaaaagccaattttttataataaaactatctatcaaaat

SEQ ID NO: 12496 - DNA, 15857 bp, Homo sapiens
cttccctggtgccgggagcagtcgccgctgccgcctccgcccgcggccgggacccccgtcctcgcccgggactccttacccggggaacctagaccaggtgagacccctttctcagtcgctcacctcctccccgcccctggcagaagcatctttgccttgccttgcagccattttatcctccgatgctttgcttatggggagggtgacgatcccctctctaggggtgaggggggttggtgggttggtggtggtttggggatggacatttatttcagttgtgctcttcaggacacacacacacacacgcatatgtataatattggtgaatggggaggaggggtgtttttctctaccttaaccaagtccccactatccccttcggagattaacgtggtggtggggttgtgaggtgggatgaggttccctcaaactcctatcccctcctcaccttgacgtccccccacccccaggatgaatgataaatgaccttggctggggctggagaatggatgctgcctcagtgtgcacgcctggacttgggtgggtggggggcaggggaagaagggcaggtgaaggatggagggaaggggagtgaagaatggaaatactggggagacagagatgtagagccgccaggtgttgggggcatggatggcgggggctggcggcagttgctccggggtggggggaagggatgttgagtgaaggtggacacttgtctagcagcaggaccaagggtggaggaggtgctcagagcagggatttagtcagttctgggggcttttcccttattccggagctgaggcaagatggggtgtgggggggtcgctgcaaatgctgataggggcggtctctatgtctgtgcatgcggaggtctctccctgcgtccccctctctgcctctccgtattcctcagtgtgcattctcagctgacaccctcatttttatccctcagaactgtgggtgctcctatcttcctaaccttggtaggatgtggggaggggaggcgcagtcttgatggtcctgggtgggggctgaagttcgatgaccgggctgtcatggggaaggggtgctcccgcacctcccacattctacccccgcccccgcggacgttttgataagtgattgctttttaatgaccttgtcacctgagctaggaaggcctggggatctgggtggaccccaaagtcaggggctttgactgggagggtggggggttctggacccagggctggatgagctgttctgaaagaaagcatttgctctggagtcccctgcctgtctccaccctctgcagaaaatctcctgggcacattttttcctgtcaggtgaagtcagccagcctaggaccttgtaaccctgaaccttgtctcctttaacctccacctctccaagtcttgtctcactcccccaggcttagccaccctgtgctgttttgggggctaaaaatagcaccacttcctcaccagctcaaagaatttgtcttctttctttctctcctgacctcctgggcttgctggccctgaggaagctggctgttgagacctcatatcctgctgtggttgtggaaggctttcctgccctacgtgcccctctcagggggaaatagggtcaacaaacatagagtatggctcctggtgggtcctgcctccttcagggctggaggggagatcctggttaggaaagagaggaaagctagcaaattgccatgcgctgaggggattccgcagttccagctctttcatgggggatggttgggccctgaaccatgaagaaaaggtgacataggggtcactgcttctggtcaccgtggtccactgcttacatctgtcctgaggggataaggcgctgcttgccagtgcttctctctgaaccacatagcattgcttaccgtcttctaccagggcgtgtgtgtgtgtgtgcgtgtgtgtgtgtgtgtgtgtgttttaatgaaggccctggatgggtgggagcaccggaggcaggatatttttagggggatgatttctgatcagaatctaggcctgcttcctctgctcctatgaaggaagggggctatcccatgccttcctctggagaatgtcttttttggggggacacccaaaccccctttattctacatccgcctcctacgcaatgcggtgtttgtggactccttcttccttgactcctggaggaggagcagaaaggattaagggggattaggaagggaggccctggagggatgggatgcaactgtaggccttagaacctcatgttggaaatgtatgcatttgacagtcatttccattctcacccccatctgtggaaagggggcctatctatgacattctgaagcaaggtggcagtggacagtcatcacctctttcttagctttccatctttcctccactttacttgggttccaggtcccccttttctggatcttcccttgttcttctggaggtagttaatgtgggcccagctactggaattagttgaaacatagataggggtgtcttgggactctgtttgcaaggatgctgggcaacagcatctaagtatgacccccctgttgtcccttgctgcttcctgtttctttcccactttcaacatcataggaaggaagaaaactaacatagagtatctactgtgagattacattctcacatcaactccaagaaacagtctcccaatttaattatccccagttaaaatagatggacactgaggcttagggaggttaactaccctgactgagatcagttagtaagtggcagagttgggatttcaacttaggtcacccctaacagtcatgtgctttgccctgaaccaggattctccttgccagtgtcccttcctgctgctcaccctaaagagcatccaagatagctttcatctggggaccttatgaggtagtatagggcatttcactatattactgtcaccacaaaattaataattaatatttattcatcatttttatgtgccaggtgacttatggtaaggagcatagatacattatatcattcgacccttactttcccctttttaaacaagaagaaactgaggcttggtcccttagctagtatttgccaaaacaggaagtcaaccccatgtctttgtgactctggaagctgagcatttacccattagactatgttgagagaaaatccctccttgttgaagcctgtaaacatgggacctgagggaaggacagtggaagcccctgccttcagatgccatcagaggagggaaggccacaggttggagggcttgtcctcttacacatcctcctcaactccacccctagtaagaaacccaggcaagactaaagaagggaattctggtttctcatatttcctgtttagttctttgcagattggtgataaagcaagggctggggtgggtttgggggtaggtgactgcgactttggagcaaattccacaggccaggcctccaaggtcaaagtaaggggacttctatgtgagtgacccggttagcccagatagccatccctttttagtgtgtggatgggagcctaaagcgagaagaccatctctgcaccacatggtccagatggggctctgggttgagaggctttatactggccttcttcaccaccttaggactcacaacttccttttgctgtctgttattttttctaggtctccagaggcttgtggaagagaagcaggcgacccttcctgagttatcctggcttagcctcccaatctggctccccttccccttcccattcccctgctccccctgtcccttccccatccacccaactgaactgggtataggtcaaagctcctctctttccttttccttcctaggcactcattggctaggacctgtttgctcttttttttgtgcccagagatactggaacacgcttcatctaagtaactgtggggaggggtctttttgactctacaagtccttgagcaaaaagctgaaaaagaagcaggaggtggagaagacccagtgaagtgccccaagccccatcatggaagagggcttccgagaccgggcagctttcatccgtggggccaaagacattgctaaggaagtcaaaaagcatgcggccaagaaggtggtgaagggcctggacagagtccaggacgaatattcccgaagatcgtactcccgctttgaggaggaggatgatgatgatgacttccctgctcccagtgatggttattaccgaggagaagggacccaggatgaggaggaaggtggtgcatccagtgatgctactgagggccatgacgaggatgatgagatctatgaaggggaatatcagggcattccccgggcagagtctgggggcaaaggcgagcggatggcagatggggcgcccctggctggagtaagggggggcttgagtgatggggagggtccccctgggggccggggggaggcacaacgacggaaagaacgagaagaactggcccaacagtatgaagccatcctacgggagtgtggccacggccgcttccagtggacactgtattttgtgcttggtctggcgctgatggctgacggtgtggaggtctttgtggtgggcttcgtgctgcccagcgctgagaaagacatgtgcctgtccgactccaacaaaggcatgctaggtaagacatggggggctccagccttatcccctcaaactctggaaacctccttgctcctggaaattgctcttgtccttaccactgggttccctaggaccctgcacccaagatgttcccagagggctcagggttcctctgcacactcttccctcacacactccctcttcttggccttgggtcagggtgaagttgaatgtgacagaggggcttgcgggagggcagctggactggggcttgggccagtggttgggtggtggtctgcttcattctgcaggaggtggctgtggtaggatggtccctaccatttaatgtttcttcatagctttccctctggttatcctgttccctttcactgattggggaacaagaagccagtatccaaactccttggtataaatggggagagtcagtttggggtggttgggggagggggggagggtcctggatcttctgccagagaagctggttagactttctctcactcagatgggagtttccaggggacaggatgtagtctttgatggcctttcctgacagggactctgaggaggaaccccgtagactcacagagaaagaatcgaggccttactctgccaccaaattgccatggggtcttggacaggtctcttcttcctggggcttggtttgggcatgggaaaatgcaaagtttggagtagatgattttaaagattaattccagctttggttttatgaaggcagtgaaaaacaggagagtttttggaccagaaatattgagactggaaggagtaaaggatggattttgtgtgggagatttcctgggaagatgaaatgaattggagcccctttccccaggaacaaatgagagctctcctgctgctttgagggatcaaagcagggagaatagagaggaccctggggtggtctgtgatcctaggcacacccattcctccttcaaagtgagccaggggtaaaggtgtcactgtgtgtgtgtcagagtgagaaatgagacagaccgaagagagtggagagtttgcaggttctcccatatcttcattcctgcctttgaacccctggcctgcagagatgatcttctatctttgcttacaccattcattttctctcacttgctctaatctctgggtagacttaccttctagaagtttttcagatccttcagctccctcagtgctcatctcctgggagaattaaggtgtgtctgctcacaccccctctgcctgttttcctcctccttccaggcctcatcgtctacctgggcatgatggtgggagccttcctctggggaggtctggctgaccggctgggtcggaggcagtgtctgctcatctcgctctcagtcaacagcgtcttcgccttcttctcatcttttgtccagggttacggcactttcctcttctgccgcctactttctggggttgggtgagtgtacacttcctaagtcccttgagggcaggactgtgccttggtcactgttgtatctttagggcccagcacagtgccaggcacaccaaatgcaccttaaatctgtgtgagttgaacggatgaatgagttcctttctcccccagccatcttcaggccagctcctccctgcccaggacctgtctgctgctgtccagaatgctgttccttggcccactcctgagtcctccaccccacctctagttccatttttgagcctgcctccacaaagaggcctagtgggcctcagccccacccctgggctcctgtggacccagagttaccccctaccagagtctacacatttcctgcattacacaacaaaccttgctaacacccacacctgccagaaccctgacgccttgtccgcactgccccttcacttttgcaagcatggcaggcccgcttactctgcttcaactccaagctcctttctggccattcccacaacatctgcccttggaggcttttggcttgtcttttttctctggagatttattctcttttctgcaattactttcccgcccttccaactctgtaattcattttcaagatttaagatttgctctttccctttccctgagactcgcttgcctgtttcccatggtcccaaggatgggtgcttgatggctggcccacatgggagcttgtaaggctttatgtgtgagatggagtctcttcaaaagcctggaagacaaaaggggctcggggtccagagcagtggggcaggggatcaggactatggccatttgctaatgctgaattcttgaaatgcacttcaggattggagggtccatccccattgtcttctcctatttctccgagtttctggcccaggagaaacgaggggagcatttgagctggctctgcatgttttggatgattggtggcgtgtacgcagctgctatggcctgggccatcatcccccactatggtgagcagcccccggaaatccaccccaggttatctccctcctccctcttcttctgtgctccctgtggtgggttcccccagcctctggcctctctgctgatgctgtcactttctccctaccagggtggagttttcagatgggttctgcctaccagttccacagctggagggtcttcgtcctcgtctgcgcctttccttctgtgtttgccattggggctctgaccacgcagcctgagagcccccgtttcttcctagaggtgatggggctgagctgcatggggtggggtggggtgcgggctgtggagtgtggacggcagcaggggcttctgtgttcaaacaccaactggagtttgatttgatcctgtttgactgcctgccttcctcacagagtccactctccaggggactttatcttgcattctttgccttggaatgtgtccctgaggggttcttgggtggagaaaccaggggacctcttcacccatggatgacttaagattttgcagggaagggccttggccctgtcctgcatttacagctcaagagacattcccaccccctataccttcccctcctaaccccagcaggattaggtctttgactacatgcttgcccatcatttcccttacctttggtttttacattcctctgtactatggaattcccaagacctgtgcttgcctttttcccctggacaacactccccacccccaacccgcagctcttgcccaagtctgattgtcttgctatacctcagcttggggctctttcagagtggtgagtgcatgcccataggtcagggcttggtggtggggttgagggctgggaaccatttagtgtcctgtgactacagaagccaggtgggagggagggggtctataactctgggtcaggtaggggctgacttggatgtggggattgtgtctttggctctagaatggaaagcatgatgaggcctggatggtgctgaagcaggtccatgataccaacatgcgagccaaaggacatcctgagcgagtgttctcagtaagccacagccctcccgactcagacctccacgccctgcagccccagcccctacctggcccctctctgagtaccccccacctcagaccacactctaccgtaaggagattttcagggtatcatatccacctcctgcctcccattttgctaatgcaggggaaactgaggcgcctggccgatgttgggaaacacagagtgtgtgactgcccaccccttctcttgaccccaggtaacccacattaagacgattcatcaggaggatgaattgattgagatccagtcggacacagggacctggtaccagcgctggggggtccgggccttgagcctaggggggcaggtaatggtggacggggtggtagatagaagggagtgggggaagtggagaagaaggcaggactgaagtctatgtgtgtgggtgatgggtgagctgaagggaggtgggagggcagaaaagtggggatctatgggtgctagaacttagtatagtcaaggtctgactttgtctggtcccctgtaggtttgggggaattttctctcctgttttggtcccgaatatcggcgcatcactctgatgatgatgggtgtgtggttcaccatgtcattcaggtgaggagatgggtgggctgggtgatgtgtggtggttgtggtggtgtgtgggctgggagagaggtggggagaatggagatgcaggggacaagcgatgagggaaggtgccatgcagaccccctctgatcctgcagccagctcctctacttcgctagttcactcaacaaacttgtactgtaggctgaccaggattcagtttctattctgtgctgggatgaaacagatgtggtccaaggtcctcctggagtttatgttttggttaagaagcaggacgatgaggctcgtaatcccagcactttgggaggacgaggcgggcggatcatgaggttaggagatcgagaccatcctggctacggtgaaaccccgtctctactaacatacaaaaaattagccgggcatggtggtgggcgcctgtagtcccagctactctggaggctgaggcaggagaatggtgtgaatccgggaggcagaggttgcagtgagtcgagatcgcgccactgcactccagcctgggtgacagagcgagactccgtctcaaaagaaaaaaaagaagtgagacgaaacttgctatgaagcagggtgatgagagaagggtgggggaagggcagtgggagcacttggggcttgggctggggtggggacctaagtcctcaaaggtgaatgggagtcagacaggtggagtgggggtggctggggtggagaagagtgtttttggcagagggaaaagcaaatgcttgggaggtaagaaaaagtatagtggctgctgtgcgagaccctgaagtcccccaggagcgcagcaactgttgaagggaggagcagggagaagctggtgaggctggagaggagcaaggtcctaacagaggttgactccatttctcccttgttctgagatgatacacatttccgttttctcctctgcctgattctaatctctgagccttgtctgaagccctgttgtctgtttccattgtccttgactcttcagctactatggcctgaccgtctggtttcctgacatgatccgccatctccaggcagtggactacgcatcccgcaccaaagtgttccccggggagcgcgtagagcatgtaacttttaacttcacgttggagaatcagatccaccgaggcgggcagtacttcaatgacaagtatgtggggacttttaaacttcacttcttccctgttccttctacctcgtctcttttatgagtctaggggttcaagacaagacatttggggggcaaacacttgtggtttcttctcaatgcccagcttcccattacttcgctaaagagtgagtcttggagggggcatgaggatgacgggggagtgtctttcaccatcctggccttacaggttcattgggctgcggctcaagtcagtgtcctttgaggattccctgtttgaagagtgttattttgaggatgtcacatccagcaacacgtttttccgcaactgcacattcatcaacactgtgttctataacactggtaaggcggggtggctggtgggtgtcagaccaaagggttgggtggaccttgatgagaaggaacctttttcattcactatcttagggttctcaagctgagatccctggacccctgtgggaaggtggcagaggggcctgatagctaccaccaataattctgaaaatctaatggatgttggacattttcctgtaatagaatatctgacaaaaacatcaagtttatttgcctttggctgaaattataactcagtgaggtaaaattaatgcacttttgaagaaggtaaaaatcatccaaaatagcattcttgggaaaaagaaaaacaatcaataaaaggggtatttggtgcggatcattgcatgaatccactcctttttaatagtgattctcaaacttcagtatatgcacacgaaatgctggttttgtgagctagactgaaatttcccacctcatactgggcgagctttttccatgttgcaggaaaacaacaatggataggactttttattattttaaatgtttttctcagaaaaatttcctaagtccacggcatcgctactgcttatagtcagctagcacggacagaaagaatgaataagcagctaagactattaatgggagaacttggacaaagtcacactgttggacagatgatggtcattttctgctctaaagatccctagttcccatggtgatgttatttgatgttttgtgattagcactgtgaataattttgagagcccctcctactaactttcatacatgcagagccctgagccataagccgtaacagcctccctctcccatctgctatgactgcctgcttatcttggcctttgcccacagacctgttcgagtacaagtttgtgaacagccgtctgataaacagtacattcctgcacaacaaggagggctgcccgctagacgtgacagggacgggcgaaggtgcctacatggtatactttgtgagcttcctggggacactggcagtgcttcctgggaatatcgtgtctgccctgctcatggacaagatcggcaggctcagaatgcttggtaagggggagaggctgagtcagatctgatagtaggggccaggggctgcgggaggcagtcaacaggcttctcaccttgggctgtggaagagattggtcagagagttcctctctcatgttttctgtttagggggtgctgcaggatggggtggggactggcacagaagcttctctgggggtaaaggaggtaagcagaattgcaagtggttagggcacaggctttgaggttatgggttttgaatctcagctccaccacctgcctctggcctctggcaaattacctctatgagcctggttgtttcctctgcaaaatggaggtgataatagtacctgtgtcatagggttgatgtgctagatcaatgcatgtaaagcatcaattgccttggcccatggctggcattgaataaatgatggttactgatattattaataaacaattataagggaggttgaggaggagtgaaaagccttccttttggataccttggttggataccttcggaacaagtctcatcctgggctatctgaaagccagctgatgggacagggtgggctgtgggtgggtttcactgtggccaggctcatgttgctctctcctctcctggctccagctggctccagcgtgatgtcctgtgtctcctgcttcttcctgtcttttgggaacagtgagtcggccatgatcgctctgctctgcctttttggcggggtcagcattgcatcctggaatgcgctggacgtgttgactgttgaactctacccctcagacaagaggtagttggaatgtgttggaggcagggcagtggattcaggggaggggtggggtgaggaaggagggctgaatgggaagagcatccttaggggtgagaggatatacatttccattttctcctctaaaatctggtagctttggccgggcacggtgactcatgcctgtaatcccagtgctttgggaggccgaggcaggcagatcacctgaggtcaggagtttgagaccagcctggccaacatggtgaaaccctgtctgtactaaaaatacaaaaagttagctgggtgcctgtaatcgcagctactcaggaggctaaggcaggagaattgcttgaacccgggaggtggagctttcagtgagccgagatcgcaccactgcactccagcctgggcaacagagcaagactccgtctcaaaaaaaaaaaaaaaggaaaaaaaaatctggtagcttttgtatctactcctcaaagtcttaactgttaacctcaatttttggtctcctttccctttgtctctcaatttatttacattcctggtgtacatcctttacctctctgatctctccaaccttctctctccctcttggacactgcctgcatcttcctggacttcacttccctgccctccactcttcctttgcctccctcctgtaccttgcgccgtgctgcactgggggactcctgagcaggaccacagcttttggcttcctgaatgccctgtgtaagctggcagctgtgctggggatcagcatcttcacatccttcgtgggaatcaccaaggctgcacccatcctctttgcctcagctgcccttgcccttggcagctctctggccctgaagctgcctgagacccgggggcaggtgctgcagtgaaggggtctctagggctttgggattggcaggcacactgtgagaccaacaactccttccttcccctccctgccctgccatcctgacctccagagccctcactccccactccccgtgtttggtgtcttaactgtgtgtgcgtgtgcgtgtgcatgtgtgtaaaccccgtgggcagggactacagggaaggctccttcatcccagttttgagatgaagctgtactccccatttcccactgcccttgactttgcacaagagaaggctgagccccatccttctccccctgttagagaggggcccttgcttccctgttccaggggttccagaataggcttcctgccttccccatcattccctctgcctaggccctggtgaaaccacaggtatgcaattatgctaggggctggggctctggtgtagaccatggaccaaaagaacttcttagagtctgaagagtgggcctcgggtgccctctcacatctcctgttggatgctgggggagaagcaataaacctcagccctctggcctccactttcctctcaatttgggctgcaaatatgaagcctgaattttatgaaattagctttctgattcttatttattaatagattaagttctgaggcagctccgcaggactgtgtgtgaatgtgtatgtatacttacatatgtgtgtgcatgtgccatggggcggggggtatcactatactgtcctcaaatataagccaagggtaatttcagcggatgcacacacaaccctgcctcccacagttcctcccctaatctggtttctgtgttgagcctgggatggaggagccctaggccagcctgggataagagtcccacagtctagggagatctgagggcatccgacaaggcccatctccttccctcctcaagaagcagaggcctcctctggagtgagaggctccacccactacagcacaggcgggaatagcacagctgccctcccatgctccctacctgtcccctcacagggaggggagcaggggagggaaagaaaccaggcatctggtcaaaccagcagatcaaaaagcacaaagagctggggcagaggcaggaagcaggggccctcctggcagctcctctgagtggggagaggttgggcagtgagtgagggacccctaatgcagggactagaagcctcagtttccccattttacccttccacacaatagcctctgtaggttaggctgccccatcccaccctactctgtgtggctgctttctttggtgccctcccctcaccccactgtagctgtgacgtgttgtagtttttagatgtttgtaaaatgtttaaaaaaatgttaaaaggaaaaaagtgaaaataacaaaaaagaaaatcaaaattcaccttcgtcatgctgcgtccagtgccccaaccctgtggtcactctccccattttgtaacactgtaccaggtggtgactgtttaactctttggtgtctgtgctcaaaagactgccttctccagtgcccagtgtatgagtgtgtgccctgtgcccttgtccctcactccccacatgctggacgtagccctcttcctcgcacccctgggagggacccatccatctcccttgctctcctggggaaccctaaacccaactctgttgatgtgaaaaatgcagtgaaaaatattgacgaaaaataaaacggaaacaaatcctcaaaatacaaaatggctatacctgcttctgtgactctccacctacatccaattctcctaacagccttggagggtaaaatggtgagatggactgaaggtcagaataacatggtgtaccagatttacttcctaaattggcctctctaccttgatctttcccctacagatggagggccctctaagtctcccagatttgaaaactttgggagtaatgtttcataagaatagaaccaactttcctctaaatcttctggtatgctttttaaaaatatagaccccagactccactcttgacttgttgaatcagaaccctttttttttttcttggtttggaaggatagggaccttgaatctacgtttttttttttttttgagacagagtctcgctttgttgcccaggctggagtgcagtggcgtgatcttggctcactgcaacctccgcctcccgggttcaagcgattctcctgcctcagcttcctaagaggctgggattacaggtgcctgccaccacacccaactaatttttgtatttttagtagagatggggtttcaccatgctgcccaagctggtctcgaactcctgacctcaggcgatccgcccgccacggcctcccaaactgctgggattacaggtgtgagccaccacacccagccagaagtttcattttaaacaatctcatgggagttcttacctgagaaaatctgaaaaccactgccttggggttaccattgactcccctctcactctagtccatttctgttccaatcaaaccattttctgattttatggtagctctcaaataaactccttcctttccattcccacagatgacttgtaagtcagggttctaccctcactctggattgatctctgttcctccagtctcccatgccaactcacttacacatcactgccagatccatctgcccccagatgctctctggcatgtctgtactcaaaatttgtcaatgactccctactgcccaaccacatgcaccttaaattctttagctagaaatggtcaagatatatgttaaccgggccgggcgtggtggctcacgcatgtaatcccagcaatttgggaggtcgatgcaggcagattgcttgaggtcaggagtttgagaccagcctgaccaatatgatgaaacctcgtctccactaaaaatacaaaaattagccgggcatggtggcaggcacctgtaatcccagctactcgggaggctgagacaggagaatcgcttgaacctgggaggcgaaggttgtagtgagctgagattgggccattgcactccagtctggtcaacaagagcaaaactccgtctcacaaaaaaaaaaaaaaaaaaaaaaaaaa

SEQ ID NO: 12497 - DNA, 3900 bp, Homo sapiens
gggagtcaagtcaggccctgttttcaaggagacaacagagcactgaagactaacaagtgagcggacaattgcaatactgggtactaggtgctacgatgagataaacacaggatgctaaggaggcaagttacccagacttggccggggttggagaggtggaatgggaggcgggcagagaatatttccgagatttagggaaacagttcagcagaaacaacatgagaatccatttctcagtccctcatagtgaggttttggctttggtagctgcatgtgtaaaggacaggaggagagagaattttgagggagtctttccttctggtgtagttagggtgtggttatgtgtggttggagcctagggggcagctgatggtgatgagtagggtaccaggaggagaggaacgggccagaccaccccaggccttgtagcccttgttaggcaattttgtctttatcctagaagtagtgggaagctactgaggttttaagcagggatgtaacaggatgtaatttttccaggatgattcttaacttgtaaaattatttaaattttattttgtatccttaatatatttacatatttctaaatgtttttccccaacttctcattttgaaaaatgtcaaagccacagaaaagttgaatagttcaaagcaacaccctctacctttcacttgacccaccattttttgcatttatatttattttatacttgtacatatatactcatatatttaagtactttacatatactttaaaatatatttatatgcttttttggatgaaccatttgaaagtaagttgcagatagcatgacatttcacccctaactactccaatatgtatctcctaagaacaaagatattctcatacataaccacaataaccttatcacactcaagaaatttaaactatgacatacactgttttccctagcctttaaaaaaaattaaaacttccagaaaatttgcaagattaatacaatgagcaacccatttatccactcttcacctaggttcactgataagattttgccagacttggctttgtatctcttttaatgtatgtgtgtataataataatgaaataataataattatttctgctgaatcacttgagttaggtgcagaaatcttatttatttatttttttttgagatggagttttgctcttcttgcccaggctggagtgcaatggcgtgatcttggctcactgcaacctctgcctcctgggttcaagcaagtctcctgcctcagcctcctgattagctgggattacaggcatgtgccaacatgcccggctaattttgtatttttagtagagacggggtttctccatgttgatcaggctggtctggaactcccaacctcaggtgatccaccctcctcggccacccaggattacagggattacaggcgtgagccactgcgcctggcccaaaattctttttttttttttttttaaacagagtctcactctgttgcccagactggagtgcagtggcgccatcttggcccactgcaacctccaccttctgggttcaagtgattctcctgcctcagcctcctgagtagctgggactacaggctggtgccaccatacctggctaaatttttttgcatttctagtagagatggggtttcaccatgttggccaggctggtctggaactcctgacctcaagtgatcctcctgctctggaactcctgacctcaagtgatctgcctgcctcagcctcccaaagtgatgggattacaggcgtgagccactgcacccagccacaaaattcttttttttttttttgagatggagtttcgctcttgttgcctaggctggagtgcaatggtgcgatcttggctcacagcaacctccgcctcctgggttcaagcgatttgcttgcctcagcctcccatgtagctgggattacaggcgtgcgccaccactctggctaattttgtgtttttagtggagacggggtttctccatgttggtcaggctggtcttgactcaggtcatcagtccgcctcggcctcccaaaatgctgggattataggcgtgagccactgcgcctggccccacaaaattctttacacttaattgctatgtactttcaatgtgtatctcctaagaacaaggacattttcatacatatccacaataccattaccacatccaagacatttaacattcatacaatactataatcacatacagttgatattcagatttccccaactgtctcattggtgtctactatagtttgaatatgtctcctccagaattcatgttgaaaattaatccatggtgttggtattaagtggtggggcctttaggaggtaataaggctatgagggctccaccctcaagaatggactaacgccttttgaaagagcttgagggggtaagttggccccttctgtcccttctgccatgtaaggtcacctcgatggcgtatctatgaggaactggccttcactagataccaaacctgccagtgccgtaatcttggacttcccagcctccagaactgtgagaaaatacatttctgtttataaattacccagtcagtggtattttgtaatagcagcacagtctaagtaaacattataaatgtttaattttcagaaaccaatcaaggatcatgcattgcatttagctgactttaagtttgtattctgcaaagatcactggcttcagggtggagaatggattgtagaggaggcaagagtggaaacagggagacaagttgggaggttactgtagcagtctaggtgagagatgatgatgatttggaccaaggtggtggtggtggtggtggaaatggagagaaattgtggctacaggatgtatattaggaaagtaaaacctacagggtgtggtaatggcttggttgtgggagggaaagtgtcaaggataattacaaggtttgtgcatctaaagttaaaaaaaacagttcaaataattcctgtatatcctttatcctgatacctagattacccaaatattaacaattcactgtttgttttatttgtatgtacctatctacaaatatataattattttctggactgtttgagactaagtttcagagataaagcctattaaactctacctgtgatggttaacttttttttttttttgagatggagtctcactctgtcgcccaggctggagtgcagtgatgcaatcttggcttactgcaacctctgtctcctgggttcaagtgattgttgtgcctccgcctcctgagtagctgggattacaggcgtggacaatggcgcctggctaatttttgtatttttagtggagaggggggtttcaccatgttggccaggctggtctcaaactcctgacctcaggtgatccacccacctcagcctcccaaagtgctgggattagaggcgtgagccaccacgcacggcctgtgatggttaatgtcccaacttctagaggattggtgctcagatatttggccaaatatgggtgcttctgtgagagtattttgaatgagattaacatttgaattggagactgagtaaattgccctccctaatataggtgggtcccatccaaccagttgaaagcttgactagaacaaaagactgacccactccggagtaagagagacttccttctgcctgactgctttgagacccggacattggcttttctcagccttcagactcagaagtaaacactggctccatctgggtcttagactcggcctttggactggaactacaccattggttctcaggcctttgaacttggactggaactatatcatcagttctcctgggtctccagcttgccaacttaccctgaagatcttggggatcttgggatttattagcttccataatcaaaaagccaattttttataataaaactatctatcaaaat

SEQ ID NO: 12498 - DNA, 6798 bp, Homo sapiens
gcaagctctacgactcgctgctcgccctggacggtaggccccaggccggcggggtgggagatgggaggtgggaacagcaggggagtctggagcaagttttcctcacagtctgctatctgcgctgggctccaacctccagcctccgctctacaattcccccactactgccctgtgcccattgacggtccaggccagcctgctgccctgtgggaggggagggctctagggtctggcggctgtgggtccagattcctgctctgtcactataactttgaactagtcaccaaacctcttcccattgtgatgttctcatctctaaaggggaatactaatacctgtggcactctgaaagactcagttaagacccttcatccacttctccccacagtcagtagacagacacacactgtatgatgcacacctgctccctagtcctgctcccaggcctgtgtgccagcatatgggtgcatgcacatgcatgcaaacacgcatgcacacgcacacacgtgcacatgcatgcacagacaggtgtgtctgcatgcagtccctctccttctggggtgtggagatgagcctgacaggcaccgccgaagttctaactctggggtggaggtgatccacctgcaatctgcccaggagcccccagggacaatctgctccccatgggagctgggagcagagcggccttcaaccagccccattgtgccagttcaggcaggtcagttcaggcaggtcatctagcctcgctgagggacccaggtctcctgagcaccccccagggcccaggatggacccatgcacccgtgaagaggcaagcttccagctgccatgggcagaggggaaagtgactgttgtctgaatggctgctggggaggggttgctgcggggctcaggctgagttgagctgggcctcagatacccccagctcttccacctaccaaacctgaggggaccctggagctgccctcagctgcttgggaggatgggccaagcccaagagggagtccccaggccagaaagcaacagcagagtgaatcatactaccggaaaagcctgcaagggcgagtggagaatggcgttgacagtgaaggggactctcacccccacaccctgtcctcatgcccgggctgtcactcctcactatcctgcacctgccagaaggtggtctgaccccccaggccagctcctgctcaagcccctctcaagctgggctccttccaccgaccccaggcaccgacccaacccccatccccgccagcccgactcagtgtcatcccgcccaccctaggtcacatccaatcagcgcgggccctgatggtggtggccgtgctcctgggcttcgtggccatggtcctcagcgtagttggcatgaagtgtacgcgggtgggagacagcaaccccattgccaagggccgtgttgccatcgccgggggagccctcttcatcctggcaggtgagtgcccctcactcctgcacaatcacaaccatggcaggcagccccagccccagtggctcggggggccagagcagagctgagcgcccctctgctttgtctttaggcctctgcactttgactgctgtctcgtggtatgccaccctggtgacccaggagttcttcaacccaagcacacctgtcaatgccaggtgggtgccagggcttgggtcttttgctttacctcctctggggccactgacctttgtccactggatcacctggcgggggaagtggggacaggatccagctgctgtccaagaagctttaaaggggggcgccaggaggagtgtggtggggccctccataggggcgggaggcctgtgatgggcacccaggtgcagcaaggactctctaaggacctaagtgccctggctctgggtttcaatcccagctctggctgggtgcagtggctcacgcctgtaatcccagcactttgggaagccaagatgggtggatcacctgaggtcaggagttcaagaccagcctggccaacatggtgaaaccccgtctctattaaaaatacaaaaaatatctgggcatggtggcgggcgcctgtaatctcagctactcgggaggcagaggcaggagaatagcttgaacccgggaggcaaaagttgcaatgagccgagattgcgccactgcactccagtctgggtgacagagtgagattttgtctcaaaaaaatcaaacgatcaatcaatcccagctttgcatgcactgtgtcacctgggcaagttacttaatctttctgtgcctagtttcctcctctgtgaaatggagctagaacctgagcaccagttcacacatggttgtcaggatccagcaggatgcaggtgagggtgtggcaccgtgcccgggccctggacagtacccagcaagcctgagctgttttcatttctgctggtggcagcagggctgagatgacttcctgcaggaggcagcagttattctgggccaggaagaaacttgagaataagggcagatcgtggagggccttgcaaccacaggaagattttgttcctcatttgggtggaggcagcggcagtccttctggctgtgatgtgcagaatggtggggagggagtgacaccaggaaggcggctgtcccaaaggtctgagcagagagtttggggcaacagggagggagcagtggaaagcaggctgatattcaggagataaccaggacttgtaagactgtgggcatgggaactgaaggggatgctctgcaaagggcctgggcccaccttggctcctccctcacttctcagcctagccaggagcagagaatgggacagtcttaaccctagacatcccaatgggctttgggccttggggtggagagaggatgagaaaagatgtctgggcttttgcaatcgggagggatgcctggaggaggcagaggtgttgagaggcaaggggagggaggagatctcaggtacaaggtttgttccctgggtggtggctgcagccacaaagtctgccaagcaaggtccagctcaggcatgtcaggataggactcggcccccgatcccttcaacagtccccaatgccacttgggctgccaggccctgtgctgggtcctggggacactgatggctctgtctgccctcaaggggcttcccagggagccggacaagcaaggggctgaggcctcctggagaaagcatggtagtggagtcggcgcaaggggcggggtgaacacagaggatgtcaaggaaagaccccacgaagaggtggcatctgaactgggctctgaaggcagagaaggaacaggggaggcacaggagtggtgggctggggggcttggtgccccagctgggggtgccttgtgcaaaggcaccaaggcagtgagaaccaggagcagggctggcctggccagcagggtctgggtgtggagagcccagagtgccaggtggaagggtctggccttctccagagggcagcgggagcagtcttggctgggagttctgtgggccagaatgtgactgggaaaaaacatggcagggattgccccactcctcccgtgcagacctctcaggccctcccatgccccctccactggccagatcaggaaatgagcccaaggttgctcagagcaggagctggaggcccagcctctagccttcacgcctaccccaggccgggtcaccctgtgtggtgttgatattctgggctgggggggagggagaaaggaagagcattcacctcaatttatctggagatatggaagaggttgtgaggctccagcctccagctccacacactctgcccttcctctgccagggcagggactgggaacaacctgagacggcagccacacctgatgccactctccctaccccttgcaggtatgaatttggcccagccctgttcgtgggctgggcctcagctggcctggccgtgctgggcggctccttcctctgctgcacatgcccggagccagagagacccaacagcagcccacagccctatcggcctggaccctctgctgctgcccgagagtacgtctgagctccgcctgccctggccagccccccacccagtggcccccttgcccagcatccagccagcctcgcagcaccctgggcagggccactggggcataggatgggcataggtgctctgagcagcttgtcctcaacacaagcacccaccctgcaatctgagacccagatcctcagagagacaccagaggcaggacccagcccccaggcatacacacagatgcaggtccaggcacggtcttgtctgcacagcctggtgggcaccagcatgcatccctggagacaggccctcaggcaccagcccggctgtttactcactgaagagctgcttgggtgtctgctacgtgctgggccctagagatagagcagtggccaagacgtaccttagtacccaggtccttggggtgagcagaaaccttcaccctccccagtcccatgggctcctcacagcaaccccacaagggcagtgccgggatgctgaacgttcacacaaggacagggagggtctgagtttaggtctcaggttcttccagtgcgcccagggctgggggccacctacacagatggtgaggtcggaccatggcgcccctgcccccgggaatgggccccaggcagggctgctgtgagggccaaggtctggccacgctggccagtacccatgtccgggcctgaatgcacagcccctgcccccgaccccacagctcactccactaaccagctctctctcttttgactttcagaccagttgttaaattgcccgcctccgccaagggccccctgggtgtgtaatgtccagtccccagccaggctctgtcccctgccatacctagactgtgtgtttcatatttttttggaaagagaagtgaacatccagccccaatcatggtatcattcggtctgtcctcagcgtggcttggacggggcctgtgtcagagtggtcagtgctgacccctggggctcttgggcagaaagatgaggagacagaggtccagggtgggttacatagcacatccagggctaagcaagaaataattcagaggtcctaccctctgtctagggacccccctcccaagcctggccttggccttggcacaaagtcctccttgataggagatcccactcactcctggaggctgcccctgaggcttggcccagctctaggagcagtccccagggtcagggagcccctggtgtggaaagaggccccaaggtagtaaaccctgcccctgttactgtgctccagagacctcctaagggaagggacagttcctggaaggccctccagctggatgctggggatcagcgataggtgaggggacacagtgtaggagctccccatgtagaaaagggaatgtggggagggcgttaggagcttgcaggcattaggactgtcctgagcaaggtctgcagcccccagctctgctcaccccgaatcctgccccttgtttccacacctaccattcctcctctcctgatccccagcatccagctgaggtccaaggtctttgtcctagaatcagagtggggaggggacagcctggggctgcccagagactgtgggtggagctgcctgctgcactcagcagtgcggtcagagaagggcttttggtcttgaagtccaggtaccatccccccttagcatacagggggaagggcctgagaggaatgtaaggaaaccagcccagatcagtcccaaggccagagtcctttgtcctacatctccctgaaccagagtgtgccctgcccctcatgctcagacctctcccaccccaaaccctctcccgggactcagtctccctggccactgcgtatcaggcttctggggaaagcatccatcacagaacctccccttccctgccacgcaccttccttggccagctccattctggcctcctccaccacctgccttgtgaccacatctcccaccacgtccccagatctcaagaacgcagctcagcttctccttcgagcttgactctgagagggaaagtgacggaaaccaagtcagatgagatgactgccatgtacactgcagtcaagggcagggaggggaggaatgacacaaatggcagggagctgctgggggactgacccctcggcgcctggcctggccggtgctgcacatccaccggggcacaacagggacttgtccagcctctggtcagaggatgtggccacctgaccctaaataggttccccagagtcctgcccctctaatgaatgagaactgcaggagtttctcctctgggtgcctgaagctatagtgcaatggttcccaaccctgcatgcacattcgaatcacctgggggcacaatgcctaggctccaaccccagacactcttatttcattggtctgggtggacctggcatcagaagtcatgtagctcctcaggggactgtagtgtgtggtcagcactgagggctcctctatgaggcctcaagcccaggtgactctgtgaggtctgcagagggagaaaagaacccacaagggaagaggtggaggtcaggcacggtggctcacgcttgtaatcccagcactttgggaggccgaggtgggtagatacctgaagtcaggagttcgagactagcctggccaatatggtaaaaccccgtgtctattaaaaatacaaaaattagctggctgtggtggtgggcacctgtaatcccagctactcgggaggctgaggcaggagaatcgcttgaactcgggaggtggaggttgcagtcagccaagatcgtgccactgcacaccatcctggatgacagagcaagactccatcacaaaaaaaaaaaaaaaaaa

SEQ ID NO: 12499 - DNA, 13292 bp, Homo sapiens
agatcgcggtggtcgtcaagtacctgttccagtttgggttcttcccctggaacagccacgtggtgctgcggcgctacgagaacaagccctacttcccgccccgcatcctgggcctggagaagactgacggctacatcaagtacgacctggtgcagctcatggcccttttcttccaccgctcccagctgctggtgagtgtgagccttggctggcaatgcggggctgggcaggccctctgggcacctgtgctctccaccagggaggcaaggccccctcaccacaccctcccgcccctcagtgctatggcctctgggaccatgaggaggactcaccatccaaggagcatgacaagagcggcgaggaggagcagggagccgaggaggggccaggggtgcctgcggccaccaccgaagaccacattcaggtggaagcgagggtcggacccacggacgggaccccagaaccccaagtggagctcaggccccgtgatacgaggcgcatcagtctacgttttagaagaaggaagaaggagggcccagcacggaaaggagcggcagccatcggtataagcgccctgcctcacaacctcctgcctacccagttttctgagtggggctactgcagggagggtctttctcagatgagacggccaagcccagtgcgaggcccacctggatcccaggaaggtgccacttctgagccacagctcccggctctgcctacagagccgtccctgactgctgcccccagggatgctccccacgtgtagggtgactgttggcctgggctggcccctcacagttgccccagacagaggacacagccccagctgtctccttgccagtgacactgggagctttcctgtgctccgtctgcttgtctgtcaaacagggagaatgccagcctcttagggtggtcaggagccatgagccaggcccagtccccagggggcccaggcagaagtcagcttttccctacagaagctgaggacagggaggaagaagagggggaggaagagaaagaggcccccacggggagagagaagaggccaagccgctctggaggaagagtaagggcggctgggcggcggctgcagggcttctgcctgtccctgtgagtgatggcggccgggggcagctggggagtgggggtggggaggcgggtactggacccaggctgagcgcccccttccgcagggcccagggcacatatcggccgctacggcgcttcttccacgacatcctgcacaccaagtaccgcgcagccaccgacgtctatgccctcatgttcctggctgatgttgtcgacttcatcatcatcatttttggcttctgggcctttggggtgagccaggcccgggacccaaacccagtgtacgcagagctcagcagccacccacatcccctgggcttggctccccctgacctgtgctctcctggccacagaagcactcggcggccacagacatcacgtcctccctatcagacgaccaggtacccgaggctttcctggtcatgctgctgatccagttcagtaccatggtggttgaccgcgccctctacctgcgcaagaccgtgctgggcaagctggccttccaggtggcgctggtgctggccatccacctatggatgttcttcatcctgcccgccgtcactgagaggtgggcccacgcgtgggggcgctcggtctccaggggcggggcagtgcaggctgggggccctgtggggctgtttctgatggggtccttgacctggccatcccgccccaggatgttcaaccagaatgtggtggcccagctctggtacttcgtgaagtgcatctacttcgccctgtccgcctaccagatccgctgcggctaccccacccgcatcctcggcaacttcctcaccaagaagtacaatcatctcaacctcttcctcttccaggggtgagtgcaggtccgccggggtgggggtcacggcccgggcatgagggagcccacctgacgggaaccctggctgtgggcaggttccggctggtgccgttcctggtggagctgcgggcagtgatggactgggtgtggacggacaccacgctgtccctgtccagctggatgtgtgtggaggacatctatgccaacatcttcatcatcaaatgcagccgagagacagagaaggtgcctgggcccagggcgggggccgggacaagggccagggatatgccctctccctaagacagaggcactgctgccacgagaacccgtggtgctggaggccctcccagggctcggagcccatggggacatgaggcgagcccacccactagctgatcacgaggccagtgatcttggcagctgcgagtgagtgctgggcgcagaagtgggcagcggagttggtcctgttccaggcaggctggcagcagagcagggcctggtgcagggaggaccggacagccactgtttgctgcattcttgtttaatggcctttctcagagagaattcgtgcgtcagaccactcccccacgtaaaaagtacaactcaggggtttctagtggattcacagttgagcatctgccttctcaccacttcaaaaagaaaccccgggccgggcacagcggctcacccctatcatcccagcactgtaagagacccaggagggaggtactgctcaaggccaggagttcaagatctgcacggccacaagcgagaccctgcctcagcaaatgtaaaaataaaacaattagctggcaatggcagctcatgcctatggtcccagcactttgggaggccaaaggaggaggatcagttgaggccaggagttttaagaccagcctgggcaacatagtgagtgagactctctctaaacgttagctgggtgtgatggtgcacacttgtgctcccagctactctggaggctgtgggaggatggcttgaggccaggagtacagggctgcattaagcctgatcacaccactgcactccagcttgggcaacagagtgagaccctgtctctaaaaaagcaaaaagaagaaacccagtgcccattggctgtcactcggtttcccctcccctgggccctagtaaccccttgtctaggtcctggttctatgagatttgcctacagtggatatttcatgaaaacaggctcagacagcgtttgtccttttgtaatcagctttcctcgctcagcatggtgtctctgaggtccacccacgtggcagtatggccttcctgtttatgggcaaatgatattctgtggcatggatggaccacaacatgctcatctgttgatgggctgttgcccgtgatgctgccaggcacgccggtgtacacgtctgtgtgcccgtgcccctggtcctgtggctgcacgccagggccggtaagtgctggtggtggtttccatcatgaggagctgctggttttccatagcagctccaccatctaaggttcccaccaccaacacgaggttgcggtttctccacatcctcaacaacctgttactatgtcttttttgttctggccatgctgctgaacgggtagcttgctgtgggctcttctcagttccctgttgaccgacgctgagcgtcttttcatgtgcttggccatttgtgtatcttctctggggaaatgtctattcaaatcctttctccatagtttagttgggcttttgagataggatctcaggctgaagtgcagtggcatgaccttcactcactgtagcctctgcctcccaggttcaagcgattctcccacctcagcctcccgagtagctgggactacaggtgtgcaccaccaggcctggctagtcttttgtatttttggccaggttcgtctcaaactcctgacctcaaagtgctgggatgacaagtgtgagccgccacacccagcagttgggttgttttttattagagttttttctgtttttctgcagatacattggctagaaatgactgaattggaagaattctctgtattctctggttgctagaaccttatcaattaaaatttgcagaaaatttctccaattctatggactgtctcttaaattttcttggtgtctttggaagcacaaagtatttattttggtaatatctggtttactttgtttccttcgccaaatccaggttcatgaagatttgcccgttttcttctaaaagttctatagttttagctctgaagtttcgctctttgatccactttgaggtaaattttggcacatggtatgaggcaggagttgcgtttcattctcctgcctggggcggtgcctgcaccgtgttgaaaaaggttgtccgttcccactgaacggtcacagctcccttgtctaagatcaacgacccctgaacatgagggttccaactggactcttagttctactccactggcctgtgtctgcccaccattactaccgccgtgccatactgaggtcaggctggggcttttctgggctgctgggtgagctggagaatgcggttgtgtgacccgcaggaagggcagagctgagcgtatgacctgtgtcgttcccctccagaaatacccgcagcccaaagggcagaagaagaagaagatcgtcaagtacggcatgggtggcctcatcatcctcttcctcatcgccatcatctggttcccgctgctcttcatgtcgctggtgcgctccgtggttggggttgtcaaccagcccatcgatgtcaccgtcaccctcaagctgggcggctatgaggtgagcatgtgtgggtccgcctgtccattcccatcccctgggggttctggccaaggcggtgcaccacccccagccgctcctccacgctcatcttcgtggccccgtgtccccgtgcctgccccagccgctgttcaccatgagcgcccagcagccgtccatcatccccttcacggcccaggcctatgaggagctgtcccggcagtttgacccccagccggtaagtggcctctgccctgtgaaagctggtgtggggaggcggctgcagtcactgagggtgtcacttgtacccagctggccatgcagttcatcagccagtacagccctgaggacatcgtcacggcgcagattgagggcagctccggggcgctgtggcgcatcagtccccccagccgtgcccagatgaagcgggagctctacaacggcacggccgacatcaccctgcgcttcacctggaacttccagaggttcgtcctggacttggggcagtgcctgggtgggtggacccactacagtgggtcacgctgtgttcccacccccagggacctggcgaagggaggcactgtggagtatgccaacgagaagcacatgctggccctggcccccaacagcactgcacggcggcagctggccagcctgctcgagggcacctcggaccagtctgtgtgagtgaagggcccgggtggtgggcaggagggctgtgccaggttggctgggccaggcctgacctgccagcacctccctgcagggtcatccctaatctcttccccaagtacatccgtgcccccaacgggcccgaagccaaccctgtgaagcagctgcagcccagtgagtatgggcgtgggggttgggggaggctagagaggggtgacctgcggcctcaacgatcttctccctccatcccagatgaggaggccgactacctcggcgtgcgtatccagctgcggagggagcagggtgcgggggccactggcttcctcgaatggtgggtcatcgagctgcaggagtgccggaccgactgcaacctgctgcccatggtcattttcagtgacaaggtcagcccaccgagcctcggcttcctggctggctacgggtgagtgagtggctggggggcaccccgcagctcggggggctccgggcggccccaggactcaccagcttcccccgcagcatcatggggctgtacgtgtccatcgtgctggtcatcggcaagttcgtgcgcggattcttcagcgagatctcgcactccattatgttcgaggagctgccgtgcgtggaccgcatcctcaagctctgccaggacatcttcctggtgcgggagactcgggagctggagctggaggaggagttgtacgccaagctcatcttcctctaccgctcaccagagaccatgatcaagtggactcgtgagaaggagtaggagctgctgctggcgcccgagagggaaggagccggcctgctgggcagcgtggccacaaggggcggcactcctcaggccgggggagccactgccccgtccaaggccgccagctgtgatgcatcctcccggcctgcctgagccctgatgctgctgtcagagaaggacactgcgtccccacggcctgcgtggcgctgccgtcccccacgtgtactgtagagttttttttttaattaaaaaatgttttatttatacaaatggacaatcagaggccagtcccccgtccttgccttccggctccagtgtggtgtaccaggtggccactgcctgctgtcccggcaagcacgtcctcacgctcagctctggcccgcctcgtcgtcactgtcctcaatcagacagtcccggatctcctgcaagccccaggccctagagagaaagctgcagtgggcaccagccccgaggccccttacccacgcgccacggcagtgtgggccccagtacctctgtgtgcggagctgggcctcagccaggatgtacggcggcagggggtccagtgagggctgcaacagaggccggtgtcgaggggccaagaaacccgccagcaccccctcaagccacccacgaggtgacgacagccttcccgcgtccccaagcccggcccaggacaggtgggcacgtactcaccaagtccttcatgttcacgcggcagctgtagcacagctgctcctcaatgcaggcttgggggtcctccctgcgggagcagagctggctgtgtgcccaccttggcacctcaatgccgtgcagtgtggggtaaggacaggtccccctcccgccccatgcagctggccatgggtggcagggacagggactcacctcctacaggccccctggccgcagcgctgggcccagcccacccctggagaacagcagggccccgggggtgtccgggtctcagtcagggggatgggtgactgcatctgggagagacgcgaggaggtctgagccccaaaagccgtggcactgtctgcaagcagagagggggtgacggagcctggggctgctgagcccccacacccactccctggctccctccccgcatcaccccaagagcatgaaacacagaccagcggcgtcgacgtccagggcacacatgcagaggaggcagcgggggccggagtcgccagcagcagggccatcccgggggcccttcaccagcttctcacttgtcctgtggccggattgtgggaggagcaggtgaatcacacgggctggggctccaccctaagccctggcctgagcacgagtggtgagctcaccacccgcacacacccgcacacacccgcgcacagcacacacccgcgcaccccccgcacacacccacacctgtacacagtgctgacagtggaggggaactgggtctgcagcctgaggatgaaggcctccatcagccggtggatgctggccttttcaggggcctagggacaatcagattggaggctatgggaaagcccagaggccagccccaggctggggcagagtccccagggcaggtgccgtgggttccacgctgctggcccacatgggtctggctttgctgcgactgctcaaggcagccagagaacccgcttcagcagtgcacccactgtggggtcctcctgtcacccccacaccctcacggcacagggtgggctcagaggatgcagcactgctgggggccacagcaggagtcactgaaggtgtgctggtgacctgagcctgtgagaggctgcccagcccacatggcccaccctggtgtcaatggtgagagaggttgcccagcccacaaggcccaccttggtgtcgacggctggtgtgaagacagaaggaacagagaacaggcggttgtagaaagcgacctccttcagggtgtggtcccgcatgggccgcaccaccaccacgtccccgtgccgctcatccgagaagccctgcgggaggcaggggctgtgtggtccaggtcaaggcccgaatgtgcttgcccctcctcccctgccaggtaggggaggtcacagaccccaccaccatccgaggccgcaggactgatacgcgagaggctactctccagtaaaggtggccgaaggggtgaaggtgaggatgggcctcctgaacacccaggcccctgcctaccgtatcccaggccaggaaggcccctcgacccagcgccaggttggtcatgagcttgatagccaagcgtgtgcagctgtccccagtcatgaccttggagtagccgtgggctcgggccatgtggaggatcaggtgggtcctaaagcacagagcgtctcaggggcctggggggtgcaggacccggggaaggggggctctcgggtatgagtgggggtcagggcccggggaagggggctctcaggggtatgagtgggggtcaggacccggggaaggggggctctcgggtatgagtgggggtcagggcccggggaaggggggctctcatgggtatgagtgggggtcagggcccggggaaggggggctctcaggggcatgagtgggggtcagggcccggggaaggggggctctcaggggtatgagtgggggtcagggcccggggaaggggggctctcgggtatgagtgggggtcagggcccggggaaggggggctctcatgggtatgagggggggtcagggtccggggaaggggggctctgtaatttcagcagtgctgtgccatgcgaccatcgtgagaccaacaccccactcctcaacccggcaaagccgacccctctcctctcaaccacccagcccacagaaacagcctcctccggtctgcacctctcatgagagtgcagagaaaccaagcacatcccgctcctgtgccctcctgagaagcaaaacatgcctcagacttcctgagctgacccctgacaggccacgggcacagccccaccacccccagccgagccctgtgtgcagcctaagcccgcctccacctccctgcgcgggccgcctcctccacctcaaacgctgctcctttgcgtctcctggcaaacccccgccccattcccaatcttccctcgggtcacacatggctgagccaagatgcagctttccactgactgtgtttctacgcaggttgagcaaatgcacagaagtcaagtgggccgcacacacgcactctggacccagcttctgattggtgcacctgctgtaaacacatctgagagtgggccgcacacacacactgtggactcagctcctgattggtgcacctgttgtgaacacatctgagaaccccccaagtgtccaggccgcagggtggactgctctctagccccaaccaagagcccctcagcaggctgagaagggaggcccccagcctgaagctcagcccagcagcccgggcccacggggtggtgaacacgcacctcaagaacctgccagaccatggagctggacgaaggccccccagaccacgccaagagcacctgggggagaaaaaacatcactcagggcaccgcacctccaacacaggcagacaccccacctcgtggacatctaggacatcgagtctgtcctcaaaggccaaggaggagctggcgggctgcagcaggccaggctgcctgtgggagggacaagcagggacctcgaggggccaggctgctcagtcagacccccaggacccagacgctaccttctcgcctggaaagatgagccggttcttgcccagcatggctctgaacttgtggacgtagaaggccttgaaacagtccctgcaacacagacctgagatgagggaaccgcctgctacccgcacagtgagcagcgtcctgaggcgctgccaggtgacgacgtcctttgccaatctccatctttaaaagcagcatcttcacatccaggctctgtccagagactggtgaaaggggcggggttggcccctctggcagtggcttcctcagggtgaacacgaggctcactggcccctcccacgaccaggtacaaactgcacagccacggaggctgcatccagcaaacgagggcagagccccggcacccctccccacaggcgctcagaagggcccagctggtggagtggacagacttaggcacgtacagggcaaggccaacccagaccccataaaaaaagacccaccacatacagacaccacctcttggaggtgaaacgtggaaatggagcgggccacagcgaggacccaccatgcagagacaccacctctttggggtgaagtgcggaaatggggtgggccacagcgagggctcagtatcctggggccccagagctggcatctttagtgtgctgggctcaactgggccaggaatggctaagaggctcactcacagagtggcctgggctcctcccctaaccccacagaatcagaacttccaggcctgggaactgcatttttaagagacagggtctcgatgtgtcacccaggttggagtgcagtgccacagttatagctcactgcagcctcaaactcctcgattcatgtgatccttctgcctcagccacccaggtagataggactacaggttacagatatatgccaccatgcctagctaattgttgtattttttgtagagacaaggtctcactttgttgcccagactggtctcaaactcctggccttaagtgaccctcctgcctgggcctcccagagtgctgagattccaggtatgagccactgcgcccagctgtaatctttgttcataataaactttccagccatctgactctggctcactacgtcaggggttcttggccctggctgtatgttagaattgcacaaaccaattaagtcaaattgtctaggggtgaggcctaggagtctgcattttaaagctctcctgcaatcctggcaggcagggtgaagagcggcacccggtacagagcggacaatgccactgcaagagtcaccctgcacctggggctctaagtctcttccttcctgtcagacacacttgatgtgcacagcagtccctccctacgttgaatggataccacgtacaagaggccgaatgacccccctgtggttcctttacagacagtaaagcaagtctgtgtttaacagcaagatgccaggtgagggactgcaggtaactggcaagtatcaaggctgggacatgggaagtgacccccaggacccagctttgggcgtggggagtctcatacaaggagacacaggtgctgggcttcacctccgcactgtggaccaggagagcctctgcgccctacaccaccagctgggattcaagcgtggtgggtccacgtgtacatgctgcgtctgggctcctgaaaccacgctgtcccctgtgggtcagggaaggccaaggtttctcccacgtgctgacctgaatgatccctggggatcccagctcgatgtagattcctaaggccttcccctagagagccggctccccactgttccttgggaccagcaagcacagcaaaagcccttctggccacaagggcctagcatacagccacagcagcctctcctcagtgaattctgccggcagcctggtgtgcttggcaatttcagatgctcctgggtggttaaagaagtacctaccttggccaggtgtggtggctcatgcctgtaatcccagcactttgggaggccgaggcaggtggatcacttgaggtcaggagttcgaaaccagcctggccaacatggtgaaaccctgtctctactaaaaatacaaaaacaattggccgggcatgatggcaggcacctgtaatcccagctactcaggaggctgaggcaggagaatcacttgaacccaggaggtaaaggttgcagtgagctgggatcatgcactccagctgttgcactccagcctgggtgacagagggagactccatctcaaaaaaaacaacaacaacaaaaaaaaaaccacgcaccaccactgggaattaagagggctaaaaggagagagacctggtcctcccttcagggagctatgagtctagtggaaacaactgaacaatacaatggctacaagccaagaaagacatgacaagcgcctgggggaaagctagaggtcttccaagcctctatcctgccacagatgaaacaagcatctcacacgagattaaaaactttcacccagaccatctgccaagttcccaagatgctctgatccgcccctagatgtattccagctgcccccaaacgcctggtcctcctacagcttatcccagtctagacaccacggccccacttccaactgtccccataagttccatcagaaacctcatcaggggatctgtggctagctcatgggaaactttcccaagcaggaaaccaatgctttcgcctccacttcaacaccaggggcacgagggaccccatcaggagcaggaataaagtaagtacatgtttttaaaaagaattaacaaagcatcacaagttgcggctatcctgtctgctagcgaggccatgtttgccagggtctcagccacctccaggcctcacctgcagaaggcatctccggctcgtatcaccacaacgggctgcgcttccttgcacttcacacacttctgctcacggctttggagatgggaggggggagaagagagaaacacagatcacatcttccccacgcctagtgggctttggggagacagctcctgtttctcaccctgagttgggtcagagaaaggcacctcggtacacacacaaacccaggcttgtgttttgtccaaacttcaagaaaaacaaaggctctggggggatgtttagcctagaaaagccggctcagggggcacataaaggccgcttttcagtctcccaaggctgacacggggaggcgagacagcttcacggcaccagttctctccgaataaggacagcactgtcagcggcagagccgtccccagtggctgctaggatgagaggcgcgagccagtggagtaagtccccttctaggtggccgtcaccgcttgacaggcattccccgagtgctagggagcgaggtcccgctctccacgcggggcttcccggagcaagcccggccgggacccttcggggcaggagtgcggcgggaaggcgaggggcggcctggcgggtccggccgccagctcttacctgggccgcggcgccgggggcggctcctcaggcgccggctccccgtagtcctcgcccacctgacacatgggcacgccgggtcccgtc

SEQ ID NO: 12500 - DNA, 7303 bp, Homo sapiens
ctgtctgaagttctcccaggagttggtccaggtccagaagtgagccttgtgctgcccgagggtggccgccatcagcgtgtcgccacggtaatagaagataggcctgtgggatgggaggggaggaccatgtaatgacaggaaggacacgctggggccacctggaggctctgggctgcgtctgtcatcagtggctcatgcctccacgtgaggtcttggttgatactttacaaagatgattgaaaagtaaaaaggcccgcaaggtggctggggctggggtgcctgggcggccggggctggagctcctgggtggccagggctggggtgactgggtatctggggcgcctgggtgtctggggctggggtgtgctgggcggccggggctggggtgactgggtgtttgggcggccggggctggggtgactgggtgtctagggtgcctgggtgtctggggcgcctgggtgtctggggctggggtgtctgggtggccagggctggggtgcctgggtgtttgggcagccggggctggggtgcctgggtggccggggcgactgggtatctggggtgcctgggtgtctggggctggggtgtctgggcaaccggggctggggtggctgggtgtctgggtggccggggctggggtgactgggtgtctggggtgcctgggtgtctagggctggagtgcctgggcggccagggctggggtacctgggtgtctgggcggccggggctggggtgcctggatgtctggggctggggtttctgggcagccggggctggggtgcctgggtgtccgggactgggattcctgggcagctggggctggggtgcctgggtgtctggggtgcctgggcggccggggctagggtgcctgggcgtcccctcattgctggtccttggcaaggctgggccagaccctggggagggtgggcagacaagaggataagcaggcggcacggggtctcctgaccatgttgggcctgcgagtcaggaacggggagtgggggacgcagctgggcaccgtctctccccacagtgaccaaccacttgtgccaggtctcgagaggggacaagtgagcaaaactccctctacccggccccagatagccggaggcggcagctgccttggggccgtccccaccttgcttcccgttgagcctttggaatcctcatcccttcaggaccacccaggaaacgtggtttgagtggaatggtggctgctctcagggggtaggaaatggactttggacactaaggatttggacagaaggtaagagctgggccatggacttggcagagcagcgacttggatggaaggaagaaggaagctacaggaagccatgaggcaccaaaaaccaggctgggcagggaacaggggtggggcagacaggggcagcgtgtgcccgggctacagacagggaacaggggtggggcgggcaggggcggcgtgtgcccaggtacaggcaggcaacaggggtggggcaggcaggggtggcatgtgcccgggctgcaggcagggaacaggggtggggcggacaggggcggcgtgtgtctgggtacaggcagggaacaggggtgcggcggacaggggtggcgtgtgtctgggtacaggcagggaacaggggtggggcgggcaggggcggcatgtgcccgggtacaggcagggatgaggcccctctcctggccttgccctccctcctaaggctttcttgaaagccagggcctcgctgtgcttggaccctcccaggatggcccctgccccacaggcaggtccccaggtcctctcgtctcaggcacccctgcctcctcctgccctgggcacgagcacgcctgtgtccagaaccaggagggctgctgggcctgggggttgcacctgattagcagctctgggcttcactacttggatcgggggaaggggccggggcaggtctagcaccaacctgtccatcagccggccctgcaggagggtggggaggaggttgaggccatcaatggccctgtcgctgggcggcgtcaggcccgcaagggccaggctggtggtgaagaggtccatgatgctgcccagctggtggctcacctgaaacacatggcagcaacacggtcagggcactctgcaccgacccgatggggctgggggccaatccctgggggggcgtgagccccgctgcccagctgggtctacagatatgcatacatgctcacacgcccacagcagggactgagcggggtcacaaggcctgtgagagacagaggagcctcaaaccaggcccaaagaccccagagccaggccacgccctcactccctggcacccttctctgcctctgtggatcagatgaaaggagaatcacagccctcccagggagatgcccctccaggcccacctgtccggagaggatcagcctcgctctaacactgaatgccctaaggccactgtgagccctgccccttaagtcagaggagcaggtggagaaaaaccagatgtggaggggcagctgaggctggacaggagcagctccgagtggctggggtggggacggctcctgacacacccagagagctccaggacaggcaggaggctgtctttcccgccgtgccttgacctccggagggcgtgggcactgctgaccagccatgagcagagcgtgccatctggcttccctcagtggccctgtctgcttcttgttttttgtttttgttttttgagatggagttttgttcttgtcacccaggctggagtgcagtggtgcgatctcagctcaccacaacctctgccttccaggttcaagtgattctcctgactcagtctcccgagaagctgggattacaggtatgtgtcactacgcccggctaattttgtacttttagtagagacggggtttctccatgttggtcaggctggtctcgaactcccaacctcaggtgatctgcccgcctcagcctcccaaagtgctgggattacaggcatgagcccggcggccctgtctctttcttaactcgggggctccaggcttgggtcactcgacggggagactggggtggggctggagagacacccctgcctggcaagctcagcccctggggcagctgggcagggaccgccatccgctgccaggccctggagctcccacccagtgtcgacagccctccccacggtccaggggcaccctcgccgcctgcagccagctcctcgctagggcagacggcgatcgccagcttctccaacagaggagccctggcctcacagggacactcactccgcgctgcagccgctcacgggatgtggggtctgcagcgcccagtgtggggcagggaatgcaaagctcagcgtttgccaggaaagttcaggaagctttgcagaaggtgagaagcttccccaggtctggtcagcagtgtctgtgcgactgcttcccgtccttcccgtgtcctttaaaggacagaataataaaggaaagaaatccagatgcttttgtcatctgaaaaaataactgcggagcagtgcttgtggtgccggcagggcgggcgggcgggagtggtgtcagcacaggcagggtcctcgtggagcgttttcgaagaactctccaggcagcgatgccttccagaaacatccagaaatgcagtgggcagctgcggctgtgggagaagtcactgaaaccgttatcagcgctttcgagacttcactcagaatccagggctgcagggactaaagcctcccctgcccagagggaactgtcgggacagacgtcaggcgctttcactgaaaccccgtcgtggtgtcctggtgcacaggcctgatgccatcgaattcaatttcactttgtggcccacgggaaaaggcaacttggtggctctgggaagagggtttcccttcctcaggtggggagagggtttcccttcttcagggagcgaggcagatggcaaggttccaaaacgctgaaattggcatttttctcagctggagcctttccgtgggcaggtgggtggggaggtctgtggggtacagacgtccctgaacccactacgcatggagccgggcggtgctggggtggctcccctcaccttttccaggctgctgctgagcacagccacgggtggctcccagcctggggagcagagccccagccctgtcccggcctggtgggcacccactgcagtggggaacctcacatctcccagacctacgcaggtcccgagtctcatgccatcgtctcccagacctacgcgggtcccgggtctcacgccatcgtctcccagacctacgcgggtcccgagtctcacgccaacgtctcccagagctacacgggtcccgagtctcatgccaacgtctcccagagctacacagttcctgagtctcatgccaacgtctcccagagctacgcgggtcccgagtctcatgccaacgtctcccagagctacacagttcctgagtctcatgccaacgtcacagtgttcactgagtgaccaccggccactccctgcaggtgcccccacacaagaaaccaaatggcccatccctaccctcagggggatggcgctcaggggagtggagggggcggcacagctgcattctgtcctaggggcaccccacaccacaaaggaggccgtgcccaccacccatgcttctcctgcacaacaaggcggtcactctcacagccactctgcccttcacacggagccgcagctgccttttcagtgaaccgtggggtctcttccaccttcagggtcctgggaacttggggtggcccaggagtcccatgtcagacaaaggctgccctgggcagggtctgagggaggcccagacagctgtagagaacaggcgcccttggcagttgccgcccccagtcccactggctgctggggacacaggggactgcccaggcatggtgggcaggagtgcaggatccacagccaggcgcctgctcccacctctgctccctagtaattgggggaccctgacagacgacttcctctctggcctcagtttcctgatgtgtagaatgagtggggaagaggaggatctggcagaacagcagccaatccctgggccttcaggcgcgcgaccaggccaggcaattgaggcggcagacacaacgcaggccgctcatcagcgaggctcgaaacagggaggccagcctgggtgagcagggggtggggtgggacacagccacagggtcctcaaaagtggaacaggcgccgggcgcggtggctcacgcctgtaatcccaacactttcggaggccgaggcgggcagatcacgaggtcaggagattgagaccatactggccaacatagtgaaactccgtctctactaaaaatacaaaaattagccgggcatggtagagcatgcctgtagtcccagctactcgggaggctgaggcaggagaatcgcttgaatctgggaggtagaagttgcagtgagccgagattgcactactgcactccagcctgggcaacagagtgagacttcatctcaaaaaaaaaaaaaaaaaaaaaaaaccgtggaaacaggaaggccagggcacagatgcctgcgtgctgctggctttgacgggggaggggccaggagctcaggaatggggcagctactaggattgggaaaaggcagggaacagaacatctcctggagcctccagaaggagctggccccacgcacgtcttcactcagccccatgagccccatgttgactctggctgtcgtcatgtgtgatgttccagctgccactgggagccccccccatcctcgtggggccacttgaaggggatggctgcctctggaggccattgggagggcaaaagactaagaaacagtgaagaaacagcggtcgtttacaaacaccagactcagccccgcgtgttgatgggtatgtctggctcaagtgcctgttacagaagaccacacggtgtgattctcaaccgaggggcagcttcctgggccagaggagatgcagtgacagcatgaaggtggtcacactgagatggcagggcgcaccctcgcccagccaggacccaggccaccaccgaggtccgcaccccatgcggcagacagacaccaacggtctcgtgtcgggctgctgctgttctctgagtgtccttaggacactggcctgagaagatgtgctttgggggaaaaaacgaccgattctgtagtagacagacaggtttttaaacactcagcctgctctaagccccttctagaagctcatggtgcccaccagcatgctaaaggcactgataagtcctgcagggaagaaacctgtttagctccatttaactcaggactgctgcggtgactggaccacggatgtctcctcaccacacagtcattaccagcacccacgtgacacacggcagtatacgtggctccagtccccaccgagagccttcctgcctgtctgaccaagcacagcaagccctacacaccgagagccaccgagagggacctggttccgaggagagcggtgaggccgagcacggggtgcgtggggaggagagcggtgaggccgagcacggggtgcgtggggaggagagcggtgaggccgagcacggggtgcgtggggaggagagcggtgaggccgagcacggggagcgtggggaggagagcggtgaggccgagcacggggtgcgtggggaggagagcggtgaggccgagcacggggtgcgtggggaggagagcggtgaggccgagcacggggtgcgtggggaggagagcggtgaggccgagcacggggtgcgtggggaggagagcggtgaggccgagcacggggtgcgtggggaggagagcggtgaggccgagcacggggtgcgtggggaggagagcggtgaggccgagcacggggtgcgtggggaggagagcggtgaggccgagcacggggagcgtggggaggagagcggtgaggccgagcacggggtgcgtggggaggagagcggtgaggccgagcacggggtgcgtggggaggagagcggtgaggccgagcacggggtgcgtggggaggagagcggtgaggccgagcacggggagcgtggggaggagggtggtgaggctgagcatggggtgcgtggaggctgagcacagggtgcgtggggaggagagcggtgaggatgagcacggggtgcatgggggaggtggccagtgaggggcgcacacaccctgggatggctgcaggcctggacctgctgcccggcagaccggtggacgctgactcacctggcctgcagtgacgtgccctggccaccatgcgagggcaggctccctcatccctccttcaaacgtggtctgcttcccacacagaaaggggccgttgctgccacc

SEQ ID NO: 12501 - DNA, 9252 bp, Homo sapiens
agcggctgtgactagcgggccggcccgggccaggacagcgggcggcgggcggcgcgggcctggccccgggatggctatgttccgcagcctggtggcctcggctcagcagcggcagccgccggccgggccggcgggcggcgacagcggcctggaggcgcagtacacctgccccatctgcctggaggtctatcaccggcccgtggccatcggcagctgcggccacacgtgagcgcgcccgcccaggggccgcggggagggggccgtgccccgccgcgggaggggtcgcgaggccggcggccgccccggtgcagccccggactgggcgcgcggggactcggggcgccggggcctcggggcgcgtggggtccgggtttccctgtgccgcgccgcctctgccctctgggcgcgttcatcccccgcccagcctccttcgcgccagccgcaggcgcccggtccgactgctgcttcggttcaccgggcgacctgcggccctgcccaagctcggggtccccggcggctgcggcgggcgctccggtactcagagggcagcaggtgccaccgctccgccagtggtggtggatttgggcttgtgcggctggaatgggcagttgtaaataaataacttgtagtttttgctatcaactcttgttcggacccgctgtctgcctgttttgactacagaggaaaggagttccctaaagtttagaggggcttgtttggagtctgatgttcttagttttgtttgaaggagaacttgggtcacaccgatcactgagtagccaggcaggctggtccacagaggagcagacactgaccaccttgctggggtttccagctgcaccagggctcacagccggctcctccagggtgtttcaggaacagaaactggaggacgtggctctcctggcggggagctgtgctcaagtattctggagctgccagccccgttgggaggaagcctagatcagtgtctgctccctcctaagtgctgaataatacagctcttgagcaaaatcagcagtggcaggggagagagagagcaggagggcttccccgcagacatccaagctgctgaggtggtggagtggaggggggtgcacccagactggtaggaggctctagaacattttgcaagcaaagtcagctgacttcaggggctcctggtacagagggagctgggactgctaggtggatgtgtgctggtcacccacggaggtggcagggccagtgtcaggatgcagagctgccttcattacctgtgtcaggcagcacaggcgcctgcccacgctgggacagctctacctacttctcttgtgaggctgctacaggctctgcccctgctcctccatctcacttagccgtgacattttgggggggcagcctctgaacgggaatatttttttttgagacagagtcttgctcttgtcacccagcctggagtgcagtggcgccatctcggctcaccgcaacctccatctcctgggttcaagtgatcctcctgcctcagcctccagagtagctgggattacaggcacccgccaccacgcccggctaattgctgtatttttagtagacaaggggtttcaccatgttggccaggctggtctcgaactcctgacctccggtgacctgcccgtctcagcctcccaaagtgctgggatgacaggcgtgagccaccgcgcctggcaggacttccttcttgtgagcaggtagcgggtgtttgaaggtggttccgcaccttctcatctgttactgagcgctgtgaggcctgacttaggccttgttttagaaaagcctcccgtaggctttgggtgccaacaccttcaccgtgtggtcggccacagcatctccactttcctaacctgcacaaattggtctttgcccttctttttcaaatatgtcttttcctaaaatgtagtttccataacacagaatgcagaaccacatggaattgtggagcatctttcctataaaactcccctctgccatgcttttcttggtagaatgacgaccatcctagtctcaccgcgggtcctgcaagagcttttcacacagcctttgcctttcaaagatttttctccccgacttttcctgctggcttttgttttctggctgttctctctctgcttctaactttgtttcttgttggtgttgctaaggcatgcatgcaaatgaccacagaaagtttaaaggctcttcaggttcccttcggaagtttgttgctggtctggttctgtcccctccgcaagctccccaaccagagcaacttcctcctccagggtagatctctcatggcaagagtatcccagtgtgggggcatgcaccctgctctagccctcgcgcaggaggccccctgggggcccagcaggagctgttctcagccaggggacagtctgagcagtgagccacctctgtaaccagaagcctgtgggccaggacacgcgtgatcacgaacctgcctggaagggctgtgtgagcagcctccactcgtgcaggacagctgtggggcttgctgagggtgctggcctgccagccaggcagatccctgaggcacgggccgtcccagcttctcagcttgtgcagcggccagtgtgggagacacattggcagtcccgggtgcctgctgggagggccagtgcgcgatcgcccctccctttgtaaggctgtcgacgcccccacacccatcgccctcagccacttccttcagctgagaagctgctcagcaccagcccctgggtgggcgcagacaggaacttcctgtgggggaagcgggcactactcccggctgctggctctctgaacaccaggctggcagtcactggaaactaggccgatagagcacccaccctgtgggtgcctcgttctgcctcctgctcctcgggcccagccgccctgccagtcgggctgggttccctcttgtgtctttcctgagtccttccggggaggacgaggctgtcttcctcccagccaaccttctgggcacctttcctctcttcccaagctctgcctgggacccttttccttcccctcagcccgtggccgtgctgtgcagccgagccccggcctggtctctggcagctcagggttcactcaggaggtgcaccatccagtcgtttccagtgtgtttgcaattatgccacaatcgatgcaattctagaagattcttcccactccagaaagaaacccaggactctccccctcgcctggcacccacccgtctgctttctggtcactgggtttctctctgctggatgttgagcgtgagtggacccccacgacacgggtgggacgtgcttgctgtctgccctgcactgttttccaggccttccggtgcgtggtggggctgcacgcctcttcccggccgaacgccctttccatgggtgtgcacgccacgccgtctcttcatccgtttaccgacgggcacctgagctgcttccgcttctcctgccatgagtgcctgagtatgggggtcccctgaggcctccccaggtggaccatcttgccagcaccttcctcccgtgaacgggtgaagtaggcggcccccccggctcaaatccaggggtcagtgccagggatgaccctggaaatatctgctggggcgcctggtgagaactcgggtgaggtgggtaaagtgagcgacctctttactctgcagaaaaaggcttgttcactttctgacgggtctcaagctgagtcccactttctctcacacgaagtttcatggtgggagccaccagccaggtggtggctctgtgggaatccagtggtggcagagagggcctgggggacagcaggagggacttaagatgcctgcttggccacctttgcctgaggccctcagacttcctccttgcagaaagggccttttcttgagggatgtggaaatctcttgacagcaaagaggactctggccctgaattcagctgagtcgtttgtgaacccagggcctgcccacagcccctctgtccagtggggctcctgtaccagccctgtggccttgccagggagaagggaagctacacccccgggtgctgtagccttcctgggactggggggctctgcctcagttacagctcctcgccgcagctcagctgtccccacagtgctcctcacaaggccagatgtggctgccccagtattaagctccttctctgtgtttgcactgggggctctcgcgcctggtgctcccactggctggtggtgcacccctccaagggctgtgtgcgtctgcagagcgggaggcggttgtagatagcagcaggagggtgtgcgagcccaaggaagcccctgctgctggagcccggagtgcgcacggggctgtgggacgctcagtctgtcctcacgatgtggtgtccccaggggcagtgccaagagccagggcccatgggtgcccaggacccgagcctccgcccagatggagcaggaccccctcctgcctgcgaagctgtcccaagcctggtgactgccacccagcctcaggatgtgctgccacttggctagctttggcccttccctgtccagtgcatctggagcccctggggcctggccgtttcctttcccacgattgtttgaggttttatcccccagagtgtggagccgggagagtttccagagtccccgggctgtccctgcgccccacagcccacccaggtgttgtcgccacgtgaacgtgaacctggtagcccgagctggggcctcctgcctatgggagctcctctggcccactcgtggggacagccatagtgacggctctgccgctagccagaaaccacaggggcctactgtcaggagggaccggggccaccctttagccagatggggcccatccagctggtgggccccggacataggagtgaccatctccagagacggcgacagcggtagggggagctgcccctgtggaccccacaaatgctgggtcctaagaagggccccgagcaaggcctgcggttcgggagacccgagcggcgggctggcactcaggcccctgtgccctgcaggttctgcggggagtgtctccagccctgcctgcaggtgccatccccgctgtgcccactgtgccgcatgcccttcgaccccaagaaggtggacaaggccacccacgtggagaagcagctctcatcctacaaagcgccctgtcgaggctgcaacaaaaaggtacccgcctgcttgggccgccctggagccggggtcacttgatgggcagcctcagcccacgggttctgcagagggtgggggccggggccctctctctttcctgttgagtaatcgcggtctctgctcctgcaccaggaagccagccccggcgcctccctcccctcccgtcttcatctctcacttcctgtggtgacggctgacgggggggccagcccggtgggggtagcactgtcagagccgcctagcccgggccaggggaacccacgtgggttgtggccagggtaaggaccagggggctgagctgaaaccttcccaatgcagccttcccctgccagccgataccggggacggcgctgggggctccaaggtcacaagggccgcgggcacagtcaaggacatctaagggccgagcaccctccagctgccaggagggccagagccgggctgatgggcactgccacacccacatcagagcagcgtaagggcctgcagcttgtcatgggcctcattggcccccatgtccatcctgtcctggtgcctggcccgtgccccgtggccctccctggcacatccgcttcagggtggagaggccccagccagcgccccgttctttcagtggcttccggaggactgagcagctagaggtgattttgcatttgcgtttcccgacgttgccacatctcaggtgaataagttgtatgaagcgctcacactagtacgtggcccctcggtggtttgtcctcgaggtcgaaggtccagatgtccaggggctgccctggactccagagtggtgcggctgagcaggctgtggtcttgggtgcttgggcacctcccgtctctccctgctcagagttcttctctcctgggcagccagaaaggatcagaaccggtcacatgcagagcggcctcccgtatcccacagcagctccgttctctaatctgggtcttcagatgcggctgtgtctcccggcaccttgctggaatgtggtgcatccctcggagtccagcagcccttaggcagagctgggtgccgagcttgagtccaggagggcctcagacacctgcgatcttgcagcctgttgccctggacagtgggtgtgctgtgggtggaggatggcgccctgcctccacggaagcatccccagcttgcccctcagtcacacgaagcgtctgtccccagcctggggcatttctgagtggcctccacttggcctcttcctttttctggagcaagtatttgaactcctgcaggcgccagagatctccttacctgtttcccgctacccttctccagccaggtttctgccctcggccagattgtcctgcagtgacttgcttttggccatggagtagtggctgctcagtgcctgagattgttttagcagcagaagggaccgggtccccctgctgctggcaacacagacgcttgcttacagttctctggtcctggacacctgaggtctcggcctccccaggacggcccttccagattctcaggaccgccttgccctccctgccctgtctcctaggtgaccctggcaaagatgagagtgcacatttcgtcctgcctgaaggtccaggagcagatggccaactgccccaagttcgtccccgtggtgcccacatcacagcctatccccaggtaggcacgctgccgggcaagggagaggaactgtcctcggcggtttcctcgttctgggagcaagcgcagtgccccatcccagagaggctgggggagtcacccggggccgggtccactctggggaagtggaccttccttgccaccctgcaggaaggctcctgtgctgccctccctggcatacccaccaggccccctggggtagggacagctcagctgtggggagcaggaggagggcgcaggccgggcccacacatcgcctcccagcaggtggatgggccgagagacggctcctgccagggcagcgccagcagagtctctgccgtttggctggcctagttgtgtggggtggacgagggtcctgggtgtgtcctcaggaggccatggcgtgcagaggcacggggggcacccagccactgccacgctcttgcagcctacagagggcaggcctggggccacgcctgtgtttgagagaagcggggaggcagagcccctagacacctagccgtgccactcactctacccccgccccgccagcaacatccccaacaggtccaccttcgcctgcccgtactgtggtgcccgcaacctggaccagcaggagctggtgaagcactgtgtggaaagccaccgcagcgaccccaaccgcgtggtgagcagtgcctgccccaagcgacgcctgcgccaggggaggcctgtgggggacagtacaaggcccaggagcctgctcgcggcgagtccgggggtgcccaggccacaaaggcctcctgggacccagggtgggaacttggctgcccgagcagcacctggcggaaaccggggagtgtccatgagtccttcagggtgacgcgcactgaataactcgcttgtcaccgggacacgcgcctccaggtctggggtgccttcccaggctgaggcagcactgacggggctcagtggagggcccccagtcctactgcggctaccccgcctctccgcggtccggctcggcttgaccccagtgcctgttccaggtgtgccccatctgctcggcaatgccctggggggaccccagctacaagagcgccaacttcctgcagcacctgcttcaccgacacaagttctcctacgacacctttgtggtaggcatcccgccagcaccgtcctcccccacgccctcctcatccaccctcctcctgctcgggcccctcgccagcctcagggtccgcagggttcagaggaagccagaaacagaagcctcgtttcaggtggccacattcccccaggttctgtgggggctgcctgcaggtggggagtgatggcagctgagtttgagtggccactagagggtgcccaggcctctcggggacatggaccgcacagggcaggtccctgcctgcccaccccacagaacccctcgagggtgagccaggcttccttctggaagctttctagagagcgcgggaaggactttcatcaacatcgaacactccagccctgtctccttttcccacccgccgcgggtcaggcacacacctggcccccgggcctgcagaccctcgcacaaactcctcactcctggtgcggcccctccctgcgccgccctgttcattcctggccctggctaacagtcctggcgatggctgtcactccctctgccagtcgtccgggacccacgctccgcctgcctcaggatggaaattgttagaggtcagggagccctggccggcctgctcacctcgcaaaccccgggcttagagtccgacctgaaccagcagccatccattccgagtgcccccgtacccagcgggtgatggacacaccttcaccttctcaccccccagaggaccgtgcaggccccgagcctgtggggacagtggagctgggtccttcctgtgtcctgctggagggaggcaggaagggtggacacgcctgtgtgggtgatgggcagaggggacctctccttcctgtctccctcgagcccggtgcatctctccttcctgtctccaggactacagtattgacgaggaggccgccttccaggctgctctggccctgtctctctctgagaactgaagggaagcgcagccacccgcctgcgtctggggtcagggatgtccccgctcctgtgtcgcacctggcacctgctcgggagtgcacctcaccggactgagctcacaggaggagcctgcacccgcgcagaaggggagccggggccgagcctccgggcctgaatacgggccagccgccgaggccgccagagcagggccgcctggtcccaccggcgtcgctgggttcttcggtgcttctggccgagcaggcggcctacttgggcagggctggacgctgagacctggagctgccaccgtctcttcaagccatgataccccctcgtgggaagaagggaccgacgcgcgagtcgcggctgcgcagtcgagcccgggaggaacccaggctgctgccctggccagcccgac

SEQ ID NO: 12502 - DNA, 1132 bp, Homo sapiens
agctgaatcttaaactaccagtggggaaagctgaaaagcagcctaatttacattgcagatgcaaagcctcagaaattggtggaaattgaaaataaggatgaacgtgggatgaaaagagaagatatgattatacatcttccctttaagagaaaattgaaggtttattctctgcagagtcaaagacagtgtctctggactagaaaaccctaggtgcacaactgtctggtggtgctgaattgaaaaatgaggaaaaaaagttttcatgctgaatattataactctcttctactgctcctatttctcccagaaaacaatgacagtaggcaggatataggaagagtcatctttggggaatcagaccagcctaagagcaaatatctaaaggtattaatattggagatcccaaggaaatggcttagccagacgtactaaaaggaagaccatatttgacaagcttcacacacgtttgcaaattccaatcaattttttagtgttcacttatacatatgaacagatggcaaaggatgaccaggcatttgaggatgaaaacattatgaaatatgggaatgtgcacaaacaagaaaagtgggttcgagtaagtagaatttatatagagagaacatttcaaaaaactgttaaagagtatcctcaaagagataagagaaggtgttactttcatgaataaaggcagtaaactacttgaaaagaaagaacgaaaaaaaatgagttcttggaaaataagaatatagtagttgaaatgaaaaatttagttttaaaaagatgataaaatagaggcaaactcccagaaagtagagcagaaagacaaagaatagaaaatttgaaagaaaagaaaggggtcatgttcaggaggcccaatatccaaataataggaaattcagaaagagagaacagaaaaaagtagaggatagcaaatcctcgaacagtattttctagaactaaattgatgagttttcagttgacaggcctctcaagagctcaatacagtggataaaaatattcccataccagcaggtatcattactaaaatgcagtgctgcaaacagtggaagattctgcaagcttcctgagaaaaaaaattaaagcttcctgaggaaaaaaagaataagaaaac

SEQ ID NO: 12503 - DNA, 296 bp, Homo sapiens
ggaggttgcagtgagccgagatcatgccactgcactccagcctgggtgacagagcaagactgtctcaaaaaaatttaaaaataaagtttaaggttagaagctttttggtgaaatattaaatggcacatgtaatggcacgattctgttgtctttggaaacagtctcaataatcgtgtatgtagaataacccaaagacaagaacactgaatagactaggaagtattttttaaactgccagagagtaaacagaaactattgcagaactgtaagttttcttgccctgaaactttcaaatt

SEQ ID NO: 12504 - DNA, 348 bp, Homo sapiens
ccacctgtcttagctgtgaatagcatttacagagtcatcatattgacaatgactatattagtgtgttaggagaatgggggtattagaagtattatgagggttgcctaggagcagcatgggagtgtgagagagctgatgtctcatattacattgaaggaaatgatatttgaagaagtaacaataaaagtatattatttagaggtattataagtattcatctaaaagggagttataagtagttgcccctgaaagggaggaatggagaagaagcaaagtactgctgttttgcctagaaatctcatagaactagttgactctatgcaaatgtacaactttgataaaaataat

SEQ ID NO: 12505 - DNA, 5006 bp, Homo sapiens
ttttgcaccatttccctctgtacttatgccgccagtatctcgtatgatttgaaccggctcccaaagctaatttatagcctgcctgctgatgtggaacatggttacagctggtccatcttttgcgcctggtgcagtttaggctttattgtggcagctggaggtctctgcatcgcttatccgtttattagccggaccaagattgcacagctaaagtctggcagagactccacggtatgactgtcctcactgggcctgtccacagtgcgagcgactcctgaggggaacagcgcggagttcaggagtccaagcacaaagcggtcttttacattccaacctgttgcctgccagccctttctggattactgatagaaaatcatgcaaaacctcccaacctttctaaggacaagactactgtggattcaagtgctttaatgactatttatgcgttgactgtgagaatagggagcagtgccatgggacatttctaggtgtagagaaagaagaaactgcaatggaaaaatttgtatgatttccatttatttcagaaagtttgtatgtaacaattacccgagagtcatttctacttgcaaaaggattcgtaacaaagcgagtataattttcttgtcattgtatcatgcttgttaaattttaatgcagcatcttcagaacttgtcctgatggtgtcttattgtgtcagcaccaaatatttgtgcattatttgtggacgttccttgtcacaggaagattcttcttctgttgccttattgtttttttttttttaagtctcttctctgtctttgtactggaatcgaaatcataagataaacagatcaaacgtgcttaagagctaactcgtgacactatgcagtattgtttgaagacctgttgttcaacctctgtctctttatgttaactggatttctgcattaaatgactgcccccttgttaatctgggtgtgttttcctatgtcttttagctgtgtcaacaggtctccctagccataaggacagaggaaaactctgttgttttaataagactcttattaagacttaataattgcttcatttcaattaggttgggcattattatcttttgtagcaaccacacacttgctattgacaaaagatgtcattttcaaacttgtttttaaaccttcctatactatttacaattttcttcttctccttctctttttctctcattttcccctctctcttcctcttcctcccctgtttaccatctgcctggtatgtatccagtcataaggatacatggtctctgtttttgttcttggacctcctaaagcagcgattttcaaccttggctgctcagagtcacctggtgaggtcttcagctgtacctaaacagggcctcaccccagaccaattaactcagaatatccacagctgggcctaggcttgagcatttttgtaaaaacatcccagatgattctgatacacagctgtgattgagagccactcatttgggccagaaccgtggttatctccttagctactaacaaagcgaactcacttatttagcacttactatgtgccagtaactgggctgtggtgttatttcacttaatcctctccaaagctctatgaggtaagtgctgttattttatgttactcataagctgaggatcagactcaaaacatttgcttcatttttttttctcgatcctttttctctgtgtgggtttgggacaacagttaaaattcttccgttgtgtttgcttatctttcagcggagggtggggcactcgccgacttctaagcttttccttttaactccaacccttgttcccgattctacacacaatgtaggataaagacagcttgtaaaatagaagacgccattccagaatatgctgtttcagattttgatttcataaaagattcttttctttcttctttataaaaactgatttagtcctcataaaaggaaaatgatcatctactcccaaaggatagagtctgatttccaagtgatggtgtccacatattgtcatgtaagggccgaaaggggttggaggatgccggcgaccacaccagctttggctccgtggctccaggcacagcacaggctcatgagtgtattcactggcactctctcaggccttttaatatactggtccctctggatgagatcagagacgtatagaaagggtcaattattttcaaagcaggagagctctttctttgaagtcttctttaaagatccccatagaagatgtcaagactcttggacatttatattccaaccaacaaagcagtgtctgagtgagtaacttttgaagtttcagagaagtttcctaggggtttgaggtgagagtggaagaaagcctcgcggtagcaggaggttgaagggttcacacaccagaaagatttgcctcgaagccaggggagttcacttaggattcaaacgagtgctggcaaggactgaggctccctgccttccagccaaagtgagctcgaagcaaccaacgtgccaggccaaggttcctcgctttctacttactgtcacgcaagtgtgggcaaatgttgccagtgctgggcatttggccctgagtccttgggcttctcttaggagttttttcttaactggcttgtgaatgaagaatgattgaaatgattgcacagtactgtgcaggacagaataatttattgaaatcctttgttctatgttctctctgtcccacacacccccctttttaacagacttgtccttggtttatttgctgtattagaaccagtgttgtccattctcggggaagcctccctcatctttcaaggactaccatggaccctcgataatcgagatttcccaggatatgggaaacctccacagaacataatagcccccataacatttcttatatagtcaacaaatatttactgaatggctattatgtgctcacattctagcacttgggaaacattaatgaagcaaaacagacaaaggtttttgccctggtaaagcttatgttctagaaaaatgcagtgaaggacatagtgaaaaaaattaagcttactctttttggccctaaattgttttgtaagtccagggttaaagttattcaattactaaaataagtttcttttaaattacattcccattggctgtgcatttcatacttcacaacattctcattatttgaatctagccctggcaagttaaaaaaatactaactttttgcaagggccgggtggggggtgcctcttaaagatttcttattcgaaattgaagtctgagaatgacaaaagtgtgcccccacaagtgagctagagggaataaaaacctgggaacccgggactcaggtgaatgggggcccacgagctcaaaatataccacctgatggaggctggtgcaggtgggatactcacactgcctaggcaaccacccactccagatctttgctcaggctctttcctctgctggggacaccccctcctctgcctggcttattctgacttttccttgtgtctcagcttctacacaacactcccggacaccttcctcaaacatgctgcattgcttcaaatcctttcctgaccagttacgctccgcacatgaattgcctggcaacccataaccagatcatagactctttcaaggaggaatctgtgccttgtcccggtgctcagcccacccagtgcctggtagaccgtaggtgctcttaaatctttgtggaatcaatacatggattcagagtcatagataaactcttttcttccctggacagagctgactcccttagcaccaattttagggagcccataaaaaatgtacagtcgtgtgatgaggctaaatggaaagagaatatagcttggcaagcaaggaaacctcattagaataattaaagggactattaacccaaaccaacctagacgtaacttaaaatgtgttatgaactactgtggaacatttatttgatggctcaaacattaagttagtaacctcaatatggttctacacctcaatttaaagcgttctcatttatgtgcatgtgtgtttcaaatccctaattggaattctgaaaggaatgcttcagaaatgacttcctttgaatgcaaatagctatcctgacgaagaacacatttaaattgcatatgaatttctctggggccttgccctttgactggaagaagaggaagttttctgtgctgcatgcaggacaaccacaaatgcttgaagatgctcagggcacccagttgcatactgggaacttggctatgcaatacatattcctcttaatatgcaacctgtgttttgccaggcatcaaagcaagatttctaattgtcctaaaacattagaatatgtctgcctggagcccctgtaagaggaaaacagattggctggctataaaagaagatagcattttttctgtttttatttccaatttttttctccccttcagcattcactataaaatactgcctgctactataaggtctggctatgcttggtttctcttaggtctctaagtgaatgttttgcagagaggaaggagacaggaccatgggtctagagcagaaagaacaagggaagagtggtgcaggtgaggttgccaaggtaggcagaggcttgctggtcacagtaaagagtttgggttttactctggtaattgaaaacaaacggcctaaaaaaggataatgatgtgatctgatttccactttaggactatcagttggccaggtgtggtggatcacacctgtcattccggtgttttggaaggctgaggctggaggatctcttgagtccaggtattcaagaccaggctgggcaaatagagcctgtctctataaaaacatttttaaaattagccaagtgtggtggtacatgcctgtaggcttagctactcggcaggctggggcaggaggattgcttgagtctagaagctattgagctattatcacaccactgcactgcactccagcctgggtgacagagtgagaccagtctcaaaaaaaaaaaaaaaaaaaaaaaaaaaaaaatcag

SEQ ID NO: 12506 - DNA, 1587 bp, Homo sapiens
tctgggagttcaggtgaacactattgtgaattccgtttaaaaggagggctcccactctccttgtctgcatcagccacatatcccatggctgcagcaataactcccctcttgggaaagtcagcagcaggagaagcccaaggcagaagggatgtgaccaggtcccagcctatgacatctcatgaaggctcctcctgtgtgctgcaaggcagcagcagtgcagaggatggggtctcctctacaattcaattattttacaccaaacccagtactacttccctccaggaaagggggcgcatggatggcctggacaaagctgcaaggagggcaaggctgggcagggtactgcatcttcaggctgcttctgggctctgccaggaagcacaggctcaggagaacagagtggggcctgaatgcacacatgtgccatctcggggccctgggccaggtctgagttgtcaaacaagaacagatgcaccactggctacatggtcgtcaatgactccccagtctcaacagagagaaagaaagtgagagtgattgctactttccattccacgcttaatgtacaatttgatcagttaaaccacttaatcctatatgaaacaggaatgtgaagacaccttatgaaatgaaaaatgttaacctcatgggtaaggatggcgatcagcaccgtcattctggtgatgaaccccagaaggccagcgccctcccaacaccaatgatgctggatgtcagcttgctgtttgcatggctaaggtcgcttctggccatttattctgggcttgtcacaaatcccatggagcaagactctgctctctcctattcctgtggagatcccaggcccaatccccagggaagttgtacctaaaggcttcccagaagataccagaaacgacgacaccagcttcaaagaagaggctggatgctccctccttcaaccatccaggtctgatctagggatacgatgtagttcagacacattgtcccactaatatggccttgacatacacaggctttgggccccatcaagcctggctccacagctgtctctggaatccacggcggagctgctcaccacccagggcagagttctccatccacagttggaagtcacaaccacacaccctgctgcaggtcaaggcttcccctactcgctcaatgtaagaggacgctgctcatgggctctggaggccacagagaacaagaggcataattcctgcccacagggagtgccccggggcgctgctgtgtaagccactgccacagctggagagcctgaccctgcgggattcagcgaggcccacgcagcacaaactgcccaagtggcctcaaagtcaggaaaagatttccatgaggtctggagcagccaggaaggctcattggaagaggccagacctggcagagccagaaggaagggggaggatggcaggctcttcaggctcagggcagtgcggacagtgagcccaggatgcccaattgtgccctggcactgaaccgagtgaagtgtaagccccggtgcaaagcatgtggcctctcctatacatacaggatgaggaacatctcttgctggcgtcctcgagaggaaca

SEQ ID NO: 12507 - DNA, 1131 bp, Homo sapiens
ggagtaagcctgcaccattttccagctatgtcagtccaggccccagttggcccttggccccttggagtccagccacatactgtgtaggatccaagtgccctgctcgccagagatccagcactcttaatggcaagagtcagatggtgggggttcaaatttggactcttacctgctgtgtaatcttggttgtagtactccccttctctgtgcctcactctctcatctgtagaatggggttaatagcaacatctgtccttcaggggcatgggaagagtaaaatgattaatgccacagtgtgcctggcactgggcctgcccagagtgcccagggaagatcagctgatagtctcacttgacccgcagagctcagaatcagcatccctggaagccttgttaaaatacagcttccttggcccgccctcactgtttcccattcagtggtctgggctgggtctgagcataagcgtttcttaccagttccaggtgacgctggttccactggcctggggacccaactctcaggacccttgagcctgtccatccatttcagtgggtccactgggacgttgatatatgggaaaggcaaatgtgacctcagacattcaggaaagcaaagaaatgtaggcaaggaatttctacgggttttaggaaaatgtttcgtcctgcactgggtacccacagtctttcccccggggactcttgcaaatatacttgactcagatctccatgggactcacctggctgaaaacaagctgtcacagcaccttcctctcacttgtcccacagccatttgagggcactccctgtgtgccagctcccgagtactgatggggctcagggggcaaggaaagaacatcactgtccccagagaggccagggtgggacttgcacaggtgcagtgttagacggtcaagaaagcctgatgcttagggcagggggcactgaggaggagtatgcatggtgaggggcttcctagggagcatcagatgcgtaggcattcataagacacagacacacagggcagggtgagagggaggcatgaagaatggggaggaaggagatggaggaaggaggggagtgagcagagggccccgggaatggcctggaaaaggctgagcccttggatcctctg

SEQ ID NO: 12508 - DNA, 1131 bp, Homo sapiens
ggagtaaggctgcaccattttccagctatgtcagtccaggccccagttggcccttggccccttggagtccagccacatactgtgtaggatccaagtgccctgctcgccagagatccagcactcttaatggcaagagtcagatggtgggggttcaaatttggactcttacctgctgtgtaatcttggttgtagtactccccttctctgtgcctcactctctcatctgtagaatggggttaatagcaacatctgtccttcaggggcatgggaagagtaaaatgattaatgccacagtgtgcctggcactgggcctgcccagagtgcccagggaagatcagctgatagtctcacttgacccgcagagctcagaatcagcatccctggaagccttgttaaaatacagcttccttggcccgccctcactgtttcccattcagtggtctgggctgggtctgagcataagcgtttcttaccagttccaggtgacgctggttccactggcctggggacccaactctcaggacccttgagcctgtccatccatttcagtgggtccactgggacgttgatatatgggaaaggcaaatgtgacctcagacattcaggaaagcaaagaaatgtaggcaaggaatttctacgggttttaggaaaatgtttcgtcctgcactgggtacccacagtctttcccccggggactcttgcaaatatacttgactcagatctccatgggactcacctggctgaaaacaagctgtcacagcaccttcctctcacttgtcccacagccatttgagggcactccctgtgtgccagctcccgagtactgatggggctcagggggcaaggaaagaacatcactgtccccagagaggccagggtgggacttgcacaggtgcagtgttagacggtcaagaaagcctgatgcttagggcagggggcactgaggaggagtatgcatggtgaggggcttcctagggagcatcagatgcgtaggcattcataagacacagacacacagggcagggtgagagggaggcatgaagaatggggaggaaggagatggaggaaggaggggagtgagcagagggccccgggaatggcctggaaaaggctgagcccttggatcctctg

SEQ ID NO: 12509 - DNA, 431 bp, Homo sapiens
ggctcacctcaatggatttggaagatttagtttcatgcctgtctctgaagctcccaggttgagcaaatgttgctgctgtctgcatgtgcagggcgggaatgcatccccagctgtttggggggcagctgttaacacgctgataattttactcggtggaaaccatgttcattccattggctcctggctcagcacatctccaggtttaagagttcacggggcaggcgggaggaggaggccatgaggctcacctcctgcctgggtctaggaagctgcacatcggcctttatgagtgttctgagcgcctgctttctgagtcatcaccatcatgggctacaggaaggagagaccaaggagcaaggtctagggcggccttgtggccagcctggccacctgggggaggggaagggagtaccttgagcacattctcaggg

SEQ ID NO: 12510 - DNA, 431 bp, Homo sapiens; identical to SEQ ID NO: 12509

SEQ ID NO: 12511 - DNA, 2450 bp, Homo sapiens
catcacacacagccttgagagctgtagacaatggagccctctctggtacacatcctggtttgggtgagtgttccgccccttttcctgtgcttaactcactccagaagcatccaccataaccaagatggactaaacttaactccactcttgcagatgccccatcaactcacagatgcaagtggtgtcatcaaagccccagcatgtcacccaaccgttaacaccaatccacataaagaaaatgagcatgcattcctgtttgctggatgctgcacacattctttaaacagagtaggcacttgggtgccacctttattcaaggtcttcaggtttcttttacgggggacatctgccatagcaactttcagtgggcatttcttttctgatgaagctttctatcctggggagccagggagactccaaggcaatggagtcccctggcagctcactgtcacaggtcaaggttttgattatgacaaagaagataaaagaagagaagcccctcatggtttgtggctgcagcattacagggctgccagagaccccagagcatgggtgtcttggtggtccacattctgtgatccaggggaggaaccctgaggagtagggaactgcccaccagaagagcactcacaacacactcaagcttcttgacatacaattccagatgtcatctctaaattcacagtgaccttttccctaaactatgttttgatacagggcgagcagaagcgaggggtgatacacagcaacatcggtgagcatctgagctcgcaaggaggcagtggcctctgtgccccctcttcccacccgtatcttaataaaatttcctaaggataattatttagattgtctctcttttgtgtcttatgtatttaatggcagagctgctatgaggcaaaaagaaacaaacaaacagaaagctctttttaaaaaatgcaggaggagaaatatgccaggaaaggctactatttgacattaggcattcctgggataactaggatttagctaacataaaaatttccatgttttaaaaagtatctctgatttaaaaataataacaaatctggctacagcccttgcagtggaaaaatcaatactcttttattcctgtaaaagctagggcattaaaacagaatccaggctagaagaggtgggtatgccggcatcatttcacctgttttgaattatgcggttaaacccagcgtgcatttccctagagggggcacagacgcttcttccttcaagaacatgctaaacatccatctgtcagaaacaattttggggtattgaggtgcagagacggagaacagaacagaccatcccttggggttcctgcccgtacagaacagttgtgtctctgctagatgcatgcacccattatcattgatcaacagtcccctgcacgacaggcatggccacccacgctggggacacggcagtccatgtcctcaagaaactcatcttctcctggcagagccagatgcccagatagaccatcccaagacaataccacattgtgagagtagaatgttgatgaaaaccaaaaccaaacgctacaattaacaatacggatttatggaaaggggtgccattgagagccgacctctggtactaccacaggcactgggggcttaaagtgtttctcacataacacagcagcccctgggggtagctttcttatctttgtgttactgagtgactcctacgatccccagggtagtgaagggcagagatgggatttgaacccagttgctctgattccaaagtccctggtctttttataccaagcaacatcttaagtaccatttttaaaatatcacatttcccgattcccttcactgaattttatttgtacttctcataaggcaattacaggctgggcacggtggctcatgcctgtaatcctagcactttgggaggccgaggcagacagatcacttgaggtcaggagttcgagaccagcctggccaacatggcaaaaccctgtctctactaaaaatacaaaaatcagataggtgtggtggcaggcgcctgtaatcccagctacttgggaggctgaggcatgagaattgcttgaacctgggaagtggaggtagcagtgagccgagatcacgccactgcattccagcctgggagacagagtgagactccatctctaaataaataaataaataaataaataaataagtcaattaccttaatctgagcatggagtcatttatcaattttgctgaactataaacttcaaaggcaggaatggcatctctttacatattttgagtttgtgtgtaattgtttagattaggtgtgcccattggaggtggtgatatagaagcagacacctgaaagaagtgaaagcaatccctgagggtatggggaagtgggaaacctccaggaagaggacacggcagatacaaaggctctaggttaaggggcaagcatgagaagca

SEQ ID NO: 12512 - DNA, 2448 bp, Homo sapiens
catcacacacagccttgagagctgtagacaatggagccctctctggtacacatcctggtttgggtgagtgttccgccccttttcctgtgcttaactcactccagaagcatccaccataaccaagatggactaaacttaactccactcttgcagatgccccatcaactcacagatgcaagtggtgtcatcaaagccccagcatgtcacccaaccgttaacaccaatccacataaagaaaatgagcatgcattcctgtttgctggatgctgcacacattctttaaacagagtaggcacttgggtgccacctttattcaaggtcttcaggtttcttttacgggggacatctgccatagcaactttcagtgggcatttcttttctgatgaagctttctatcctggggagccagggagactccaaggcaatggagtcccctggcagctcactgtcacaggtcaaggttttgattatgacaaagaagataaaagaagagaagcccctcatggtttgtggctgcagcattacagggctgccagagaccccagagcatgggtgtcttggtggtccacattctgtgatccaggggaggaaccctgaggagtagggaactgcccaccagaagagcactcacaacacactcaagcttcttgacatacaattccagatgtcatctctaaattcacagtgaccttttccctaaactatgttttgatacagggcgagcagaagcgaggggtgatacacagcaacatcggtgagcatctgagctcgcaaggaggcagtggcctctgtgccccctcttcccacccgtatcttaataaaatttcctaaggataattatttagattgtctctcttttgtgtcttatgtatttaatggcagagctgctatgaggcaaaaagaaacaaacaaacagaaagctctttttaaaaaatgcaggaggagaaatatgccaggaaaggctactatttgacattaggcattcctgggataactaggatttagctaacataaaaatttccatgttttaaaaagtatctctgatttaaaaataataacaaatctggctacagcccttgcagtggaaaaatcaatactcttttattcctgtaaaagctagggcattaaaacagaatccaggctagaagaggtgggtatgccggcatcatttcacctgttttgaattatgcggttaaacccagcgtgcatttccctagagggggcacagacgcttcttccttcaagaacatgctaaacatccatctgtcagaaacaattttggggtattgaggtgcagagacggagaacagaacagaccatcccttggggttcctgcccgtacagaacagttgtgtctctgctagatgcatgcacccattatcattgatcaacagtcccctgcacgacaggcatggccacccacgctggggacacggcagtccatgtcctcaagaaactcatcttctcctggcagagccagatgcccagatagaccatcccaagacaataccacattgtgagagtagaatgttgatgaaaaccaaaaccaaacgctacaattaacaatacggatttatggaaaggggtgccattgagagccgacctctggtactaccacaggcactgggggcttaaagtgtttctcacataacacagcagcccctgggggtagctttcttatctttgtgttactgagtgactcctacgatccccagggtagtgaagggcagagatgggatttgaacccagttgctctgattccaaagtccctggtctttttataccaagcaacatcttaagtaccatttttaaaatatcacatttcccgattcccttcactgaattttatttgtacttctcataaggcaattacaggctgggcacggtggctcatgcctgtaatcctagcactttgggaggccgaggcagacagatcacttgaggtcaggagttcgagaccagcctggccaacatggcaaaaccctgtctctactaaaaatacaaaaatcagataggtgtggtggcaggcgcctgtaatcccagctacttgggaggctgaggcatgagaattgcttgaacctgggaagtggaggtagcagtgagccgagatcacgccactgcattccagcctgggagacagagtgagactccatctctaaataaataaataaataaataaataaataagtcaattaccttaatctgagcatggagtcatttatcaattttgctgaactataaacttcaaaggcaggaatggcatctctttacatattttgagtttgtgtgtaattgtttagattaggtgtgcccattggaggtggtgatatagaagcagacacctgaaagaagtgaaagcaatccctgagggtatggggaagtgggaaacctccaggaagaggacacggcagatacaaaggcttagttaaggggcaagcatgagaagca

SEQ ID NO: 12513 - DNA, 661 bp, Homo sapiens
ttgagacagggttcactcccattgcccaggctggaatgcagtggcatgctctcggctcactacaacctcctcctctcgggctcaagcaatactcctgccttagcctcctgagaaactgggactacaagtgcacaccaccatgcctggctaatttttgtatttttagtagagatggggtttcaccatattggccaggctgttcttgaactcctgacctcaagtgatccacccacctcggcttcccaaagtgctggaattataggcgtgagccaccatgcctggcctattttatgtatctctttcttagcaagataacttttccagaagcttcccagcaaaccctccctcccatctcactggccccgattgggtcacacaccccattccaaaatcaatcattgtcaggggataagtttacatgtctggcttagcataatttacacatggtgagagtcaactgctatgaatcatcagtcaaaactcttgaaaggctactgggccaggcaacagatgctagcagcccaagctacaataatggtggtaagggatggggaagtaagaataggtaagatttatttagcaagttatgttggtagagtttagtgaatgtgggaggaggagggaaaggaggaaggaaaggacaccctcatccatatttcca

SEQ ID NO: 12514 - DNA, 661 bp, Homo sapiens; identical to SEQ ID NO: 12513

SEQ ID NO: 12515 - DNA, 1031 bp, Homo sapiens
gccaggcgccatggctctggcggatcagccccgcacccccaacagccccacaggggggcccatccagggccacacacctgcccccaggagcaggacgtccctgaggctagagtccagggggactggtggaagggtctcaccctttgccctttgactcctcttgtaggcaccctcgctgggctcctaagcactccttcacaccctggctctgtcaccagccccatagtgatgtcataaactcccagatgcccagtgtgcacccggccacagagaagtgggtgacttcggagtatcctctccgcttctgacccttagtttcgtctgtgcacaactcgctcaaaatgggcaactcactaagcatattttgttcctggttccaccgcaggtcctggccacgccaccggcaacctgctcgtcttgtccgtgaggccttcccagctggccgggctcaccccgcggctcctgcacctgtgcctgccccgggaatctggggccgtttcccactcctcttcaaccgtcagcgacatcttgggccttcttttccagtcaggtgggatggcgcccctgtgaggctgtgtcttatccctcggaacacgggcaccccacagagggtcctgcctcctgtggtctggagcccccccctcaaggaagaaacccgtgctgtctgctcgcaactccaggatgtttggacacctcagccccgtgaggatctcttgtctcagaggcaagtttaaccttcaacttccttcattagatgagcaggtgatcccagccaggctcccgaagatggaggtgagggcagaagagcccaaagaagcaacggaggtgaaagaccaggtagagacccaggggcaggaggacaataaaaggggcccctgtagcaatggggaagcagcttccacctctaggcccctggagactcagggaaacctcacttcctcctggtacaatcccaggcccttggagggaaatgtccacctcaagagcttgacagaaaacaaccagactgacaaggcccaggtgcatgcagt

SEQ ID NO: 12516 - DNA, 1051 bp, Homo sapiens
tagccagcacctgggccaggcgccaggtggaagggctctggcggatcagcctcgcacccccaacagccccacaggggggcccatccagggccacacacttgcccccaggagcaggatatccctgaggctagagtccagctggaccggtggaagggtctcaccctttgccctttgactcctcttgtaggcaccctcgctgggctcctaagcactcctccacacactggctctgtcaccagccccatagtgatgtcataaactcccagatgcccagtgtgcacccagccacagagaagtgggtgacttaggagtatcctctccgcttctgacccttagtttcgtctgtgcacaactcactcaaaatgggcaactcgctaagcgtattttgttcctggttctgccgcaggtcctggccatgccatcggcaacctgctcgtcttgtccgtgaggccttcccagctggccgggctcaccctgcagctcctgcacctgtgcctgcccggggaattgtgggccgtttcccactcctcttcaaccgtcagcgacatcttgggccttcttttccagtcaggtgggacggcgcccctatgaggctgtgtcttatccctcggaacacgggcaccccacagagggtcctgcgtcctgtggtctggagccccccctcaaggaagaaacccgtgctgtctcctcacaactccataatgtttggacacctcagccccgtaaggatcccttgtctcagaggcaagtttaaccttcaacttccttcattagatgatcaggtgatcccagccaggctcccgaagacggaggtgagcgcagaagagcccaaagaagcaacagaggtgaaagaccaggtagagacccaggggcaggaggacaataaaaggggcccctgtagcaatggggaagcagcctccacctctaggcccctggagactcagggaaacctcacttcttcctggtacaatcccaggcccttggagggaaatgtccacctcaagagcttgacagaaaagaatcagactgacaaggcccaggtgcatgcagt

SEQ ID NO: 12517 - DNA, 1046 bp, Homo sapiens
agccagcacctgggccaggcgccaggcggaagcgctctggcagatcagccccgcacccccaacagccccacagggggcccatccagggccacacacctgcccccaggagcaggacgtccctgaggctagagtccaggggaaccggtggaagggtctcaccctttgccctttgactcctcttgtaggcaccctcgctgggctcctaagcactcctccacaccctagctctgtcaccagccccattgtgatgtcataaactcccagatgcccagtgtgcacccggccacagagaagtgggtgacttaggagtatcctctccgcttctcacccttactttcgtctgtgcacaactcgctcaaaatgggcaactcactaagcgtattttgttcctggttccgccgcaggtcctggccatgccatcggccacctgctcgtcttgtccgtgaggccttcccagctggccgggctcaccccgcggctcctgcacctgtgcctgcccggggaatctggggccatttcccactcttcaaccgtcagcgacatcttgggccttcttttccagacaggtgggatggtgcccctatgaggctgtgtcttagccctcagaacacgggcaccccacagagggtcctgcctcctgtggtctggagccccccctcgaggaagaaacctgcgctgtctgctcgcaactccacgatgtttggacacctcaggcccctgaggatccctcgtctcagaggcaagtttaaccttcaacttccttcatttgatgagcaggtgatcccagccaggctcccgaagacggagatgagggcagaagagcccaaagaagcaacggaggtgaaagaccaggtagagacccaggggcaggaggacaataaaaggggcccctgtagcaatggggaagcggcctccacctctaggcccctggagactcagggaaacctcacttcctcctggtacaatcccaggaccttggagggaaatgtccacctcaagagcttgacagaaaacaaccagactgacaaggcccaggtgcatgcagt

SEQ ID NO: 12518 - DNA, 1051 bp, Homo sapiens; identical to SEQ ID NO: 12516

SEQ ID NO: 12519 - DNA, 1051 bp, Homo sapiens; identical to SEQ ID NO: 12516

SEQ ID NO: 12520 - DNA, 455 bp, Homo sapiens
gtctgcgaagtgaggagtgcctctgcccggcctcctcaccgtctgggaaatgaggagcgcctctgccttgccgccgtcctgtctgcgaagtgaggagtgcctctgcccggcctcctcaccatctgggaaatgagaagcacctctgcctggccgccgtcccatctgggaagtgaggagcacttctgcccagccgccaccctgtctggcaagtgaggagcacctctgcccggccccctcaccgtttgtaagggaggagcgcctctgcccagcccctgcaccgtctgggaagtgaggagcgcctctgcccggccccctcaccatctgggaagtgaggagcgtctctgcccgctgctgtgcaaccttccaagtgtgaagtgacagccttgtgtgtgatctttctgccctccccaagtctgcattttcgacattaaagtttactttttaattaaaaaaaa

SEQ ID NO: 12521 - DNA, 442 bp, Homo sapiens
gagtgcctctgcccggcctcctcaccgtctgggaaatgaggagcgcctctgccctgctgccgtcctgtctgtgaagtgaggagtgcctctgcctggcctcctcaccgtctgggaaatgaggagcgcctctgcccggccaccgtcccatctgggaagtgaggagcgcccctgcccagccgccgccctgtctggaaagtgaggagcacctctgcccagccccctcaccatttgtaagggaggagtgcctctgcccagcccctgcaccgtctgggaagtgaggagtgcccccacccggccccctcaccatctgggaagtgaggagggtctctgcctggctgctgtgcaaccttccaagtgtgaagtgacagccttgtgtgtgatctttctgccctccccaggtttgcattttcgacattaaagtttactttttaatttaaaaaaa

SEQ ID NO: 12522 - DNA, 722 bp, Homo sapiens
ctggtactatcaaaactcaacagtataaggtatggatttagtatacttattaaatgaaagatatcctataatatgacctgtgaatggattaaataaaaggtatgtacagttataaaattccataacaacagacatgcaatttatttttttattttttaacttcttgccttttaataatatctttgaatatagatggtttcaattctccaataacaagatgtagagtggccaaatggtttttcatacatgtttccctagtccagacacccaagagtatgtccctctcttgggcataagaaaacctagagttatatttagggcatcatgtgtggtgaatagttgaccaagctggcatgctcacaatgaccaaattatgtttgtcatattttaatccaatacattgatctactatgaacttgtaaataatctatttgctttctagacacattccaggaagaccagagaaactgacttttatccatatggaataatccactggcaaatttcttttaggacagaccaaagctgatctataacataatctttacatacttggatccttcccatcagacgagaaagaacatctggggtgaaaggctccattagaagagcaatgtgggatggtgctgtgctgacaactggtagttcctgccctacgtctttgtagaggactggagcccagagcatgccatggtcaactcgtatgttgaagtgaagacctc

SEQ ID NO: 12523 - DNA, 825 bp, Homo sapiens
gaggagaaaggagagacggcagggcaggcgtggtggcccacgcctgtaatccagcactttgggaggcccaggcgggcggatcaggaggtcaagagattgagacctgaggagcatctctgcctgcaccatctgggaagtgaggagcgcctctgcctggctgccgtcctgtctgcgaagcaaggagtgcctctgcccggcccccttacactctgggaagtgaggagtgcttctgcctggccactgccctgtctgggaagtgaggagtgcctctacccagctgcccaccatctgggaattgagaaggagcaccgcctctgcccggcctccaccccatctgggaagtgacgagcacctctgcccggccgcctcacggtatgggaagtcaggagcgcctctgcccagctgccctgtctgggaagtaaggagcgcctctgcctcgccgccatcccgtctgcgaagtgaggcgtgcctctgcccggcctcctcaccgtctgggaaatgagaagcgcctctgcccggccaccgtcccatctgggaagtgaggagcgcttctgcccagccaccgccctgtctggaaagtgaggagcacctctgcccagccccctcaccctttgtaagggaggagtgcctctgcccagcccctgcaccgtctgggaagtgaggagcgcctctgcccggccccctcaccatctgggaagtgaggagcgtctctgcccagccgctgtgcaaccttccacgtgtgaagtgacagccttgtgtgtgatctttctgccctccccaagtttgcattttcgacattaaagtttactttttaattaaaaaaaa

SEQ ID NO: 12524 - DNA, 442 bp, Homo sapiens; identical to SEQ ID NO: 12521

SEQ ID NO: 12525 - DNA, 722 bp, Homo sapiens; identical to SEQ ID NO: 12522

SEQ ID NO: 12526 - DNA, 442 bp, Homo sapiens; identical to SEQ ID NO: 12521

SEQ ID NO: 12527 - DNA, 722 bp, Homo sapiens; identical to SEQ ID NO: 12522

SEQ ID NO: 12528 - DNA, 1567 bp, Homo sapiens
atgcaaccttttcagacagggcttccctgatgaactcagattcctgtgcctttcctgcaggtctctatacctcactacaatggtggaacatcttcatctgacttaccattatctgaagttaccttgcatatttgcttgcttattactttattggttctctcctttactaaattctaagctccaggacagcagggaccttgtttgtttccttaaccagtggcacacagtatgtgcttaacaattgttggttgaataaatgctggataaataaatgcccccacctctattctcactcctaccatcctgtcctgcagacctgtttgtatttccaggacattgcacactccttcagacctctgtgcctttgtacatggttccctctgctaggagggcccgttctctacaattggacttggaaagctcctattcatccttcaaaacccagctcaacgccacctcctccagggagctctgctccttccttggctttctcacaacaccttcctcacacgtctactgtgggattagctgttggtaggcctgaatccccaaggacattcaggctaggggctcccatgggcaggggctgggcctgaatcactggtgggttgggggtggagatagtcccagcacttggcctgagcacccagagtagctttgcagagggtgtttgctgagcactgctggacaataaggccttttgggcgtccctgtgaaaaggggcctcacctggctagtgtctcacccctgcagggtttccccacctcttctctgcccctgtagctgagtgagcttgtaaaaatgtaaacatgatcagctcactgcttaaaaccgtttcagagaatcctcatcacactgggagtaatttccaaatgctgaccatggcccatgaggcctgacctgtggcctctccactctctctatttcactgcagcctccagccagtcctgcttctgggcttttgcccctgctgtttcctctgcctggtgtgttcttcctcagatagtcacaaggccagctcctcctcatcacccacactcagcacacctttgccctgtttgttttcttcacacacttctctgctcaggaattttcacatcgcctccctgctcctcactccgccacaagctcctcagggctgggccttccctgcctcactcactgctgcagccttagtgccgggcccagtacctggcacacagctggtggccagaatgcttatcacctgactgattctttctcatctctgatgagagtgggcttcggtgttcagctttttagtaaaccaagtcactagaaggccaatgccatgagggcagggatgctttgtctattttattcgccgcagtctccccagggctggggttgctgagtgcacagtaggctcaatgtgtgtttgtgagagaaaaggaagggagttctcacttggggctgagctggctggagataccagagccaaggatcaaagtctctgagtcccttcagcctcatgaaggggacacacaggcatcccctgtgcatggcgacgggaatgggcccaacatcaggctgaagctcacctgacagc

SEQ ID NO: 12529 - DNA, 1567 bp, Homo sapiens; identical to SEQ ID NO: 12528

SEQ ID NO: 12530 - DNA, 1567 bp, Homo sapiens; identical to SEQ ID NO: 12528

SEQ ID NO: 12531 - DNA, 1286 bp, Homo sapiens
gtgggactgtggtctggcacgggcatttctgaagctgtggccacgccattgcagcacgcatcactcctgcacacccagatgcagagctcggtgagaacctcactgtgggcagtgccaggcacagcaggtcccacgtatttgagatgctcaggagccccagggcctggagggagacttttgggcccacatgccccatgtttgggaaggtttgggcttaaccagggaataacatcatgcattttgcagctcccttccagctgcagagccagacgttccgatatgaagttggctccgtgcgtaaatcacagcaggtactcaaagcagtggttaccgctctccttattcctgctttctcttccctgagttcaaaagcctgcaaagccagttttgggaaaaaaaaaaaaaaaaaaaagaaaagaaaacaaaacaaaggaaaaagaaaacccactctagtccttgtggcgaggtaaatactgcagaattgactctggcatcctgaaatgtggtgtggcatcgtaacaggggaacaagaatatgggagcaatttaaaccaaacaagactcaaaaatgacagcaatcacggacctgaacacgacgcacaggacgatgactgtggatgtgggttttcccctttgattgctggcaacctcatcaatgctttgcctggagattccagagcacgagtggggtggaacacctgagacccaccattcagacatcctggaaggcctcaggcctcatactgtgtggcttagcgatccccaggccccaggccccaggcccagagctggagcagctcttggagtccagcctgtcctccaccagctgtgaaactctctcccagttatgcctctgggaggtggcttctcagtcctcatactcctgtcttgtagggtaagagaatacatacggggaactgacagaatgcggggaccccggagcatgcccagcgcagaccgatattgcttgaattgtgtcctgattgcagccatcaccacaattcctcattggctttggtggaaacctcatgtcagccacacatcctgtcccctggagtgtcaccacctggtgcttcttctgcacctggaatgccacgtgctctgctgggccttcaccaggtcacagggtcagctcaagcacggcctctttcataagagtttcctattttccttcctatttttcctctcctctgtctgtaacatgtgttcctgtatcgtcctaggttatttattcaacaaatgatgattgaacctcttttatgccccagagactgttctaggcactaa

SEQ ID NO: 12532 - DNA, 2809 bp, Homo sapiens
  misc_feature (1651)..(1651): n equals a,t,g, or c
gtgggactgtggtctggcacgggcatttctgaagctgtggccacgccattgcagcacgcatcactcctgcacacccagatgcagagctcggtgagaacctcactgtgggcagtgccaggcacagcaggtcccacgtatttgagatgctcaggagccccagggcctggagggagacttttgggcccacatgccccatggttgggaaggtttgggcttaaccagggaataacatcatgcattttgcagctcccttccagctgcagagccagacgttccgatatgaagttggctccgtgcgtaaatcacagcaggtactcaaagcagtggttaccgctctccttattcctgctttctcttccctgagttcaaaagcctgcaaagccagttttgggaaaaaaaaaaaaaaaaaaaagaaaagaaaacaaaacaaaggaaaaagaaaacccactctagtccttgtggcgaggtaaatactgcagaattgactctggcatcctgaaatgtggtgtggcatcgtaacaggggaacaagaatatgggagcaatttaaaccaaacaagactcaaaaatgacagcaatcacggacctgaacacgacgcacaggacgatgactgtggatgtgggttttcccctttgattgctggcaacctcatcaatgctttgcctggagattccagagcacgagtggggtggaacacctgagacccaccattcagacatcctggaaggcctcaggcctcatactgtgtggcttagcgatccccaggccccaggccccaggcccagagctggagcagctcttggagtccagcctgtcctccaccagctgtgaaacactctcccagttatgcctctgggaggtggcttctcagtcctcatacccctgtcttgtagggtaagagaatacatacggggaactgacagaatgtggggaccccggagcatgcccagcgcagaccgatattgcttgaattgtgtcctgattgcagccatcaccacgattcctcattggctttggtggaaacctcatgtcagccacacatcctgtcccctggagtgtcaccacctggtgcttcttctgcacctggaatgccacgtgctctgctgggccttcaccaggtcacagggtcagctcaagcacggcctctttcataagagtttcctattttccttcctatttttcctctcctctgtctgtaacatgtgttcctgtatcgtcctaggttatttattcaacaaatgatgattgaacctcttttatgccccagagactgttctaggcactaagaatataggagtgaacaacacacacacactcacacacactcacccccacacactcccactcccacacactcccacacactcacacacacacagtcactcccactcacacacacacacacactcactcccactcacacactcactcccacacactcactctcactcccactcacacactcacactcacacactcacacacactcacacactcactcccactcacttgccctcatggagacattttattagaggaagacataagataaaaatctataagtaaactacatattagatggcagtaagtattaagggaccattttaaacaaggaaaggggataagaagtgtggcacagtggctttactgngagctgacatttgaatgaagacctcacaaagatgggagagtttgctgggctcatcactgagggcaggatgtgcagcaggttcaaaggtcctgagtcagaacgtgctggtgtgtgtggggaggcagtgttgctgcagggaggtgagagccagcagtgacaggtgaaggcagaaagtgttgggaggctgggtcatatagggctctcgggcattttaaggactttggcttttaccccaatgagatggacagggtggtgacttgatttgacttttgttttattaggtgtcttattcagagtcattgatactgtctcagtggcttagtaaaaaaagtctcttttttgctcacatgtcacagtctgataaaaggccccctggatgggcctcctcccagccagtgcaggaatccaggctgcctgaggccggaatcagaggcctcagaataactgcagccagagaagagagatgggtcggggagcactctctgccttggactagaagtggcacatcgcttctgtgcgaggtccgttggcgagaacgtcacgtgcccaggctcactgtgagggcggctgggagcaccattgtcgcgtgtccagatgaggagacgatgtgttgcacacagcattgtctgccatatcaggaacgtgctggctgctgtctggggaaggggaggggacaaggcataagcgggaaaacgaattctccatgcgaagcaggtctcctctgcctcccgccgccctaccgtcaggagctgagagaacctcctggcccctaagatttctcttgagacctaacaccaaggccacagcaagtgcccctgcatcgtgccccaacagcgccaaccgcaacccactgtgaaagggccaggtgggtgtctctgaggatcccattttgcaaacgaagaaactggagctccagggtgtcactggcgaatgacaggcacaaccaggacccaaactgatgcccgactgactcttcccatcaccatagagtgttgcagacactagtggcgtggcagggccgccgtcgatggctcttcagtgtgcagcagaagacacggccgaggtttgtgtttctcagaaggcaaaggcatgcatttcagggatatcttaagattatatcttcctagtttttttttcagtataacatgcactttttca

SEQ ID NO: 12533 - DNA, 1110 bp, Homo sapiens
cactcacacactcacacacactcacacactcactcccactcacttgccctcatggagacattttattagaggaagacataagataaaaatctataagtaaactacatattagatggtagtaagtattaagggaccattttctacaaggaaaggggataagaagtgtggccaacagtggctttactggaagctgacatttgaatgaagacctcacaaagatgggagagtttgctgggctcatcactgagggcaggatgtgcagcaggttcaaaggtcctgagtcagaacgtgctggtgtgtgtggggaggcagtgttgctgcagggaggtgagagccagcagtgacaggtgaaggcagaaagtgttgggaggctgggtcatatagggctctcgggcattttaaggactttggcttttaccccaatgagatggacagggtggtgacttgatttgacttttgttttattaggtgtcttattcagagtcattgatactgtctcagtggcttagtaaaaaaagtctcttttttgctcacatgtcacagtctgataagaggccccctggatgggcctcctcccagccagtgcaggaatccaggctgcctgaggccggaatcagaggcctcagaataactgcagccagagaagagagatgggtcggggagcactctctgccttggactagaagtggcacatcgcttctgtgcgaggtccgttggcgagaacatcacgtgcccaggctcactgtgagggcggctggagcaccattgtcgcgtgtccagatgaggagacgatgtgttgcacacagcattgtctgccatatcaggaacgtgctggctgctgtctggggaaggggaggggacaaggcataagcgggaaaacgaattctccatgcgaagcaggtctcctctgcctcccgccgccctaccgtcaggagctgagagaacctcctggcccctaagatttctcttgagacctaacaccaaggccacagcaagtgcccctgcatcgtgccccaacagcgccaaccgcaacccactgtgaaagggccaggtgggtgtctctgaggatcccattttgcaaacgaagaaactggagctccagggtgtcac

SEQ ID NO: 12534 - DNA, 3616 bp, Homo sapiens; identical to SEQ ID NO: 11471

SEQ ID NO: 12535 - DNA, 7096 bp, Homo sapiens; identical to SEQ ID NO: 11472

SEQ ID NO: 12536 - DNA, 224 bp, Homo sapiens; identical to SEQ ID NO: 11473

SEQ ID NO: 12537 - DNA, 15261 bp, Homo sapiens
atttccggctcctcccggaagtgccgaagctggctactaagggaacttgggaggatcccacctcagccttcgtgactagtgaggtgcgcaaacgcccgagttttccctggtgcgcgggttccgcctttgcagtgccctccacccttcctggtgtctgacccgcctccttcccaggccttttgttcctgtcccggaaagccggcgtcctgccgcgcgatgcccctgctcggacttcttcccaggagggcctgggcttcgctgctcagccagctcctgcgaccgccctgcgcttcgtgcaccggggcggtccgttgccaaagccaggtgagcgagacagaattatctctggtctgtcccagcagggtctccagatctgaacgcatagcctcgcggcctgtattccagtagtgttacaatcggtttttatcgagtgcccactatgtactgacactgaactaagcgatttggatgcctggtcatttaatccttggagcaatcttgagaggttggagttttgatttccattctgcagttgaggaaacggaggctgcaagattaaatgaatgacttatacacggatatgtagtaagggagtattttaattcatatccacactttttcctgaaactcttggactcaaacagtaacatttttaagcgaaatatatgaatattcctagtaaatgagatgactaaagatcagaagtagactgagttcgtcttagaatttacctcaaaatgaatctcagaaaaacattttcagatgtcagagagttttggattttggaattgcagataagggattgtgtacttgaacttggacttctcttagggcagataatcgccatagtatggaaccaccacatcctctatttttggaagggcatacagcgtgctggtaatgtcactgattaagttttgccttacttcggaaagattctaatgctctcttagcagatgctttgtgctatcgtgaacaatagggcacagatcttttattgatattcaatcacagcatcttatcagtctgagttttttagttcattcaagaaatccatatcttatcattccacaggcttgttctgtgtccttgagctggttcccttgtcttcaagttacagttttcctctctctaaacctgataaccagtgctaccttattaaaaattattatttttttgtccgggcacagtggctcatgcctgtaatcccatcactttgggaggccaagggtggtggatcacctgaggtcaggagtttgagaccagcctgacctatatggcgaaaccccgtatctactaaaaatacaaaaattagccgggcgtggtggcatgtgcctgtaatcccagctactcgggaggcagagacaggagaattgcttgaacccgggaggcggaggttgcaggagctgagatcgtgccactgcactccagcctgggcgacagagtaagactctatctgaaaaaaaaaaaaaaattatttttgctctttcagtaggaacggtgacctggagaagatcaccataatccctacccctgaatggttggtgttggtagtggtgggttgttcagtgccttcattattctcagattcttaaagtatttgagaatattaaaaatgcggctgagctctgtggctcatgtctgtaatcccagcactttgggaggctgaagcggttggatcacgaggtcaggagttcaagagcagcctggccaacatggtgaaaccccatctctactaaaaatacaaaaattagctgggcgtggtggtggcgcgcctgtagtcccagctactcgggaggctaaggcaggagaattgcttgaaccaggaggcagagattgcagtgagccgtgattgtgccactgtactccagcctgggcaacagaccgagactctgtctcaaaaaaaaaaaaaaaatccatatacagtgaggaagcttgtgtggtgaagacctgacctcatatatattacacgtgtaattgtaaatacaacatagattctttggggtgggactgagattgggatagatgaaatggtgctttggcttcctgttgctcagggtgaagagtctttgcaggttggtggtcaacagggtcagagatgccacaggtctggccagtgtccagagaagccacatctcacattcattcttctgccaggttgcagaggcagtgttaacatcccaactgaaagcacatcaagagaaaccaaattttattatcaagaccccaaaggtaatactttttgcctaccctatcccattagagtgccttggaggactgacctctgccttgcatgtctctctgaccccttttaatgttctttacagtaaattttaaaaatatatactattcttgagatactaggtgcggctcagagtcatttgaactcagtagatttcagctccagacctgagattacataataagtgtagtttaactccttgtctgaaatggacttattttttgtttttgttttcactatggctgcttttggtttccagggtaccagggatcttagtcctcagcatatggttgtgagggagaaaattcttgatttggttatcagctgctttaaacgtcatggagcaaaggggatggacaccccagcatttgagctgaaggtaaggggagaagaaagagtacgtgcaacctcactcacttcttcaatggcgttcagtgtcccaaagggcttctcatctgtgttttggagtcatgctttcaactgtggctcattctgtttgacccctataggaaaccctgactgagaagtatggagaggactctgggctcatgtatgatctgaaggatcaaggtggagagctgttgtccctccgctatgaccttactgtatccttttgagtactggagcctgacctgtctctttccaaatccagcgggctttctctgacaaaagtggagaacgtgactttgggatcttagaggtccattgcctatacttctagtttctcccagaaggcagttctgctacggaagcctggcctggagccctgtcatttaactctagtgtgtatcataatcctttgggggagcttgcagaagcacagacatttggctgcagtcccagagattcttagctaattctgtagctggaatggggctcaataatttgtattaaaaaattgttttttttggccagacacgtggctcacgcctgtaatccaagccctttgggaggctgaggcaggtggatcacctgaggtcaggagttcaagaccagcctggccaatatagtgaaaccccatctctactcagctcctgctgagctctggggctctcaggttctgagtctagtttgggactgactgtcaccttgtctccacagatctcttttgacgtaaaaagttagctggctgtggtggcaggtgcctgtaatcccagctactagggaggctgaggcaggagaatcacttgaacccaggaggcagaggttgcagtgagccgagattgcgccattgcactccagcctgggtgacaagagcaaaactctgtctcaaaaaaaaaattttttttgtggagatgggtgtctttgttgcccaggctggttgtaaactcatcgtttcaagtgatcctcccatcttggcctcctaaagtgctggggttacgggtgtgagccactgcatctggcctacagtctgcattttaaacaagcatcgtgggtaattaagatgcatgtagtcctttccctgcactttcagaaccagtagcttagaagttgttaggcaaatccaagttctgaagcttgactattttgagatggttcggaatcgatctgaatgggcagaaagacctgaagttagttcttgggtcacttctatctctacttgccttgctttctgctgaacttttagttttgctaggtgagattccttcatttgacactattcaatatatattgaattccaagcactgctaggccttggggatagtggaaaaaagggaaggtccttgttcttaccctagtggatgagatccagttgatataggcccagtcctccctaatgtctgtatactgggcctaatctttggatgcagtatccctcttccttaacccatttatgtgaggttccctttgctcgttatctggccatgaataaggtgaagaagatgaaacgttatcatgttggaaaggtgtggcggcgagagagcccaaccatagtccaaggccgttatagggagttctgccagtgtgtaagtgacctgatgggagcagcacagtttgatagttctaggggccacaaccttgaaactggctggataatggatgttttttcccatctttttctttgctgtaggattttgacattgctggtcagtttgaccctatgatccccgatgcagagtgtttgaagatcatgtgtgaaatcctaagtggattgcagttgggagactttctcattaaggtgaggccagggctgagaactgtgggagaagtctggatttggcctaatactgtttatgcaagtcccaaacttgggtgactccaacccttaagcctgcaactgtaggactttcctagtaaagctgttgtatttcctatatgtctgtactcttcctgtgaaatttccatcctttttgtgtgtcaggaaagtaggtactgccattgttttgagtggaagggcattgacaagcacttgggtcactgacattgagttctcaggtaaatgaccggcggattgtggatgggatgtttgctgtctgtggtgttcctgaaagcaagttccgtgccatctgctcctccatagataaactagacaaggtaacaaagaagacatacttcagtagaccctatctagcttctgccctgccctcaaatccataccactagtgaaaaataaggagattgtggctggaagtgggctattttggggtggaaggtaaggaggcatactctgaaggaagatctgagtcatgctatacagtggggattgtgactggatttcttaagctgtctctgactttgctgagtatacagttagctacttgtgatgtatatactgaatggaagttgagttgtcctttttcagtttgagaaagaaagatcttggggctgggctaatgtttgggtgtttatgcagatggcttggaaagatgtgagacatgagatggtggtgaagaaaggcctggctcctgaggtggctgatcgaattggggactatgtccagtgtcatggtaagaaccagggttttcagagctgtgatagaaccaggctgaaggtgacatgtgctcaaattctacctctgaaacaactcttttctgtagatatgctaagctccagggcctgtcctgaatttaatttctcttttacttattgtaacgactttgtgtcttcagatggcaaagctagaggcaaaggaggagggtcttgtcatgtgagactgggatctttttttttttttttttttttttaaagaaaatgaggaagactagctagagcacattagggataattttgaatgaaacacatgtgagtgaacagcagagactttatttctctccaggtggggtatccctagtagagcaaatgtttcaggatcccagactatcccagaacaagcaggccctggagggcctgggagacctaaagctgctatttgaatacctgactttatttggaattgctgataaggtaagctgaattgcaaatggacctcctgctgagctctagggctctcagggtcccgagtctagtttgggactgactgtaatcttgtccccacagatctcctttgacctcagcctggctcggggcctagactactatacaggagtgatctatgaagcagtgctgctgcagaccccaactcaggctggggaggagcccctgaatgtgggcagtgtggctgctggtgggcgctatgatgggctggtgggcatgtttgaccccaagggccacaaggtgccatgtgtgggactcagcattggggttgagcgaatcttctacattgtggagcagaggatgaaggtaggtcctagataggtgtgaggtggggctggagacctaaaaaccctcctgtttctggaggtgtagttggagtggttttctgatgattctttttgtcttgatttttggaattgctggtggaaaggaggtttttattagttttactttcttctctcttattagaccaaaggtgagaaggtgcggactacagagactcaagtgtttgtggccacaccacagaagaactttctccaagaacggttgaagcttattgcagagctttgggattctggaatcaaggtatggtggagctgatatctgagccatctgggtatgtgtggaatttaggacccagggctatatctatcttatgtctggggtggaactcaaaacctttttagtctgctagctactactggctactagattggctttttagggtaggcggactagccacttatctctggctttcttggatatccatgttcctgaggtttgttgctgtgttcacttctaagtcccttactctgtcttgatccttttcaggcagagatgctatacaagaacaaccccaaactattaacccagctgcactattgtgagagcacaggcattccactggtggtcattattggtgagcaagaactgaaagaaggggtcatcaagatccgttcagtggccagcagagaggaggtgagtggcggcagcagaaatagaagggacgaagtgtttctgcctttcccagattctgtaagaaatatgcatcttctggctgagaaattatcttcatggttaatagtggtagagatgaacaaacactcactcaagatgaccattgctgcctgtgagtattgactgggtggccagaagaaagacaaatgaaatccgaatgggtattttgagactaatcaacataatagacatagatcaggtgtttgaatccctttcatcttgagggtatacattcttcaggtcaacccacactactcctttctggttgtataagtaatgggagaagatgcagagtaaaacaaatctggaaaaacagtggctaaggagttagtatcactttctagtttatcacatgaggattctcttatgtttcaggtggccattaaacgggaaaattttgtggctgaaattcagaagcgactgtctgagtcttgatccttgcctgattcccatctgctgctctttgtagaaaaggtttcctctagaactgaattcctctggaattgagtgatggacttcacaacaactagccaggaagggtgacaagtaccttctgcctcctccattcttcctgggtgcagaactgtagaagaccctgaggactcctgggctagtgtgagcagctattctgcatgggtgcagatggctggatgtgaaagagacatgctctagctgcagaggcaaatttgaagtgccacggaacgttgtcaagaggtagtgagattgttgctgtgagcaaggctctgggagagtcacctcaggctcaggattctgaaccattgagatcagaaaccagatacttagccttctactgtagctacggaaccagattctggtgaatttgtccacaatcagccattggcctgtctggggagtttttggaagacagcaaagaggggcaatggctgctttcagctttgaggacagatgctatcctaagggcatggcagtacccatgttgatttgacatctctctagcccatccattgcttacagtagaagagtggggctgtatgcttgataatcttgaacattgaacttaatagatgacttgacaaggtagagatctgatattttgagattttggagaccatttcctgtgccagaatcactgctctattccataccgtgccatggaggctgttttagaagtggttggataacatgttaaataaaatattaagtgtagtagtttgggtaatttgttattgttatcaagggctttgtttgcatagaccatagaaaatgcttgagtgtacattggagaattctgtgaggtagaagtaacctccctgggatgatgcttctgtattcagtgatgagcagccacagtttctccctctttccccgtctcctcaagaggtagtttttttgtttgtttgtttttagacggagtcttgctctgtcacccaggctagagtgcagtggcgtgatctcggctcactgcaacctccgcctctcaggttcaagagattctcctgcttcagcctcccgagtagccagctaatttttgtatttttagtagagacagggtttcaccatcttggccaggctggtctcaaactcctgacctcataatccacccacctcagcctcccaaagtgctgggattacaggcatgagccactgtgcccggccaagaggtagttttgttgctaaaaatcaacatatagtgagccggtatgccacagtgcttcactctagagtgttgatgactggcctttccaaatccaattatgctgattaaattatgttctactataaagttccccagatgatggaaaaataagtgaaccaaagggtggtagcattgcttcaaggaaaagagcccaagtgcaaaacatgctttttatatgtgcgtcgggaagggtgcctctgttgcaaacgtttcagtgtagtttagggtcatatccctagtgcatgcaggtgaatgagaggcatctagaccccctaatggcgcttcggccttaaaaaaggtttagaaattcttggcagtggacgcaaagttgctagactagatcagagaccactgttttgcgaacctcagtttccttgtttgtaaaatagttgaactaaatcttgaccctttaatgcttgttttgaaatccaaggcaaaaaacaattgcaagcgcccttacttccgtgttgcttcatactcctcttgcgcctgcgctgtctccttggagcagaggcggggccaacaagcctgttttagaaaccctccagtccttagctcgtttagaacacaagactccaagcttattggagggctatcttgccttacggctccaagccgctttttacggcgtttttcagctcgccattcacttcgctgtgaagatggcgtcgggcagcggggtaggtgttgtgtctgaggaggaggttttgcggggtggggaatggtttttcagacctgaatagagacaaactcctgcacccgactggcttcccgatatctcctcgagatcccagggttcaggttcaagaactccccagtaataggccttggcagagggtcagtagaatcgcggaggtttctcgggttggggtcttgaggctacctcagtcttctcgtacagtccaaagaggcttcgctttcaaaacgtcctgtagacacctggaccgcgagggcgcggttccctgcttctctaggggcccagacacggcgacggatcttgacgctttttcctccccacagacaaaaaacttggactttcgccgaaagtgggacaaagatgaatatgagaaactcgccgagaagaggctcacggaagagagagaaaagaaagatggtgggtgctaactacatcaagggctaagggtatcacagaggcgatgcgatgatggagagcgggtgggagttgaagtgcgctgccttcccacgcggtgtaagctctggcagagtgctgcttccctgggcctaggtttctgcatttacaaaatgagagcgaggaggtgggatgaagtaagtagttttgagatgctcttcagctctatttcactctgcttccttgcccaccctttgcttggctcgtttaatgctttcctgaagtacagagaagataacggcatccttagtagtgacagagaagttaagtagagtattttgctgctgtgcattaccgctatcagtgacccccctctttcccttgaaatttcttaagggagagaacattcctggcccaatcaagaccctcccatatagtctgagaaaagccggggaactttgcaggatctgtgattgtttcagctagagcttagtagtgctgtttctctgtgccttgtacatcagggagttggtgcttctctcctgtttaagagattgcataaagaaatgttttattttgtcatctgtttcaaacgtgtacattcttctttccctttacctccaggccaccttgcactcactaactctttcattttttatgtaacatgtaaaataaatagtgcttgacatgtaacaggcatttcctagatgttggtccccttttataaatttgcccagctctcagaaggttcctttccgttatgcctagggtatctgcctgaaagcattcttgaatgtccttgctcccgttttgaaaaagttgcttctagtaattcttcagaaattctcccccacaattcagttaatcaatgaatataaaacatactgtttttagatttgctggctttaaagtggagaaaagctgtagagttgaggattgcttatgattttttcctgtgttgagattctccccagctgctactttaagtgtctgttgtgtcctttcaggaatgattttgaaatgagtaagacctgaattttggatttcatgcattttttttcctttctggttgaggaactataatattgaagggacttccttccccattatgtttcaggaaaaccagtgcagcctgtcaagcgagagcttttacggcatagggactacaaggtggacttggaatccaagcttgggaagacaattgtcattaccaagacaacccctcaatctgagatgggagggtgagttgcttatcatttttcctctgcagccaagaatgcatctaataagccacctattttggttttaggaagtgttgaggaaggtccttggccccaggattacgtccttcttgcctgtaattctatctttatatttgtttttctgtgtctcccaaggtctcaagttgacatgatagtgtctctaggaatggtcactcagtgggtttcttcatgttattagcattggctgggcacagtggctcacgcctgtattcccagcactttgggaggccaaggcaggaggattgcttgagcccaggaattcaagaccagcctgggtaacacagtgagaccctgtctcaattaaaaaaaccaaaacaaacaaaaatcatactatgagcactacagctactactcaatatagtttttaaattttttattgccattgtacttgttatcaattctgatttactattaatattttaaaagggattatttgatctgtcagaagaagaaatgaaggaaaggactactgaggagatttctaggagagaaattaggtggagctagaatagagcctaggagttgttaatggtgaagaagaggggtttgaggttccagactagctgcaaaggctgtagttgttatggatgcctgattgtacaccttcttccaagactataacctataggaagaagggtcctacaagagcttgtcacccttttgccccccactgcttctctgtccagttaggttttctggcaggagagcaacacagatagcaatgagtgacacttctctgagctgcttagtaaacccactgttgtccattcctgtctgtattagttatctattgttatgtaaattaacaaattaacctaaagcttagcagcataaactacaccactcacagtttctttgggtaaggaatctgggagtggcttacctaggtggttctggctcagggtcttcatgaagctgcaatcaaggagttggcaaggtaggtctgcattcatatgaatcttaagtggggctggaagatctgcttccaagctctctcacatgcctgtggtttggaagcctaagttctttgccccatagacctttcttttttctttttcttttttcttttctttttttttttttttctgagacagagtttcactcttcttgcccaggatggagtgcaatggtatgatctcggctcaccacagcctcgcctcctgggttcaagcgattctcctgcctcagcctcccaagtagctgggattacaggcatgcaccacctgatttttttgtatttttagtagagacggggtttctccgtgttggtcaggctagtctcgaactcccgacctcaggtgatccgcccgcctcggcctcccaaagtgctgggattacaggcgtgagccaccatgcccggccaccccatagacctttctataagactgctcacaataaagcaactggcttccccagagcaagtaacccaaacaaagacagaaggcatggtttttaaaataacctaattttggaagatactacttttgacatattctattggccaaacagaccaactctggtacaaattgggaagagactacacagagtaggaataccaagagggtggggctcatcctggggctgtcttggaagatgactgctatactctctcgaaagctaaggctttatagaaatgaaggcttaacacttctaaaaagaagtttacctaaaaatttgagtttcttggttgaaaatgataagatccttaaaaccatatttgactcaggtgctgtttcttcctgttagatattactgcaatgtctgtgactgtgtggtgaaggactccatcaactttctggatcacattaatggaaagaaacgtaaggcttggaggtagcttgtgactagggctggaattgggttttggaggtggggtggaatggaagggtagctttttttttcttctttttactcatcaaaagatggctggagtaagaagggtagtttctactgggctcttttttgatgcccctattagaactctccagttgtttcagcacaggccgtcttttacttcattatgtaatatttctggaggccgtgaggtaagaggcctcattctggaggccatgaggctttcaacagcacccaaaccatgtgctgctcctggacccagctggccaagggagtttcttttagccataattatttttgctgtgtgttttatgagatgtcagagaagtcaggaaaataatttttgaggggctgaggatgttgtaatgaacttgccttcttcactgttgaccctatgcagatcagagaaacctgggcatgtctatgcgtgtggaacgttccaccctggatcaggtgaagaaacgttttgaggtcaacaagaagaagatggaagagaagcagaaggattatgattttgaggaaaggatgaaggagctcagagaagaggtaagggtctcctatccttcccctctcccccagatttgagttttatgttatgaatcatgggagaccctgtcctcatcccactcctactcccacccccagagttgtatctcctgagttctgtatattagcggaaacatttgttgcctttgtttaggattctcatgatctgaaggaaatggctctgaaactacttttttctcctagactctctgggccttatttttttttttgtaatttttaaaaaaatttttttttttttttggtcatacagatatttctcaacttctgatggggttacctactgataaacctatcatcaagttaaaaatatcataagtcaaaaatacataatacacctaacctactgtagtttagcctagcctaccttaatgtgctcagaacacattagcctacaattgacccaaattatctaacacaaagcctattctataataaagtattcatctcattaatttattgaatactgtactgaatgtgaaaaacaatggttgtatggatacttgaagtacagtttcaaatgcatgtcagtttttcaccattataaaattgaaaaatcttgtcagcatcataagttgaggactgtctcatctgtattctttgatttaatttttttaaaagactaaactttttttagaggagtttaggtttgcaacaaaattgagagggagttataaagatttcccatatacccactgtcccccacaacatgcatagcctcccccataatttttttttttttttaactgcaagaggaattaactaaatgtacctagtcctaaagagacccatgaaatcaggctgactgggtcaaaattctgtttcttccacttactggctgtgaatcttgggcaagttatataacctctttgtgcctcaatatccccatattagagatcttaatatacatgaagtactcagagcaatttctggcatgtactgcatgccccagaatgttagttgttgttacaaacaacatttggctgaggagtctaaactgattctgagtgatttttccctccaggaggaaaaggccaaagcgtacaagaaagagaaacagaaggagaagaaaaggagggctgaggaggacttgacatttgaggaggacgatgagatggcagctgtgatgggcttctctggctttggttccaccaagaagagttactgaggctttctgtgcttggcctgactttggcctatgctggacctaactttgcgtgtgtgtgtgtgtagtagggggtcatttctttttgggtaatgggaaagttcttaagagtgtcaatggggagggatagagggtgggggctcatggtttccctctactttgggagagggcacagattgcagaggtaatgctgtggcatattgcttctgcctcagtgtatcactggagtcacaggaccctgcccacctgagttcccaataaagaaaaacctccccttctgaggctgctttcccaaaactccccctgcatctttatctcttcatctatcccacctcttgtctgaacatcccacctttatcctgtgttctgcctttgttttaattttaactcatgttcatcctgcaacagaagcattctctaggtcccagtttccagttgattgcatatccttgatcagccctttttcccatcctgccctatggttctctagccacctgtgcatgcatgtgtatttctgcctggttctatggtgtgtggatgtgtgtgcatgaatctgtcatatagagggggtccgagctggaatcctagagcattgctgccctggggcctgatgttcttggcttcctcagagcatgtaacaggaaattaaatgggatgagtgtttggtgtggtttgtgtctgatgagttttttaacattcaggtgtagattgtttcagcttctcttgtttcattttcctgaagatttatgtttttgtctaccttgtgagcaggcttttggaagaacctgtttgatgcaaaaaagaaaatgaaaaacaaaacaaaaaatccccaaaaccttattatgggagcccttcggtcttagaagctgtttgacatgtataataaatggcattgactgggcctgttttacatttggtgagaacattccataa

SEQ ID NO: 12538 - DNA, 109 bp, Homo sapiens
agtagagatggggtttcaccatgttggctaggctggtctcaaactcctgacctcaggtgatccacctgcctcggcctcccaaagtgctgggattacaggcgtgagccac

SEQ ID NO: 12539 - DNA, 503 bp, Homo sapiens
tgggggttttgagcacaaatttctgtttgctttcatcaggacccagctgtgccttcagtttcaggagtttcgccacctcctcctcgatctgtggagggaaagaaggcgctgagctatccatctgtcactctcctccctcccccgccattcattcaatattcctccctcatcacatctctctgctcaggcctagctttgtttctctcgggacccaccccggatgtctccccacgcagcccactctcctccctacaagactggtcgcttccctcacatctctaccctatgtcccgaacaccctggctttacgtcctcccaggctttgccttggccctctcccctgctgcctaaatctcaccagctcggcgctggccttctgctgcttgaggcctcgcacgcgctctccctgaagtttcaccagctcctccagcgccgcacgctctgccatcccggctgtccacttgagccgcctgctgtctcgacctgcggtggttgccccagcc

SEQ ID NO: 12540 - DNA, 21477 bp, Homo sapiens
gagatgtatatctggggtcacgacaggtggtcaaacctgcaattctaccatctctgcctgctctccagctaccactgtgtctgagcaggaagggatccagccagtcatttcaaacccttctatcagcctcctctggaacccattcctgtgaatggacccagggtacagggatggcttcctgtaactagaattaggcatgggacaacagctacggcaggtctaggtctggctttgcaggtagctggaaacaggcctgggttgccccactgccagctggggaggcagggaagtggcagccttgccaggaagagcaattattaaaagggtgcagacagcgagagtctctctgaaagtgaggcaacctttcccactgccattagcatttccactaaaaacttggcatttgatagaggggaaaaaatgtattttttcaactgtgaaaaggtcaggcatatttatctgacttaataatttataattgatatttaatgcctccttgaaagatgacctctaagcacccggccagcaccctcttccctttactccactacatcctgctgggcgcaaccccatgccacctgggttagaggtcagacgacacctccacacagcctgctcctcgtgcttgggtgggccctgactccaccatcagtgaaaagacagccagtctcccaagtctaatcccagttctgccacatttgagttctctgtggcagtagcgatgctgtaagaaataagaaacctcttgaatgctataagaaaattataaaattcctcttctccacccccttttccctttttaccagtaaggggttctcttatgttgaaaatcaactgaaggaaagatgaaggtgcctagaaaatttcgatacgccctaaagccaatgtcactagcctggagatcttggaggtgacttgaccattgtggagccgctcccctcaccccttcagaaggtctctagagaactaagtagtacagggctcccggtttcctaaccacaagctccagaatctagagaaggccttccttagacagtaggaagtattgttctccctcagagatgggacaaacaggggaagtctgggaaagacccttgggtggaatagggtggggccaggctcacttggagaggaatacaagagcctacctgcatggtgagaagattttttatttgaaatatagtctgagcaacatgagtgtagccaagaggagtaggggctggcctgcctggggcagcagcctctcaaatggcacgagagcagtacaaatattccaatgtctgtgtgccccaaccccacctgtcaggaaaggcagaacagcagaacaaagacccacccacagcgccttctcaaggggtctggttcttggtgcctgcctgcctttgccttacctcctgctctgcccaggttccaaacagaggtgtgcagcagaggtttctcccaccccacccacagagacatgatgagccagtgtgacaattagttctcaggactattttgagggaaaagaatcagagaagacagggaggaggggcaaggtgatcaagggccctcgccaaaccagactaggcagagctctcccagagggactgtgtcagcacccctcatttccctccttctcaggatctaaaggcaggaaggagagctggtgtctgcaggaaaatagagctctgaggagcgccctggctgaaggcagcaagcgggaacctcccagaagagcacagccgctgtggggttcaagcctagttgacagcagtggggttgggccacataagcagcttggggttggaaggacacagacaagagatggggcaccaagaagcagcgaaaagccataaataacagaagcaaattcagagctgtgagggtcctggccgaccccacatttcctggggctgggggatacccagcactggcagctcagggcagacactactccagggtacaaccggtcacactcacactgggggcagagccttttattttccacggtccgcagggcaggtggaagacacttcggcaccacccctgaccatgcacactgcaaagtctccggtcacacctgaggggacagtgtgtggctgtcctggtcctgagaggcctgtggttgactgtgatcattgtggccaccatcgtcctcaggggccgggcccagcaatctcctcgcctctgggtcagctgacaaaggctcaccggcacattcttccagtccattctctctagtctccatgggcacctcctccccggagccctcctctggctctgccacctccactgccatctccgctgccgccgcctcctcttcctcctcctcctcctggtctctcaccttgtggacaatgaagaggtggcggctgagggagctggcagaggtgtagcacaaaccacagaggagacattgggctgtggagctgtccacctggtgctgaggtatgtggctctgaaactcgagccccgagtctgtggcaaaactacatttcgcgcactgaaaaagggacttgtgccttttggtggaagagacagttgcgccattgctggtgcctggagcgtcccccactccactgactggtcttttcagatggttcacctaaaaggagagacagcatgagcaaagtccaggccaagccctggacatgagcccctagacataaccatgagcccaaggactcaaagaaagcaccacccaggccagggtcaccccagccctgaacgctggtttacgtttggtttgtttcaattctttgttttgtaatgtaacatatgcatgtgtcacaatactccaaaggcacgggaagggtatagagactaccccactccccagacctgctctccaaagaacatattacctgggtttgtggctcctccaagaggtatcctatgcctatacaaaaacaaaactattgtcttttacaaaatatggcatgccatgcatacttttctttttctttttgaggcagggtcttactctgttgcccaggctggagtgcagaggcacaatcacagctcactgcatccttgacctaccgggcttaagcgatcctcccacctcagcctcatgagtagctgggactacaagtgaacatcaccaaacccagctaattattttattttatttcatttcatttttgagacagggtctcattttgttacccaggctggagtgcagtggcgtgatcacagctcactgcagtcttacctcagagcttaagcgatcctcccacctcagcctcctgaatagatggaactataggtgcacaccaccacacccagctaatttatttacttatttattgtagagacagagtctcccaatgttgcctaggctggtctcaaactcctaggctcaagtgatccttccaccttggcctcccaaagtgatgggattacaggcatgagccaccgcacccagtatatgcatgcttttcttcaccctgtgtttttcttgtttttgtttttgttttacttaacaacatacattggagcatgtttccatgggagaacatacagaggcttcattcttctaaaggcagcacactaacccaatgtggggatgagaagtccccaacggcagacatttagctgagttccgtctttgttactgcacacagtgctgcagcaaacatcctttagcagacttctttatgcccaaggcaaaagatctctctaatagacaaatcctagaagcagaattgctggatcaaagggtatgtgcattttgggggaagggaggatgtacattttacaattggacaggtgttgccaaaaacatcaatcgatacccccagctactacgcatgaaaggtgctttgccaactactgacaccatctgattaggcaagaacgtttttaagaatgccttgaaactccaggcagctcttaggacttcccagacacacctgacccttctgtggaacagcacccccctaccatggtatggagagaggctggagtgaggaggaaaaaccaggctgctccaaagttcaccagaaatcagaatagggcatggaacagggatgaggtcatagggcaaggggccaggatagaaggttctaggcctggctcttcctataactagtgagaaggttggggggtgagttggccaaacatcattatcctcatctgacaaggtagtcctgtgtgctcccgcctcaggactgctgtgaagcagaaagagaatggtatgtgtgaaaatgcaccaatgtccacagagcacagcacacccctacagagggggccgtggtgacagggaagcaacagtaacaaaaggctgacaggccaccttatgggtctttgtccttatcccctacttgtgtccagtgccaggcgggtcacacaggactagagagtgacccacattgagggaagctgtcactctggttgttccatggccacaacagtagccttcctaatgcccttccagctccaagcctcactgagcagccagctccaataggcagggagcccacactcacctgaggggaatgtccacccggaggtttcactttggacgtctggctcaaatcagggtttctgatgccatgcataaggctgatgtggctctccagaagggagggccgaggaaagctggggctgtcctctgtgcagtacctgcagaagcacagcggagaggtcaggtaagtgcccgggccgcaggctccctcagtgctattcacaccaaggccaggaaggagggagtctggagcagactcctgggctggctagtgctgggaaccccagagagatccagccagcaggccagccaaggtagcagacaatagcacgtcagaatacttgcactcttgacacctggcactcagccacaatctcactgaacactacctgatgtcaccgcccagagacccaagtgctaggctagtagtcacagtgaaagggcctggggccaccccaaggcacaggcagatggtgcagaagcctctcggccccaggggtgcatgctcacatcaccacccctcctcttaaacctcaggatgcttcgtgactgatgggctgtgcagtcctgggctagagagtgacgagagagggctcaggagctaccaggttctggaagctgatttttgacctgcccctgatttctgacttagccgcaatttcttccagttggaaatcacttgtctcttgtcttagacacctgatcttgcagcacagaaaagccccagtggtgccacggacagagtcttttgaacctcaggcctcctcactactatccccagggactcacccgcaggtgtagaacttctttactgtgtcatggttgttgcggatgtgtttgcgcaggctgttgggggtgtggaaggactgttcacactgccggcatgggtaccgcttcaatgtctaaggaaggaggtggcaacacacaaagcatcagaactgtaagatagttctgggtgcatttttcttctcagatgccatgggcagaaaggaggatactcccgaagacctcaagatctgtggtacccaccctgccctaagcaccaggaaccctaggggttctggcttcacagaaggaagtccagaggactgggctctgcattatgactgtgtggctgcacttacccgaccgtggctctttttcatgtgggacacgtagctctcccgatctggaacccactcctggcactcctggcaggtccagccagtgttcctcagccgcggcctggcttccaccctgcggtgggcttcaggcctaccccagcggccagaaggcagggagctgctccgagcagccacactagtggctggtggctcagtgggaactcgagagccagggcggcttgaggatgtgtccgctgaagactggaggcttgacagctcgtccacatttcggggaacaccgtgggtgctctggggatggggagagcgattactgactgggcaaggggaaagatgcacagagtcagacccccagcctgaggcatgtgccctcctccccggcctcctcccgcaaggcatcccaccttgacgtgttgcatcaactccggcttctgcacgaacaagagtgggcactcagggcacttgaagacgcccacctgcgtcttgctgacattctggtaaaaatgctgctgaatgtgcctcttcttgttgaagaccatttcacaggagcacttataaatgagcctgatgagacaagccctagggggtgaggtggccaaggcaccatgcagcccctccacccatctctgctctctctgaaccagggtcaagtttgggaaagcactaccctgagccaatgtggatgctcccctgcctcaggacatccttagtacgaccccaggcacctctgccactaaccccagctccctcacccatccctatgccaccccctacagcacccaggctactcctctctgctccacagggcctgctggccctggagctgcactcactgggagggtctgtggggctgggtggggtgctgggtggcactgtggtctgcagtgctgctggcagtcttgaaggccatggggcagaatgcacatttgtggaaaacctggcagtgtcgctcctggatgtggcttttcagcaaggccaaggtcaggtggacgacaccacagtggatgcacctagacagaagtggggtagtgtgagtgtgggtggagtatagggagtactggacccagaggtggtgctgcaagaggagggatggagaagaggaacagaactatccaggcaccttctccctccctcaatcacttggacttccacccttgacaagtacgtcctgagggtctgcttgctacagtctagcacaatgtggccacacagtggcccccaagcccaaggccacgccttgtacagaagggagaaaccccaaccttccctgcactggccagaggatattctgcaaaccaaaaacctgagcctacctaagagaagttggtggaagtggagagggaagaaaatggttcaataatggcataaacagtatttaagtgtgaggcaactgtagaagtccaagaatttccgaaggaggctgcacaaagcccatgccttcccacaggctggtatgagtaagtagggatgaccacttaacaaaacatacagtcaggcaatgctatggtcaccaaaacaacaactacattaaaaaaacccttaaagcccaggaagaaatactctatagtgttgtccagtggaacttgctgtgatgaaggaatggtcaatagttccactggggcgggcacgataggtcacgcctgtaatcccagcacttggggaggccaaggagggtggatcacacgaggccaggaattcaagatgagacatggccgacatagcaaaaccctgtttctactaaaaatacaaaaattagtgggcatggtggcacgtgcctgtaatcccagctactcaggtggctgaggcagaattgcttgaacccgggaggcagaggttgcagtaagccgagtttgtgccaccgcattccagcctgggtgacagagtgagaacctgtctcttgggggggagcgggggaagctccactgttcatgtggccacgtggctatttaaataacaaaaaaataaaaataaaaattcagttccttagttgcactggccacatttcaagcacccggtagccacaaatggctggtactatactatactctactggaccatgcagctcaaaagtgctgtgatgtcttcctggtggaactatggggataacttttcatttttttttctccctaccaatttgtattttctgagtttatttggtggattttttttttacaatgcataaataagataaacaattgtcttaaaccatttttctgaaattgaggccgtatggaacttgtttcaacttcacaacatctctctataaatactgcctttccttttatcgatatcagagaataatatgaccttcctccatgccaacctgcatccataagattactagtccctctcctgtgttcagtctttcctcctgcccaagaacacacataggtctcccctacatgacaaaacatcttttccctctctgctcttcctttttatcttccttttgttgcaatactgtctgccctcatattattgacatccccataggcactaaagagaggcaggtgctttgctaaaataaaaggcgtgccttcatttaagaattatttgactcctgaatgttaccctacgtttttttatatatatatatatatatatatataaaatatatatatatttatttatttatttatttattttttttttatttaagacagagtcttgctctgttgcccaggctggagtgcagtggcacaatctcggctcactgcaacctccacctcccagattcaagcaattctccctgcctcagcctcccgagtagctgggattacaggtgtgcaccaccatgcctagctaaattttgtatttttagtacagacggggtttcacaatgttggccgggttggtcttgaacgcctgacctcaggtgatccactgacctcggcctcccaaattgctgggattacaggcgtgatacattttcacggcccacataaatccccacagaatcctgaacaatcttttttcttccttgtgtgtattggaagggaggggtagagaatcaccttcgaaaatttaattagcaatgaagagcagcccacggaaccagaaagctttttgtgataaactccacagagcattcattactacatttgtatatgctttaaattagggtttctattcaagttacttacttaattttcctttctctcctgctaaacagaagagtgaaaccaacttctagcacacagaagtatttccacactacaaagtattatgaggagaaaaaagcacataattccacattcatccaaagtggccaagtacatctgatatgtgtaaagaatctcttaagtggctttatttgtgccatttgaccaaactcctgcagaaatagtagaaatacattcttttcgaatgctactgaaaactccttctatgtatctggtagacatttctttgagaaacctcattgaaagtaagaacacatgcaaagtatcctcaatgaaggactgaatccaatggtgtttacaagttgatgagaaagtatgcagaaaagagtgccaaccatatgacaccgcacttgaccacagttttttaagacgagatagacaattatggaatcatatgttgtgaaatatgtagttttagaaaagataataaacaacatatttaactttaataatcacaaataagaaaataacattaaaacagtctaaacttgcatccttatgacatcattagccattctccaaattattaataaagaacagaataatttatgaaattctgaaatatatgtgtatgcatattttacataaaatacatataaattttatatacttatatattatataaataaccatatataggctttttacattatcaagtaaaagcaaaaataatacaaaacataaaataatattgtaaaactctgtagtagagttcaataaaatggaacataggtatcttgagaatttactaaaaaaattaacatccacagaatgggagaaaatatttgcaaatctgacaagtaacttgtattcagaagatataaaaaactcttacaactcaattataagatgtcaaataacccaattcagaagtgggcaaattatctgaacagacatttctccaaagaagatggagtccaggccgggagcagtggctcacgtctgtaatcccagcactttgggaggctgaggtcggtggatcacctgaggtcaggagttcaagaccagcctgaccaaaatggtgaaaccccgtctctactaaaaatacaaaaattagccaggaatggtggtgggcgtctgtaatcccagctattcaggaggctgaggcaggagaagtgcttgaacccggggtggcggaggttgcagtgagctgagatagcgccactgcactccagcctggtcaacagagtaagactgtctcaaaaaaaaaaaaaagttggagtccaataagcacatgatcaacaccgttaaccatcagggaaacaagataccatttcacacccataaggatggttacaatcaaaaagacaataacaagtgttggcaagggtgtacagaaatcaaaacctagatacactgctggtggggatgtaaaaacgctgcagtcactttggaaaatagtctgacagtttctcaaaaagttaatcagagttactactttttttcctcttttaaaattatattttaagtttggggatacatgtgcagaatgtgcaggtttgttacataggtatacacgtgccatggtggtttgctgcacccatcaacccgtcttctacattaggtatttctcctaatgctatccctcccctagccccccacccgctgacaggccccagtgtgtgatgttcccctccctacagagttactatttgacccagctattctactcctaggtatccaaagcaactgaaaacatgtccacatgataacttgtacatgaatgttcttcagcagcattattcatattattcattattcatgaagccaaaaggggaaaccaacccaaaggtccatcagctgacaaatggataaacaaaacatggtgtatccccgcaatggaatctcagccataataaggaatgaaatactgatatatgctacaacatggatgaaccttgcaaatatgctaataatattacataattccacttatatgacatgtccagaagagctatgagacagaaagtaaattagcgattgcctagggctaggggggaagaaagaagtggtggatatgaggtttcttcttggatagtaaaaatgctctaaaattgtttgtagtgattgcacaactctgttatgaacactgtagtgttgtgtatgtcttctgacttcaaccgcagatcactgaaaattttaatatcgctatcttcagtaatccctttcgctgagtcacaattcatttggtctggcattccttacaaaaaggtttgataaactgaactgcttttgagacatttctttttacttgtacataagaaaatatgtaattaaaaatgaaaagtattaatccatccgtacaattaaacatttcttgggccaggtgcagtggctcatgcctgtagtcccagcactttgggaggccaagccaggtggatcacctgaggtcaggagtttgagaccagcctggccatcatggtgaaaccccatctctactaaaaatacaaaaattagccaagcgtggtggcacatgcctataatcccagctactcaggaagctgaggcaggagaattgcttgaactcgagaggtggagattgcagtaagccaagatgctgccactgcactccagcctgggtgacacagcgagactccatctttaaaaaaaaaaaaattttttttcttggattcaagattcaaagataaatatttaagtgttgattgtattactattggattggatttgatcttagaacaagcagcatacacttaaatcaaggctagaaaggtatttttaagtgttacaggatactgtaaaaacatattcagatgtttggtttaaaatatagcctgggatgctgccaagcaatgctcctcagcaacttggtggtaagtgctttgtataatcctgtcttaggtttgtcttgtttttaatgtactttagatactccatcctccataagatgaaaaagaaatcagtctacatttttaaatgtttataatgccaggcacggtggctcacgcctgtaatcccaacacttcggggagttgaggtgggaggatcgcttgagcccaggagttatgtgaccagcctgggcaacatggtgaaaccctctctctacaaaaagcacaaaaagttagccaggcatggcagtgcatgcctgtagtcccagctacctgggaggccgagatgggaggatcacctgagctcgggaggtcaaggctgcagtgagccacgatcacaccactgccctccagcctgggtgacagtgagacactgtctcaaaaaaatatacaaataaaatgtttaccccaagacagaaatgtgggagtcattgcaaaactttaatatacgtgttagcttcccagaatgatctttctaaaacatactagccagattactgccctgctgcaaatccttctgtagctcctcaatgtccgctggaaaatgtccaaatgcctgccaagaaatataaggtcttgcatggcctagcctcgcctctgccaaactcctcatccctcattccatataaaagctattgtcaaatcttgatgcttcttcctaaacccctgtcaaatctaccttctctccattcccacgatcatgccttcagtgaagccctcagcatctcatctggaccatcatacttgcctttcaagaagtcttcagtctctctcctcactaatatatgtgttcgcttcccagaatgatctttctaaaatatactagccaaatcactcccctgctgcaaatatttctgtagctcctcactgtccattggataaagtccaaatgtctgccaaaaaatacaaggtcttgcatggtctgacctctgccaactccctagtctcatttctccccactcccacaattcatcctgacattcctctatacaaccatactcatcattcctgacacctcttttgtgtatgctgttattcctggtcaggcccttgccaggtatggtttccccttcttttgtctgaaaatctcctaatatctcctttaggaagctttcctgaccatttctctattgtgggacttagcactctgggttataattacctatgttcttatgtttgtaacctaccagggcaagggctgtgtcttaatcatttttgtatcctgagtgtctaacacaatgccgaagacaataataagtacacacaaaaaagtcaaatgaactaaaaccaaaaaaaaaaatttaatgccaaagagcagaaaacaacttacagatcaatgagctctagagggaagttttttccctcactttgatcttttccctgaaaatgacttcttgcttatgtttgacacaaaggaggaaattccattgaaaataagagttttcttggttttaccaagaggctgatccttttttccagtctcaggttttgcccattttgccacaaactgacaaaaattaacaaaaagaaagatactaaagccctttgagtttggcatcttgcagccccatttgttaaaacctgcaaacatttccaagtactgtaattagtacattcattattgaaacagcactttacatttaatgtgccaaacataacttggtgagcaaattaaacttacatacgttttaaaaccaaatagacaaagtattatatgtctaatctccccaaaacttcaaagctaattttctaatatttaagtttttaaaactccttattcttctctctcttgttcttcctgtctgctaccaaataaaaaatgtctgtccacataccatccaatgctcttgtcctgtgtagactggaacccaagcctcttaagaccaaaactatctgaaatgagttctggcttaggaaaaggaccagccattgggcaataccaggacagcaagccaggcagcacccacctgtagcccaccttgcgggcatagtgcaggcaattctcctttacatgggtctggaagtaggcagagcggcagaggaccccacactccgggcagcagtagggggacttgtgtgcatgaatccgctggtgggcacagaaactgcactggttgggcagcagcatttggcatacctggcaggtctaggaaagaacaccaagaaagcagatcatgcaggggccataggcctgtggctctccaatcagggctgtctggtttgctagtacatgggtcagaataaccccttcccccaaccactctctcttccaactctcctggacacttctgacacccctagacctcatttccagtgctgatactgatacccaagcaagctttgtctgacaccctattaatcagagacagacctgaccctattctctcaaagaccagttccgccccaggactgtgtttctttcctgtggcttagcagaggaccagcttttcctttgcagaggcctaaagcacatcttgaattctaagacctcactgcactgctagacccaccagggtctctgtcacagctcagtagaggcagttcttgccatctacccccaacattggcctggtagagacctgctcagcacctcgagtcaggtggatcagtgacttccaaagtggatctgagaccaccctgattggtactcagaaggctctcaataaagactgactgagtggtcttgtcagtttccattgctctagccctgtttgcccactctgcaggttaggagagttgcgggggtgggggttggggggtgggatgggtggcgggggttccctgagccacagctaagcaaacatacccacagacaagggcagattaggtagcagctcctttgttcccagccccaggagaaaaccaggggaagtacaagtactacaaccagactaattacgctctgatgggcagagctctgacaagcagccagcccagagggaaaaagtaaaagacttcgctggtgcctgcatgctggagaggcccttcttaacttcttagtaaaggggacacctgtcctactcacagagggtggccactgatgtggggtcaaagaagctgactagagggatatagaagccagctcgaaggggcttgccactgaccaaagataggataacatgagcattaaaaagaatgactgaatatgtaaatatactgaatatataaaaatcaatgagccatgacaacatttaaactaatagaggaggtcacctcaaacccactaggatggctactatttgaaagaacagaaaataagtgctggtgaggatatggagaaactggaacacttgggcactgttggtgggaatataaaatggtgcatctactgtggaaaatagtacagtggtatctcagaaaattaaacacagaagtaccatatgatctagcaatgccacttctgggtgtgtaccaaaaagacttaaaagcaaggtctcaaagagatacacttttatgcttatgttcatagcaacattattcacaatagctaagaagtggaaataacccaagtatccatcaatggatgaaaggataaataaaatgtggtatgtacacacaatggaatattattcagccttaaaaaaagaagggactttttttttttttttgagacagggtctctgatgcccagactagagcgcagtggcatgatcttggctcaccgcagcctccacctcccaggctcaagcaattctcctgcctcagcctcctgagtagctgggattataggcacgcaccactaccacctggctaatttttgttttttggttttctgttttgttttttttgtttttttttttttaaatagagacagggtttcaccatgatggccaggctggtctcgaactcgtgacctcaaatgatccacccaccttagccacccaaagtgctgggcttacaggtgtgagccaccatgcccggccaaaaaagaaggagattctgacatatgctacaacataaatgaatcttgaggacatgctaaatggaaaagccagtcacaaaaagataaatgctgtgtgattccacttgtatgagatacctagaatagtcaaactcctagagacagaaaacataagggtggttgccagggcttgggaggaggaagataaatgggaattgttttttgtttgtttcttttttaaaacgagtacagggtttcagttttgcaacatgaagagttctggagactggtttcacaacagtgtgaatatacttaacattaacactactgaactgtacacatcaaaatgattgtgatgggaaattttacattacgtgtattttaccacaatttttaaaaaatagaagagggactcttagaacaccaattgagattgtcagggtatcaactcacaactctgagaactgttaattaaaagaaacaaattatcccattttccaacgtaaactatatttcagagtaaccaaatagccctcacggaagcaaaaaatatactttatacagaattctagctaataaatgagaaagaaacaatagaattagaaaaatatcctttgaaactcaataaaattagactcaagcagtgattactgatggataattaggtaaaaggtggggagctttacaatgaagggatcagaatattatcacctaaattcactctcattaattcagcatcattaaaagtgaagacaatcaggcactttgtgcctccttaagttatgaaacaggaagaacgcagcaccctccacccccaccctccatcaaaactgacctgaatctaatcaagtttttattgcttacttccagtctacaggaaaaaatatgggatatggaggaaaaaattccctgcatgaggaagtaatcagtaaaactcaaagttctggaaaacttaggaagcaatcagttaaacccagaattgttctggaaaatgctcagaacacatgacccaatttcttcaacaagtcaatggcatgaaaagagggtgcctactaggatggagtgggaagaggtactgttccagactgagatatttatgaaacataaacaaacgtgatgtatagccccatgttcagatcctgactcaaaataatcccaactgtaaaaagacattttttgacataactggaaaaatctgaatatgaacttgtagtaggtaatactaagggactgttattaattgtgttgggtggaatgacaatatccatctggctgacatcctgccccaacagcgtggcttggaaagcaagaggaaggatgaaagaactccctgggtcactgcagagggaggcatgctccattcaggggcagactcccaggaagaagatggaaatcccaaaccgatgctgttcccacagtccctgctgtggtgtggagcccaactatctgtccaccccctgccctggacacatgggctgaagctagatactgtcctgtggaaaacccaagcccagcagccatcaagcctagtttttaatcccatagctcagggctcaccctttccctgagactcagaagccacaatgagtggcatgagattttgtgagggatttggagctggctgagagaggcctgatagccttctgtgcactccttcccttcctgtcggcgggtgctcttctccagctcccactagggcagaatgacacagagaggatgtaagatgagaaaggtgccatgccagcctgggatcctacacccagacctctgcctactcaaattttagaagatgcacaaggaggcgggtgtgatggctcatgcctgtaatcccagcactttgggaggccgaggcaggtggatcacttgaggtccgaagttcaagaccggcctgggcaaacatggcaaaactccatctctactaaaaatacaaaaattagccaggcatggtggcgcacacctgtagtcgcagctactcaggaagctgaggcaggagaatcacttgaacccaggaggcagaggctgcagtgggccgagatcgcaccactgcactccatcctgggcaacaaagcaagactccgtctcacaaaaaaaaaaaaaaaaaaaaaaaaagatacgtaaggaccagtgtgaaaaaatcccaggcccaggcatcagacctccactgccatggggcctcctcatggccccttgactcagataaagtaaacctggcccaactcaaccatgctggggcagcaagaacactgaagccccaggggaagagacccagagtgcccacaccccatctgacgcatcagaagaaaaatgcaaactgaaacagagcaggaggagatgagaggccacagtgggatcctatagcaccttctggcccctttggggggctgagtcctctgcagaagccctacaggcccgccaaactcaacctctgacctctaccctaatatttccaagaccagcctcatgcataacaatgtcctcttcttcaaacccactctgcactctcatattcctttgctccctatactcaaaacacccttgcccctcctactcctccaaactcatccttgcaagcccaacttaaatttcacctccacacagcatcttccttacgcatggagtcatcgtgaattagtccctctggggcactctgcgcaactaagtttataaccttggtttagccccactctcagttggccatatactgtagctgtttgggtggtgaccactgcccttgctaggccactgtaagctcctgaaggttagactcccttctgccggcatcccctggttggcatagacccccagcccatgcacagtgggcactcagggaacacatgcaaagctcaacagctaccaacacatgcacagaaccctggctgaactgaagcaaaaagagctgttttactttcctcccaggcctctgtagcaccagcttagggaagcaccatgaggggtgggtctggctatgtcatgaagagaaccaccttctggaggcctctttcttcagagaaaccactaacacataacatagacacagaaggtgccaaagggtattctcagcgcagaaggctttttttttttttttaaatgaatctcatcaagcataaccaagaatcaaaacaagcagacaagcacagttgctttcctggagtggtgagaacgcagttgaaagaaggaggctccataaacctctgccacaggccccacatgtctgtccactctccttcctcctatcccagccctgccattggccctactgcagtttccacaaaaggactctgcaagaacagctgtgtcactgcagggcagaacaacaacttattaaagacacagttctttggctggggacagtggctcacgcctgtaatcccagcactctgggaggctgaggtgggcagatcacttgaagccaggagttcaagaacagcctgggcaacatggtgaaaccctgtctctactaaaaatacaaaaattagctaggcgtggtggcacatgcctggagtcctagctacttgggaggctgaggcataagaatcacttgaaccccagaggcagaggttgtagtgaactgagatcccaccagtgcactccagcctgggtgacagagtgagactccgtctcaagaaaaaaaaaaaaaagacaaagttcttagaacagactgaggtgcaggggcagtgactcagctatctctgtccccaagttccttggtcacatgctaagactgtgctgacacctgccagagaccagagggagatcatccagtaaagacctatctcgggcctgacactgggccttgacagaccctttgaggggaagttgagtggaacacgggacacgtccgtaaatacacttgctaaattagggtctcacctcagtatgggcaggacaccttttccaacaaacaccaaacactaaatattcaggcagacatcctcttctaagactcataagattccaccactgcccccatatcaatgagctttcctctccatgcccagtcatggaacctgtgtgagccaggggcccgatacccgtaacagtgagggtctgcttaccagcccctctgtctcctctgttgtcctctggaaatgtgcagccaggaccatgtagtcccgcatctgcttgtgacattcaagacacttgattgagtaccggatgagcctcacagggtctgggtagagtggcaaggctggaggagggggactggcactgcccgaagtgaggccatgtttgggagaggatgaaggggctggggctgctggtgccgtggagttcacaggggccgacacgaacatttggtccgcagagataggcttcaccagcagctgggaacactgcatgacgagccccttgctcttgtggtcacgggcgtgccggagcaggctgcacttgttgaagaagagcagcgtcttggagcacagtgtgcacagtacctcaatgtggacgctccgccggccatagtgctggctcaggctcttctctaaggcaaatgcgtctccacactccaggcagcagtacccactggccggcacgtggatcctgctgtccgcaggcgggctgagatttggcgcatagaggggcacggggttggagctgtgaaggaccttgttgaagacctctacaatcagtggggcagcctttttcacctggtggaccaggggcaccgacatttgtgtaagctgtggctggctccgtctttgcactgaagactgggctgtcactgatgcagcaacactgtgggggacgaggttcaggttggccaagtgcacggctttgggcaggaggttggcaggggccagggtggatgcctgcagtgctgtgctctgttgcttcttgcctgtctgtgagcctggggcagccccctttgggacccggggcccagaactgcagctgggagatgacgagtcactggcctttgtcatgctctcgtcccctttcctggccccctgggggctccctgaatttgtgcctgcctcaggaaagtgctcttccacaggcacctcatcccctggcatctcgctgggggcctctgcaatggcgctccctagaggtgacccaacaggggacttacttggatcatcaggatctggcaggatccttgtgacagtccgtttgatttcccctgatgatgtcttaatggttttgattctcactttgggaattgctggtggggagctggcagccacagacggtgagcctttgctgctgctgtcactgcagatgctacgagggctgtccgatggcttgatactttttctagtggcctccagagggctccggggactctttggtgacttgggcattttggggctacctttagaactctctttagtgggccctgagagatcctttgtgtggccaggctgatcctccttagtgacactagccactcttttggcctgcaaggccaccaaggctgccacacaagaggacagcttggaatgagctggctttagacgctgcctaggggggactgatgagcaggtaccaagctcccgggcaagccccttggactctccaatactgttgctaggatggctgttgaactccaaagcttccccgaagaatcgagtggcatccggatccttgtgaggttccactgtgttctgcccactttgctcgtgttcctgctggctccccaagggcaggggttctggcttgggttctttcttacaaaaatgatcaaacatatgcagctctggaaccggaaacttagccagagcctccaggactgggcctcccacagccccgcacccaagagggggtgggaaataactgtcagagtgtttgggctttatcccaaatccgttatctttgatgggatcctcaggttctgggctggagattggactgaactggttgaaggtgggtaatggctctgacttgggaggctccagtttgccagggaaactcctggcactgtctccattcataaaagtagaatcaaatttcccacagttgtggggatctggaggca

SEQ ID NO: 12541 - DNA, 21480 bp, Homo sapiens
gagatgtatatctggggtcacgacaggtggtcaaacctgcaattctaccatctctgcctgctctccagctaccactgtgtctgagcaggaagggatccagccagtcatttcaaacccttctatcagcctcctctggaacccattcctgtgaatggacccagggtacagggatggcttcctgtaactagaattaggcatgggacaacagctacggcaggtctaggtctggctttgcaggtagctggaaacaggcctgggttgccccactgccagctggggaggcagggaagtggcagccttgccaggaagagcaattattaaaagggtgcagacagcgagagtctctctgaaagtgaggcaacctttcccactgccattagcatttccactaaaaacttggcatttgatagaggggaaaaaatgtattttttcaactgtgaaaaggtcaggcatatttatctgacttaataatttataattgatatttaatgcctccttgaaagatgacctctaagcacccggccagcaccctcttccctttactccactacatcctgctgggcgcaaccccatgccacctgggttagaggtcagacgacacctccacacagcctgctcctcgtgcttgggtgggccctgactccaccatcagtgaaaagacagccagtctcccaagtctaatcccagttctgccacatttgagttctctgtggcagtagcgatgctgtaagaaataagaaacctcttgaatgctataagaaaattataaaattcctcttctccacccccttttccctttttaccagtaaggggttctcttatgttgaaaatcaactgaaggaaagatgaaggtgcctagaaaatttcgatacgccctaaagccaatgtcactagcctggagatcttggaggtgacttgaccattgtggagccgctcccctcaccccttcagaaggtctctagagaactaagtagtacagggctcccggtttcctaaccacaagctccagaatctagagaaggccttccttagacagtaggaagtattgttctccctcagagatgggacaaacaggggaagtctgggaaagacccttgggtggaatagggtggggccaggctcacttggagaggaatacaagagcctacctgcatggtgagaagattttttatttgaaatatagtctgagcaacatgagtgtagccaagaggagtaggggctggcctgcctggggcagcagcctctcaaatggcacgagagcagtacaaatattccaatgtctgtgtgccccaaccccacctgtcaggaaaggcagaacagcagaacaaagacccacccacagcgccttctcaaggggtctggttcttggtgcctgcctgcctttgccttacctcctgctctgcccaggttccaaacagaggtgtgcagcagaggtttctcccaccccacccacagagacatgatgagccagtgtgacaattagttctcaggactattttgagggaaaagaatcagagaagacagggaggaggggcaaggtgatcaagggccctcgccaaaccagactaggcagagctctcccagagggactgtgtcagcacccctcatttccctccttctcaggatctaaaggcaggaaggagagctggtgtctgcaggaaaatagagctctgaggagcgccctggctgaaggcagcaagcgggaacctcccagaagagcacagccgctgtggggttcaagcctagttgacagcagtggggttgggccacataagcagcttggggttggaaggacacagacaagagatggggcaccaagaagcagcgaaaagccataaataacagaagcaaattcagagctgtgagggtcctggccgaccccacatttcctggggctgggggatacccagcactggcagctcagggcagacactactccagggtacaaccggtcacactcacactgggggcagagccttttattttccacggtccgcagggcaggtggaagacacttcggcaccacccctgaccatgcacactgcaaagtctccggtcacacctgaggggacagtgtgtggctgtcctggtcctgagaggcctgtggttgactgtgatcattgtggccaccatcgtcctcaggggccgggcccagcaatctcctcgcctctgggtcagctgacaaaggctcaccggcacattcttccagtccattctctctagtctccatgggcacctcctccccggagccctcctctggctctgccacctccactgccatctccgctgccgccgcctcctcttcctcctcctcctcctggtctctcaccttgtggacaatgaagaggtggcggctgagggagctggcagaggtgtagcacaaaccacagaggagacattgggctgtggagctgtccacctggtgctgaggtatgtggctctgaaactcgagccccgagtctgtggcaaaactacatttcgcgcactgaaaaagggacttgtgccttttggtggaagagacagttgcgccattgctggtgcctggagcgtcccccactccactgactggtcttttcagatggttcacctaaaaggagagacagcatgagcaaagtccaggccaagccctggacatgagcccctagacataaccatgagcccaaggactcaaagaaagcaccacccaggccagggtcaccccagccctgaacgctggtttacgtttggtttgtttcaattctttgttttgtaatgtaacatatgcatgtgtcacaatactccaaaggcacgggaagggtatagagactaccccactccccagacctgctctccaaagaacatattacctgggtttgtggctcctccaagaggtatcctatgcctatacaaaaacaaaactattgtcttttacaaaatatggcatgccatgcatacttttctttttctttttgaggcagggtcttactctgttgcccaggctggagtgcagaggcacaatcacagctcactgcatccttgacctaccgggcttaagcgatcctcccacctcagcctcatgagtagctgggactacaagtgaacatcaccaaacccagctaattattttattttatttcatttcatttttgagacagggtctcattttgttacccaggctggagtgcagtggcgtgatcacagctcactgcagtcttacctcagagcttaagcgatcctcccacctcagcctcctgaatagatggaactataggtgcacaccaccacacccagctaatttatttacttatttattgtagagacagagtctcccaatgttgcctaggctggtctcaaactcctaggctcaagtgatccttccaccttggcctcccaaagtgatgggattacaggcatgagccaccgcacccagtatatgcatgcttttcttcaccctgtgtttttcttgtttttgtttttgttttacttaacaacatacattggagcatgtttccatgggagaacatacagaggcttcattcttctaaaggcagcacactaacccaatgtggggatgagaagtccccaacggcagacatttagctgagttccgtctttgttactgcacacagtgctgcagcaaacatcctttagcagacttctttatgcccaaggcaaaagatctctctaatagacaaatcctagaagcagaattgctggatcaaagggtatgtgcattttgggggaagggaggatgtacattttacaattggacaggtgttgccaaaaacatcaatcgatacccccagctactacgcatgaaaggtgctttgccaactactgacaccatctgattaggcaagaacgtttttaagaatgccttgaaactccaggcagctcttaggacttcccagacacacctgacccttctgtggaacagcacccccctaccatggtatggagagaggctggagtgaggaggaaaaaccaggctgctccaaagttcaccagaaatcagaatagggcatggaacagggatgaggtcatagggcaaggggccaggatagaaggttctaggcctggctcttcctataactagtgagaaggttggggggtgagttggccaaacatcattatcctcatctgacaaggtagtcctgtgtgctcccgcctcaggactgctgtgaagcagaaagagaatggtatgtgtgaaaatgcaccaatgtccacagagcacagcacacccctacagagggggccgtggtgacagggaagcaacagtaacaaaaggctgacaggccaccttatgggtctttgtccttatcccctacttgtgtccagtgccaggcgggtcacacaggactagagagtgacccacattgagggaagctgtcactctggttgttccatggccacaacagtagccttcctaatgcccttccagctccaagcctcactgagcagccagctccaataggcagggagcccacactcacctgaggggaatgtccacccggaggtttcactttggacgtctggctcaaatcagggtttctgatgccatgcataaggctgatgtggctctccagaagggagggccgaggaaagctggggctgtcctctgtgcagtacctgcagaagcacagcggagaggtcaggtaagtgcccgggccgcaggctccctcagtgctattcacaccaaggccaggaaggagggagtctggagcagactcctgggctggctagtgctgggaaccccagagagatccagccagcaggccagccaaggtagcagacaatagcacgtcagaatacttgcactcttgacacctggcactcagccacaatctcactgaacactacctgatgtcaccgcccagagacccaagtgctaggctagtagtcacagtgaaagggcctggggccaccccaaggcacaggcagatggtgcagaagcctctcggccccaggggtgcatgctcacatcaccacccctcctcttaaacctcaggatgcttcgtgactgatgggctgtgcagtcctgggctagagagtgacgagagagggctcaggagctaccaggttctggaagctgatttttgacctgcccctgatttctgacttagccgcaatttcttccagttggaaatcacttgtctcttgtcttagacacctgatcttgcagcacagaaaagccccagtggtgccacggacagagtcttttgaacctcaggcctcctcactactatccccagggactcacccgcaggtgtagaacttctttactgtgtcatggttgttgcggatgtgtttgcgcaggctgttgggggtgtggaaggactgttcacactgccggcatgggtaccgcttcaatgtctaaggaaggaggtggcaacacacaaagcatcagaactgtaagatagttctgggtgcatttttcttctcagatgccatgggcagaaaggaggatactcccgaagacctcaagatctgtggtacccaccctgccctaagcaccaggaaccctaggggttctggcttcacagaaggaagtccagaggactgggctctgcattatgactgtgtggctgcacttacccgaccgtggctctttttcatgtgggacacgtagctctcccgatctggaacccactcctggcactcctggcaggtccagccagtgttcctcagccgcggcctggcttccaccctgcggtgggcttcaggcctaccccagcggccagaaggcagggagctgctccgagcagccacactagtggctggtggctcagtgggaactcgagagccagggcggcttgaggatgtgtccgctgaagactggaggcttgacagctcgtccacatttcggggaacaccgtgggtgctctggggatggggagagcgattactgactgggcaaggggaaagatgcacagagtcagacccccagcctgaggcatgtgccctcctccccggcctcctcccgcaaggcatcccaccttgacgtgttgcatcaactccggcttctgcacgaacaagagtgggcactcagggcacttgaagacgcccacctgcgtcttgctgacattctggtaaaaatgctgctgaatgtgcctcttcttgttgaagaccatttcacaggagcacttataaatgagcctgatgagacaagccctagggggtgaggtggccaaggcaccatgcagcccctccacccatctctgctctctctgaaccagggtcaagtttgggaaagcactaccctgagccaatgtggatgctcccctgcctcaggacatccttagtacgaccccaggcacctctgccactaaccccagctccctcacccatccctatgccaccccctacagcacccaggctactcctctctgctccacagggcctgctggccctggagctgcactcactgggagggtctgtggggctgggtggggtgctgggtggcactgtggtctgcagtgctgctggcagtcttgaaggccatggggcagaatgcacatttgtggaaaacctggcagtgtcgctcctggatgtggcttttcagcaaggccaaggtcaggtggacgacaccacagtggatgcacctagacagaagtggggtagtgtgagtgtgggtggagtatagggagtactggacccagaggtggtgctgcaagaggagggatggagaagaggaacagaactatccaggcaccttctccctccctcaatcacttggacttccacccttgacaagtacgtcctgagggtctgcttgctacagtctagcacaatgtggccacacagtggcccccaagcccaaggccacgccttgtacagaagggagaaaccccaaccttccctgcactggccagaggatattctgcaaaccaaaaacctgagcctacctaagagaagttggtggaagtggagagggaagaaaatggttcaataatggcataaacagtatttaagtgtgaggcaactgtagaagtccaagaatttccgaaggaggctgcacaaagcccatgccttcccacaggctggtatgagtaagtagggatgaccacttaacaaaacatacagtcaggcaatgctatggtcaccaaaacaacaactacattaaaaaaacccttaaagcccaggaagaaatactctatagtgttgtccagtggaacttgctgtgatgaaggaatggtcaatagttccactggggcgggcacgataggtcacgcctgtaatcccagcacttggggaggccaaggagggtggatcacacgaggccaggaattcaagatgagacatggccgacatagcaaaaccctgtttctactaaaaatacaaaaattagtgggcatggtggcacgtgcctgtaatcccagctactcaggtggctgaggcagaattgcttgaacccgggaggcagaggttgcagtaagccgagtttgtgccaccgcattccagcctgggtgacagagtgagaacctgtctcttgggggggagcgggggaagctccactgttcatgtggccacgtggctatttaaataacaaaaaaataaaaataaaaattcagttccttagttgcactggccacatttcaagcacccggtagccacaaatggctggtactatactatactctactggaccatgcagctcaaaagtgctgtgatgtcttcctggtggaactatggggataacttttcatttttttttctccctaccaatttgtattttctgagtttatttggtggattttttttttacaatgcataaataagataaacaattgtcttaaaccatttttctgaaattgaggccgtatggaacttgtttcaacttcacaacatctctctataaatactgcctttccttttatcgatatcagagaataatatgaccttcctccatgccaacctgcatccataagattactagtccctctcctgtgttcagtctttcctcctgcccaagaacacacataggtctcccctacatgacaaaacatcttttccctctctgctcttcctttttatcttccttttgttgcaatactgtctgccctcatattattgacatccccataggcactaaagagaggcaggtgctttgctaaaataaaaggcgtgccttcatttaagaattatttgactcctgaatgttacccttcgtttttttatatatatatatatatatatatatataaaatatatatatatatatatatatatatttttttttttttttttttgagacagagtcttgctttgtcacccagattggagtgcagtggtgcaatcttggctcactgcaacctccacctcctgggttcaagcgattctcctgtctcagcctcccaagtagctgggattacaggtgcctgcaaccacacccggcttacttttgtatttttagtagagacggggtttcaccatgttggccgcgctggtcttgaacgcctgacctcaggtgatccactgacctcggcctcccaaattgctgggattacaggcgtgatacattttcacggcccacataaatccccacagaatcctgaacaatcttttttcttccttgtgtgtattggaagggaggggtagagaatcaccttcgaaaatttaattagcaatgaagagcagcccacggaaccagaaagctttttgtgataaactccacagagcattcattactacatttgtatatgctttaaattagggtttctattcaagttacttacttaattttcctttctctcctgctaaacagaagagtgaaaccaacttctagcacacagaagtatttccacactacaaagtattatgaggagaaaaaagcacataattccacattcatccaaagtggccaagtacatctgatatgtgtaaagaatctcttaagtggctttatttgtgccatttgaccaaactcctgcagaaatagtagaaatacattcttttcgaatgctactgaaaactccttctatgtatctggtagacatttctttgagaaacctcattgaaagtaagaacacatgcaaagtatcctcaatgaaggactgaatccaatggtgtttacaagttgatgagaaagtatgcagaaaagagtgccaaccatatgacaccgcacttgaccacagttttttaagacgagatagacaattatggaatcatatgttgtgaaatatgtagttttagaaaagataataaacaacatatttaactttaataatcacaaataagaaaataacattaaaacagtctaaacttgcatccttatgacatcattagccattctccaaattattaataaagaacagaataatttatgaaattctgaaatatatgtgtatgcatattttacataaaatacatataaattttatatacttatatattatataaataaccatatataggctttttacattatcaagtaaaagcaaaaataatacaaaacataaaataatattgtaaaactctgtagtagagttcaataaaatggaacataggtatcttgagaatttactaaaaaaattaacatccacagaatgggagaaaatatttgcaaatctgacaagtaacttgtattcagaagatataaaaaactcttacaactcaattataagatgtcaaataacccaattcagaagtgggcaaattatctgaacagacatttctccaaagaagatggagtccaggccgggagcagtggctcacgtctgtaatcccagcactttgggaggctgaggtcggtggatcacctgaggtcaggagttcaagaccagcctgaccaaaatggtgaaaccccgtctctactaaaaatacaaaaattagccaggaatggtggtgggcgtctgtaatcccagctattcaggaggctgaggtgggagaagtgcttgaacccggggtggcgggaggttgcagtgagctgagatagcgccactgcactccagcctggtcaacagagtaagactgtctcaaaaaaaaaaaaaagttggagtccaataagcacatgatcaacaccgttaaccatcagggaaacaagataccatttcacacccataaggatggttacaatcaaaaagacaataacaagtgttggcaagggtgtacagaaatcaaaacctagatacactgctggtggggatgtaaaaacgctgcagtcactttggaaaatagtctgacagtttctcaaaaagttaatcagagttactactttttttcctcttttaaaattatattttaagtttggggatacatgtgcagaatgtgcaggtttgttacataggtatacacgtgccatggtggtttgctgcacccatcaacccgtcttctacattaggtatttctcctaatgctatccctcccctagccccccacccgctgacaggccccagtgtgtgatgttcccctccctacagagttactatttgacccagctattctactcctaggtatccaaagcaactgaaaacatgtccacatgataacttgtacatgaatgttcttcagcagcattattcatattattcattattcatgaagccaaaaggggaaaccaacccaaaggtccatcagctgacaaatggataaacaaaacatggtgtatccccgcaatggaatctcagccataataaggaatgaaatactgatatatgctacaacatggatgaaccttgcaaatatgctaataatattacataattccacttatatgacatgtccagaagagctatgagacagaaagtaaattagcgattgcctagggctaggggggaagaaagaagtggtggatatgaggtttcttcttggatagtaaaaatgctctaaaattgtttgtagtgattgcacaactctgttatgaacactgtagtgttgtgtatgtcttctgacttcaaccgcagatcactggaaaattttaatatcgctatcttcagtaatccctttcgctgagtcacaattcatttggtctggcattccttacaaaaaggtttgataaactgaactgcttttgagacatttctttttacttgtacataagaaaatatgtaattaaaaatgaaaagtattaatccatccgtacaattaaacatttcttgggccaggtgcagtggctcatgcctgtagtcccagcactttgggaggccaagccaggtggatcacctgaggtcaggagtttgagaccagcctggccatcatggtgaaaccccatctctactaaaaatacaaaaattagccaagcgtggtggcacatgcctataatcccagctactcaggaagctgaggcaggagaattgcttgaactcgagaggtggagattgcagtaagccaagatgctgccactgcactccagcctgggtgacacagcgagactccatctttaaaaaaaaaaaaattttttttcttggattcaagattcaaagataaatatttaagtgttgattgtattactattggattggatttgatcttagaacaagcagcatacacttaaatcaaggctagaaaggtatttttaagtgttacaggatactgtaaaaacatattcagatgtttggtttaaaatatagcctgggatgctgccaagcaatgctcctcagcaacttggtggtaagtgctttgtataatcctgtcttaggtttgtcttgtttttaatgtactttagatactccatcctccataagatgaaaaagaaatcagtctacatttttaaatgtttataatgccaggcacggtggctcacgcctgtaatcccaacacttcggggagttgaggtgggaggatcgcttgagcccaggagttatgtgaccagcctgggcaacatggtgaaaccctctctctacaaaaagcacaaaaagttagccaggcatggcagtgcatgcctgtagtcccagctacctgggaggccgagatgggaggatcacctgagctcgggaggtcaaggctgcagtgagccacgatcacaccactgccctccagcctgggtgacagtgagacactgtctcaaaaaaatatacaaataaaatgttcaccccaagacagaaatgtgggagtcattgcaaaactttaatatacgtgttagcttcccagaatgatctttctaaaacatactagccagattactgccctgctgcaaatccttctgtagctcctcaatgtccgctggaaaatgtccaaatgcctgccaagaaatataaggtcttgcatggcctagcctcgcctctgccaaactcctcatccctcattccatataaaagctattgtcaaatcttgatgcttcttcctaaacccctgtcaaatctaccttctctccattcccacgatcatgccttcagtgaagccctcagcatctcatctggaccatcatacttgcctttcaagaagtcttcagtctctctcctcactaatatatgtgttcgcttcccagaatgatctttctaaaatatactagccaaatcactcccctgctgcaaatatttctgtagctcctcactgtccattggataaagtccaaatgtctgccaagaaatacaaggtcttgcatggtctgacctctgccaactccctagtctcatttctccccactcccacaattcatcctgacattcctctatacaaccatactcatcattcctgacacctcttttgtgtatgctgttattcctggtcaggcccttgccaggtatggtttccccttcttttgtctgaaaatctcctaatatctcctttaggaagctttcctgaccatttctctattgtgggacttagcactctgggttataattacctatgttcttatgtttgtaacctaccagggcaagggctgtgtcttaatcatttttgtatcctgagtgtctaacacaatgccgaagacaataataagtacacacaaaaaagtcaaatgaactaaaaccaaaaaaaaaaatttaatgccaaagagcagaaaacaacttacagatcaatgagctctagagggaagttttttccctcactttgatcttttccctgaaaatgacttcttgcttatgtttgacacaaaggaggaaattccattgaaaataagagttttcttggttttaccaagaggctgatccttttttccagtctcaggttttgcccattttgccacaaactgacaaaaattaacaaaaagaaagatactaaagccctttgagtttggcatcttgcagccccatttgttaaaacctgcaaacatttccaagtactgtaattagtacattcattattgaaacagcactttacatttaatgtgccaaacataacttggtgagcaaattaaacttacatacgttttaaaaccaaatagacaaagtattatatgtctaatctccccaaaacttcaaagctaattttctaatatttaagtttttaaaactccttattcttctctctcttgttcttcctgtctgctaccaaataaaaaatgtctgtccacataccatccaatgctcttgtcctgtgtagactggaacccaagcctcttaagaccaaaactatctgaaatgagttctggcttaggaaaaggaccagccattgggcaataccaggacagcaagccaggcagcacccacctgtagcccaccttgcgggcatagtgcaggcaattctcctttacatgggtctggaagtaggcagagcggcagaggaccccacactccgggcagcagtagggggacttgtgtgcatgaatccgctggtgggcacagaaactgcactggttgggcagcagcatttggcatacctggcaggtctaggaaagaacaccaagaaagcagatcatgcaggggccataggcctgtggctctccaatcagggctgtctggtttgctagtacatgggtcagaataaccccttcccccaaccactctctcttccaactctcctggacacttctgacacccctagacctcatttccagtgctgatactgatacccaagcaagctttgtctgacaccctattaatcagagacagacctgaccctattctctcaaagaccagttccgccccaggactgtgtttctttcctgtggcttagcagaggaccagcttttcctttgcagaggcctaaagcacatcttgaattctaagacctcactgcactgctagacccaccagggtctctgtcacagctcagtagaggcagttcttgccatctacccccaacattggcctggtagagacctgctcagcacctcgagtcaggtggatcagtgacttccaaagtggatctgagaccaccctgattggtactcagaaggctctcaataaagactgactgagtggtcttgtcagtttccattgctctagccctgtttgcccactctgcaggttaggagagttgcgggggtgggggttggggggtgggatgggtggcgggggttccctgagccacagctaagcaaacatacccacagacaagggcagattaggtagcagctcctttgttcccagccccaggagaaaaccaggggaagtacaagtactacaaccagactaattacgctctgatgggcagagctctgacaagcagccagcccagagggaaaaagtaaaagacttcgctggtgcctgcatgctggagaggcccttcttaacttcttagtaaaggggacacctgtcctactcacagaggtggccactgatgtggggtcagaggagctgactagagggatatagaagccagctcgaaggggcttgccactgaccaaagataggataacatgagcattaaaaagaatgactgaatatgtaaatatactgaatatataaaaatcaatgagccatgacaacatttaaactaatagaggaggtcacctcaaacccactaggatggctactatttgaaagaacagaaaataagtgctggtgaggatatggagaaactggaacacttgggcactgttggtgggaatataaaatggtgcatctactgtggaaaatagtacagtggtatctcagaaaattaaacacagaagtaccatatgatctagcaatgccacttctgggtgtgtaccaaaaagacttaaaagcaaggtctcaaagagatacacttttatgcttatgttcatagcaacattattcacaatagctaagaagtggaaataacccaagtatccatcaatggatgaaaggataaataaaatgtggtatgtacacacaatggaatattattcagccttaaaaaaagaagggactttttttttttttttgagacagggtctctgatgcccagactagagcgcagtggcatgatcttggctcaccgcagcctccacctcccaggctcaagcaattctcctgcctcagcctcctgagtagctgggattataggcacgcaccactaccacctggctaatttttgttttttggttttctgttttgttttttttgtttttttttttttaaatagagacagggtttcaccatgatggccaggctggtctcgaactcgtgacctcaaatgatccacccaccttagccacccaaagtgctgggcttacaggtgtgagccaccatgcccggccaaaaaagaaggagattctgacatatgctacaacataaatgaatcttgaggacatgctaaatggaaaagccagtcacaaaaagataaatgctgtgtgattccacttgtatgagatacctagaatagtcaaactcctagagacagaaaacataagggtggttgccagggcttgggaggaggaagataaatgggaattgttttttgtttgtttcttttttaaaacgagtacagggtttcagttttgcaacatgaagagttctggagactggtttcacaacagtgtgaatatacttaacattaacactactgaactgtacacatcaaaatgattgtgatgggaaattttacattacgtgtattttaccacaatttttaaaaaatagaagagggactcttacaacaccaattgagattgtcagggtatcaactcacaactctgagaactgttaattaaaagaaacaaattatcccattttccaacgtaaactatatttcagagtaaccaaatagccctcacggaagcaaaaaatatactttatacagaattctagctaataaatgagaaagaaacaatagaattagaaaaatatcctttgaaactcaataaaattagactcaagcagtgattactgatggataattaggtaaaaggtggggagctttacaatgaagggatcagaatattatcacctaaattcactctcattaattcagcatcattaaaagtgaagacaatcaggcactttgtgcctccttaagttatgaaacaggaagaacgcagcaccctccacccccaccctccatcaaaactgacctgaatctaatcaagtttttattgcttacttccagtctacaggaaaaaatatgggatatggaggaaaaaattccctgcatgaggaagtaatcagtaaaactcaaagttctggaaaacttaggaagcaatcagttaaacccagaattgttctggaaaatgctcagaacacatgacccaatttcttcaacaagtcaatggcatgaaaagagggtgcctactaggatggagtgggaagaggtactgttccagactgagatatttatgaaacataaacaaacgtgatgtatagccccatgttcagatcctgactcaaaataatcccaactgtaaaaagacattttttgacataactggaaaaatctgaatatgaacttgtagtaggtaatactaagggactgttattaattgtgttgggtggaatgacaatatccatctggctgacatcctgccccaacagcgtggcttggaaagcaagaggaaggatgaaagaactccctgggtcactgcagagggaggcatgctccattcaggggcagactccccaggaagaagatggaaatcccaaaccgatgctgttcccacagtgccctgctgtggtgtggagcccaactatctgtccaccccctgccctggacacatgggctgaagctagatactgtcctgtggaaaacccaagcccagcagccatcaagcctagtttttaatcccatagctcagggctcaccctttccctgagactcagaagccacaatgagtggcatgagattttgtgagggatttggagctggctgagagaggcctgatagccttctgtgcactccttcccttcctgtcggcgggtgctcttctccagctcccactagggcagaatgacacagagaggatgtaagatgagaaaggtgccatgccagcctgggatcctacacccagacctctgcctactcaaattttagaagatgcacaaggaggcgggtgtgatggctcatgcctgtaatcccagcactttgggaggccgaggcaggtggatcacttgaggtccgaagttcaagaccggcctgggcaaacatggcaaaactccatctctactaaaaatacaaaaattagccaggcatggtggcgcacacctgtagtcgcagctactcaggaagctgaggcaggagaatcacttgaacccaggaggcagaggctgcagtgggccgagatcgcaccactgcactccatcctgggcaacaaagcaagactccgtctcacaaaaaaaaaaaaaaaaaaaaaaaaagatacgtaaggaccagtgtgaaaaaatcccaggcccaggcatcagacctccactgccatggggcctcctcatggccccttgactcagataaagtaaacctggcccaactcaaccatgctggggcagcaagaacactgaagccccaggggaagagacccagagtgcccacaccccatctgacgcatcagaagaaaaatgcaaactgaaacagagcaggaggagatgagaggccacagtgggatcctatagcaccttctggcccctttggggggctgagtcctctgcagaagccctacaggcccgccaaactcaacctctgacctctaccctaatatttccaagaccagcctcatgcataacaatgtcctcttcttcaaacccactctgcactctcatattcctttgctccctatactcaaaacacccttgcccctcctactcctccaaactcatccttgcaagcccaacttaaatttcacctccacacagcatcttccttacgcatggagtcatcgtgaattagtccctctggggcactctgcgcaactaagtttataaccttggtttagccccactctcagttggccatatactgtagctgtttgggtggtgaccactgcccttgctaggccactgtaagctcctgaaggttagactcccttctgccggcatcccctggttggcatagacccccagcccatgcacagtgggcactcagggaacacatgcaaagctcaacagctaccaacacatgcacagaaccctggctgaactgaagcaaaaagagctgttttactttcctcccaggcctctgtagcaccagcttagggaagcaccatgaggggtgggtctggctatgtcatgaagagaaccaccttctggaggcctctttcttcagagaaaccactaacacataacatagacacagaaggtgccaaagggtattctcagcgcagaaggctttttttttttttttaaatgaatctcatcaagcataaccaagaatcaaaacaagcagacaagcacagttgctttcctggagtggtgagaacgcagttgaaagaaggaggctccataaacctctgccacaggccccacatgtctgtccactctccttcctcctatcccagccctgccattggccctactgcagtttccacaaaaggactctgcaagaacagctgtgtcactgcagggcagaacaacaacttattaaagacacagttctttggctggggacagtggctcacgcctgtaatcccagcactctgggaggctgaggtgggcagatcacttgaagccaggagttcaagaacagcctgggcaacatggtgaaaccctgtctctactaaaaatacaaaaattagctaggcgtggtggcacatgcctggagtcctagctacttgggaggctgaggcataagaatcacttgaaccccagaggcagaggttgtagtgaactgagatcccaccagtgcactccagcctgggtgacagagtgagactccgtctcaagaaaaaaaaaaaaaagacaaagttcttagaacagactgaggtgcaggggcagtgactcagctatctctgtccccaagttccttggtcacatgctaagactgtgctgacacctgccagagaccagagggagatcatccagtaaagacctatctcgggcctgacactgggccttgacagaccctttgaggggaagttgagtggaacacgggacacgtccgtaaatacacttgctaaattagggtctcacctcagtatgggcaggacaccttttccaacaaacaccaaacactaaatattcaggcagacatcctcttctaagactcataagattccaccactgcccccatatcaatgagctttcctctccatgcccagtcatggaacctgtgtgagccaggggcccgatacccgtaacagtgagggtctgcttaccagcccctctgtctcctctgttgtcctctggaaatgtgcagccaggaccatgtagtcccgcatctgcttgtgacattcaagacacttgattgagtaccggatgagcctcacagggtctgggtagagtggcaaggctggaggagggggactggcactgcccgaagtgaggccatgtttgggagaggatgaaggggctggggctgctggtgccgtggagttcacaggggccgacacgaacatttggtccgcagagataggcttcaccagcagctgggaacactgcatgacgagccccttgctcttgtggtcacgggcgtgccggagcaggctgcacttgttgaagaagagcagcgtcttggagcacagtgtgcacagtacctcaatgtggacgctccgccggccatagtgctggctcaggctcttctctaaggcaaatgcgtctccacactccaggcagcagtacccactggccggcacgtggatcctgctgtccgcaggcgggctgagatttggcgcatagaggggcacggggttggagctgtgaaggaccttgttgaagacctctacaatcagtggggcagcctttttcacctggtggaccaggggcaccgacatttgtgtaagctgtggctggctccgtctttgcactgaagacttggctgtcactgatgcagcaacactgtgggggacgaggttcaggttggccaagtgcacggctttgggcaggaggttggcaggggccagggtggatgcctgcagtgctgtgctctgttgcttcttgcctgtctgtgagcctggggcagccccctttgggacccggggcccagaactgcagctgggagatgacgagtcactggcctttgtcatgctctcgtcccctttcctggccccctgggggctccctgaatttgtgcctgcctcaggaaagtgctcttccacaggcacctcatcccctggcatctcgctgggggcctctgcaatggcgctccctagaggtgacccaacaggggacttacttggatcatcaggatctggcaggatccttgtgacagtccgtttgatttcccctgatgatgtcttaatggttttgattctcactttgggaattgctggtggggagctggcagccacagacggtgagcctttgctgctgctgtcactgcagatgctacgagggctgtccgatggcttgatactttttctagtggcctccagagggctccggggactctttggtgacttgggcattttggggctacctttagaactctctttagtgggccctgagagatcctttgtgtggccaggctgatcctccttagtgacactagccactcttttggcctgcaaggccaccaaggctgccacacaagaggacagcttggaatgagctggctttagacgctgcctaggggggactgatgagcaggtaccaagctcccgggcaagccccttggactctccaatactgttgctaggatggctgttgaactccaaagcttccccgaagaatcgagtggcatccggatccttgtgaggttccactgtgttctgcccactttgctcgtgttcctgctggctccccaagggcaggggttctggcttgggttctttcttacaaaaatgatcaaacatatgcagctctggaaccggaaacttagccagagcctccaggactgggcctcccacagccccgcacccaagagggggtgggaaataactgtcagagtgtttgggctttatcccaaatccgttatctttgatgggatcctcaggttctgggctggagattggactgaactggttgaaggtgggtaatggctctgacttgggaggctccagtttgccagggaaactcctggcactgtctccattcataaaagtagaatcaaatttcccacagttgtggggatctggaggca

SEQ ID NO: 12542 - DNA, 1855 bp, Homo sapiens
ttataaatatgtgtgctttttaatttctctaaaatgttacatcattttccaataaagaaaaaagcattttaagtaggaacccaaaaaaatcccatacttgggacctgcgtcctagtctcaactttttcctccaggggcccaaggcttcctgtgcccagttcctaaggctccggtggcatctgttggagaaggtgaacagtatcctgaaccccttagtcaggaggacacattctagaatctagaaggtgctgtcttggtcagatcagaccctgagagaacagctgtagctaccaattgaatcagattcattcattcatgcagcattcactcattcatccatatactttttgaatcactgttatatgcaaggaacttttaaagaattactctgacccaatgtatgaatttggaataatctccaaaatactatataagaaagcaagcttcagaacactgtgtatagaattctactatttgtattaaaaatagatatataaatatacatatttataaacttgtaaatgcatagaattgctatgaaaggatacacaacatatagataacagtgattaactctggagaggggactagaggctgacctccatggggaagcttaccatttattgtatacccttttgtattgtggaatgtcttaccatgtatatgtattaatttttcaaaacaaaaaaacaaacaaacaaaaaaagaaactgcctggtgctgaatatacagtggtgaacaggacagaggttccccagtcttggggaaggcaaagtgttgagcttactgggccacaattatcaaattttttaaaaccagactgtttacataagttaaggggaaagttctttctacaacaattagcttataataattcagcatatcattttacagagataaagcagttggaaaataaatactaagtaatttgtcaagtcttagactgtattaagttgtagtttctacaagggaagggatcttatctgtttaacttgatcagtagagcattcactgcagcataatgtgcagataaacgcttgttacagcaagcattttctgatgatgacaaatgatagcacaaccatttaaaaaaatcttgaaaaagaaaagaccagaagatgctggactctgagggaactgtgtgttccctgtgagggttaggcaaccttttctagacagtcctcaaaaaatgatggtgttcaaatggcaaggtaaatcccaatgagaatgaaaggttgtagagataccacgtttcgaaatgtcaacggtgtgatgctcgaggccctccttggggtgacaaggcacagatggactccaaagagaacctggcacttggcagggcaccccaactgcatgggaagtaggaaagcaaatgtctggggggctgcaaaccactgacaagctggcagcctgtcaaagcagccttggtcactaacgagcacagtggttgacaggcttgactcagcaccatcactacaggtagcctctgcacatcgtttaacctctcggagcctcggtttcttctccgtaaaatggaggacaactgtgagatctttgtgaggattaaaggagagaatcaccagaaagtgttcagtaagatgctaggcacacaaggagggcttaaaatgctatcttcactcttactaaagaatggctaggtgtctgggccacttcataactgctaatcagcatccaagtccaaacagcagacaaaatgtgctccaccctccatgccctaaggtcaagtaaagatttccccacattcatatagtgttttataaactagaaaatactttcacattcataagctcacaaaagcctgtgaagccagttggatgggaattactaactctat

SEQ ID NO: 12543 - DNA, 1855 bp, Homo sapiens; identical to SEQ ID NO: 12542

SEQ ID NO: 12544 - DNA, 26241 bp, Homo sapiens
catgtgttgttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcctggctaattttttgtatttttagtagagacggggtttcaccttgttagccaggatggtctcgatctcctgacctcatgatccacccgcctcggcctcccaaagtgctgggattacaggcgtgagccaccgcgcccggcctcatgtgttgttgttaaagctggtgtttctgttgtgaagtgagctctcgggtttcctattctactgtcttgctgatgctacttaaataagaaggatagttttatggcattgcataaaagtgtatcctagcatcactctactgaaaacataactagttttatcattgatgccttccaagaaaccatttacaagtattaaaaggacttgctcttggagagatgtcaatctgttacttatagtgaacaataagcatattggaaaaatgtgttagatgaaagaaaggggtaatgaatggttttaaattaatagatctttcacctaaagctagccatggagcattgcttgtaaatcaattaaaggccaaaggaaatattcatcattgaattatatgggtttttacctagaagaatttccctcaaaatgcaatttccctggaaatctgtgaatcctcagttctctgatgagaggcagcttaaaattcagctgggtagtttctgtgatgtctcaaacaggctccataaccttcatgatatatagtcttggaatttgtgtgtgcctcctcttttctctgagggcagagattggacaaacttgaactgctgatatagagaaagtgacttatgttttttagctttcaactgcactgcttggcaaattttaggggctaaagcatgaattgtatgccctggatagaatgacatctattaaacgtcttctgtcactgagcaagtctgtgaatgaatgaactttgatttcctgcagagaagcaggtgaatcggtcagtaaatccacattattgagtgtctctgccctcagcagcatgtcttgggattaggaaaaattttatcttgaccaagagaaaagtttaaggagggcctgctctgtgctgtctcatatatgctctggtttttagagtcttagctttctccccaaacactttactttcaaagaagggaaaattaaacaataggcaatacttgtttcatctttgaattcccattaatcaaagggtagtctcctagtaacatcctggatttgtttctatttccacttcaaacccacttggccatctaaacaattatctggctcaccatccaccagaaccctagttacagggagaggaatctcgagcactcttacctcttctcaaggtactgagagggattcccaggagactgggctgagaagacagacaaacccctcattataatcaggtggtccctcagtgctgctacctggaaataggaattctgcttgacattctagacaatagagccatgctttttttattatttaaggacagccttttctttcttctcaggtagtcgacagctaccaatttaaatgagctgggtttatggatggctgcagaaatcctctttactcaaacccagtatctatccatcagccactgcgcagcactttactgtggaggcagcggggggacagctcatcagaatcgccccagtggaatgttacgataggaaaaaagaggaatggattacatatttatgtggtctttgaaaatgcagtgggacaggaagattgcttgtaacgtatgcagttacattaaatgactattaaccttcactggttgcaggtgtctggtgaattcatttgtgcttgtgtatgttgtgtggcttgaaaaattaatgagactttttaaataatcaaattaaaagtatttgttactccaggttctggtgagctatcaaaacaaaactgggtacagcttacaaaaataaagtgtctactgagaagaataaaaatatgaattgaggggggaaattgatagctatgcggatcttggaaactagtttcatctgatggagtaaaataagagaaaatatgcccatcgtgactagttttatttgtagattatggttagtgaattctctcttttgtcatgaatgcttcacattctggaggaaggaggtggccttgcagtaatgttttatttctgtgaatgccagacttttcttcaacctgttgacttgtagggttgacgtgtcagacatggtgaagaacaatacctgtggagctgagccttcatttcctgaaacgtgtgtccaagaggcttttttgacaaggatgttttaactatgctgtgtacaccgttagaatttcagttttgtttttaaacattcccatctgactggagcttccctccatccattcctgaaactcacctattcctgatctgctgaagcccatgtcctctccagtgtcctgcattgcaccaaaacggcagtaatataggtcagggacgaatcccctgaagtccctgaaggttggagaccaccagatctcactacccttactccatggccaggagatggaaggaacaaggaagaaaaggcttccagcaatttcactgtaggacctaaaagcagaggctctttctgcttcttgactgaacatttcttacaaagccctctgtgcttatctagctgtagtgaaaactgggagggagacaagggctgtagttggtgaccagagactctcccccaggatacccgcactcacctctgccaaaagacatgcccctctgcctcagccaagcagtaaaatcaaggaccatccatgttgtgcccagaggcccttggaagaaggtgggctgcttgatcttcctagctgagtggccattcagagctcttatcagcttggaaaaaagagtaatcctcagaaggattcacagtgtcacccttcttagatgatgaggcaccatgggggctttggttcttaaatggatctcctccaaaggcaggtagatttgttttccagtgggcacagagcgggcccacgctgaacacagaaatggtgttattctaactgttaaataagaaaaattacatgttgtgagttaggctaattgatctgcagaattctggtttcctgcaatttaagactctgtcttgggcatgaatgaaatattcagagggcagaggagctagagatgaaaactgcaaggaaaaaagtagttagaataaggtttaacttgtacagttctgaattccagggatttaagagtaaaggcatccaaaaatactcctgctgccaaggccaggttgtcaataataaactgtgagtcacaagtcctggttgtgggcctggaagctagcagagaggggattcaactggcaggttctccagctctcagcctttagctcttcagggctgaaactttgctcgaattccttgaatcacatgatatcaaggaccaggagggagggctcacatcatagctgaaagaaaggacaaccccaagtgctcaggaaagacaaacttctttttagaacataaaaggattttttctagctagccgctgtgatttgaatgcatcacttcccaaattcaggtgttgctcatttgatagcattcagaggtgggtcctttgagagatgatttgagggcatgtccttcatgagtgggattatgactcttataaaagaggcttcacacagtagcatttggctctcgtccttccaccatgtgagcacacagtgttcctcccctttggacggtacatccctccttggatgccagatgctatcacttcaatcttggatttcccggcttccagaactgtgagaaatgagtttctgtcctttataaatgacccaagtctcaggtattttgtcatagcacaagtgaacgaccagccaagccttcaacaactagcggctcacctctcagaaggcagtctgctttccagtggccttggcataacctgggagctatcagaaaggctgactctccagcaccctgcccccaactcccctaggacctactgagtcaaaatctgcattttaataagatctcctggggattcataggcaccatgaagtctgagaagcagagagggacggataagttgtctgtatcatttcagcagatcttcatgggaacctacagcctgcctgccttgctagtgctggacacagtgggaggagacagacactgtgcctagtctcaggaagctaactgtccagaggagaagatggcaaataatgatcatgaaatgacctcaaaggggtgtttgtgagagccttgagccatcagtgcagcaggaggccactcgatgtgctctggtggcatgtcctggcatggaggtctcctttctctcctgtgtaaaacagaggcattgaaggtaaagtgctcagttgctcctagctactgcttctcatgtatcaaagtggagatggtgggggggttgtgggatgccatatctgcttcacaaggctgctaagttattcatcaaaagtttgctgaacctgtattctctatccatcgccatacgtggttcagagttgaagacagatccttggaactcatagcctcatgagaatgacagatgagatggagagagaattacagttccatggagtacagccccatggaatatgaaatacagagagtcactgaggattagtgttgaattctgtccatggtgaaccttggaaggcttcctagtggaaggagatggatttttagctaagacagtgaaactattccttgacatagttctagttctagcttttgccattttttttccctatcagagaagagtagggacctgtcgggattggcaggggtaagcagacaggtgagggttcctattttagagaagctacaggatttggtgcatactgaagctgactttggtgcatacagccactctttcaaatgttcctgaagacaactcatttctgctgggtattgagactgagctggtgcatgtaggtggacagacagttttaaacactactatctcagtaaagccaattaaagacatggaactggctggggttgtcctgagagcctaatttatggagcacctgcttggtgctggtgctgagctcaggatgagaggcagtggaggagtaaagagaacatggaaaacgtggtccatgcactctaaaacctttaaatatggcaggatcccatatgtccttttaaatagagccaggcagtaaaccgatagctaaggactgtagctgtggataaacaatagacaggtgacaaatactgatactggctacttttcatagagaacagagtgtgtgttcctggcactctgctgggtgctttatagatggcatttctaattaattttttgaaaatccccaaagcaggttttattatctctgttgtacaggtgaggaaaatgagactcagaaagcttgtcattggaagaactggggttgcagtacaggtttgttatgtgccaagtcctgtcttccttctgtggaatcatgtgtcacttctaaatcaagcccacagaagctggtggagatactagagtgcagagatggtagcgtttgtgaggctggagtttggaggcctttgaactggtattagaaagtaagaattgtcccagtatcatgtgagagaatgatgttttctggtccttattcactgatgagcagtgatgtgcctggttgccttgttaattaaaatgagccaagaaaaggaaatgagatgggcactgcttgtcctcagagactgtcaggctggggaggggctggggagaaatggagggttaactgggataaagcccctgggcaggaaagcctaaggggtagagctcagagcttgaggccaaactgaattgagatgatctagagacaaggagctctgagaggacgatgggaggagagcttggatgtctgcaggtgggtgtggtgcaggaccatctgggaacacaaaaagcaggctctagccagagtctccttatctccctgttgtgagcgtatgtcagttctgctgctgctctcttctgtgggaagcatttataaaggggttcttcatttcccccaggatgtggagccttgcagtatatgatcagaaagagctaggtaggaaaatggttccttttcctgtcatgcatgaatgcaacccttttgtaaatgcccttggtccaaggagctctggaagaactataggcagcagctgggtagggtagggtggcctcctggccaagcagtgggttgtagcttggatagacttggatgattgttttccccagagcatctatatttgtgcaaagtagcaatatgttctgggagcttagaagaatggggtcaggttcattttaagaggaggtaggaggcaggctggagcctgtgactctcctatggatcccttctgaggctgctggtgtccttgttttgggtgggtgtcacaggtgcccggcctgtgccctgatgatttcctgagaccaccccttgcagcaggtaagacactttctgaagcaaaatgctgggctttacttttcttctctttaatctttttgtcctgtcaatgtctggctcttctgtgtgcccatacctcatccctacttccaactaaatgattgtagtgtcctatcaataaggctaatagaattaatgagtatagcagggactggcttatgtgttgctccaaaagtataatgctttatgtttattaaaacacacacatctccactgggcttttaggagagactctaactgtgggaatttcaggcacttttgggaatggatggtagggacacattttggtccaggtaacttaaccccaccctctgttaccccaagtaggtggcattgtgttctcctgggtctagcctttcttttactgtaggagctgcacggggaagacagcaacccaggatactcctggttgggattcatgtttacctgccagtaggaaaatgggcctgtccctggttgactgtggcctgatggtagctgtcatccttcagatctacacagaagtgggcattcctcctccagtagcatttagtcttcagagaagtcctcctaacacaaaggaatctcctgcaagtggacaatttactggatggggatgatgggagagagatagaagtaggattttggggcagagagagcatctcttttcagaacctctatacacagcccctgtgggtgctttcctgtccactgtaccctatccactgtaccctactcgctgtgtgcttgaaggatgggcctgctgctcctgaaagagcacacattccaacctaaaccaccccagattcctgacagctgtgggctcctgcattggcacttcttggaataatataattcgtaacccagcatctgaatttaaattaagagaaaacaacaacaacaaaaaatttaaaaaaaacaaccaaaattctggtccttcctcaccagtgtggtgacaaagggttttgactgtttatggcatggttttcctgaaggcctcagcaattttttgctttattctccaaccctcctggaggaggtctctctcatttgagtgctgtggggatgagatcaagcagatccatgaccctctgaggtcccaagactaggccagaccctggagtctggaacctgtgacattccttccctctccacctctcctgacagcaggctgcctgggaccaggcatggtaagctctttcaggccagctctgctgctagggatttaagggagttgagtttgaatattgagccatcccctagggggtttccaggcatttattgaaatgagatgtgtctaggatctctttgaaaaagaagtacccgaaagaattggcatattaatggagctacgtgccaagcaatgaaagtgtctccacattttcaaatacctgggtacctgatttttctagtttggggatagaaatggaagactaacttttgtcagacagtaaagcctaattaattcaggcgagctaagtaaattagggcacaggcatacactgcgatgctaggcagccactaaaatgatgctgtagaatatttaatgatatgaagcaaagttcatgctttattaagtgtaaaaagcaggttacaaaagactgggtacagacttatcctattctttcataattaaaaaacagtatacaaaaagactgactaggcagacatcaaaatgttaacagtgattcttcctgggagttctgctttcaggtgattattttaaaatttttacatatttatatatttttcagagtatacatgatatttatcaaaaggagaaaagtcaataaaagtgtacacatgtgcttatgtgtgtgtaaagattagactgaaggaaaagagcggagtagatagtttgaaattatttaaaattatgttggacacattacttatgcttgcagatgaagaaactgaggtttaacagagtgggaatatccttatctgttatatatgcttgttgtaattatttatggaagaagaacatttgtaaggtatccaagacagtggtatgtgttaatactccccaggtggttttaatatgcggtccagattgaaaaccaaacattagcatggtggctcaggaacagacagaaatttgcagtcaccctccttcccacccctcaacaagagaatgtagggaggtgcttagcacatagtaggtatccagaagattcatctttttttttctgggatcagtgcttttgttctggttaaaattaaaccatgacattctgaagccaatggggaaaagagatgactttgaatttatcccttttggattatctctgtttgttaaaccaacactcagaggctctaccttgtggcctgagatcctagtacccatttggaaatgtgctttttaagaggaaaacacatagattttcagactggccttccggaggtttgctcttgaatgagagaagggttccccaaggcctgttccctcacagagggtgcctgtgttagggaattgagcagtccttctgttcctttgtcatgagggtcaaattgattttaaagctgtgtgttacctgcatctgggggaggtagctttttcttctgttcagcatcatagtttctcatttcctgggtggcttttgcagttttacatggatgttattcagtagaaaatagccagtaagtgttctccaaattattaattcattaataaacccattaaacccttgcagctttgcagcaattaatgatgaggtccatcctccattggaactgtcattttcagatgcagattcccactttgtttgagtggaacagggcagatataggaaaaatgccaaagagttgttggatgacagggctggagatttttgtgcaaattctcctttcgtcacagaaagcaagttccacagaggccagctcatcaagtatatgttgctgttttgatgattaatgattctggcatgttgatccaccctactttcttcaaaacaattatttcaactgtagtctcctctggggaatggcttcttatagctaataactcagtagacgatataaaattcttaaatgaggatgacactagcatggttccacctggatgccattatgctgtggtgtttataattacagcgaggtctgcttacttttttcctgagctcagaaaagcttggtgccattcatttaaatgggagagacaggaacttctatttatagagactgcccatgctgggagctgtgttaagcactttgcgcctacgttttctcatttaatccttttaagactccttttgaagaaggtaatgtcttttccattctacagaactggctcagagaggttcagtaacttggttgagacacacagctagtgagtggtgccacctgaattggaagaatcacaggatcctggcttgaaagtctatgctctctttaggcttttgtgcctctggggttattgtacaaagaggcaagcaattttgagtgaaggttcctcggtaactagattaatgatgtatatgtggaaaaagagacattaagtaacaactatttatagaatgcctatgacatgtgatatgtcagaccctcttggaaaagtagaaactataaattgaatggggggtactcactgtttgagcacctcctacttgggaggcatgatactagatgcttcacatgcattttcttatttaatcctcaggatcattctatgtgataagtctctgtagccttaacttagagctcagcgaagataagtaatctgcacacatagaaacacagattttaagtggcaggaccaggatttgggctcatttttgagtttgttattaacagataattacagtgagtgagaatcaggttatagcgcactcaacccatgacagaggatcaatgtactcatcagacacataggatgtgtttagtgcatgtcccaagaggaaaggagcaggcactgggtggagaataacaatgcctggctgagaaagtgggcaaggcttcaggaggaggggaggtttggtttggttcctagggagctggagtgggctcctgaaacaggtggtgaggacaaaggcctggagaccaggctggggcggccaagaggagcccacagaggaggtgcctggcacctgggaccctgagcaggaattccaggaactctttgcccttctccttatccatacagttttcttatgggctctctgctgcccctctccttgtgccaggaaccagtttggaaagctgttccccttgggagtctctcagtgttacagaggagaaagaaagatggcaatgatgtatgcatccttcacttcacactgaagatctatctacttttagatgactttttccccaaaatgcaatgggaaatttttttttgttctgatattaaagcaattcctactcattacagaataatcaaattctttagaaaagcacaaagaagggggaaaaaatccagcatctcaccacctggagataaccacagtcaaaatgttatgtatatttctccagtcattttttttaagtgtgtaaatgtgcatacttctcaacgtctgctctctgggtataacactgtttcactgtcttctggttctcttcaccataaccctcagtcatctttatacatcagtatgtttagatatgtatcattgtttctaatggctgctgagtactccataggatggttgtataaaaattcttctttagatggtgtatctgtcagggtccaatcaggaaaacagacccataataggtgttttaaatggaaaatattttatacagggaattggttacacaggagatgaaagagctgagaggagcaagaaattgctaccacccctgggctaggggtcacacgggaggaggcagtgatgataccagaggccaggagccagggccttctggtaggagctggaaccgcagatatgctgtcctttggaaccggggccctggaagagatgcatggcactgctctctcactgctgaggtgcccctcaaagcaggggaagctggggagaaatgccctggcttctggttttctaccttccaacattccatctgggcctcccactggacaaagctgccttgctgcagccagaggtcaaaggagaatgagaaatgcttttctctctgatacagagcagagcagaggagaggcagagccaggaattgttctgagatcaaataggcagatgactggtaaggatgagaatcagtcaacttagtccaaaggctttgtgtgtctgaaaaatcttggtagaattaatgagatgatatctttttagtacttttgcatgccctgcactggctgaagtccagttgggaatacaaagaactataggacattgctcctgctctgtagtaaagttcaataggggagataataggaaggctaacagcacctgctgtttgttgagcatttactaactgccaggcactgtgctcagccctttgtgtatatcatcattttaatcttcatggctcatggcatcacattcatttcttttggacatttaccttgttttgtcattatggaaatgcatacctggtttagtgcaggatgtgttcctggaaatgaaagtgctcactgagtcagcactatgcaaggtcatgacacttgagcccctgcagcacagcgttctagtcttcagatgttggcagtcacccttccaggcaaagtcctcaaggccatgtcaggcatccatctttgcctattatactctcaatttctgacaactgcagggcagtccatccaggctgcagcagtttttatgatgtgctctctaagtcaccgaagtggtcaccaatgactaaaagcctgctggcctttgctctgtgttctgtaggtttttatctgggaaattggcattttagcatcatgtgccagattcttcctttgctagacaacttttgcaaaccattatgagtgttacccacaatgggtaaaaaccatggaccagaacacaaaaaaaatggtgagaagagaagcttcagcatagtgcagcagaattgaattggctcatgatggtgtggcagaacatgttggctgagagctttagctgtatggtggggccgtgttttttctccctggctgagagcataaacagttcttggagaaaagtaggtaaatcaaaactgtgccattgtggcttatgggtatgtatgtttggtagttagaaatgattttggagacggcagttaagtggctgggctcttccatcagcaaaggcctgcctccagctttgtcctgtgagaataaggatcatgtcttgcttttgtacataattgtatctttatctcctagtgtgtggaaacttaacaaatatttactgggcgttggatatgtacactaccatataaacaatcctcattttacaggcaagagcattgaggctcaaataggttagataaacaactagcaactagcaaggactagagttgggtaagggtggagtctgacatcaggatgggcctaccggagggttctgtgtgtgcttagtgcattctgagaccactggattttccagagagagcagtaaactcagagattgcagttgttcaaacatgggtgcacccagattttgtggggcctaaagcttgtatgacatagtggccttctttataaaaaatccccacagaattatatatacacgcttaggagtaaaattatgtgttgtttaggctgagaaaataaataatcacaaaattataaactttaaaaagctatgcacattacaaacatggtcgggtctgaaaaaaaaaaagaaaacagatttacattgtgaattaactgcccaacacagctttataataaaatttccccatatgttatgttttttgctgtatactttttggttgtctctttatatgacatcaattttgtaatctttctctactgagagattgaaaagataattcagtctttcctctagcatggctgaggaaatttgctttttatttttgataattggacgaagaaagcacacaacttcctacacagatgtcccctgctcaccgcttgtcatactgctcccctcaagcacagggaatctaattaattctgtgtcatgtgactcccacctagagatagaggaacaaagcatgagcatttgtgattgtacatgctgcgttatcggggacactcctattggatgagaacttccattttaaacaggcagcaacgagcaccaaacccccatggtggttttatgtgtctgataactggcaggttgtgccacaggttagattctggctttataggtttcagaacttgtttctcctccaccttcctggacttccagtgctgtgcactgtatgacgtgttcctcttgtcacatgacttctcgccccattcttaagtgttactgtgagttcctgaaagccatttccacgccatggtgactagcagtaattctaactatacacagaagtgaccaccaactacacagtccaccctactgaatcctccttgaatacatccccacctcttagctggattccagtgctacctggaacaaggtgagatagaaagagagaggtcttaactaattgttgttaaaagatcttacttttgcacatcgtatgcaaacatatatccatgtgaatgcattgctagggcctgccccgagatcttggaaggagcatgcacaagaaggagacctgaggctctcttaacctcacagcatggctgcctctagttcaggggaactctggctgccttgagtgaagaagtttgcacggaggaactggagttgagctgggtgtgaaggcagtaggactgggtgcagcctaaatgagaaggcgtgtttttacagcggagatcataattaaatggccgttaagctgtgaggacaaggagatggtgtagattaaatgttaagaatggccatcccgaaacctgtcggtgttgttgattacagcagagtggctgacatcccgtggagcacttccggtggccaggtgagtttctccagccctatctcagggagtctctaggccatgcattgaataagtcttaacctctggcatctatgaatgtgaccacctttggaaatgaggtctttacagatgtaatcaagttaggataagataagcaggatggggctgaatcctatatggcagacatccttatgcagggagaagagacacggggcacagacacacggggtgagagtgctgttcaaggcagagggtgaagtactgccttcaggcaaacacccagggtggccgacaaccactagatgcttatcatgggataagcatgagtttggtgggtcattatgtgttacgtaaggagagagtttactaacagtgtaaagacataagcctgaataagggctacagcaaattcgagggtggttaataaaattggaatgatgagtgtaattgaagctatgggtaaattaatagttgaagctaggaaggggcaggggagggttctcccctacagctttcagagggaatgtggctctgccaacgctttggttttggatttccagcctccgaaactgagagactaagtttgtgcggtttaagcccccagtttatggtactttgttaaagccaccctaggaagctgatgcactctcccctgccgaacatacaaagtaggtgcagtcacagcccccactggcagaagaggaagctgagacacagattaagtgacttgttgatgtcacacagccactcacggtagagcctgggcagtgcatccactctcctctctgtagagaggcccttctggtggtattcacatggtacatgggccactggtccagagcagcagggggtcttgctcctcagttgaaaagacaatctgctttgctcacccagtggggggaagctgcctcccttaccaaacctgctggtttcccatgttgcagacctcaccagggcaccttctgtggcacattcttaatttcctcttcccataaaaatcctattcctgactgccccacacactctgcagttcctgtccccccgccccgcacaactcagcttacatttcagctggcacacttcaaactgataaacttggcaaagcatatgcccttcatttgagggccttctggaagcctgagaggaaaagcagctggggcagggcttgtgagctgcagtttacacaggtttattggcaagcctgtgtgttccagggcctcggtcaggtgctgtgggaatgcagagataaacagaacattgctcctttccctaccttgagtattacatgtgggttcaagcctttgaacatcaaaacctcgtttcttatggatgcaaaattttgactgtggttttctccaggtgatgaggtggtggattttttcccccttctttgtgcttttctaaagaatttgattcttctgtaatgagtaggaattgcttttataacagaacaacaacaacaaaaaaaacccattgcattttggggaaaaagtcatctaaaagtagatagattttcagtgtgaagtgaaggatgcctacgtcatcaccatctttctttcttctctgcaacactgagagactcctaagggggatggctttccaaaccggttcctggcacaaggagaaggacagcagggagcccacaggaaaagggagtgtgtacaaagaaaggagaagggcaaagagttgctggaattcctgctcagggtcccaggcgtcacacgccttctctgtgggcccctcctggctgccccagcctggtctccaggcctttgtcctcaccacctgcttcaggagcccactcctaggttccctaggaaccaaaccaaacctcccctcctcctgaagccttgcctgccttctcaaccaggcattgttgttctccacccagtgcctgctcctttcctcttgggacaagtactaaacacagcctatgtgtctgctgaatacattgatcctctgtcatcggttgaccatgctatgacctgattctcaatcgctgtaattacttgttaatagcaaacgcaaaaatgagtccaaatcctggttctgccacttaaaatctgtgtgtctatgtgtgaagattacttatcttcactgagctctgagttaaggctacagagacttatcacatagaataatcataagcattcaataagaaaatgtatgtgaggcatctagtatcttgcctcccaagtagcaggtgcttgaacagtgggaacccctccccacatcttataggtctcgctttcccaagagggtctgacatatcacatgtcataggcattctgtaaatcgttgttacttaatgtctcttttttctacatatacatcattaatctagtcacaaaggaacccccactcaaaaatgcttgcctctttgtacaataaccccagaggcacaaaaagccttaaaaaagtgcacactttaaaatcagagtcctgtgattcttccaattcagtttgcactcctcactagctgtgtgtctcagccaagtactaaacctctctgagctggttttgtaagatggaaatgatattaccttcctcagaaggattctcatgaagattaaataataaaatatactgctagtatgtattgagtccctactttgtgccagccctgtacctgttccagatctgaaaatactattgtggaaatgaatggaacaaccccagccttataactccccaaagactgagacagcagtgggaagcaaaagatgcactattttgagtttcttaacgttgagtccggaagtcctcgtggatgcagagttcaaggacgttttagaaggtgtaccttactcctgaaattatttataacgtatatgtatgtgtatatatgtttatttccatgggagaagaaatataattgggttaggcttttaatggcatctaaaactgatttatttatttatttatttatttatttatttatttatttattttttgagatggagtctcactctgttgcccaggctggagtgcaatggcacaatctcccctcactgcaagctctgcctcccaggttcacgccattctcctgcctcagcctcccgagtagctgggactacaggtgcgtgccaccacacctggctaattttttttttttttttgtatttttagtagagacggggtttcactgtgttagccaggatggtctcaatctcctgaccttgtgatctgcccgccttggcctcccaaagtgctgggattacaggcgtgagccaccgcgcccagcctataaactgatttaaaggagcttcaatgttaattcctcatgtaaagcaaaggaatctcctacaatatgcatgttctcctacaatttatcattcaaaactatttaatatctaatttgattttctctttccctttacattctgattctaaaacgtctcgtttctgtggagtggaccagcctgaatttctggacaactgtttataggttctgcaatattatttggcagtaagttcaggctgtttataagatgcctcttcaagaaccaatttcattttataatggttgaaagcacattgttttagaagcgccatgaccctcagcattatgggccacctggagtgggctcgtggatgtcagtcatcatactcacagctcttgccatcctcccagtatttaaattattcattgatgactctgaagcagtactgtttagagaaaatttgtgtatctggagttgttaaaatagaaaacctgaaatcagcttgcttttcattattctgtaaattgtctctgcttgtgtacaggaaattttgtaaggcatggaatcaccttgccaatattagttgagtaaactgtgtcattgttcttccttctgcgccctgagtagtccttgcccaaaatgagaacatactcaaaaaaaaaaaaaaaaaaaaggaggcgaaatgcttaatgagtatgtttgctggtagttcctgaagatcacaaccggagttcataccctagaaacaggagatgcaaagatactgctttagtattgactgactgttctagagtaggccaaggggaactgttggtggagttggaaggaaggtttatatggagctgttcatgcttctgaaggagttcacaactggtgttggcagaatatggtactacctgcatcctgcccaaaaatagtttccctgtggcttccccagtttcacaaatattattgtcatgatgcctctcagttggtaagctgctttgagtaatatcagtgacaaataggtccaggacagccacaggcatctactgggatctgctctttgtccaggctggaggagaagatcctgcaggtgtgagtatagcagaggcattccccctttcctgggaaggtggaggaggtccctctataggtcctgggcattcctactgggagctccaaggctgtaaaagaattcttaattccaatggaggcatagacaaagagactaaggggtcagttaagagactagaagattcccagggatgtctctgtttcttccctgtttggctaaggatgagcctcttcctttattaagaccacatggtcttagactagactcctaaagaagcctcttctgtttgaggaaaaaaacccagtggccaccagaacctgggagggaatggacccttgtgagaagagagctgcacttggtacaatctgtgttcatggggctttctgtgtgagggtgccctccattcactgtggcacggagctgctggaggtcacagctgagagctgtgttacaactgggtttcagaattggaggaggcagttaagaactgctagaacaactggaaagggagggaagacatttcagaaaggacggaaccacagaagggggagcactaaaatcattgtaaactctacccaagttattggcggccctctgaactcacatgaatgggtgagactccaaggtttccagcaaaaagcaacaggaaaagtctggaagaactgagcagtttcagctgtgactcattgcaggggagacagtttggacttggagtctagccacattaactgcctattggaacataaaaataaaaattattttaaaagaaagataaaagaacctagagactctttgtggccaacagtatgttctatacaatacaaatcgctaggtatgtgaagaaacaggagtgtctaggtcatggttattagacaattagatgaaactgaccctgaaatgatccagatgtgagaattaggagacaagtacttcaaaaccatgttataaatatgttcagagacctaaaggaaatggagacataatacgcaaattggggattctgagcagaaaaatggaaactattttaaaaatgaaaattctatctgaaatgaaaattttatcagatggagtccagagtagtttggaaatggcagaagaaaaagtcactgaatctagacttacatcaataaaaacttacccaatctgaaaaagagaaaaaagtaggaaaaaagtcaacagagtatcagggtcctccaggacaatataaagtggtctaatatatgtgtaataggaatcccagagaaagaagaggaaagtcggacaggaaaaatatttgaagaaataatggcctaacatttcctaaaactggcgagaacattaatttatagatacagcaagctcagcaaactcaaagaaggatatatacaaagaaatctgcacttaggtatattatagccaaaatgctaagaaccaaaagaaagagaaagttttaaagcagccagagagggcagaaagatacattatttatagtgagaataatgatattttaaaaacctgactctttattagaaataatggagaccagataacaatggaacaaaatattttaaatttaaatttatttagaacattaaaacctgtcaactcttaaatctgcattatgcaaaaatattcatcaaaaatgaaggtaaaatattttcagataaaagcagaaaatttttcaccagcaaaactatactgtatgatatgctaaaggaagttcttcaggctaaaaggcagttgtaccagatggcaacatgaatctacaggaatgaatgaaatatatgtattttatatgtaaacataaatttatatataaatataaatgtatacaggactatatatgtatatatttttcttctcagtttatttaaaagacagtaatttggatcaaaaacttaaaaaactttattggatttgtaaggggtatagcgtataaacccaacatatattatgtaatatgtgcaagtgtattcatatatatgaacatcagcaatagcctgtaggaacaggatgtggggaggggataaatagaatgattgtgtttcctacattaagtagtacaacaggaactctgcctagactgttttaattaaggatacatattgtgatcatcatatcagttactaaaaatagtaaaagatgtagccaaaatagacagtataagaattaaaatggtatgctaaaaatattcgattaaatgaagaaaggagatgagaattagaacagatggaacaaatagaaaacaaataggaatatgtcagacctgaatacaaccatctcaatgattatattagatgtaaataaacattcatgtaaaaatcagaaattgtcagactggattgaaagggaggacacctaaatgttgtctacaagaggcttacttgaaatatagagaaatgggtaggttgaaaattaaaaggtggagaaatatataccatgcaaactataaaaataagaaaacttgagtgacaatagtaatatcagataatagaccttaaaagaaggcatattaacacagataaagagaggtacttcataagaataaaagagtcagttcacccagaaaacctaacagtcatcaatatgtatgtacctagtaacagaacttcaaattatttgaacaaaaccagacaagtataggaagaaataaacagattctctcttgtagctggagatttcaacactcctctctcagcaattgatggacaatcagattaaaaattagtaagaatacagaagatcttaaaaatgcaatcaaccatcttgacctaattgatttttgtggaacagttcacccaaaagaagaatgtacttatttttaataagtgcttgtggaacatttgccaagagaaaccattcagtgtcataaataagacccacatttcaaaccattgaaatgttatgaagtttgttctctgaccacactggaattgaattagaaattagtatcaatacaatatcaacaaaatcctaaataaatggaaattaaacatgctctcaggagaccccattctggtatccaaagcaagagaacctgccctcagggtggggtatggtcagcccatcacagtgagaggaaaaggcacctggcattcactgggtcctcactgcacacatagcactgttaaaagtaccttaaacgtaatcttcatacaactattcctgttttagaggtgagaagaatgaggctcagaaagtttgagtgacttgcccacagtttcacagctagtgggtgggtgagctgaggttggggccacgtctgtctgattccagagacagacttctctgggccacagtaaaataccgcctttgaatcatgtttgtatggtcacatttcctgtcttgatgagattttgaaattgtaccacgctcttttctgatgaaaatatgtccattcctacccgatttgtactttctcctatcattttcctccttctgttaaaattaagtgtgccagaagtctgccctgtgcacctcgattgaagacattcactgacctcctagatcttagtgagataacttctgacaatccttggtctgctcatgtttgtgccctaccatgtctccccaggctctccgttactttcttcctgcctttgtcccacctccccaccctgttcctcgaggatttgaatgctcactgcaggccaggccctctactaggccagaagggacccctcccctcacaaaagagagacacacctcatagtctccttaaaacatagtctgatacttatcgttgttaaaacaattcatgcctgctatagaaaggcataaaggaagaaatgtctcttatcactaagaggtagctacccttaagttttttttatatttgcttccactgtgtttttgttgtgcatgcttaacaaaaatcccaattttttcagttataatttcataaaatattctcattatttcagattctttggaagcatcttttctaatgtatcatgatatgctgtggagtgaatgaatcatagtttactcagtaattccaaaggagacgcattctgaggacagtcttaattaaagggagataagtagacacatacacacttatttgtataaaaatatacatgtatgtgtgtattcacacacataaagatatgcatacatacatgtatgtgtgtgtatatacatccctctttaattgaagcttaacttcaagaaaaggcaaaaagaaaatatacatacatattatgtttatatacatatacacatatgtatctattgcatgtgtatgtatgtattgtgtgtttgtacatatatacacacatagatactcttgtctgtccttcttgaggtgcactccagctaaaattctttaagcaaagtacattgcagttcattgggattagctgtgcctatctccccgttttgcaggagggcttgggtagcctggtctcaggaagcctgctgttaggtctctgctattccatacatgggcttcttcaaatcccaagtccccagtctcccacctgtgtgagcctgtgtcaagattctgcatagcattgaatgtaccttttaacctgtctctctgggatgatgaattatgctagtccggacatctccaccagtccttccagaggaaagccctaaactgtgatttatcggtgcttgtcacagatgagtgctatttacttatgaggcctgcattagtgccaggtcagtgggaaagccttttcatcccctgattcactgggcagcacttgtccaacagtaatgttcacagacagagccgggagcacaatttcacagcctggatgctcctttagttcgcgttcagtcggccatgccatgctttgcagtcacccatcccagcctctccattacttggacgcccagccttgctgctttgctcatcactcgtgactagaaatgacgtcctttaatgcaacctgagtcctgagtttgaatgcgggctccccttgcgtgacttggtgatatttgagaaaggcatgcatattgcctttctgtgcttttgtttcctcagcttctgacttagtctgttcaggccacggtaacaacaataccatatgttgggtggcttgtaaacaacagatacttatttctcactgtctggaagctgggaagtccaagatccaggcactggcagattcatcatctgaagagggcccattcctcatagatgctgttttctcactgtgtcctcatgtggcagaaggaatgcggggtctcttcagggtctcttttatgagggcactaatcccattcatgagggctgtgccctcacaacctaatcacctcctgaagactctacctcctgacacctcacattgggggttaggtatcaacaaaaaatctgggggagacacaaacattcagcccatagcaacttcttaacaggaataagagtaaaccaccccctactgagttgttcagaagattcaggaaggtgataaatgaggaaaaacactgtaaaatgaagtagtatgccatgtgtatttattattttaatatataactccactcatatttgattcacataaatcagaaaccacacccaataatatgtatttttttttttcagtaaaaatgtattaactaaacttgcttggtcagtgaagtgagtgtacccttaactccctgatgccagcattataaacagtgtctgtagttggcctgtactgggggaaaaagtcacgtggctactttagcaaatactgggtcctttaattctcagccttcattgcaattgtaaaattgtcagaagtgataaagttgtatttttcttaaatgaaataagtggagaattgttcattggctggccctgtggtgagctcttcgatccaacagttttgatgaaacgtagacatgctcatctctgtttccagggaatattagctctgtgctgctggtggtagagctctaaggaggaacagtggcaagtagggtagatataaagtgagctttcatggaggcagtgacatttagggcaacacagtgaccactgagtagcattatgtgaaaggcatgtcgatttgtgactgcaggggacatagtttattgtagaatgttggggaagtacagaaaagcataaagaacaaaaaacagctgtattgcagccatgcaggtgaactttggttgtatatctaggtatttattcagggtatttgtgcagtatctcccgtgggtcaagtgctgggatgcatcagtgaccagaatgaaatacctgccctcatgcagctgatgtcctagagggagtagaggaagacaggcaataaatgagtgatgaatcctacagagaaaaataaagggagaagggcagtgccagaagtaggagatcatgggggtggaaagaggagtttggtcttcttttaatagctagtgaaggaaggattcatttgtaaagggcagctgggcagagatctcaagaaagaggtagtaagctatgtggatatctgaaggaaaaatatttcagataagaaaacagcaagtgcaaaggccctgaggcaagaatgtgcctgaaacgttgctgcagcagcagatcagagtgactggagcagagtgaaccagaggggagagatggaaagtaggagaagcaatagggtcaaatcctggtcctggaacatcttcccttctctgtgggatgctgtctttatttatgtatagaaccctgggtaggaatgccagctgatatgtggaaaataatggaaaatgtcagtttgagataagggaggtgacaacttccacggccttggcctttgtgttttcagttgagctcatctacatggaggcagtgtgttgtgatggagacagcatgggtgttggaattgtaggacttgtgttcaactcttgactgtgtcctggccagccctgcatccttgggcggatcacttagcttcttggatctcagtctcttcacctataaaacgtaactaatacagggtttttgagagacttataatgcacagtatgtactcaatccaagccattttgcctgtatctattaatataggaaattgctgtagtttttctcatgatggaaataaatatgatctagtacagctaactctcaattattttttcttagatgctgctgtttcatctagtaccatatggttcgataaagaagccaaaagacatatgtggccatttaaatttaaattcattgaaattaaataagattaaatgctcaattcctcagtcatactagtgatatttcaagaggtcattagcccagtggctactgttttgggcagtgcagaatagggaccatttccagcaccactttttgagatggagtgttgctctgtcacccaggctggagtgcagtgctatctcggctcactgcaagctccgcctcccgggttcatgccattctcctgcctcagcctcccgagtagctgggactacaggcgcatgccaccacgcccggctaatttttttgtatttttagtagagacggggtttcaccgtgttagcgaggatggtctcgatctcctgacctcatgatccacccgcctcggcctcccaaagtgctgggattacaggcgtgagccaccactccc

SEQ ID NO: 12545 - DNA, 1381 bp, Homo sapiens
ggctaacagcacctgctgtttgttgagcatttactaactgccaggcactgtgctcagccctttgtgtatatcatcattttaatcttcatggctcatggcatcacattcatttcttttggacatttaccttgttttgtcattatggaaatgcatacctggtttagtgcaggatgtgttcctggaaatgaaagtgctcactgagtcagcactatgcaaggtcatgacacttgagcccctgcagcacagcgttctagtcttcagatgttggcagtcacccttccaggcaaagtcctcaaggccatgtcaggcatccatctttgcctattatactctcaatttctgacaactgcagggcagtccatccaggctgcagcagtttttatgatgtgctctctaagtcaccgaagtggtcaccaatgactaaaagcctgctggcctttgctctgtgttctgtaggtttttatctgggaaattggcattttagcatcatgtgccagattcttcctttgctagacaacttttgcaaaccattatgagtgttacccacaatgggtaaaaaccatggaccagaacacaaaaaaaatggtgagaagagaagcttcagcatagtgcagcagaattgaattggctcatgatggtgtggcagaacatgttggctgagagctttagctgtatggtggggccgtgttttttctccctggctgagagcataaacagttcttggagaaaagtaggtaaatcaaaactgtgccattgtggcttatgggtatgtatgtttggtagttagaaatgattttggagacggcagttaagtggctgggctcttccatcagcaaaggcctgcctccagctttgtcctgtgagaataaggatcatgtcttgcttttgtacataattgtatctttatctcctagtgtgtggaaacttaacaaatatttactgggcgttggatatgtacactaccatataaacaatcctcattttacaggcaagagcattgaggctcaaataggttagataaacaactagcaactagcaaggactagagttgggtaagggtggagtctgacatcaggatgggcctaccggagggttctgtgtgtgcttagtgcattctgagaccactggattttccagagagagcagtaaactcagagattgcagttgttcaaacatgggtgcacccagattttgtggggcctaaagcttgtatgacatagtggccttctttataaaaaatccccacagaattatatatacacgcttaggagtaaaattatgtgttgtttaggctgagaaaataaataatcacaaaattataaactttaaaaagctatgcacattacaaacatggtcgggtctgaaaaaaaaaaagaaaaca

SEQ ID NO: 12546 - DNA, 501 bp, Homo sapiens
caagaagataaacaagattaaaatgaaattatttcttactccaaatcaggattttccgccgtgtttgcagcagcgactctgagggaaatgtggcctgcaaagagtttactgtcatggtgccagtttcgtgtttgtccagtgataaatcagtggatttatgggtttaattacctcttattgccaactcccttcctatctgaatatacgaatttaaaagttaggatgtgtatctacaggtagtaaaataccattttgttctttctcagtggctgaatcctgtatggaatgaaaatcaaaggaaaatcttaaagatgcgtcagtgcattacgctgtagagattcatgtgcagaagactagctggctatgcactagttctgtcctgggaagggcttcgttctaacaattgttttctctggaaggtgatgggtgactccgtcttttcagatcacatccacacccatggtagctgccccagcattttggtctggctcctccaacttt

SEQ ID NO: 12547 - DNA, 20295 bp, Homo sapiens
tttatttttaaaataaattttattgcatacatttaaggtatacaatgtgaagcaaattaacatatccatcatctcagttacccacatattttttgttttttgacaacagcagctgacatctactcatttaccatgaatcccaaatacagtacaaatttgttacctaaaatcctcatgttgtacaatagatctctagacttattcatcctacatatctgctaccttgaatcctttgacctacattccccatttctccctatccccctataaccagttttgctctttatatatttaaattttttttttagattccacatatatgtgaaattatgcagtatctttttttctgtctggcttatttcatttagcacagtgtccttcaggcccatccatgttgtagcaaatggcaagatatcgttggttttttttttttagggatgaataatattccattgtgtgtaggcatatatatacacagtttctttattcatctgtcaacggacacttcagttgtctccatgttggctactatgaataatgctgcaatgaacacggactgcagatatatttacaaggtggtgatttcatttactttgagtatatgcccagaagagggattgctggatcgtatggtagttttatttttctttagaaacttccattctgttttccataatggctgtaccaatctacattcccaccaacagtgcacagagttccttttattccacaccatcacaacatttgttgtcttttgttttttttgataacagctagcctaactggtgagaggtagtacttcgagtggtttttatatgcatttccttgatgattaattatgttgagcacccttttatatacctgttggccatctgtgtgtcgtcttcggagaaatgtcttttcaggtcttgcccatttttaaaattgagttgtatgaattctttataaattttggatactaacccttttccatatatatgccttacaaatattttttactcaatctgtaggctactgtttcattttgttgactgtttcttttactgtcagaagctttttggtttgatgtagtcacatttgtttttgtttttgttgactgagcttttggtgtgatatccaaaaaatcattgccaagggtcagtgtccaggaacttttctcctatgttctcttctatagtttctggtcttacatttaggtcttttatccattttgaattgattgttgtgtaggtctaagataagggtctgatttcattgttttgcatgtggaagtgcagttttcccagcatcttcattaagaacacttaatgaagactgttctttccccgatgtgtcttcttggtgtctttgtcaaaaattagttgactgtgtatgtttggatttatatctggactctttcttctgtcccactggcctgtgtatgtgtttttataccagtaccatactgtcttgattactatagttttgtagtataatttataattaggaaatgtgatgtctccaacattttttcctcagtattcttttgcctattcagggtcttttatcgttacatatgaattttaggatttttttctgtttgtgtaaataatgccattggaattttgataggattgcattgattctgaattgctttgggtagtgtgaccattttaacagtattattctgatccatgagcacgggatacctttccatttatttgtgtctttctttcatcagtgtttcatagttttcagtgtacatacagatcttttactgccttggtgttaaatttattcctaagtaagtattttttttatgctatcataaatggcatcttaatttttcagttaggtcattattttcattatttatgtataaaaatgctaatgctttttgtatgttgattttgtattctgcaactttactgaattcacttgagttctaacaaacagattttttttgtgtgtgtatctttggggtttttacatagagcccagttttagttttaatagaaatgtttataatagtggatggaataaagactttgtatgattactgtgaaccactatctctctctatatatatagatagatatgaatgagtatgtgtataaatacataaagcaaaggctttgagaaacaatactcatctttgctttctgtaacatactatggcactttctgttttattttcattataaaatgtcaaacatgacccagtggggttgtgattagcaattagagaaaccccatcctaggtaataaaaagttttcccaaatagcacctatatgtctttctgactgtggtttaatgagtaattaagaccattcagccaagatttacatttgctgccacctttaatagcactgatgaaaagtagaacttttttttttgacttctttttcactgtgcctctaatcaagaaatttttgttaaaatattaagggtttttaatgtttaaagaatgagacataaaaaagttgcagaaaataaatgataaattcttatttattgaaagacattcagttgaggaatagggatataactgtttgttaggtaagcttatatggcacatgattaagttccactaattcgtatttctgcattatgctttctgataattccggagcattatactcatgcagcagtggtaggaagtactgatgtttttttaaaaaatgtccattcttggccaggcgcagtggctcacgcctgtaattccagcactttgggaggccgaggtcggcggatcacgaggtcagatcaagaccatcctggctaacatggtgagaccctgtctctactgaaaaaaaaaaaattagctgggcatggtggcaggtgcctgtagtcccagctacttgggaggctgaggcaggagaatggcatgaacttgggaggcagagcttgcagtgacccgagattgcgccactgcactccagcctgggtgacagagcaagactctgtctgtctcaaaaaaaaaaaagtccatcctcttgataaagcagtgtaacatcaggaagatttagttggggtcattgtctaccatttgagtatgcgataccctaatgttaagaaatcaagtctaagtctaggaaatttagaccaattatttttgatatacaaaacttacatatataaatgcagtagttgtacctggctttcagctatttttgtgttgacattttccatcatttatggtctgtcccaagcacaaaatccatgggataccaggtaatgatataatgtagtagttgcacagtttgcttttccatactgttcaggaatccacggatttatctgaaggttcttttttctctcctatagtatcactaaggatttcatcagatatcttagctgtggtaggtgtagtctggggagtcacagtgtgtccaaacccttggtagtgacccatgggtgaaggtggcatagaagaagcaatggaaattgcatcttgtgatgatgatgataataaacttgtatgttcattttgatcttgatcctcgggaaacaattttttcctgggatgtcccctgactgtccgtcctttaatataaagttttctgttagtcaaaagttatttttaccattataaacttaccattctaaaaataagctccccacttccccctctcccactccccaaagttgatgagcctgcactgtggtactgctttaaagtcttttttcatctctaaatagataataaattgccctagtaggagaaattcaatatcctacccaacctatttggttgaattaaatagctggtacttaccaacatgccttacttgttcagaaatatcatctctaatatctgagacatcccacatggcaagaaaggaatcaaagcatgagccctcttctgcttcttggacatatggtttatatgagaatgtgtaatgatgagcaatggcagcgaggaacatctcaatacagataataaaatcctatgagaacaacaataagataacagccacctttggatttaaatctaggtttgtagagtgctatctttctctacttgcttttcaaaagtgctaagataaacagctgtgttttttcttctcagattatattcatttttccattttctaaaataattatttttgaccccttcaaaaaaagacaaaatgccaaaatgtgaatctattttgcacttcctcaagtagcagccttgaactcctgcattcaagcaatcctcccacttcagcctcccaagtaactaggagtataggcatgtgctgtcatgcctggctaagtattttattttttagttttttgtagagatgaggtctctctttgttgcccaggctgatctcgaatgcctggtccagtgatcccccaacgttggccttacaaagtgctaggattacaggcgtgagtcactgcaccaggccagcctcaagtatttcttagcaaagtacatttcattctcaatcacatcaagtatattgcattccaccacccaaggactacaaggagaaatgtggaaagagaattggacttaggaataatgaaatccaggttttattcatggatctgctacaaattagtaattatggccaatttctctagggttcccctgttttctcacctgtaaagtgaggataatagccccataccctgtgtgttgtcaggtttagtggagatatgtaaaaatgcttaacaaatagtaaagttctattgaattcagagatggcactacttacctggagtccggtggccacagcttctacagtttgccattcccacgtatgcttttcagaaataacgccaacttttaccaacaaagcaataactactgcttgcctatatgttaggaaaaggtaaacgccaaatctatatcaagcataaaatgagcagtagttttaaaaatgtgccattaaaaaaaaatccagtgcaacctgtgtaccaccaccaccctgcctttacagcatattgctgaagaaactctatgttaaatatattaatttgctttacaaattcatttttctagtagttttgtctcaagatagggagtcaagctgagcatttcaagcaaatctagagataatggccccaggtaaaatttaaacagcaaataatgacatggacatgctttcatagttgtatacataagaatattcacttcagtgtttcttataatggtaaaaaaattaggaacaacctgaatatcaaaaggagattagtaaaaagttatatccacataacagaatactaagcaaaataaaaataaaaataaaaatcaccccctccacaaaacaaaataatatttctgtttactgacaaagaactgtatctacaatatactactgaacattgtcgaattccaaaaatttttatagtatgaaactttctctggagttttatatgtgacacaggtttaccaagatgttaatcattcttttctgggtggtgggatttcagggatttttctttttccctttttgtattgtttctagcttgttaaatttggtgtatttgtttctaggacccctattacccacctctttactaaattctttttttttttttttttgagacagagtttcactctggtgcccaggctggagtgcagtggcatgattttggctcaccgcaacctctgccttctgggttcaggtaattctcctgccttccctgccaagtagcttggattacaggtgcctgctaccatgcctggctgatttttgtatttttagtagagactagccatgttggccaggctagtctggaactcccaacctcaggtgatccacctgtcttggcctcccaaagtgctgggattacaggcgtgagccactgtgcccggccctctttactatattgaactatgtatagttttaccttctgttttaaaaagatttactgattattttcccatataattaaatattctacatcatgctttcttccaaactccatagtattctattatatgacagggccatgatttattttaataattattctagtattgacatatttaggttgtctcaaactattttcttcatataaatgttacagcgaccatctaattatttcttttgaaaattgtagaagggctaaaaagatgaacttttaaaaagagaagtagagacattttaatctatcttccgcattaagactgtttaaaaatcctccttaatcaacggtttttactgcccttaaaaaaatgagaacatttaaaaaaaagtaacacttaccaaaaagaaacaaaaaccaccagctttacacaaagaaatttgccaacaggttggattgggctcagttcttcttttagtactttataaaagagcaggagacaatacatggcaaactagaaacaagattaacatttaaacttgttcagtaatagatatggtaatagaaatattaaagttacataccagagacctggtacagagtaatgtttcaggcaaacttttctaggctttattattctatttttagattaacaagctttcatagtttactatagatgaatatatactacatacaacatcttccgtaaaaatgtttttaagtgttcacttcctgggttccataaagggaacaataaacaaatgattgacataaatggaagaaatggctcttgttcagccaaaataaaaaaatccatctgtaacggcttttaaacataaatttctgaccactcattttatgaggctttagcttattacctagtctatcctatgtaactaaagtaacccattaaacaagtacaatttcaataaaattgtgactatgaaatctgaatgtaaagaatcaaacaatttttcctgagagcggtgtattagttcagctagatttattttttaaaatgaacaagacttactaactttttagaaatctgtaataacctagtgtagtgctgaataacaataaacattttcctgaaagttcactattccctattaaaatcatataaaatgcaaattcaaagtattttagaatatgaaaccagtaaagaaagaaagaataaagtgattcatggtgtccaatcatcctttttacacataagccagtttttaaataactgtcatgaactaattataaaattttattgcctaatgttttttccacttaaaatacataacttctatatgtttcatcaggcttatttttagtaactgcctaatattttggccaatggaaagaccacagtgcattcaactagtccctaacattgggttttggattgctttcagccttttgttatttacaagtaatgggctttatatacaaagatactttaggcaaacatacttttgaacacttctttagaatacattcccagaaacagaattactggttccaaagaggatgaacatgtgggaaaactttagctacatggacatttaatttttattataaagctctaataccaaccatgcataccactgcatctaaattattttgctgacagcattagtcaaagaatttaaataaaatgcacatttttttaagcttgtaagatcaaataggacattacatcataggtctttggaacatacagtttctagaacatcatccatttttttaaacttggcattctcaattttcctttaacttcaaatatatgataacagagaattttattctcacatttttattcaaaccctgtaccatcaaataccaatttgatattttctcttctgaatatgttcagtatatgtgggcgtgtgtgtgtatttttttttttatgtagcactgtgcttttatttatgacatactcatacagctatgcaatgagcaacagaaataaatgaacaaacatggtcaacatgtgagggtataagttgccaaataataaacaaagatgttattatatctttatatatgtattaagatatatattaaatttttttcaagtctttctataaattaaatttcagatttaatttataggaagattaaaaagaagcaagccttatcctaagaagaaactttgtctaaagaaatttagttatagatacgaatttagtacagtttaagaaaagtgaacattttacttaccaactgtgacatgttgtttattataaccaaataagtccaagcatttgaaaagctaaagttcccttcgtcatatataccaagcagctcacagattctaaaaatagtaaaaatgagatatctctgattaaatcaaaatcgtacttcaaaatacagcaatagcaatacttaaatttagaagtcagtttatttgagatctcactgacaatcacttgactttggacacagagaatttagaagtcagtttatttgagagatccattgacaatcacttgactttggatctagaggtggttcaaaaatgaaaaacccatttttttctagaaatattactatattccttcaacttgaaggaaatcccaaataagacacataacacttaactagaaagagtactaaatttaaaaaaaaacaactatgctgtctaattttgggaaagcttgattgttaaacataatataatgcaggtgtatataactgtagttgttaattttttcccctcaattgtcttggaggtaaattttatgaagacccagatcccctcaagtaagtatgaccatcagtattgttataatcttacccaatttctaagctgcagggaaataaagcatgccttcataattaaatggctaaataattgctagctcaaaggcagaataaagaattctttcacaagtctttctttccacttttcctctgtgagcatgcaaaatgttagtaacaactaggagataaaacatgtaatctattggcattaaagtatttgatgttcttgaatttttagggaatagttttgccaggtagcttaatgataccccattttacctcaattctaagccttgatagaatatattaaaagaaaatatgacttctttcttagagtacttctaatatattctaaattaactatgtagaaaatagaactgtaattaacctaaagtagcatactttaacttcatgcaatagggtttctgtcaagctatgtatctgaaaaagaaggtatttttttttcaaagtgctttacggccagctagctctggagaggatgtgaatatttaggagacccctgtggtgactctttgcctataaatggtcatgttatttattttaatagagtgagtttctatacagtgtttttttttacaacagactagacctgcattataaataagcacattaacactatgttttctacttagttgttcccacataagatcacaaggatgaaaaaaaaagttcatataaaatccgagtacttacaaagcaacgatggtggtgaaaggtctgacaactgtgtactgtaatacacctagtttgcacctaaacagcaatactctgcaaaagaaaaagaacttagaatttcaactactcatttaaatagcatcagattttccccaaagcctccaaattaaaatcactttgatgaatgataccatatttacagttaattctttcaatgtagtcatccttaatagcagtggcagaagaatgtggatggcaggaaacaaattatctaaataccttttttattttttgagatataggatcttattctgttgcccagggtggagtgcagtggtgtgaacatggcttactgcagccttgaccttctgtgctcaagtgatcctcccacctcagcctcctgagtagctggaactatatctgcataccaccacacctggctaatttattttctgtagacatggggtctcactatgttgcccaggctactcttgacctcctgggctcaagtaatcctcccacctcagcctcctgagtagctggaactgtatctgcataccaccacacctggctaatttattttctgtagacatggggtctcactatgttgcccaggctactcttgacctcctgggctcaagtgatcctcccacctcagcctcctgagtagctggaactatatctgcataccaccacacctggctaatttattttctatagacatgggagtctcactatgttgcccaggctactcttgacctcctgggctcaagtgatcctcctgagtagctgggactgtaggtgtgtgcccccacacccagctatttttaaattttctgtagagatgtggtttcactgtgttgcccaggctagtctcaaactcctgggctcaagccatcctcacgcctgtaatcccagcactgtgggaggccgaggcaggtggatcacttgagagcagcctggccaacatggcaaaactctgtctctacaaaaaaaataacaaaatttagccgggcacgcctgtaatcccagctacttgggaggctgaggcatgagaattgcttgaatatgggaggtggaggttgcaatgagctgagatcacgccactgtattctagcctgggtgacagagcaagaccatctcaaaaaaaaaacacagtaatctttgaaaatgaaatttagataccggttctctgcataatatcctataaatggtttctcatttgacaaagactctcatttagacaaactttagacaagcctctgatgcctcttttcaacttggcttcatccttgggccttgtccttgtcctgtgtcagtcaatctaaaagaatcttgctaagtcattccccagccccctttgatatctgatcacctttgacatccgatcaaattcctcagcacccaccttggatgactaaggccttggcctgcctttagcaagaattctgttcagtttagtgagaatcctcctagccctgatgtcccctcttcgtaattctgcattcgctgaccccctcaacatgctctagctataaatgcccatttgtccttgttgccttcagagttgagcacaatctgtctcccttgataaccaatctatattaatttgtcattactattctctcatggcctcctgtccttcttccttcattgcatttcctgaaataactaactatatatttgtgtcttaattcctaactctcctaaccaaactaagttccatgaggtctatgtctgttctgtgcactaaggtatttctttatactagcacgtacttggtgctcaacatatatttgtcaaatgaacacattagtagcttatttttttaaaaagccaggtagctccctgtcatttcaagggtgtaaatagagacaaaatttgtcaggacgttgtacaaatggtcctgtactgcataggaggcaatgcacccattcttatgttgtatgtctacactgatcactctacctccatttaccttggcttgtaacttccaccttattcctcatttattagtgaaactgcctttgcaaaattatgactgagacagtgaaagagataacttaaaccgactccatcttgtgtctaacctccaagctgtccttgttcattcctgggcgtaggctgaactaactttgagagaaacttagtttatagtttctcccaaagctatagaaatagccctgccccaaagcaaacctccttgcctggggactagattgcctttgtaggactaacattagccataagattagaaattatggtttaggagtcatgcagctggaggctacaagattctggccctccctaaactgctcctaagatcagtgcttgtgatattttgcagaccctgcatttgttgaatcagctggcaccacccagatcaataaacgggctcatctcaccttgtggcccccacccaggaactgactcagtataagtggacagctttgactccctatgatttcacctctctccaatcagcactcatggctcactggcttccccctacccagcaaattatccttaaaactctgctccccgaatgcctagggagactgatttgagtaataataaaactcctgtctcccgcacagctggctctgtctgaattactctttatcttttgcaattcccgtcttgatgaatcggttctgtctaggtggctggcaaagtgaaccccttgggcggttgcattagtggacatgtcctattgatttttcagttgcattctcttattgcctttcttttctattccaatctcatcccccttttcagttttatttcacaaatagattattataaactcctaatttatttctccatctctggaatcttcttccttccaattcatcctttatgatattgcaaaattaatctttctaaaacactgtttccaaatgtttgcttgctgaaaaataccaagtggttcatttctataataaatgcaattgtaaactcaatttatttttcaaaatgaaatgacataagttttaatgtcctacatgaacatataataaggcaagctgatgtattatgttaccaaacactgttacttattgctcctacttcatatcatatgtggttctacaacctacattatcttgtctatgtcttttaactagctgtgtgttcttacataagatctgcagaccttggttctcaactgcaaaagcatattgattaaatgattactgtttttacctgcaatactttaatttttggatttgggattaataatgtaaaaaagactaacatatatgtgggattacaaaactgttttgttagccttcaaacaactatgaactgcatcaggagctgtcttatacttattgttctgctattaatacttaatgcactgccttgtaaagagctgattgctacttaaaaactctgcttaaatgaaaaaccaaaacataaaagaattaaaccaaacatacttactctcccatagcccatggtggacagcaacataaaggagggaaatgtttctgttgatctttggcttcaaggattaataccagatttggataccggttagttagataattggtaaggaatcccataaagttgtaaattacataagcttcatagcattctctgcaggtatccacatatattgcaattccgggatatttcaaagctatccactatgaaaaagcacagatgttaaagatagttgcagctaagataaaatgaatcaccactccattcatggtactcacaataagctaatttttatgcttgagatgtcttgtcatatacttacatgggactctctaaaatttatcattatgagggctatcaatctgtgaaatgaatgcttaaaagcaataaacatcttagatattggtaaacaaaaacaagtgtttgaggggtaaataatgaataaagagagaagctaaagtaagtacttgtgttcttaaatctgaagtttttcttaatatgatcatagataatgctgctaaagatatttcctttaatatttactcatattagaagcagtcatctacaacaatttcatgtgtatccactggggaaggtttttaaatttttgattcaaataaaagacgtaataaataaaaagagtagtatattaatttaaaatattacattctttaacaatctgaaagtttaaaagaaagcaaacagctatagatttttaaacatttataatataacattttacatttttaattatactttatattctctatcattagaaacaagtgaacctttttacttattaatctgactccttgtcaataacatactttcattatcttaagcattctgtaattatagtatcatcaaacaagtccttagttaatgagataaaaatgaaacatacttacactatctaaactgtaaataggtaccatccaaagaatcctattggaaaaggaaaacagaaatttaaaacattttatgtcatatttatgaaataagccaacacaacagtagtggaatcaaaattattaagacataccttattattggtttttgtagttcaggttgtgtataatgcactaagtgttgcaatatcacccacagtgatataggaatagtcaacagcaaaaagattccagcaataaaccaagccttggtgtgtattccaaccttaagaaacaaaataacatgttaatataaattctgatattaaaacaaaagagcttggccaggctcagtgccttgtgcctataatcctagcacttggggaggccgaggtgggaggatcgcttgaggccaggagtttgaaaccagcctgggcctacaaagtgagaacccgtcactacaaaaaaaaaaaattaaaaaattgaaaaaaatttgtgggggaggggggacttttatattaacttgtaatcttgccttgaagagtatgaatctttttttttttttaaggggaaaaggtgggcatttatttttgatgcttgaagggttgagcagtttacaattaaaatagaactaaggtctacaaccttaagtatcactgtttcttttctttttctttttttttttttgagacagttttgctctgttgcccaggctggagtacagcggcgcgatcttggctcactgcaacctctgcctccggggttcaagcgattctcctgcctcagcctcccaaatagctgggattacacacccagctaatttttttgtatttttagtagagatggggtttcgccctgttggccagcctggtctggaactcctgacttcaagtgatccgtccgcctccgcctcctgaagtgctgggattacaggcatgagccaccgtgcacggcccagtttcactgtttgaacaggactttttcttcctctaccaggggccaaagataaaagaggtagaaaacaaaagtatggagaacaaatgcatttttacaacaacaaatttccacattaaaatgtatagaaagcttgaaaagggctgagtgaggtggctcatgattgcttgagcccaggggttccatccagcccagcctgagcaacatggcgagatgccatctctacaaaaaataaattagcgaggcgtggaagcatgtgcctgtagtcctacctactaggaagactgaggtgggagatctgcttgagcccaggagttcaaggctacagtgagccatgatttgtgccaccgtactccaccctgggcaacagagtgagaccctgtctcaaaaacaaaaacaaaccaaaagctaatacaaagtcttactgattgtgggggcgttaatcaaacagtaaatgaaaagcaaatatatggacgtaagactctaaaaggaatgtctgagcactcatattacagggctttttgcttttatccatttcatttaaaattgagtacagtagtccccacttatatgtggggattaggttccaagacccccagtgaatacctaaaactatagatagtcccaaatcctatatgcatatactatgttttttcctatacatatatacttatgataaagtttaattcataaattggacacacagtaagtggttaacaagaaaatagaacaattatatattgtaataagttatttaaaacttacaaattacttatttctgaaatttttcatttaatattttcagaccatggtggacaacaggttactgaaaccaagggaagtgaaatttcagtgatgatctaagaaaataataataggataagcatattctagatctcctttattataaaggatggtactgcggccaggcgcggtggctcatgcctgtaatcccaacactttgtgaggctgaggagggcagatggtttgagtccaatagtgtgagaccagtgtgggcaacatggcaaaactccatctctacaaaaaatacaaaaaattagccgggtgccagaggatcacttgagcccagaaggtcaaagctgcagtgagccatgaccgcgccactgcactccagcctgggtgacagagcgagaccctggctcaaaaaaaaaaaaagaaagaaaaaaagaaaaaaaagtattgccaagtaattgcttattttgattgctttagttccaaaaactagaacttggtggtacacttaagagaaaaatgatgtgcttgtgactaatgaaggtcaagtgtcctcagtgtgctataaagaagaaagttgtttttgttttttaaacaatcataaaacaagtgactagagacttggtcactgcaggccaaattttaaaatcctgtaccacataatatcatttttacagtgcaagtggtaatttagtttcagaaaaacatcatctctccacattaatgtcattaattttaattattggttttacagttgttttgatttttgagctatataaaagttacatgcacaagaaatttaacctattttatgtgtgtatatatttaagtaacattgtaatagaataactcaacactagctatctgcagaaattatcaatataattttttaattttatgtttacctctaaataatttattcaaatttgagacacattgatgtagataccagtaatattattcttaatctttatcagccatgagttgagtttttgggctcacgaaatgaggaggagataaacagattttttttcatgggtaactttaggaaagaagagaggaaagaaaaaacccttaaagacaagcatccaagaataagttaactctccctcagcaaaatgcttcaaaacagagagtggagatgaataggagagagtgctttctgggccaggtcttcctgaggggagagagtagaactgacctaagggcatgaggtaaatgtgctgaggttaaaaaaaaaagtgtgctgaggtaaaaagactagagcagcatgcacattcacttcaggtatacatggtcagccaagtgagtgggaaaaatagtttaaacagtgcagatggtcaccctaccattccaataaatgggtatatgccccaccatgggcatgggatgagcttccagaactgtgagaaaataaatttctgtagtttaagccactcaggctatggtattttctcacggcagcctggggacaccaagataaactctcacatttgtatctgcagctcatatctttctgagcattagatgtgcatatccaacagcatatctgacatgcctattgaatgtctcttattaaactaaatgtccataacagaactcaatttctctcaaacctgttcctaaccctcaattttctatctcagtaactagcaccaccatttacacagttgttcaaacaaaaaacttcagaatcatctttgatttgttcctttctctcactgcttctcctctggaatccaatcttcctgctacgtcttgtttgctcacttctaaggatacttacaattcagttttccatttccactcctgctatccttaccggggccataaaccatcatagcccaggcacccaacacctctcactaccataaagagctttctaacttcccttcacttctgctttattttccatagctggtagagtggtcttttgaagttatgcaattagactgccctgcatggtaacttctcagatcttttctggtttcctccacagcattttatacaattttattgatttgtttttgttggtcccttttgtctccaccaagttctatggaggtaatgttctctcatatagtatacaaagcctgattcatcactgggactcagtcatttgggcagaaagagggggaaagaaaacaaagtaaaatatgtatcgtggtagatggtggtaagtcctatggaaaaagtaaagcagagaaaggaatatgaagagttggggtggggggaagttgacaatgttaaatagagtagtcaggtgacatttgagtaaagacctgaagaacataaaggaatgagaataatatctacggaaaggaaattctgtgaaggggaaacatcgtgcaaagtttcaaggagggagcatgcctgggatttttgagcaaagccgtgcagtggaagcctaggacttgaggagaaaaagtcagagggggatcaggtgggagtggtgtcagatcatgttggaccttgatggccacagtgaggaatactggcctttactctaggactagaagtgatttaagatgacacacataatgtgccaagttttaactggttactctggctggtgtgttgagaagagtccaagcaagacatgttgggaacttggctaggacaagtacagactacagattccaatttttcttaaaagctagtggtacctaaaaactacatttgaaactaacaactaagagaagtcttaaactggactgatattatgcatattattaacctttaaagtggttcctatactatactccacggaaatatttcaaagtaagaaaatcccatttgtattaagatgcttatacctaagtttttgtagacaaattgtggaaagaacctaaatatctaacaaatgggaaatattgaatgtagcagaatattacatggccattaaaaataactatatgggccgggtgcggtggctcatgcttgtaatcccagcactttgggaagccgaggtgggtggatcacaaggtcaggagttgagaccagcctggccaacaccgtgaaaccccgtctgtactaaaaatacaaaaattagttgggtgtggtggtgggcacctgtaatcccagctacttgggaggctgaggcaggagaatcgcttgaacctgggaggcagaggttgcagtgagccaagatcgcgccactgcactccagccagggcgacagagctagactctttctcaaaaataaataaataaaaataaacaacaacaacaacaagtaagtatatggggctgggtgcggtggctcacacctgtaatcccagcactctgggaggccgaggacagatcacctgaggtcaggagtttgagaccagcccgaccaacatggagaaaccccgtcgctactaaaaatacaaaattagccgggcgtgatggcgcatgcctgtaatctcagctactcgggaggctgaggcaggagaatcgcttgaacccaggaggcggaggttgcggtgagccgagatctcgccattgcactccagcctgggcaacaggagcaaaactccgtctcataaacaaacaaacaaaaaactatatggactatgctagtatgggaaagtcatcagaaaataatttagtgtaaatagagaacacaaatgtatattaaatacagtttatgtaaaaatcatttccacaataaagaagggcctaaaatagtcatggtcttattatagttcttgtaataggtgttcctctgtaaaagtacttggtgggttttattaactccgaatttaaagttcattatataatatttatatctgagttatttaccttggggttttccagcttgtagtacattactgatgtcacaataagcatatgacatcaaaaaatatatataagggactttttgcaaaacctttgttgggtaagagctaatttccacagtaaaaacagacaccaaagttaaaacaactagaacgctttgattcaagaagctagttaaaagctaataaaattcaatacatggttttcaaggtagtttatttgacctagtttcgtccaatgtctgaacagatcagatttcagcaataaaattaccttactttcagggaactgatgaatacttgcaaaacagtgcccttctaagcagctatattaatatattctattttctcgacccggtcccacctccacctgtagcatgacttgaagaaccgtgaacaagaaattagacaggtttatatcctaagagtaggctcgtttacattagatggttttcaggactgtcagggcagaaatggggtaagggtgtctctttcccaaccatagatgggtagaagaaagtgtacaggctgatggtgcagaaccctcttacctccagtttctgtaattcccacacgcataggggaaccgcaaccactattgacaccaggtagatgaccgctactaaaggtcgaatccactgtctccagttcctccaggtacaagtgcaaggcatgttttcgcacaaatcagatccggttagcaagggaaaagatctcgaaaagattgtaatggggagccctgttctctggctgttttgtcaactcgcatactacggagaaaaagctgtcgggcgactttacgaacagctcgagccgcctcctggaccggcgctgtgtcttctgctgctgctgcttctgcaaatgtagcctctcagggtgctattggcgagcagtgcaggcaacatcctttcttctccaccccgcatctacccggttgtactgcggtggaatcccaggcagagccgctgccctcacctggggatcgccctgagctctgcctgtaccatggcttccaggagagcagcacagaccaggaaccggcctctagggaccctgcacactccggttctgtctcgcagctgcctgcccactcgctcttttctttggggatcgagcttcctacctcccgcactggcaggcgtctcttcagtcgattccgctagtaggtaaggccccaggatctcctcattctttcgcacgggacctcccctacagcggaacccaaggccaa

SEQ ID NO: 12548 - DNA, 708 bp, Homo sapiens
aggtacctatacgtgtatttttggacctatcctcattgccctgtatacctttaagcaagccagtggaactcttaagactagatttaatgactccgtatttgaacacctctaacagagaagtaaaggtaaggacaacatgcaaaatgatttcgtttgttattgtttagaataattatcttaaattaggtaatacttttatacatacttttagctactttaaagatttaaatctagtgaaatgtattttaaatttttgtatttaaaagtaactaaaaagagacttatctaagtctactctatgcactctgatattttcctaatttctttattttcataggtatacgtttgtaaatctggaagactgactgctattccattttggtatcatatgtaccttgatgaagagattaggttggatacttcaagtgaagcctcccactggaaacaagctgcagttgttttagataatcccatccaggttgaaatgggagaggaacttgtactcagcattcagcatcacaaaagcaatgtcagcatcacagtaaagcaatgaagagcagttttccaatgaaaactgtgtaaatagagcatcaacaagtacaaaattcttgtcttaattagtgggggtatataaaaattccttgtaatggtcaaatattttttaaaattgacattaataaagcatattttaaaagattctaaataaaa

SEQ ID NO: 12549 - DNA, 270 bp, Homo sapiens
tttgggaggcggaggtgggcggatcatgaggtcaggaaatcgagactatcctggctaacacagtgaaactccgtctctaccaaaaatacaaaaaattagccagttgtggtggcgggagcctgtagtcccaggtactcaggaggctgaggcaggagaatggcgtgaacccgggaggcggagcttgcagtgagccgagatcaagccactgcactccagcctgggcgacagagcgagactctgtctcaaaaaataaataaataaataaataaa

SEQ ID NO: 12550 - DNA, 1069 bp, Homo sapiens
ctggcatgccaaaaactaacagaaacttagttgaaggcaaagagagcaaggagaacgtttaatacttcattacatcaaatcaacactgctccatggtgagagcacagcaactcatttatatatatatatataggctttgttgatgaaaaactacaattgaagagaggacgttgagtggattcctgggtacagcttttgtaaaaatgtcaccatggctttcatccaatggaatgagtcgatgttttttaatgctataaaatgttagaatgtgccatcagctaatgccaggcttacgtatttctagaccataaagcagtttttcacaaattcatctttacagaaaaccagcatctagcttagcatctttccccttttaatttgtaggcttttaaaggcaaatcattcccaccatcacttaacgccgggattatacacattctagaaatgattctgagaggagtgtatagtatggtgcctatctacactcacatgatattcttattcacgttttttttaaccataagtggcaaatattttaaaatatttgaaaaacactccagaatctagtacgctttatttttagactgaacctaaagtaggttgttcttttaacaaagggtttaattcgggtggggaatataacatcatcaaaatacatgaacaaatggaaagttacttctagaaaagcaaagaaattgggtatcatttttgtttcttgggaagctaattttgttgaatgtttagaattgagcaaagatgtaaatttttgaagggcagtttagaaaaattaactttgtgaatgaacttaagatgtctgtactctatatgtgatgctgtgcagtttgtttttatatggaaagatgtcaactatagccataaccaataaaataaaaactgatgaggcatgcagctttcagcacatcttttatacatgaagaaattaattttgtgttgctatggtgttgaaatatccaagatgttctgtatctatgtaaacatgattcctttaataaattgtattttattattaagcctttttttccttttaatataatcataagttgctatt

SEQ ID NO: 12551 - DNA, 1700 bp, Homo sapiens
ttttaattggccagaagattctgcaaatcccaaatctatctttattatttatcgtaaaaaagtttccttagaagtcataaaatattttgaaatttagagaggaattcatgattaaagattcctaaaaatataattctgatttatgtaagctgtccctgaaaatagaaatgtgtacttagctgagagaaaattcagcatctcaggaggtggtattaggatgactgtgttaacccattaccttttagaagccaactgttggccccttaccatgctggactgctataggcccagcttccccttgttctgtggcccttttcttcctccttgaagctcccagtattctttttcttttcccctctaaacctgtttctgagagtggatctcaagcaagttcatgccttcaatcagatgttacttagggtgggtatacctaaattataaaccttatgtacaagtcagtaagccttagggaaggtgagtgtgggtccttcctaatccctctgacgtcatgtcatataggtggctgcctccttagactgacctttgggagaaaaaaaccccagactttgaattagtaacagctctaagatggtcatgcagtgagataggaaatcaagatggaagcagagaatctggcatgccaaaaactaacagaaacttagttgaaggcaaagagagcaaggagaacgtttaatacttcattacatcaaatcaacactgctccatggtgagagcacagcaactcatttatatatatatatataggctttgttgatgaaaaacgacaattgaagagaggacgttgagtggattcctgggtacagcttttgtaaaaatgtcaccatggctttcatccaatggaatgagtcgatgttttttaatgctataaaatgttagaatgtgccatcagctaatgccaggcttacgtatttctagaccataaagcagtttttcacaaattcatctttacagaaaaccagcatctagcttagcatctttccccttttaatttgtaggcttttaaaggcaaatcattcccaccatcacttaacgccgggattatacacattctagaaatgattctgagaggagtgtatagtatggtgcctatctacactcacatgatattcttattcacgttttttttaaccataagtggcaaatattttaaaatatttgaaaaacactccagaatctagtacgctttatttttagactgaacctaaagtaggttgttcttttaacaaagggtttaattcgggtggggaatataacatatcaaaatacatgaacaaatggaaagttacttctagaaaagcaaagaaattgggtatcatttttgtttcttgggaagctaattttgttgaatgtttagaattgagcaaagatgtaaatttttgaagggcagtttagaaaaattaactttgtgaatgaacttaagatgtctgtactctatatgtgatgctgtgcagtttgtttttatatggaaagatgtcaactatagccataaccaataaaataaaaactgatgaggcatgcagctttcagcacatcttttatacatgaagaaattaattttgtgttgctatggtgttgaaatatccaagatgttctgtatctatgtaaacatgattcctttaataaattgtattttattattaagcctttttttccttttaatataatcataagttgctatt

SEQ ID NO: 12552 - DNA, 2302 bp, Homo sapiens
cattttctcattgcctgaagatctctgctgatgctcctggagaatgactttgggggctttagaaagaatattgccagtccgtctcggcaaggagatgatgggagcgctttatatggaggctttacatgacttgtaaattaaatgtgaatgagggcagttgattaaaattggtattacagaagggccctgctgaggtttgaaaacagctgagctgctgatgtctcaggcctttccctgaattagcactgcggttctccaggatatcagcaaagagggcaagtaatagaagcccctgataaggagcgtcagccgacaggcaagcttgggaggctgtgggaatgggtctgcccccagcttcacagacctcttcctccagcctctgaatcccattagccacagcctagaacattagctgagctgcacaagctcacccacccctgtgccagggggccctgacctccctccatgccatgtttttggctgtatctacggcacttaacaataggggctttttattttcattacagagatattttgaaaaatttaaaagacatgaactcacataaacagttatggatgatagttaaaagagaaacgggtggaggtggatgagaggttgtcttcatgaatataattacttgagatttttttttcttaatggaattagtttattagaaaatgtctgtgttaaatccgtagaaaaggaagaaaagtgtagcaacaaaaatgtagccattatctaacttgccataaatatttgcagttatgataccttggaatgttgccacgatatggattgctttgattaaaagatgtcagttgaataaaacagtactgtgggagaatcgctttctgctgctagataaatgctgatgtttatttttaaaccaggaaacattgatcctgtaacaatgcccgattacaattgctttattacaccccagggctgatggagatgtaatcacttggctaatggatgtgggtgcaggacagatgctcgcttgctggcctgctttcctgcttgcattctgatgagctgcaggagtgcgcctggccttctgcaggtggagctgctgtcagagcttcgtttcactgatacccaaagccatgtctgactgaaataaaacaggttccctttttttttccctttggaaaatgccaactaagggagactaatcagatatcttaacacaatttcatccaggcttagtgctaacaagattgcggggctttttagggtttaagaagatgagaaatgagtgtgcacgtttcacacgttgacttgccggtttttccatgtcatacaaaaaagtcctggctgtttctccgaactggctgcctgcattcccgtctttcttttgtttttaagaaatagactgaattcagctgttaatcctctagtacagtatccatgttaaaatgtttttccattgcatcttttatgtgaattcaaaggtcagaatttattgtctgtgatattgagaccatgtgtacaagaactactttttgcttttcatcattcactccttagcaaacgtttcgtaagtaccctctgtctgtttgctactatatgaggtgctgcgaaattagtgggcgtggctttttatatttttcattcgtgtgtagcctaagtaaggtgactcaagatgatacaccgagagaaaaatgcaaaatatatttggttctcatttctgttgctgtcgtttcctttttaaagacgatttatcaactgctgccatttggaacttcctataagaaactaaaaatgatctatttcagtgttcctttcgcctttcctctgctttctgaataaatggtttcagtaacccatgctgttctctccctattctacgtctttctccctatgttgaaaaaagattcccacagtttctgatgtgtgtgtttatagtcttcaatgtatgttaacatgttaggaactgagtatcttaagagatgtcttagaatgctttagttttcataatttgtcctttatgtatttttcattgtatttgctgttttgacatggaagtaatttaaaaagttggtgcaggaaaggactctttactgttgcacattttggttttctgatatgtaataaattcatggcttggcagctgacatgatgtttcccagagagaaggagatgtatttctgcagggtccagaccaaaagagccatttacagcatgttctcccatgttccattatcagcctgatgaaacctgccctgccaaggcataaacttttgtactagctgtctccatattatgttcaataaattctgtgctctgaatatatttaaa

SEQ ID NO: 12553 - DNA, 530 bp, Homo sapiens
gtagatatgaggtctctctgtgttgcccaggctggtctcgaactcctgggctcaagccatcctcctgtctcagccttctagagtgctgggattacaggcgtgagccactgcacccaaccatgtgttttctaatacacatgcaacagcacacactaactgctctgttgtgcatgttcctttttggactttgaagtttatcttggagatatttcatgccagcccacatcattctttatggctgcataattttcctctgtatgtgcccttaatttacttaaccagccctctatggaggtacgtttaagcagtttctagtctcactgctaaagacaacgctacaacaaacactcctacaaatgagcaggaatatcacagaatcaatttgtagaggagcagtggttggctcaaagggtgcctgcattttaaattgtgttagatggcttccacattgccatccaaagaggaggtaccaattcatagtcctcgcagggtctgctgctttacgctttgccagcaccttgcgccatcta

SEQ ID NO: 12554 - DNA, 7786 bp, Homo sapiens
cacacttactctgtacaagacagaaattttcattggtttctaatgcttaaaaaataagtactatgcattttattctctgtaagtaaaaattcacttagcctgagctgagtgttctatgaaacagcatcttcatgatgacctacaggaatattttggttctgaagttttcacaaggctacttctgaggaacaatcacaaaaggcctgaagaaggttcccaccttcccaagtcactttcctcaccaacgagaacactgtagctaatgacaaggcgtgtgtgtctaagggcagggcgtgtactgacttacgcagaatctggttcatacttcagcacgatgcttccctttgctggaaaagaaacagacacacatttgccaggttttccaggtagtggatgcatgcgctgagcacatttctgcacctagtgatgtgttaagtattctgaagaaagaaaacaacaaataatctacattcttggcttcaaggatctagatggtgaaaagaggccgtctggatacatgaaccaagtccaaatgacgcagtagggacgatctggaagaggacccaggcaaaagccattcagggacttcaagggatgtcacctgacaatccactctgagaagcaaggaggctggggattaactgctggttaattcttcaaaattcaaaattaaataaactataacaccaactcccagaatggcatgaaatacataaaaattgtctaaaacaatactgcaatcatctaagtgcaggattaaaagaaaaccagtataaacaggtcctttatcctttacaagaatctctactttaaattgtggttcttgcctggagacggcagtgggagacagactccacagagcatgttttatatcccaaaggaaccacacgagtaagttttaaacgcaagtaagaaacgtaactgcaagaagtgattcacgtacttttgatcaaattgagccaaaaatattaaacagcaagttatttaaaaaaataaacaagaatgaagacaacagaaagaaaattagaacagcttggagaaatgatttttatgcttaggggaaaacgtcactggagtgatctgaagtggaagttgatgaaatataaaagcagcaatatgaccaataatctactccagctggctagcagaaaagtcagaactgctggcaagactcttattttgctctaacacaggtgattaaaatctgcatgttagccagtctcgtgaggctgtgtaccttaaaaaacaaatttactggctgggcgcggtggcccacgcctgtaatcccagcactttgggaggctgagacaggcagatcacaaggtcaggagattgagaccatcctggctaacacggtgaaaccccgtctctactaaaaatacaaaaaattagctgggcatggtggcgggtgcttgtagtcccagctacttgggaggctggggcaggagaatggctgaacctgggaggcggagcttgcagtgagccgagatcgtgccactgtactccagcctgggtgacagagcgagactctgtctcaaaacaaaaaaagaaaaaaacaaatttgctcatgcacagagacctgcttccacccacccccgacctgctgacaggcaagtgggtcaagagctctggctgggaggcttgccagggctgctcacaggctgacccctcctctccccggactctctggcccagcaaggtgagcaaaggccagccctgcacgccacacagacacaccacaggctgctgggcagcagcagggcaccaccagagcctggggaagtacaccaaccccaagatgcctttgacccttagcattctgaactgtcaatcagggatctacagaaccctctggaaattgatgtagccataaataaactgaaaactatgattgataaatatgccccaacgcacaccacctgcatttttgctggccttataaagggaatacaagttatgtctctatgcatttccaactactcacccaggtcctttgcttgactgtaggtctcactgctgagttttctaaaaaagggattttcctgggtcaacagtatcttaacatcttccattgatacagtaataattcttgagttaataaatggatacaatgtatatattccctgtgtgaataaagagaatgagagaacagataccatgatgtcattcatgaacgacaacagcctgctctcaggggctatgctcttagcggctatggtggtcgagccctcactatggcccctccccttggacaggtgtggaacccacccccccctaggaggggaaaccagcactctgggagagctctataacctgtgagggtcaagtggctggtaggtgccagccaagccctgagccactcagaccatctggctgaccagcaagcccatctactcccgactgcttcagtcatctgtggctactgctgttcaaatccacttccaaaattacctcctgtgccagccggaaagcacagtcaaactcttcaccgctgttatttctacaccagactttgatccccgtgttaataacctgtaagtaaaaaaataagatgaaacacagagagatgaagacaggaccatctcctgtaaggatgccgggccacatggagcaaccgtcacggaatgggaaaggagaggagaagcagaaacccaccgagaaaccccggttaagaacgaactgatactcacaacttgtgattacgtcgtttggaggacagtaaagcaaatgaaagaagggcccccaaatggccaaattctaagggaagtacctcaaaggacaaatcccaagggtcggggcagcagtactcgcagcctctacacctttagtaccttctctgcccaggagggcgagctgtgagaactacaccatggctcacccccctgcgggaatggggcacagaaaagacacaggccaccagattcaggactctggcaggaaccattcagccctgtgtcagtcaacagctctgaaatcaaagggcaggctcagggacccacagccaacgctacaggtggggagggcagatgtcacggtctgctccaaatgaaatctaagccgctgtgaaaagccacacgcatcccgcatcacacagcactcagcgtctgtgcggctggcaccttcatcttctcactgttattcagcagcacattccgcaactccttagaaaccatgtagagctgccttttcttcccttctgtagtccgagttaacaaattcatccttgggaatgaaggatccaaagcataaaatttcctgtacataacaacattgttgtttatccacaatgagttcaaaatctggtagactgtttctaaacatcttattctcctcctccagaattcaatccccaaaactgcagtgtggttcaagggcactgggctctgctctggactccagcttctaaacttcatccacttccacctgaaacctccacgtaacatttatttggggcacaactccatcagaaacctaaattaacaagtgcagcttctctccctcagccgctactccaatgataatgacctgataacactacttttgagactttttttttttttttgatatggagtcttgctctgtcttccaagctggagtgcagtggcgcagtctcagctcactgcaacctctgcctcccgggttgaagcggttctcctgcctcagcctgagtagctgtgattataggtgcacgccaccacacctaatttttttttgtatttttagtaaagacggggtttcaccacattggtcagactggtctcaaactcctaacctcatgatctgcctgcctcagcctccccaagtgctgggatgtgcccggctgagacttattttttaatagacttttacaaatgtatgcaaaggaccagttattaaaaaagacagtaagtgaccgccctggtaaatagattctaaaattcaatgaataagaaacagatgaatgtcagacttgtcctaaacccttttcctctatattctgtctatgtcatccctaattagccctcacccatgctgctcttcatttcttctacagaaactgaactagacaaccttggctactcgtctatatactcaattgagtaatttaggttcaggatcacaactaatttagattcataatcacagtccagttttcttttgttttttttgagacggagtctcgctctgtcgcccaggctggagtgcagcggcgcgatctcggctcactgcaagctccacctcccaggttcacgccattctcctgcctcagcctccagagtagctgggactacaggtgcccgccaccacgcccggctaattttttttgtatttttagtagagacggggtttcaccgtgtcagccaggatggtctcaatctcctgacctcgtgctccgcccgtctcggcctcccaaagtgctgggattacagccgtgagccaccgcgcccggtccagtttttttttatctatcatgttcacaaagtaaaagtttactttctccttaaattaaaagattgagtaacctctaaagtttcatcctgctctaatatgcagttaaaaaggttaaaaaaaaaaaaaagctagacagaactacatacaaaacaatggttacatgtgatcagttgtacatttgatactctatagtaaatttctttaaatgaataattaaaaaggctgaatccttactcaataggtggaaataatgggtcatcttcaggaataaatacaaatggatcttctttaaatccaaataacttcattttctttgatggaggaggactaaaaagggaatcaggatgagacaaatcaatctgtaatgtgtggtaaccttcaataccaaaagcacattcttcctttctgtcagttctgtgcaacatggaacggtttgcggcagatgttgaaaccttccggcttccacagagtccagccctcacactgcatgtgcctgataccacacatgtactgccccctcaaaccgaccaagaagtggctctgggatcccatttaatccaaaaggactgtgaagacaccagcgtattagatcaagacataaccacttttcttacccacacacgccatctttcttactgccattattctctaaatcctcagttgcatgagctatttctgtgtcaccagttcctgtgaatgacggactttccagcttagagggatctgtgggtttcccttctgtgagatctgcagggctcagctgtgtgctttctctggtctctgcagatttaccctgaagctgtcataaagaacaatttcattgacacacaaagaggagcattctttgtgctgctacgaaaagttaaaaataccacgttcacaaaatccatcagttatatttttctacagcattatatgtagagaaagacaacagaatttttttaaagtgtcattttaaatctacttgctattataaacaaaattcatggacagtttctttggagttaaagctgattctaccttaatcccacaaagagcatatacagcctgttccttagcagaggcctacaccaccagcttgttctcgtgtaaaaatgcttatcgtgcatctgctctgggtaaggcacactgaaggacacaaagtgcaccaagcacgatttctaaaatacccggcaggggcaaaaagacaagtatataaataacgagaaaggagggtatgaattgttcttgggcacctggacaaactgccacaggaactgggagaaagagagagtgccccaggcaccaaggaaacacctgccaaagaatgaacttctgaattagggccatggtataatttaaatttggctttgggaatgagcaaaatgttttacttaaagatctttaaaaaatacatgtcctttttaacattttaacaggtcacaaaattgataaaagtcgtaattcctcagtccctatgaagtaagtttaaaaattaggatatttcaacacaggcaagttcattttactcagagccacaaagctactgagcagagaagccgggagcatcccagggaacaccttttatttccatgttaatataatgtaaaaaagcaaaaaccaaaacagatgaaccccaagcctgtgagcaagtcagtgagggcacacgcccttcctgtccaacctcagcttcccccagaggggccttcttgttgagtccagctccaagggcatgttctcccatctctgttctacctcaacaacctcattctgggaccttcaaataccaaggtcagtgtgagcttccctggcctaacttctagccaagtgcttacaggcctcagcaccacaacagatcacggcatcctgaccatggagactctacctgcgttcccagtaggaccaacagcagcacaggccatgctagcactagatctgttgaactaagtgaataagaaactgacatagtaacagaaagagagaagtattcatattatttaaacgagaaaatgacaataagttgttctaaaaagtaagactatacataaggggctaattgaaaaaatgtcaaaacctttctatgtaagtattaacacgtcagaaacatcaatgtaagccctaatgcaggccaacctaaagcacgcgtctctaagacaggctcctctgtgactgcactgtgctctgcagctgggcagccacgagcctgtggtcactgaccacttaaaatgtgacaagcgcaaagtctaaaacacaagctactgaaacctagtatgaatgaatgcaaagtatctaatactttacaatataatttcttatactgattccatgaaaataacattccatcagcgttaagataccttgtgagacttttagcctcaaagtgaaatactttctaacctgacagaaaaaccctggtggcggcagaagtgcagtcgccccctttgcccgtctgaggctgtacgttccaacgttaaactgcacaaaccgtgccccagaaaaaggctggagctctttgcggaactgtttcctttttgttcctccaaagctaagcgttttttgtcctaattttcaagcatggatcttaaagaaatacagacttccagactttgattccaggccaggttctttcatcatggaaggctgatttatgaactaataaataatgctggcgtgatacaggtgagacagcacgcattacaaaggactgcgtgttaggatgagggcaacactccttcaccactgtttcctggcctgccttggaaaggaaccagcaggcagtttagatccatagcaaacaggccgggctgcatctttctagccaggtctggacaaggccgtcatcattccttgcagccaaggtgaacccgggctggcttggggtcagcagagctctgctatctgtaattggtgaaatgaaccactcacaaggaactagagcacagaaacctggggcttccaattgagagccacagagcaatctttcatgtcttttcaatttttattaaataactggatttacagtgtggcaggaatacattcccccaaacactgacttctccacttacctatcacctatgagaaatttctgctttttggaaaacttgatatttaaatgaaattccccctcattcagggtcagctctcctgctgcccacagcaagaagctcctctttcctctgtacttctactaaactccggttagtttttgtcttaaatgtacaagatcaaatgttatgtcattttggaaaaagaaaaactcacctttggctgacgtttattccacggcattgaagattttttcaccaatactgccacaaaaaaccctccagtattctgatgatggggtaatatcctaaggctaaatatatatatataa

SEQ ID NO: 12555 - DNA, 17603 bp, Homo sapiens
  misc_feature (15945)..(15946): n equals a,t,g, or c
  misc_feature (15952)..(15953): n equals a,t,g, or c
  misc_feature (15956)..(15956): n equals a,t,g, or c
  misc_feature (15959)..(15959): n equals a,t,g, or c
  misc_feature (15966)..(15967): n equals a,t,g, or c
  misc_feature (15969)..(15969): n equals a,t,g, or c
  misc_feature (15971)..(15971): n equals a,t,g, or c
  misc_feature (15973)..(15973): n equals a,t,g, or c
  misc_feature (15975)..(15976): n equals a,t,g, or c
  misc_feature (15978)..(15978): n equals a,t,g, or c
  misc_feature (15980)..(15980): n equals a,t,g, or c
  misc_feature (15982)..(15983): n equals a,t,g, or c
  misc_feature (15985)..(15985): n equals a,t,g, or c
  misc_feature (15987)..(15987): n equals a,t,g, or c
  misc_feature (15990)..(15991): n equals a,t,g, or c
  misc_feature (15993)..(15993): n equals a,t,g, or c
  misc_feature (15995)..(15996): n equals a,t,g, or c
  misc_feature (15998)..(15999): n equals a,t,g, or c
  misc_feature (16003)..(16004): n equals a,t,g, or c
  misc_feature (16006)..(16006): n equals a,t,g, or c
  misc_feature (16008)..(16009): n equals a,t,g, or c
  misc_feature (16011)..(16011): n equals a,t,g, or c
  misc_feature (16013)..(16015): n equals a,t,g, or c
  misc_feature (16017)..(16017): n equals a,t,g, or c
  misc_feature (16019)..(16020): n equals a,t,g, or c
  misc_feature (16022)..(16023): n equals a,t,g, or c
  misc_feature (16025)..(16025): n equals a,t,g, or c
  misc_feature (16027)..(16027): n equals a,t,g, or c
  misc_feature (16029)..(16030): n equals a,t,g, or c
  misc_feature (16032)..(16032): n equals a,t,g, or c
  misc_feature (16034)..(16034): n equals a,t,g, or c
  misc_feature (16036)..(16036): n equals a,t,g, or c
  misc_feature (16038)..(16038): n equals a,t,g, or c
  misc_feature (16040)..(16040): n equals a,t,g, or c
  misc_feature (16044)..(16044): n equals a,t,g, or c
  misc_feature (16047)..(16048): n equals a,t,g, or c
  misc_feature (16051)..(16051): n equals a,t,g, or c
  misc_feature (16056)..(16056): n equals a,t,g, or c
  misc_feature (16058)..(16059): n equals a,t,g, or c
  misc_feature (16082)..(16083): n equals a,t,g, or c
  misc_feature (16121)..(16121): n equals a,t,g, or c
gtatatattttatcaattttattgaaatattccaaggatcccaaccccatttaaaaataaaaattgtaaagcactccattcaataaaagcacataagtccccctcaataattagtatgacaattcacgatacagctcttactctgggagagtttattttaccctttattccaaaaggcacaaagtcatctgaggcctcagatattaaccccactgcatgttaatgacacaccactgaggtgcagctcaatgtaattattaaagcttataacacacttccccaagaatttatagattctttctataaataataatttaaaaaatactgcaccttaagaccaatacaggcttaacaaaagacctgaaatttctgcaagggcagttttgtttcttgatagaagtacaacttttgaaagtctattcccagcaaaagaaacactagacccagcttggccaaagaaacaaaataaaacaagtgatttctaacacgctaaaagagtacattttcatcagctccaaagaaagcagtcctggtcattcagaaggctcctatgatcccaccagtctgcagtcattagaaatatatgctttacaggccacaggctgctctggatttggtttcagacaccagtgaccagaagaagccagttttgcgtgtgaggggtgtgggcccccgctgccttgggcctgctcaccggggtggatggacccccgccgggtcacagcctgctgtcacgtctggactgttggcctcttctgcatctgggctgttgggctctcctgctctctgtccctcagtcacgtcattgtctggctgtccggtgctggctgcactctcatttgtgaggataaccccttccttcttcttttctcccaatacctccagccccatcatcctgagataatgaagccgttcattcttgggcacaaaagttcgaatggaggcctttccccgccatccgcataagacgatgggacactgcagagcgtctggattcctacaagtgaaagtggcttcatgtagaacattaaacattcccataactaaatcgaatgagatgtaatatgcaactgcttaaaaaagaaaaccacagaaaacccatacccacaaaacccccaaaactactgggaggacatttcatctggatccgaggggtaggttttctcaaaggacttccttcttcatgtcctgagtaaaattctcaccctcgctttcgccctgcctctttaagttcacaatggagtagaggccccaaatctacagatttcacatacactttctacatacttccttctcaaacttaacttactgtccccgccaccccgtgtcacctcaccccactaaatgagaagcgtttctccacaggctccctgcagctcacctcaagtttcctaagtggactgaagctcctgagaggctgggagactctgcccttagcagggcgtcagagcaggacccaggaccaccgggagactctgcccttagcagggctgccagagcagaacccaggaccactcatccttttgatactcagtgttagcgtgatttcttctccagggaccccacatggcagtctgagccctgctgggcacacagtgctcatttccgttcccagcatgcagtgttacccacagtcaaaaacatccctgcctctctgaacatgctccgagcctccctaccttccaggctccacctgtccagccaggaggcatcgacgccccagcagagatggacgccaccatttccaacctgcacacgccctctctcaacttatctgatttctttcatacgggactctgacctagattttaggctcctaacggccgtgtttaatcacctttccatttttcctaatgtaaagcaggggcacaaaggtggttttaagaagtgagaggaaaatataagaaattcccaactcccatcttcttaaaaaaaaaaaaccattattcctgaagttgacctgtcacctgtgtatttcaccaagtagaaacaagtgtttaaatatggaaaagtgaatccacaccttaaaatatcccaatattttctatgtgggccacatgggactgttattttaaaaaccatttctgagtctttgttcaaactctcgttaaaaacacccagaagccatcaatcactagatgctcctgcccgttcaccatccagacaccatccgcctccagcaggtccccagggtgctcatgcgctcggcctcgctgacctctccagcccatccatctgttgttccctcaccaagttcctgcccctcccacctcagcccccacctgtcctctctccacatggcagccggacagcctgaaccctgaggacatgtggcccctcggcctccctgccaacctcttacctatccctcctccttccctacttggctgggcccgccccgacccccagcttgcacctgcctcaggatctgcgctttggtggttccttcaagttagcactggatccctggtccaacactaacttcccaaagaaatctgtacagtggttctacctattcactcccccaaatcccagtcagccgtggaccccattctgtttcctcctctcagaaatggtgttgcatgtcaccaagacggagctgttgcaggtgagatccgaattctgccactcgtgagctgaggagctctgggcaagccacctaactttctgtcccggcttcctcctctggcaagtgctgccaaaaccagcacctgctcccccaaggccccccacaaggatgcagcgtgaatacatgcaagcagcgtggagcagtggtcccgtggggaccgtgagtgcaagcgtgagcaaatcccatgctccggccctagcactcctgatgcagtaacatgtcagcaacacacatggctgaaccagccatgaggacaaaagaacggaacctcactcaactgtccaatcttcacacttactctgtacaagacagaaattttcattggtttctaatgcttaaaaaataagtactatgcattttattctctgtaagtaaaaattcacttagcctgagctgagtgttctatgaaacagcatcttcatgatgacctacaggaatattttggttctgaagttttcacaaggctacttctgaggaacaatcacaaaaggcctgaagaaggttcccaccttcccaagtcactttcctcaccaacgagaacactgtagctaatgacaaggcgtgtgtgtctaagggcagggcgtgtactgacttacgcagaatctggttcatacttcagcacgatgcttccctttgctggaaaagaaacagacacacatttgccaggttttccaggtagtggatgcatgcgctgagcacatttctgcacctagtgatgtgttaagtattctgaagaaagaaaacaacaaataatctacattcttggcttcaaggatctagatggtgaaaagaggccgtctggatacatgaaccaagtccaaatgacgcagtagggacgatctggaagaggacccaggcaaaagccattcagggacttcaagggatgtcacctgacaatccactctgagaagcaaggaggctggggattaactgctggttaattcttcaaaattcaaaattaaataaactataacaccaactcccagaatggcatgaaatacataaaaattgtctaaaacaatactgcaatcatctaagtgcaggattaaaagaaaaccagtataaacaggtcctttatcctttacaagaatctctactttaaattgtggttcttgcctggagacggcagtgggagacagactccacagagcatgttttatatcccaaaggaaccacacgagtaagttttaaacgcaagtaagaaacgtaactgcaagaagtgattcacgtacttttgatcaaattgagccaaaaatattaaacagcaagttatttaaaaaaataaacaagaatgaagacaacagaaagaaaattagaacagcttggagaaatgatttttatgcttaggggaaaacgtcactggagtgatctgaagtggaagttgatgaaatataaaagcagcaatatgaccaataatctactccagctggctagcagaaaagtcagaactgctggcaagactcttattttgctctaacacaggtgattaaaatctgcatgttagccagtctcgtgaggctgtgtaccttaaaaaacaaatttactggctgggcgcggtggcccacgcctgtaatcccagcactttgggaggctgagacaggcagatcacaaggtcaggagattgagaccatcctggctaacacggtgaaaccccgtctctactaaaaatacaaaaaattagctgggcgtggtggcgggtgcttgtagtcccagctacttgggaggctggggcaggagaatggctgaacctgggaggcggagcttgcagtgagccgagatcgtgccactgtactccagcctgggtgacagagcgagactctgtctcaaaacaaaaaaagaaaaaaacaaatttgctcatgcacagagacctgcttccacccacccccgacctgctgacaggcaagtgggtcaagagctctggctgggaggcttgccagggctgctcacaggctgacccctcctctccccggactctctggcccagcaaggtgagcaaaggccagccctgcacgccacacagacacaccacaggctgctgggcagcagcagggcaccaccagagcctggggaagtacaccaaccccaagatgcctttgacccttagcattctgaactgtcaatcagggatctacagaaccctctggaaattgatgtagccataaataaactgaaaactatgattgataaatatgccccaacgcacaccacctgcatttttgctggccttataaagggaatacaagttatgtctctatgcatttccaactactcacccaggtcctttgcttgactgtaggtctcactgctgagttttctaaaaaagggattttcctgggtcaacagtatcttaacatcttccattgatacagtaataattcttgagttaataaatggatacaatgtatatattccctgtgtgaataaagagaatgagagaacagataccatgatgtcattcatgaacgacaacagcctgctctcaggggctatgctcttagcggctatggtggtcgagccctcactatggcccctccccttggacaggtgtggaacccacccccccctaggaggggaaaccagcactctgggagagctctataacctgtgagggtcaagtggctggtaggtgccagccaagccctgagccactcagaccatctggctgaccagcaagcccatctactcccgactgcttcagtcatctgtggctactgctgttcaaatccacttccaaaattacctcctgtgccagccggaaagcacagtcaaactcttcaccgctgttatttctacaccagactttgatccccgtgttaataacctgtaagtaaaaaaataagatgaaacacagagagatgaagacaggaccatctcctgtaaggatgccgggccacatggagcaaccgtcacggaatgggaaaggagaggagaagcagaaacccaccgagaaaccccggttaagaacgaactgatactcacaacttgtgattacgtcgtttggaggacagtaaagcaaatgaaagaagggcccccaaatggccaaattctaagggaagtacctcaaaggacaaatcccaagggtcggggcagcagtactcgcagcctctacacctttagtaccttctctgcccaggagggcgagctgtgagaactacaccatggctcacccccctgcgggaatggggcacagaaaagacacaggccaccagattcaggactctggcaggaaccattcagccctgtgtcagtcaacagctctgaaatcaaagggcaggctcagggacccacagccagcgctacaggtggggagggcagatgtcacggtctgctccaaatgaaatctaagccgctgtgaaaagccacacgcatcccgcatcacacagcactcagcgtctgtgcggctggcaccttcatcttctcactgttattcagcagcacattccgcaactccttagaaaccatgtagagctgccttttcttcccttctgtagtccgagttaacaaattcatccttgggaatgaaggatccaaagcataaaatttcctgtacataacaacattgttgtttatccacaatgagttcaaaatctggtagactgtttctaaacatcttattctcctcctccagaattcaatccccaaaactgcagtgtggttcaagggcactgggctctgctctggactccagcttctaaacttcatccacttccacctgaaacctccacgtaacatttatttggggcacaactccatcagaaacctaaattaacaagtgcagcttctctccctcagccgctactccaatgataatgacctgataacactacttttgagactttttttttttttttgatatggagtcttgctctgtcttccaagctggagtgcagtggcgcagtctcagctcactgcaacctctgcctcccgggttgaagcggttctcctgcctcagcctgagtagctgtgattataggtgcacgccaccacacctaatttttttttgtatttttagtaaagacggggtttcaccacattggtcagactggtctcaaactcctaacctcatgatctgcctgcctcagcctccccaagtgctgggatgtgcccggctgagacttattttttaatagacttttacaaatgtatgcaaaggaccagttattaaaaaagacagtaagtgaccgccctggtaaatagattctaaaattcaatgaataagaaacagatgaatgtcagacttgtcctaaacccttttcctctatattctgtctatgtcatccctaattagccctcacccatgctgctcttcatttcttctacagaaactgaactagacaaccttggctactcgtctatatactcaattgagtaatttaggttcaggatcacaactaatttagattcataatcacagtccagttttcttttgttttttttgagacggagtctcgctctgtcgcccaggctggagtgcagcggcgcgatctcggctcactgcaagctccacctcccaggttcacgccattctcctgcctcagcctccagagtagctgggactacaggtgcccgccaccacgcccggctaattttttttgtatttttagtagagacggggtttcaccgtgtcagccaggatggtctcaatctcctgacctcgtgctccgcccgtctcggcctcccaaagtgctgggattacagccgtgagccaccgcgcccggtccagtttttttttatctatcatgttcacaaagtaaaagtttactttctccttaaattaaaagattgagtaacctctaaagtttcatcctgctctaatatgcagttaaaaaggttaaaaaaaaaaaaaaagctagacagaactacatacaaaacaatggttacatgtgatcagttgtacatttgatactctatagtaaatttctttaaatgaataattaaaaaggctgaatccttactcaataggtggaaataatgggtcatcttcaggaataaatacaaatggatcttctttaaatccaaataacttcattttctttgatggaggaggactaaaaagggaatcaggatgagacaaatcaatctgtaatgtgtggtaaccttcaataccaaaagcacattcttcctttctgtcagttctgtgcaacatggaacggtttgcggcagatgttgaaaccttccggcttccacagagtccagccctcacactgcatgtgcctgataccacacatgtactgccccctcaaaccgaccaagaagtggctctgggatcccatttaatccaaaaggactgtgaagacaccagcgtattagatcaagacataaccacttttcttacccacacacgccatctttcttactgccattattctctaaatcctcagttgcatgagctatttctgtgtcaccagttcctgtgaatgacggactttccagcttagagggatctgtgggtttcccttctgtgagatctgcagggctcagctgtgtgctttctctggtctctgcagatttaccctgaagctgtcataaagaacaatttcattgacacacaaagaggagcattctttgtgctgctacgaaaagttaaaaataccacgttcacaaaatccatcagttatatttttctacagcattatatgtagagaaagacaacagaatttttttaaagtgtcattttaaatctacttgctattataaacaaaattcatggacagtttctttggagttaaagctgattctaccttaatcccacaaagagcatatacagcctgttccttagcagaggcctacaccaccagcttgttctcgtgtaaaaatgcttatcgtgcatctgctctgggtaaggcacactgaaggacacaaagtgcaccaagcacgatttctaaaatacccggcaggggcaaaaagacaagtatataaataacgagaaaggagggtatgaattgttcttgggcacctggacaaactgccacaggaactgggagaaagagagagtgccccaggcaccaaggaaacacctgccaaagaatgaacttctgaattagggccatggtataatttaaatttggctttgggaatgagcaaaatgttttacttaaagatctttaaaaaatacatgtcctttttaacattttaacaggtcacaaaattgataaaagtcgtaattcctcagtccctatgaagtaagtttaaaaattaggatatttcaacacaggcaagttcattttactcagagccacaaagctactgagcagagaagccgggagcatcccagggaacaccttttatttccatgttaatataatgtaaaaaagcaaaaaccaaaacagatgaaccccaagcctgtgagcaagtcagtgagggcacacgcccttcctgtccaacctcagcttcccccagaggggccttcttgttgagtccagctccaagggcatgttctcccatctctgttctacctcaacaacctcattctgggaccttcaaataccaaggtcagtgtgagcttccctggcctaacttctagccaagtgcttacaggcctcagcaccacaacagaacacggcatcctgaccatggagactctacctgcgttcccagtaggaccaacagcagcacaggccatgctagcactagatctgttgaactaagtgaataagaaactgacatagtaacagaaagagagaagtattcatattatttaaacgagaaaatgacaataagttgttctaaaaagtaagactatacataaggggctaattgaaaaaatgtcaaaacctttctatgtaagtattaacacgtcagaaacatcaatgtaagccctaatgcaggccaacctaaagcacgcgtctctaagacaggctcctctgtgactgcactgtgctctgcagctgggcagccacaagcctgtggtcactgaccacttaaaatgtgacaagcgcaaagtctaaaacacaagctactgaaacctagtatgaatgaatgcaaagtatctaatactttacaatataatttcttatactgattccatgaaaataacattccatcagcgttaagataccttgtgagacttttagcctcaaagtgaaatactttctaacctgacagaaaaaccctggtggcggcagaagtgcagtcgccccctttgcccgtctgaggctgtacgttccaacgttaaactgcacaaaccgtgccccagaaaaaggctggagctctttgcggaactgtttcctttttgttcctccaaagctaagcgttttttgtcctaattttcaagcatggatcttaaagaaatacagacttccagactttgattccaggccaggttctttcatcatggaaggctgatttatgaactaataaataatgctggcgtgatacaggtgagacagcacgcattacaaaggactgcgtgttaggatgagggcaacactccttcaccactgtttcctggcctgccttggaaaggaaccagcaggcagtttagatccatagcaaacaggccgggctgcatctttctagccaggtctggacaaggccgtcatcattccttgcagccaaggtgaacccgggctggcttggggtcagcagagctctgctatctgtaattggtgaaatgaaccactcacaaggaactagagcacagaaacctggggcttccaattgagagccacagagcaatctttcatgtcttttcaatttttattaaataactggatttacagtgtggcaggaatacattcccccaaacactgacttctccacttacctatcacctatgagaaatttctgctttttggaaaacttgatatttaaatgaaattccccctcattcagggtcagctctcctgctgcccacagcaagaagctcctctttcctctgtacttctactaaactccggttagtttttgtcttaaatgtacaagatcaaatgttatgtcattttggaaaaagaaaaactcacctttggctgacgtttattccacggcattgaagattttttcaccaatactgccacaaaaaaccctccagtattctgatgatggggtaatatcctaaggctaaatatatatatataattcacacctctgaactaatcaaaaatgcattcttttactattaagacaaataccgcaaagatgatacaagagaaaaatcatgtcttcgaccctcactcatagaatggccaatatgtaaacttaaattttttttttttttttgagtcaaggtctggatctgttgcctaggctggagtgcagtggtgtgatctcaacccactgtagcctccgcctcctgggctcaggagatcctcctgcctcagcctcccaaggagctgggactacaggcatgcaacacactgcctggccagtttttgtatttttctttttttttttctgtagagatggggtcttgccatgtcgtccaggctggtctcaaacttttgagctcaagtgatccatcagccttggcctcccaaagtgctggggattacaggattgggccactgcacctggcccactttgtaatctttaaaaagttcatgacggctgggcacagtggctcatgcctgtaatcccagcactttgggaggccgaggtgggcagataacctgaggttgggagttcaacaccagcctggccaacgtggtgaaaccctgtctctactaataaaaatacaaaaattagccaggcatgcacctgtaatcccagctacttgggaggctgaggcacgagaattgcttgaacccaggaggcagaggttgcagtgagccgagatcgagctactacactccagcctggatgacagagtgagactctctctcaaaaaaaaaaaaaaaaagttcatgaagtaccctaagcattaccatttagattctagccaatttcactattaataaatgctcaatgccagcaacaggcacaagagccatactggctgggaagttcacacacatggggttgaccctggcataacccaagcctcacagcaatgtcacctgctgcctccaactcaccccaacaagactcaccagctcaccagggatggggcttaaccttcccccctccccacacctggaggccccaccagctcaccatcgctccaggtgcatggcctgcagcttttctgggtccttcggagggaacatggtaggtcggatctgggtgtgtctgctgtgaggaacagcgtcccagtctgtaaaccactgcccatctttcgtcattacctgcagaaccacagggtacattccagattactagcactatccaataccaacaaaaatcacagggcaggagtatccattctctcaaaggtgacaaatggtgattctcattcactccaaagataggaagattatttgccaagacaaaacaaaacaatctttacagaaaatccccaaattattaatacataaattctgttaaaaacaaagatgaaatacatttattctaaaaaccaggacaagcattataaaataacattttccatctagtttttttctttttaaacaagcctcaggctgtttctggcctaaaattgtaatgaattacttcatattggaaacaaggcttgaatcccggcccaatttaaaaaaaaaaaaaaaaagcaaagctacccttacagggatgagagtaaaagagtttatttctgtacgtggagaaaaaaaaacttttccactgccaggaataaacatgccacttgtcatgaaatgtgtcatgaaataacactccgaaattgattctaattggcataaccagatgtagtatttattcaagttactcacacgtgaatgctttgaaacttgactctacttcagtgatgctgcacctactctttagaatgaaagttctcgaggaaaggttaccttccactgtgtgattccaggcatccacttcagccctggcagttcattagacacatcagcaagctccaaagcacctgtgcagcaaaagcatggacgtcttttgtttttcaaaaaagtattaacacactatgctcagtgaaaaaaaccagacacagatcacatattatatgattccatgtacagaaaatgtccagggaaggcaaacccgtcgacagaaagtggatgagtggccgacggggtggatgagtggccgatggggctcagctggaatggggagcaagtgctgttgggcaggaaaggtctgctagggtgacgggaacggcctaaagctggactgtggtaaggcgctgccaactgagtaaacttactaaaaatcactgaaccgtacacttaaaatgagcaaacattaacaatatgtaaacgacagctcaataaagttgttccaatgacagggcattgaggagtcctgccacagacgcgagactaactccgcaagaagacaaccagaaggctgggctgcaggacgcctgctccgtctccccattccaatgcacaccagggcgatgctgcaggtcttcacgcaggcatgtctaacaaacatcccagagcaatgctgaaaatgaactatgggaatttttaaacctcaagttcgtggtcccaggaagtttcctaaaattgcccatcgggacacagtcagcccagttttaaaaacaatgcgataagagctgtgaaaacacactggccttaagtgtccataccagtgacacaataagaagctataaggtgaggccattacaggaaaccagtgagaccagctactagcacagatactgatgtgacagcctctcagcagaggaaaattcaacaaatctcccagaaaacatgaaaatgggacaattacaaaaacaaaggaaaagaatctccaaggtggaggaatggcagtaagaaacctttgaagcaagcatcgtactgacttctgccatcatttctgaatcctcttccttttaaaagctaacagtaaatgacagtgcaggcaaacatgcgggcttctccatcaaacactgtccaggggcttcacagatgagcagggcaggcagcaggtgttatctccacaccccagcacctgggttggaagctgccaatgctaccccatgttgccccttctccagtaaagttgttgagcactttcaggtggggaacgcacaccccctccagtcaaaatcaccagcaaccacccactctaaggctcagccaaggtctgctccttcctgcataaagccatatccatgcacaccgcctctgacagagaaaagggaggaagcatctacaatacggtctgaagccacccacatgcaaaaagttggctgtgacatcatactgtacacaggtccatgctggaaacccacctgtccagtaagaaaatgactacagaataggagactcactgaatgaagtaattcatttttgacacttgctaacaggaaaaactactatgacatattggaatgttaggtgaaaaagcagggtatttaagatatacacaacacaatcaaaactattcaacacagtgaagactagaggaaaagttgcaaaaagcaatgcagttacttgaaggaaaagaatccatgtactttttttctaaatatgaatgcccttatacttaaaacccactggccaaacggtgctggctgttctttgaaatctcctatgtggaggcagaagccagcccctgaccaagaactccctccatccccaaggtatctcccctggcatctcagaaagctaaaatgattccaaaatttgaataaagaacctgagcatactgtctcctttcttgtcttgcagtgaagcttgcccttagaacaaagctcaaatgcatgccatagtctaacaacttctgtgacctgtgacaatgaggagataagcctcatttaaaaggtaagtatctgaaagcatatcatctgctctattggtaataaaggtgcgattttggccttggtctgccttgctccattaccttgtcaattggttcagaagctggacagggaaagagggtgttatttactgggctttcaaaagaaagcctgccaggccaggcatggtggctcacacctgtaatcccagcactttgggaggccgaggtgggaagactgcctgaagtcaggagtttgagaccagcctggccaacatggtgaaaccccgtctctactaaaaatacaaaaattggctgggcgtggtggcacatgcctgtagtcccagctactcgggaggctgaggcaggagaatcacttaacccgggagatggaggttgcagtgagccgagatggcgccactgcactccagcctgggcaacagagcgagactgtctcggaaaaaaaaaaaaaaaaaaaaaaaaaaacccacaacacacacatatagacagacataaagccaactagagccacaaatttggtgaagtctgaaaagatctgcaagcgttcactcagaaaaccagcagtaacattctaaatacaagaaaaagaaccagccagccagtctgaaaatcagaaagaccaatgaaaatccacaatcaagaaaggtttcagaccggatgaagacgaacccatcagtaccccaggacaatcccacatctgctcatccctcctcacaatcctgatcaccagcattcccgttttctttttcaccctgcagctcttcctcactcccccgtgcctgggtcacgcttgctcattcttaactttcgaacatggtgcactgtgtgtgaggttctgtccactcttcccttagagatcagtgggttttcaggagaatgatggttccccactgctgctggaaagagagacccatgggaatgagaactagaacttggattcaacctgctttcagatgacaacccctcacgaagccactccttcaaacgttggcacgttcaggaaatgggtgagggtggcagaagcatccagagctccaggcaagtaacccggtctgacagcacagccagcccacagagcacacagcatgttctctgagcggggacaattttgcggtaatgagacaggcaaacagcaagtatctccaatgtgaggaaagaaagcccggtggactcaggccagcaagtcctgcctgcaaagagtgactccagccacgagtgaggacaggcttgtgtggacaagagcctctctcacctaagaactcaggagacctggcttttggtcccagccaaaagcttacaagagaaaaaggagcaaaattaaacacctagagtacttaactagccaacacagacttaggagagtagcaaatgcttaaagaatctacaaacatttgaagctaagcagcacaagatggggctgtgaccactcaccccaagtcaagaaagctgctcaccgagaaaccgggggaagctgtctttacaaaagacaaaagagcaccagccaagaatgcagtgagtgcgcnnccaggnnaanctnggggggnngncncncnnancncnncntnccnnananngnnttcnntngnnangnnntncnngnntnanannantngngncnaganctnnagngcatngnncaaattaataaatgcagtccatnntttctttctcagggatctgaaagcagactgtggcaagnggaaacaggaggtgtctgtgctgctcaagctgcctggaatcatggtttcctaaattcctagctaatgaacactaaaatctgagcaggattcaacagtcctaacaactgaccccaaatcacacttgaaggtgtaatttcattacaactaaactattatgtgccccatactccccctcacacaccttttggaataaagtatcaccaacaccatggcaattatgaccatgcaagaaaacatcacccagaaatgacatctttacagaggtctacatgagcacaggaaaataaacacaacattacattccagcttaaaggaccgtgaaggccatcaacaaccgcagggctgagggcacaacccagaccagccagccgccaaggggagcctcactggaaggacagcagcaggtgggcactgcccaggaaaggcctctctcactgactatgcaccaactgacttcacacacgtgggtgcaggaaacatgctaagtttgaaatttctcattattggctctaaggaaaatatgatgggaaaagttaacattctggcaaaacataaaaggagaaatattttatatcaatacactgtagaaatacactactgtttcagaatattctgtactatctgtcagttcctcagtataaaactgtatgaggtgacctcacacccattaggatggctactaacaacaaagagccccagataataagtgtccctgaatgtgtagagaaattggaacccttgtgcactgggggtagaaatacaaaatgacgcagccactgtgaaaaaaagcatggtggggtccccccaaaattaaacacagaattactatatgatcatatgatccagccattcaacttctgagtgtatatccaaagaatcgtaaccaggatcttggagaggtatttgtataccatgctcacagcagcatggctcacaacagccaaaaagtggaagaaacccagatgtccatcaacagatggatgggtaaacaaaatgcggtttatataaacaacagaatagtgttcagccttaataagcaatgcaattttgacacagacaacaacacaagtgagcctcaaggacgctgcagtaagttaaataagccagtcacgaaaagacaaatacagtatgattccgcttctgtgaggtctagagtagtcaaagtcatacagacaaaaaatagaacggtggtgtgaggggcagggaagagagagatgggagctactgtttaaaggagttcagagtttcagttttgcaaggtgaagatttctggagatggatggtggtggtgattaacaatgggaatatacctaacgggactgaactgcaggctcaaaaatgattaagatggtaaacctcacgttatgtgtattgtaccatacacatatgaaaagccccctatgctgttaataaaagatccatcaagcgtgcttaccttcacttttttccagtaaagatgctatgactgcttcatcctcaat

SEQ ID NO: 12556 - DNA, 579 bp, Homo sapiens
accccactaaatgagaagcatttctccacaggctccctgcagctcacctcaagtttcctaagtggactgaagctcctgagaggctgggagactctgcccttagcagggcgtcagagcaggacccaggaccaccgggagactctgcccttagcagggctgccagagcagaacccaggaccactcatccttttgatactcagtgttagcgtgatttcttctccagggaccccacatggcagtctgagccctgctgggcacacagtgctcatttccgttcccagcatgcagtgttacccacagtcaaaaacatccctgcctctctgaacatgctccgagcctccctaccttccaggctccacctgtccagccaggaggcatcgacgccccagcagagatggacgccaccatttccaacctgcacacgccctctctcaacttatctgatttctttcatacgggactctgacctagattttaggctcctaacggccgtgtttaatcacctttccatttttcctaatgtaaagcaggggcacaaaggtggttttaagaagtgagaggaaaatataagaaactccc

SEQ ID NO: 12557 - DNA, 3908 bp, Homo sapiens
gtgccacccagccaagctacgtgggcaacaggagctcttcaaaaatgtcaagcccgcagagtgcggtggctcacgcctgtaatcccagtactttgggaggccaaggtgggcggatcatgaggtcaggagatcgagaccatcctggctaacacggtgaaaccccgtctctactgaaaatacaaaaaaattagccgggcgtggtggcgggcacctgtagtcccagctactcgggaggctgaggcaggagaatggcatgaacccgggaggcagatcttgcagtgagccgagatcgcaccactgcactccagcctgggtgacagagcgagactccatctcaaaaaaaaaaaaatgtcaagccaactgtcctcagaatctaacctgtagataactatagatgaaactcacattttccttcccctggttcaccttgacagcattgcagctctggtcagccacagaatgccaggcagtggtggacaccatgatagccgtgtggtcagaagggaagggcacgggagtgagctgggaaccttggctgttggggaagttgcaaagctccagtttcctctaagtgtgcctttatgatccgcactggcgacagcaggctttgtctttccttagaaagactttgtgcctgttctcacttgaccagatatcgtgtacggagcacttgctggcagtaggccaagctctgcacattcatgaattgctttgtctcacaacaccctgagccgtaggtatctttattgaccatattttccagatgaagagacgaaagcccaagagaaccctgttaatgctcggccagatcagaggagacaaaacaagcacccctgccttcatgggttgtgtggatgaatgagggtcggcctagggctgtcccctcgcggtctgtccggtctgtcggtacaggcagcagatgggccacttgttcctggaattgcagaagcagataaccaagtgtagaaaatgtatgtatccctcttctaccccaacagaagcaccgtctttttgctttttctttttttttttagttacagatatgataggtaggtttttttctatggtgtaagcatttctgctgttggattttgtttgctgtttgaagacctgcctaactcgtctcagtaggctgtataaatcgtttaatgaagattggcccttttctgaagtgagaaaaaggatggttgctgaagaacctatctcgagaatacactattgacagactcacggtgtctgtgtgtctcacatcctggaattacttgcacaccattgtggctatgtgttatatcccagaatatggaattgattttgatgtttagaaggccaaagcttacttagtaaatgccacactgattttagcttaccattttgtagtttttttctgtgggaaataacaaaaaaattattgattgaggatctatattgattttacagagctattttagaggaagtatttctcatttaatgaacactttacattggactttccatcttaacaagacactgccccaggtggaactctgtcttcacaacacctgagctgcccagtggtgtcagattgactggtgtcagtttaaccccgttaagtttaaaggatctgtgcaccctcatctggaagcaaagctccgccttcggctgctgtggcccgcctgcccgcagagaggcttgctgggaggtccaggccgcagttcccgtccagctcctggagtcagagctgcaggatggctgttgggggtccttgaagcctgtccagatgcacttgggatgggtttttttgttttgtccagactgtttctgtagattcctaatataatgagccattataattttgacaatttgtaaagagtacttgcagaggaacctgttaaccattcaaccattaggtctttgctgtaagtgtctgtttttaattttctggcagtgcttctgagaattctgcaaagcctcaagaaaaaatagagtaagctgtcttagccaggcccctgtagctttggtcacagcacttcctggtgtgacaaggactcagaccccccgggagccccttggctatcctcagcactgtttattcctcctcaggctctgcctggcaccctaccctccctggcactctttctttgtcaggccactcgttgccaccctgagactccagctcatgtctgatttgtgcatcctacttaactgatgtgtttttcctcctctctgtgtgtgaggatgttgtcaccacctcacattggctcttgagtgtgaagtgtcttgctgcacggcagaaacagacctagagaagtcccttggtttggccagtattgtgttgctgacaggcggtggatcaagagttaaaatgtaggaagtccatgttctgtcccctttgacaagccattttcttaatctgtacaaagggaacaatgtctgcaccacgaggttggggagattttcagtgagagtggatgtgaagagtgtttcgtaaaccataaagcagtttattgtcattgatgattctcagctttgcatgaacctgagggacaccagaccacttgctctaggagcccatattctgggttctttgtcctaaactactttttgggccttttcctaaaaatacacattctaagagtcaaggtaagagtgttcctaatttggtgcatggatgagagttcatgttagttttcattgaggctggaagttaaacctgagccattttcctgtccagctgcactttgccacaggctgggcacactggctcatacctgtaatcctagcactttgggagactgaggaggattacttaagaccacgtgttcaagaccagcctaggagtatagtgaggtgccatctcttttaatttttaaaaaatagtcctagtgactcttaccaggccagtcaccatctccaggagcccccctgtgggagtatgttcagtgtctgccctttgtgaagtggggccttttgtcccgccacctacccccagggcacttaaggcctgggtgtgtttctgccggcagggacttgaaggtgtctggcagtgaaggaaggagaggatgaagggaggctggagagggagtggcgagcggccagaggcaggcggggccgtgggaagggaaagcagcacaggcaagctgagtgcacattggtgatgagatacagagatccatgattgaacttctagtgtatcttagcccactggggctgccatgacaaaacaccatagagtgtggctcatcaacagcaggagtctgttgctcacagctctggaggctggaggtccagggtcaaggcactggcagattgcatgtctggtggggccccgcttcctggtccatagccagcaccttctcactgcatccttatgtggtggaagaggcaggggagctctctggggtctcttttgtaaccccattcttgaggcttgtccactctcatgacctaatcacctcccagaggccctgcctcctaacaccattaccgtagagtgagagcttcagcctatgaattttggggggacatgaacattcaagactaatattctttcagtattccagttactgaatggtgtgtagtattcagtggagaaggtagctgaaattaaggggttaaaattgtaataatggccggttgcggtggctcacgcctgtaatcccggcactttgggaggctgaggccagtggatcacaaggtcaggagttcgagatcagcctgaccaacatggtgaaaccccgtctctactaaaaatacaaaaaattagctgggcgtggtggcacacgcctgtaatcccagctactcaagaggctgaggcaggagaatcgcttgaacctgggaggcagaggctgcactgctgagctaagatcgtgccactgcactccagcctgggcgacagagcgagactccatctcaaaaaaaaaaaaaaaggt

SEQ ID NO: 12558 - DNA, 15535 bp, Homo sapiens
gtgccacccagccaagctacgtgggcaacaggagctcttcaaaaatgtcaagcccgcagagtgcggtggctcacgcctgtaatcccagtactttgggaggccaaggtgggcggatcatgaggtcaggagatcgagaccatcctggctaacacggtgaaaccccgtctctactgaaaatacaaaaaaattagccgggcgtggtggcgggcacctgtagtcccagctactcggggaggctgaggcaggagaatggcatgaacccgggaggcagatcttgcagtgagccgagatcgcaccactgcactccagcctgggtgacagagcgagactccatctcaaaaaaaaaaaaatgtcaagccaactgtcctcagaatctaacctgtagataactatagatgaaactcacattttccttcccctggttcaccttgacagcattgcagctctggtcagccacagaatgccaggcagtggtggacaccatgatagccgtgtggtcagaagggaagggcacgggagtgagctgggaaccttggctgttggggaagttgcaaagctccagtttcctctaagtgtgcctttatgatccgcactggcgacagcaggctttgtctttccttagaaagactttgtgcctgttctcacttgaccagatatcgtgtacggagcacttgctggcagtaggccaagctctgcacattcatgaattgctttgtctcacaacaccctgagccgtaggtatctttattgaccatattttccagatgaagagacgaaagcccaagagaaccctgttaatgctcggccagatcagaggagacaaaacaagcacccctgccttcatgggttgtgtggatgaatgagggtcggcctagggctgtcccctcgcggtctgtccggtctgtcggtacaggcagcagatgggccacttgttcctggaattgcagaagcagataaccaagtgtagaaaatgtatgtatccctcttctaccccaacagaagcaccgtctttttgctttttctttttttttttagttacagatatgataggtaggtttttttctatggtgtaagcatttctgctgttggattttgtttgctgtttgaagacctgcctaactcgtctcagtaggctgtataaatcgtttaatgaagattggcccttttctgaagtgagaaaaaggatggttgctgaagaacctatctcgagaatacactattgacagactcacggtgtctgtgtgtctcacatcctggaattacttgcacaccattgtggctatgtgttatatcccagaatatggaattgattttgatgtttagaaggccaaagcttacttagtaaatgccacactgattttagcttaccattttgtagtttttttctgtgggaaataacaaaaaaattattgattgaggatctatattgattttacagagctattttagaggaagtatttctcatttaatgaacactttacattggactttccatcttaacaagacactgccccaggtggaactctgtcttcacaacacctgagctgcccagtggtgtcagattgactggtgtcagtttaaccccgttaagtttaaaggatctgtgcaccctcatctggaagcaaagctccgccttcggctgctgtggcccgcctgcccgcagagaggcttgctgggaggtccaggccgcagttcccgtccagctcctggagtcagagctgcaggatggctgttgggggtccttgaagcctgtccagatgcacttgggatgggtttttttgttttgtccagactgtttctgtagattcctaatataatgagccattataattttgaacaatttgtaaagagtacttccagaggaacctgttaaccattcaaccattaggtctttgctgtaagtgtctgtttttaattttctggcagtgcttctgagaattctgcaaagcctcaagaaaaaatagagtaagctgtcttagccaggcccctgtagctttggtcacagcacttcctggtgtgacaaggactcagaccccccgggagccccttggctatcctcagcactgtttattcctcctcaggctctgcctggcaccctaccctccctggcactctttctttgtcaggccactcgttgccaccctgagactccagctcatgtctgatttgtgcatcctacttaactgatgtgtttttcctcctctctgtgtgtgaggatgttgtcaccacctcacattggctcttgagtgtgaagtgtcttgctgcacggcagaaacagacctagagaagtcccttggtttggccagtattgtgttgctgacaggcggtggatcaagagttaaaatgtaggaagtccatgttctgtcccctttgacaagccattttcttaatctgtacaaagggaacaatgtctgcaccacgaggttggggagattttcagtgagagtggatgtgaagagtgtttcgtaaaccataaagcagtttattgtcattgatgattctcagctttgcatgaacctgagggacaccagaccacttgctctaggagcccatattctgggttctttgtcctaaactactttttgggccttttcctaaaaatacacattctaagagtcaaggtaagagtgttcctaatttggtgcatggatgagagttcatgttagttttcattgaggctggaagttaaacctgagccattttcctgtccagctgcactttgccacaggctgggcacactggctcatacctgtaatcctagcactttgggagactgaggaggattacttaagaccacgtgttcaagaccagcctaggagtatagtgaggtgccatctcttttaatttttaaaaaatagtcctagtgactcttaccaggccagtcaccatctccaggagcccccctgtgggagtatgttcagtgtctgccctttgtgaagtggggccttttgtcccgccacctacccccagggcacttaaggcctgggtgtgtttctgccggcagggacttgaaggtgtctggcagtgaaggaaggagaggatgaagggaggctggagagggagtggcgagcggccagaggcaggcggggccgtgggaagggaaagcagcacaggcaagctgagtgcacattggtgatgagatacagagatccatgattgaacttctagtgtatcttagcccactggggctgccatgacaaaacaccatagagtgtggctcatcaacagcaggagtctgttgctcacagctctggaggctggaggtccagggtcaaggcactggcagattgcatgtctggtggggccccgcttcctggtccatagccagcaccttctcactgcatccttatgtggtggaagaggcaggggagctctctggggtctcttttgtaaccccattcttgaggcttgtccactctcatgacctaatcacctcccagaggccctgcctcctaacaccattaccgtagagtgagagcttcagcctatgaattttggggggacatgaacattcaagactaatattctttcagtattccagttactgaatggtgtgtagtattcagtggagaaggtagctgaaattaaggggttaaaattgtaataatggccggttgcggtggctcacgcctgtaatcccggcactttgggaggctgaggccagtggatcacaaggtcaggagttcgagatcagcctgaccaacatggtgaaaccccgtctctactaaaaatacaaaaaattagctgggcgtggtggcacacgcctgtaatcccagctactcaagaggctgaggcaggagaatcgcttgaacctgggaggcagaggctgcactgctgagctaagatcgtgccactgcactccagcctgggcgacagagcgagactccatctcaaaaaaaaaaaaaaaggtaataattaaattggccagcatttttaaagttttccttagcagatctgtacagactcactagatagtgttttatttttaaagaagattaacacgtgctggcaggaccactgcagacaaatggtaagcttgttcactttttcatcaaaacacgacctcatccatcttccctcacccacatgattgagagctgagacatagaagttctgttgaggattctgtctgtgttcagtgctgtggttgaacagcacgatgagaaaagcagggaaggtgaactcctcagctcctgtgagagggcaccactgaccctcttggccttcaggtccacagtcacagtccgcagtggtgacagggttcttagatgcctgcatgggtctctaaatgtctctttaagcacagtttactcctcagaatctagcctgaatcccaggtctttcctgcagctgcacaaccagcgtcttaggctttgtagatgtcttggctttgacttgacgtcatgtatacatttttagtgtgacctggccgttaattacttaagtgagagaacagaccgtattaatagctttcctaagtaggttgaaatcttccgttttctaaatgatatcagtaggagacgatgggtgtatttcttttctgggccaggtagctggcagctgctagagctcgctgagggtctgttgggaagggtttggtgagatgcgttcacaagtctccccagccaggtagtgggctcgatggtaggagcacaggacaggaccagggatcatcctgcatccctcactctgctcgcaacgcagagtcagagacacacgtccaagagcctcatcatgtaacaggaactcaggttttaaaagctaagtgcatctccctaatctagtaagaagtagcacatcagtcaaaaaaatgaccaaatttaggccgggcgcggtggctcacgcctgtaatcccagctctttgggaggccgaggcgggcggatcacgaggtcaggagatcgagaccatcctggctaacacggtgaaaccacgtctctactgaaaatacaaaaaaaaaaaaaattaaccgggtggggtggtgggcgcctgtagtcccagctactcgggaggctgaggcaggagaatggtgtgaacccaggaggcggagcttgcacatcacgccaccgcactccagcctgggcgacagagcgagactccgtctcaagacaaaaaaaagaaaaatgaccaaatttaaaagatatcctttaggccttggctgaacacaggatctctttaaaaagaaaaaaaagataccattttaggctaagtgcgttaaaattcctacagtcagatttacaatattaaagagatggaaatcacataccaaggggacaaaattaactttagaaaaaaaaaataaaacatgagggctgtggtggacaggaaacagctgttggatttgagacagctagcatggagttaaaaggcctgatctttcatattttgctagtagaattcataagtaaatggttctcctttctgctggtcagatcatgatcagaagcatcttcctgttcttggaccgcacctatgtgctgcagaactccacgctgccctccatctggtgagtgtcctcacagcgcagagctgcgtcttccctgcagctgatgcttttcgtcccgtttgtgtcttccgcaggctaagatggtaaagtgtgtgtgattacttgtgccttcctttcttcagccaaaatcattaacgtgaacgtaggagtccaggtgggtcttagccttgaaacaccaggtgtctagccagcagcaaggagtggagcaggaagctcggacaggcggctgactttggtcatgagggtgaagacagagggtcttggtttctctctgacgactggaggttgagcctggagcggctctttccagcgctgcagttgaaactcggagaaagactgcctgctgcccgtggggtcgcagccctgaggctgtgcgtcccctgtggaatggcttgctcagcctcccggcctcctgagcacatagcactcatcgtccgtcatctttcggggactgtatacaccaggggttctggggcctttcctcagcagcgttcgcggccacggaccccacatgtcctctgctgacccctgtgtgtcctctgtggccaccccatggcgctgaatcctgccgcctcctgcaagccgactttggacaaaagctgtgtccggtctcaccgtctgatttgtcttgttctctgttaatgtagtgtttcattcttctcacattcatacataaaagtgatgtcgtgccttctcatgagctttaaacccaagttctttaaaatgtgcctgcttttcctaccccacccactgggcacgctgacccaaggcaatgtgatttctgctttcgccatgtagagattgctcttgtctgagatgtcggtgacctgccagttaccaaatccagcaagcatttttgtccttattttatacaacatctatacaattttggacaccctgtccttgttgaagctcccattaatgccatttgcccttctaacttcctcatggaactcccaaacatctcctagtaggcatccatgtggtctacgagaaggcaaacgctgcacagaaaagacagcctgtgttccaggaaagaatggagatgataaaagtgatcatagcagattatttagcatttgctctgtgcaagggactgtttcctactaatgtatttaatccctagagcagctctgtggcgtggccattgtcactcctattttatacaaactaaggcacataagttaaaataacttgccctacctcagttgtctggcccatagtctaaatgcttttcaaaaattattattattattattattatttttagagacagggtctcactctgttacccaggctggagtgcagtggcacaatcataactcactgcagcctcaaactcctgggctcaagtgatcttcctgcgttggcctcccctgtagctgggactataggcacgcaccaccacattcgactaacttctaaaaattttttgtagtgccaggatcttgctatgttgcccaggctggtctcgaacccctggcctcaagcgatcctcccacctcagcctcccaaagtgctggaattacaggtgtgaaccaccatgcccaacactaaactcttaatttataaacatagtttataccataactgtcatacaaactataaacattgtttataaaatagaataaatgataccacctccagtctaccacaagtggctaaaaacctgaacgtgagcatcattacaagaagaatcctggttgaggtgtgtgtgggcaatgcatggtgaggagatactttgtccatctctgggatggggaggagggctgagggtgaaccttggcctgtgctttgaagaatgagcaaaggtggtcaggcagctaagaaagaaagagtagaaggaagcagtaagttcaaagccgagtatctcctgctagtgatggctaggacggcagcatgaccagaagaagcctgtgtggggagtgggaggtggggagggatagagctgatgagggccctgaagggtttttcagctgaggttgatgttttaaagagaagatcccagtggcagggtagagagtcacacaagtggagacctaagccttcctaagcactggctacctgcctggcactgccccaagggcttcagaggcaggaactaataacatttgatccccattttaacagttcaggaaggaaaggcacagagacattaagcttctcacccagggtcacacagctagcaagtagtagggccaggattcaaacccaggcagctgcctcgagcccacaagtctggccactgcaccttcctgctccaactgtggtgaagtgcacagaagacctggtgtgcagcacacgcgggagcaacaggagaggcccatggtgatgtgggcagtcaagggaggtgcacgtctccaccattgaggtggttccaaggccctctgcacacctgtgtggcacccaccactgcggctgctgccaccactgccaccataatattattaataatactaccaccaccacccgcctaccactgttactactgccaccaccaccaccaccattactgctgccaccactacccgcccaccaccattactgtcaccactacccgcccaccaccattactgtcaccactacccgcccaccaccattactgtcaccactacccgcccaccaccattactgctgccaccactacccgcccaccaccattactgctgccaccactacccgcccaccaccattactgctgccaccactacccgcccaccaccattactgctgccaccactacccgcccaccactattactgctgccaccactacccgcccaccactattactgctgctgccaccaccagtattactgtcaccgccaccaccgctattactactgccaccaccacctgtccaccactatattactgctgccaccaccaccactattactattactgccaccaccagcaccactcctgccctgatgtgccaattccggatttctggctggagcccagcatctgtatttttggcccctccttaatggcgtacttggccactggggacagtaggagtgttgaagcaaagcacagagcccacaagatgggttttgtggacagccactggcagctgaaccatcttcctaacattcctcaggccatgagctgaggactgcgatgaactctgaaagctgtgcatcaccttctcttctcaggggaaagcagcaaacatttggtaggagagctcccagggcttggagaagggaagctgctgggacgtgctcagcagaggacactgggaagagagtgtaccctgagggctgttggagacggtggcgggaggggcaggtggggcaggcagggtcgtggtgcccaactgcctgagtgtctcccgtcgctcagcaggaaggtggcgaggaccccgggcttctgccagcagcttgtgtgataccagttttactgtcagtggcatgcatgacctagcagcgtctccaggaacgtggagcagctctgtttaaggaaggaaatacaaggcgcgctagactggctgagaaacagaagtttttaaaaggaattcttggcacctagatgtagagaattagcaacttcacatttttgggatgatattgaatagcatagctggagattcacccataacttctaaaaagcgaaactaaaatgtagtcctgtttcttactgtctatacagggatatgggattagaactgtttagaacccatattattagtgataaaatggttcagagtaaaaccattgatggaatcctactgctgatcgagcgcgagaggagcggcgaggccgtggaccggagcctgttgcggagcctcctgggcatgctgtctgacctgcaggtgagtgctgcctgtgcggaagatacctgggtacctgcccagctacttgcaccagaataaatggttgtaccaaagatgttaaacaatgaaatcataaaggcatttgttgaagataggagagtctttaaaatccctagaaggggaatagcgctcaagctaacaccacaccaggtgccacaaaagagaagatagatcaatatcactacataaaatgcacggatagatcaatatcactacataaaatgcacgtttttcatggaaaatataaacagagacaaagccagatgacacgctgggggaaaatattagcaacacacacaaaagacaaagggcgaagttctttagagcaataggaccccaaggcactataggaagagaacagaggagggcctgcccggccgttttgggaaggacagtgcagccggccggctgggtggccacaggcgcctccaagttcaggtcatggcagcctgccccgtcagaaactgggatgtgttagcacttgtgaagatagtttcctttactgaaattggtcagtaactctgcttgtttcttaggtgtataaagattcatttgaactgaaatttttggaagagactaattgcttatatgctgccgaaggccaaaggttaatgcaggaaagagaggtgagatgatgggatgtttccgaatcccctggcttcgtttctgcagatgagcacctaggaggactttcctcatgtttgccttttcacacacatgcaaatgtttcattgaaaatcttctgaaagctgcaatcttgccagaatccccagtaatgagcttcgttcttagtatactaagaatttagtttatgtgaacttagaaactattgcactccccccacaagtaaaaagctgtaagatcatttctgaaataattaaaataactcaaatttaagcaagatgataaaaacatacatgaaaacttaaaaatataaatgtaaatgataaaatttttcatttgtgtgaagcactgcaaaaaattttcccaaaaaaagctgtgcgaaaaaacatgtagtagtaataggaacccaaaaaacttaatcacctttccagataccagagcaaaatcataaaggaacctgccccatagactgtcacccaaatggtgcgtgctactgccagaatggaccttagccattggttccttcattctggctttgcagaggaagtttcatgtcagatactgagcccagctgcagctaccccagcagagcctcaggcctttcccgcactgtcttgggaaacatgggcgtactttgaggtctcctgcaaccgtgttgtttggtgtcccccaaatgaacaaccaccttgttgacttgcttttgctgacccagctgtgcggggcagggttgccatttagcacctcatcctcctaccaagtgaggctcagctccctgtgggccctggggatgggaggagggtgtgcacagaccccgaaacttggtggtgcacagggacgaaagagaagtgcagcctgggccctgttgtaggatggatgttaatatcagcgtcctttctccatgtcccccacacacatttccgtcctacctctccctccctgttaatctgtgttaatatttggcttgaatatgtattctgctttttaaaaaaattacatgtaaggaaaacaaaatctcaatttcttggatagtgtcgacattctttttgttactgatacatttaattgttttgtttgtaaggttccagaatatcttaaccatgtaagtaaacgcttagaggaagagggagacagagtaatcacttacttggaccacagcacacagtaagtaccgtttgctcgctgagcgttcgtatcttcaccatggctggaaggttctcctggctggttattgaaataaagggtgtctttgtcaattcattcagtactaagagtgtttttgcacctagcatattttactttgttatttgtcattatttggcattcacaaattacagtttttacccagtgccttgtcatgagttacgtctaaagagagtaaatcttgctgagatacttggcatctttgagttttgagacggtctatttatgttaatggagtatcactgaatattaggttattttgattgtgcattctctgttacacattttatatcgctttaattttatttatggtgctgtcacacaattttctcttttcatcttatgtttttttcctgcaaacctgaggttgatgagtagctagggaaacaaaaagggagagattatgtgagcgtgtgtgtcaggcacagtgtgtccatatgatgggaggcaaggacagaggcagaggggacagcaagggagagaaatgaaaatgatacagtgtgcagctgggcgcggtggctcaggcctgtaatcccagcactttgggaggctgaggtgggcagatcacaaagtcaggagatcgagaccatcctgaccaacatggtgaaaccccgtctctactaacaatacaaaaaaattagccgggcgtggtggcgggaacctatagtcccagctacttgggaggctgaggcaggagaatggcatgagcccgggaggcagagcttgcagtgagccgagatcacgccactgcactccagcctgggcgacagagcgagactccgtctcaaaaaaaaaaaaaaaagaaaatgatacagtgtgcagaactggacccagtagggaatgataaaatgtacagatgtgcagaacaggacttggtaggactcagcagagaaaacaggaggagagatgaaaatgatatggtgtgcagaactggactcagtaaggtgcggaaaggggaaggattctgacagaatccagcacaaaaacagagagggtgcagaaaaagagatttggtcacttagacgtgtggagttggaggagcctgtgggaaatccaggatctcgaggcaggccagggtggctcgggggccatgttgtgcttccttccaactgggagcagaagagcagcccccgggagactgggaagcagcagccagggaagtccgggggaaatagtggagagagcggcagccacagcgaagccccacaaccagggtgtgcaggtcacacacagcttccctgagccctttctgcctgtgtaggaagcagaaggcggaatgtcggctctgcccttctccgtaagatggtgcattaaaacgttccttataaactggaaatgaaggcttgggaagatggctaaaatcagcaatccttggaataacgcagaagcatccctgcttccctgggcccgcccgtgggcctgcttgtgctgttcagtaggtggtttttagaaagggcttccttcagcgtcattagcaacaggagtcgtcgtccgtttgcatgaggaaatgttcttaaccttccgtttctgattgcctctagactgcatctgtcatagacaaatgcccccatcttttgcagagaaccagtctcttctttaaactttacttctaacgcttattctttttaccttatataggaaaccactgattgcttgtgtggagaaacagctattaggagaacatttaacagcaattctgcagaaaggtagatttcctaactcttgtgcaaattaaactgaacaattatccttagttcattaggaaagtaaagggggcattacaaatagcagtgttaggacgtttgttattttcataagacagtcattaaaaatcttttctaatgaacatgttagccatccacgggagaaaaaaaaatcagtaagagaaataatggaaggcacctagtggaactacattcactgctaaaaccccagtggcaggaaggcccggcagaccttctgtaccacactcatgctgaaacatgggtgcagtgagcctgttgcagctctctgagcagactcatttcctgtgtccggccgttcttcatgcacactcggatgtaggggactcggggagctgttcgggctgttagattttcgtgaggcttccctcacctgcggacttcgtgcatcttagtgtcagatgaactaccgactaggtggtctgcttaagcagagtatacttttctcctggttttctggaagagaagagcatgtgttctagtgctgacggcgcggccttcacgtccgcttctccccaagtggtggcagtacctggccataggaaggtggcttctagcagcctgcacctttaaaattgatgctgatgtcttacctcgatctttgtttattgctgttttttctaggcttcaaagtgtgctgaattctatgaaaattacaatgagcagtctaacctttgtaacactttagtacttactggcacatttcactgttaccatttgaaacaatgttaccttctgaaagtcattttaaatgtatttggaaaatacgagacttttttcaagccattggaaaccttaaagtttaattttgagaaggccctaaatggtattcaaatatattctgctttgggttctacattgtcagataatagtattatggctaatgagatacttaagtgaaaccagaataaaaccaaaagggaggagaattaacatgattgagcatctcctgttacaaacaactccacttgatgtgaatatcttttcaagcaattctgtgaaatcattatccccattctacaaataagaaaaccagggcttaaaacagccagatgttggtgcctggaatcacattgcttgtgagctgagagtcacgggtccaatctggttatgatgtttctgcttattccacactgaaacctacacatcacctatccacctaaaaacaaatgcattcagaatttgtgtcaggtgtttttatgaaaggagtcactttataagaaaaaaggccaggcatagtggcccatacctgtgacatcagcactttgggaggccaaagtatcactttggatcacttgagcccaagaattcacgaccagcctgggcaacaaagagagaccctgtctctaccaaaaaaataaaaataaaatttttttttaaagccacaggtggtgcatgcctagggtaccagctactcaggagggtgaggtgggaggatcactttggcccagggggttaaggctacaaaactacaaaaacctgggtgacaaagcaagagacctgtctcaaaaaaaaaagagaaaaaagatttcaagtaaatagtagaaatttgcataaattgttccagtgcatactttgttaagcaaaattatttaaagaaaatggtaaattatatatgtaaaagcttaccctaaattttattagaaatattttaaaaattaaaaagatacttttgaattcttaagacatgggttttagtaaaataaagtataaaaagtttgtgtcagtagatcagaatgtaattgagagaaataaacatttggagctctaggtgaggattgtaattatagccccaccatgtgtttgcgcacagctttaaacctcctcgtttgtgtgaacatcgtgcccagtgtaggcagaatctgagactttgtgaattgtatgactgttcaccattttatgctttaacctggctgcctctcagtagttatcataaagcaagtatttagaaaatctatgagagtttttctcattgaggtatggtttcagaaaaccgttataaatattaaaaatctaaaacactgaaagcttttttaaatgctgtgttaaacacttcaaaatatccgatgatgtttttctcttatagtttactataggtgtgaataaatttaatccactataaattagatttgatagcttgtccttttacattgtctggccgatggactaaatcagaagtagattgagaacatgaacctcccaggttaaatagttggtgtaaactggattttctgacttgctaacttaagtgaaataagagggcttcaatgacataaagaagtaaataatacatcttccaacatactcagagaaaatgaggttcacctaataggatccatctcacatatttaaccagatcaacctgctcatgtagaggcagcgatgtggagacccgcccaatttctaagcggtgtattgacgttcttctggtgcacgctgtattctagttgagttgttgttaatgctgcccatgctgtactctgctgacgtgtactgcacatctcagggctcgaccacttactggatgagaacagagtgccggacctcgcacagatgtaccagctgttcagccgggtgaggggcgggcagcaggcgctgctgcagcactggagcgagtacatcaag

SEQ ID NO: 12559 - DNA, 541 bp, Homo sapiens
catcaaaacacgacctcatccatcttccctcacccacatgattgagagctgagacatagaagttctgttgaggattctgtctgtgttcagtgctgtggttgaacagcacgatgagaaaagcagggaaggtgaactcctcagctcctgtgagagggcaccactgaccctcttggccttcaggtccacagtcacagtccgcagtggtgacagggttcttagatgcctgcatgggtctctaaatgtctctttaagcacagtttactcctcagaatctagcctgaatcccaggtctttcctgcagctgcacaaccagcgtcttaggctatgtagatgttttggctttgacttgacgtcatgtatacatttttagtgtgacctggccggtaattacttaagtgagagaacagaccgtattaatagctttcctaagtaggttgaaatcttccgttttctaaatgatatcagtaggagacgatgggtgtatttcttttctgggcccggtcgctggctgttgttagagctcgcttaaggtctgctggga

SEQ ID NO: 12560 - DNA, 253 bp, Homo sapiens
aagaccctctaatgagaagccattctccagatgcccctcacagaaacaggagaactgaggcagacatcagggccccttcacagatagctcgtgttttcaggatgtgccagttgcctagcatgaattttccagcttaaatggtgaacatttagcaaaagtctgtgtttttgcttgctggtgactattcttaaatcccataatgaaaagataaacaaaatttccagagaattacactaagaggaaaaaaagaaaa

SEQ ID NO: 12561 - DNA, 409 bp, Homo sapiens
gaacctggagagtcatcttgtgggaatcgaggggcgagtttaatatggcaggcggcttagtgaccagtaagtagagtctgaggggatgatgagaccaggaagtggctggttactgtgatgaaggcttttaggctacattcgtacgttaacctagtaaacatggggtgtttctgtccaactcagcactgtgcgttggggaccagggacaggcatgaatggcacgggtcctgctctcaaaaagcttgtttttgctggaagagagttctgacccagcccagtctcacctggggaaatgttaatgtgatggcagatgctgagatactgtgtggcagggagtattccaaggtctgcatattcagatttcttttgcctctgggatattccagtacttcaagtaactctactttct

SEQ ID NO: 12562 - DNA, 4102 bp, Homo sapiens
tgtagtaacatccagtattttaatatttatgcttgataagtcatttaagttgaagactctttatgtattaatttcagcaagtaacataaccacacagaatagacaatgaaagcataattagtcattatacacaattataatttgataaaaaatttcaacatatacagaagtataaagaatgtgtatctatcatgcagcttctacaattatcattccaactcctcgtttctttgatattgccaacaatttacaccctgccccaattccaaatttggaaacaagtcccagatattaatataatttcctcttcaacatttcagtatgcctgagagattcttgtttaaaaaaaacatttttttgaggggcacagggtctctctctgtcacccaggctggagtgtaatggtgcgatcttggctcactgcaacctctgcctcccaggctcaagcaattctcctggttcagcctcccaggtagctaggactacaggcgcacaccactgctctaggactgtgtactcttttagagatggggtttcaccatgttagccaggctggactcaaacttctgagctcaggtgatccgcccaccttggcctcacaaagtgctgggattacaggcataagccagggtgccaagccttgttttaaaatttaatctttatgctctgaatggaaaggctataaatggagttcaatgaaaggaaaaaacatttaaaaaatagaagttctttctttcttctttttaagatggagtcttgctctgttgcccaagctggagtgcagtggcacgatctcagctcactgcagcctcccctgggttcaagtgatcctcctgccttagcctcccaagtacctgggattacaagcgtgcaccaccaggcctggctaattttttgtatttttagtagagatggggtttcgccgtgttggccaggctggtctggaactcctggcctcaagtgatccatctgcctcggcctcccaaagcactgggattacaggtgtgagccactgtatccagacaaaaataaaatttaatcataacatcattctaataataaaacatcacagccaaacaaaattaatgattccttggtatcattaaatatccagttaatcccacatttaataccacttacagcccattattacttttgttatattatcacagccagttccaaaacttatagcccattaagtgtatgagtttacacctgcatttatattatctctgatttcttttttttttttttgagacagagtctcactctgttgccccaggttggagtgcagtggcgtgatcttggctcactgcaacctccacctcctgtgttcaagcaattctcttgtgcctcagcctcttgagtagctgggattacaggcacacaccatcacgtccagctaatcttttgtatctctagtagagataggcttttgccatgttgcccaggctggtcttgaactcctggcctcaagtgatccacctgccttggcctcccaaagtgctgggcttataggcatgagccactatgcccagcctctgatttcttttttcttttttttgaggcagagtcttgctctgttgccccggctggagtgcagtgacacgatcttggctcactgcaacctccacctcccggattcaagcaattctcctaactcagcacccaagcagctaggattacaggcatgcaccagcacgcccgactaatttttgtatttttagtagagacggggttttgccatgttggccaggctggtttctaactcccgacatctggtgatctgtctgcctgggcctcccaaagtgctgggattacaggcgtgagccaccttgcccggcaagcagcctctgatttcaactcaagagacagaagaggatcccaaattccaagcaactcccaagatgcaaatcaaaatatggaaatgttaaacaaattgaaggatttcccaatagttacctgcaacacctaaaggtcactgtttccaaatggtgcaagaactatgcaaacaatatgttggttgctgttaaattcaaggacaggacactattaacagttataacatttttgtatggacctttatgaatctgtgggaaactagagacgcgctgtcttagcttaggatgccataaaactaccatgggcttaaataatagaaatttatttctcacagttctggagcatgggaagtccaagatcaaggtgccagccaatttggttcctggtgggggctccctttctggtttggaagtggccgtctcactgtattcttatatggcttttcctctgctcttgaggaggaagatttctctcttcttcttataacgccactaatcccataatgagggccctaccgtcatgacctatctaacccatattacctccaaaggccccatctccagatactatcacattggactccaaatatttatttattatgggactccaaatatttatttatttttttgagatgcaatctcgcattgttgcccaggctggagtgtactgacgcgatctcagctcacaacctctgcctcccgggttcaaagcaattctcctgcctcagcctccccagtagctgggactacaggcgtgtgccaccatgcctggctaatttttgtatttttagtagagacagggtttcactatgttggccaggctggtcttgaactcctgactttgtgatccaccgccttggcctcccaaagtgctgggattacaggtgtgagccaccgtgcccagccctccaaattttttttttttggagacagtttccctcttgttgcccaggtgaagtacaatggcatgatctcggctcagtgcaacctccaccccctgggttcaagagattctcttgcctcagcctcccgagtagcagggattacaggtgctcaccaacacgtcccggtaatttttgcatttttagtagagacggggttttgccacgttggccaggctggtctcaaaactcctgacctcaggtgattcacccacctcggcctcctagtgctgggattacaggcgtgagccatcgcaattggcaattttttttttttttcttgagacaaggtcttgctctgtcacccaggctggcaatatcatggctcactgcagtctcaaacttctgggctcaggcaagcctcctgagtagctgggactacaggtgtatgccaccacacctggctaattaaaaattttttttttttttgtagagacggggtctcactatgttgtccaggctggttctgaactcccggactcaagcaatcctcccacctaggcctcccaaagtgttaggtttacaggtgtgagttaccatgtctggcttccaaaatatgaagtttgggaggacataaacatttagtctataacatatattaagttggtacactacaaagtaagcaaaagtatatacatccaaatagctgggaaaaggtgagagcattaaggacaagcaaacatgtgactgtttctagccatttgccagatttacctatgagcttaacaatgaagctagaactgaaccaagctactgttttctgactaaagagatgtcttcgtaagcagtaatgtggggtaacccataatgaggaaaacttagtcataaaggagaaaagcaagagaaacagagaattagcaggattttttttttttaaaaagaatgaattcatgaaacatgaaaaatgaatgaattcgtgaaaacggcaaaacatatttttaccatttccgatatgtacagtgacaagttcttttgataccatgccctagactgtgtattacccatctattcagcagttatctcaacaggtatcatgacattttcaaaaccaaaaactgagttttttttttttttttttttttttttagatggagtctcgctctgttgtccaggctggagtgcgatggcactatcttggctcactgcaaactccgcctcccgggttcaagcaattctcctgcctcagcctcctgagtagctgggattacaggcgcctgccaccatgctctgctaatttttgtatttttagtagagacagggtttcaccatgttggcaaggctggtcttgaactcctgacctcaggtgatctgcctgccttt

SEQ ID NO: 12563 - DNA, 619 bp, Homo sapiens
ttttttttttttttggaaggaaaaaagtgataccaaaatatcttaacacttataaggagtcaaaagtccaaaaccatttagaaattaattgattttttaaaagccttaagtggctgagtgcggtggctcatgcctttaatcccagccctttgggagactgaggtgggcagatcaccggaggtcaggtgttccagaccagcctgtctaacatggcaaaaccctgtctctactaaaaaatacaaaaattagcccggtgtggtagagcacaactgtagtcccagctactcaggaggtgcacgccaacatgtccggtggaaggatggcttgagcctaggaatttgatgctgcagcaagctgtgatactgtgccactgtactccagctggggtacagagagacactacctctaaataaataaccttaagtgttttttccaaagatattgcttatgactttcaaaagagatatacagagtggtggctgcagtggctcaagcctataatcctagcaccttagaaggctgaggcaggtgatcacttgaagtccagagtttgaggccagcctggccaacatggtaaaaccccatctctactaaaaatacaaaaattagccaggtgtgg

SEQ ID NO: 12564 - DNA, 1822 bp, Homo sapiens
gctgcagctccggtggaaataataagatataaaccacgaggttgttatttgcatagaaatagcatggagccccaggcagcaagggagaaggacacagggatgatttgtctaaaattttaatgaaaacttttgctgaggcagagatttttaaaaactttctttctccctgcttttccccttccttcccctaccccccaaaccccatcattgattttacttaacatggttcagtttgaagagaaaaggttgacactccacatatcatactcccataatgcagcaacctgtaaattgtttcttcctttaatagatatgaagctgaagagacatgcattttcaacttaatacattgcatgtgtgcgcctggcttttatggctatactccatcttggcatacacatgatgttgcctgtcattagcctgtttttaattagtttacaccttcctatcttttgcttccaaagactcttactttttaaaggatttctttttatagccaacagtagtaaccttcatataaaataaatattttctggtgttttcctgtttttttacttttggtggtttttctgtatacttacatgttttattcatggacgccatcctttgtcactgtgtcttttattccaaaaccaggaagtgcttcccaccttcgtatttttatccttttccccctgtgaactcaccatttgtgtatcttctttccatgtctgtcttgctttgttgcctgcagttatttgtaaaatattcaaaatattacccaaattgagatgagttgtagtatctggattttattgagtgttactaagcacatttgacattagaactaaaggcagtaggctggtgattagaagcagcccaagtgggtttgcttgaaattcagtcaagaatatctgtctggttccttgctatcttctggaatgggctaatggtatcagggctatatttcgtagacaggaaggcaaaaacagaagggaaagtgacttagtttcattgagagagactagatcagggtcagaacatgaactttcatgtccctaagtttcactgaagaaagctcaggcctctttgcttagtggtctgtaaagcctaagagaaggtggtccggtcgttttcctgtttgtccaaatgtcgtgagaatgatgacattaataagagaagtttctaggggcttgctatttcatgtcactcaaggtagtagatcctaactctaggaactgtaggctgtgggtgacagattccttaaaatgcctcactgcgtggcagacctgatgtgtgtggcaaattaccctgcttgaagggagtcatgctggcctggcaaaggcagtaacctgtgtacttggggaactgttaagatgcacccttaaggagctgagatgattgcagagtcataaactcttaagtctatttgccactggacatttgcagagatgatcatatttacttccctcctcccaccactcttcctctcagtttcctttttactttatttttttctccctttcctggtaaaagtattagtatgtttaacatagtgttaggtggcagataggctgggaagagctagtattgtaaaggaacactgatgtgtactggagcctactagctctcaatccattgccccagacttggggagagagagcacattctctatccagagaaataagaatatgcagtttatggttgtcctgtggacattaactgactgtgaaggtaaggtatatgccaaaggcagtgatatgcaggtgatagattcaccgggagatgatatgtgacttttcttgtattttaaagctctgcttcttttttagaaaaaaaaaaa

SEQ ID NO: 12565 - DNA, 9167 bp, Homo sapiens
gcaggttctaactttggcctgggactctgcccctctacctcagcacagaatcgccccgggtcctactacagaatcaatccttgaacactgcctccacgtcgccggctcaatctgggcgagaacccagacttccaccgcagccccgcaatctgcagacctcagcggcagcgcaggtggcaggtaagcggcgcacgctcgtcccacttagggcttaggatctccaggcttcgcgctcatccccggcccggaagctgcgcctctggctcagccggactgggtcaggccagggaccggagcttcagatagcccaggactctgcgtggacgcgccccgaggggctgccgcgccagattcccatatccaggcagccacactcagagggttgtagtagttgtccacctctggacagtcccactcagccccttcttcactctctgggcctcccaaaagacagtcagccttgtcctcaggcccgcacccagttgtcagcctctgactcctctcccctcaaaggattcttaccttggctcctcctcttagccctagtgaggttctcccctaccccccaacctcgccccaacacacacacagtctccaggcttccctcagagtaagtctttgcttccacagacctgcctcctttgcctgtgagtcatggcagctcccatgaatggccaagtgtgtgtggtgactggtgcctccaggggtattggccgtggcattgccttgcagctctgcaaagcaggcgccacagtttacatcactggccgccatctggacacccttcgcgttgttgctcaggaggtgagtgcttcctctgggaccacagttgcagaaaccacccgagagagcccttccacttaacagctcctttcctaatcccttacctgaaactataatactactcaacaagatgtgaatatttattcaaagtggaaattaaaaaccccgtaaataacttcaggtaaggtagaattttgccgccaagtgagttttatgaaaaaactttgtgtttgagccaggcatggtggcacgttcctgcagtcccagcagctactccggaggctgaggcaggaggatcgcttgagcctaggagttgagccatgatcacaccactgcactccagtctagacgacacagcgagacactgtattaaaaaaaagaaaagaaagaaaagtaaaaaactttttgtttgagagcagagattttggaattgcaactaaagggttgtggacctgtgctttcctctatttcaggcaagactttattgaactgcacattttttacttatttactagacttcagttaaataaatatttgagtatccatgatttgctaggcattggtaaaccactgaagttaccaagactaataaaatctaatttctgctcttcaaagattcagtccatggtggagtacagtggctcatgcctgtagtcccagcactttgggtggccaaggcagcaagatcacttgaggccagcagttggagaccagtctgggcaacatagctagacccagtctctacaaaaaatattttttaaataattagctaggcacagtggcctgcacctgtagtaccatctacttgggaggctgaggcaggaggatcgtttgagcccaggagttcgaggttgcagtgagctatgattgcaccactgcactccagcctggtgacagtgagaccctgtctctaaaaaaaaaaattttaattaaaaatgaagatagattccaacaggaagtcaggtacagaaagcagtcacttcaatgtaatgtgaatatggtaaattataagagggagatatgcacagaatactctaggggtgttggggagcatccagatgacataggagagtggctagggaaagtggtttgggaaagcgtcctggaggaggtaggtggttcttgaactgagttttgaaaggtaagaattaggtaaaggaagttaggaaaagcattccagcagagggagctccataagcatagggacgctgtgtgaaagagtagatgtgtgagataatgcaagggaagagtagtgagtgagaggctggagaggaaagagtgggtcttggaagaccctaatagagaactcaggcttcatcctctaagagatggagatccagttaggagattttgaacagggtttgtgttttagataggtcgtactggctggattatgaagaattaatttaaggcagacagactggaggtcaggtgagtcgttgggaggcattgcagtagttcaggcaaggagggtaataggcggggacccagagcataaatttggagaataggaggattgttcttagataaaggactcttcttcctctgaagttggaggtttgtgggcatttgtagagagtgagacagaacaggaagtagaaatcattcatggctgatagctttggttttttcaattaccaaccaggagcattggtggagtgagggtaagacaactgggactgagtagaggttttaggtgagtagtgtagggtgggagctaagggcatgagagatggaaatgaccacaacaaggaaaaggatgcttactcatttctcaagagcagactccatgcctcacttgttcttaccctctacttgcaaagtacaatgctgtgcacatggtgggcctcagtaaatgtttgtagattattaaaacttacattgcaattcaccttgctctgtggtggggaggcctatcattcctgaaactactcaaacagacaccagagggcagcgttgcctgccatgttgcctctgcagcaggctctcctaggattgattgtcttctcagttctcaagcccactttggttggggagttttgtcatgactcacacccatgtgtgaatgtgagctcatatcccctgtcctactccaggcacaatccctcgggggccaatgtgtgcctgtggtgtgcgattcaagccaggagagtgaagtgcgaagcctgtttgagcaagtggatcgggaacagcaagggcgtctagatgtgctggtcaacaatgcttatgcaggggtccaggtaccctttgaactttgttcccaactccacatttctgacctccccctcagacccctgcatcttcatccccactcattgtcccttccattacccagcccctcacacctccctaccttcagatcattcatcaccctccctgtgccttccagacgatcctgaacaccaggaataaggcattctgggaaacccctgcctccatgtgggatgatatcaacaacgtcggactcaggtgggtgctccactgccaggacccatgttccctcactcacttagccaactcgacggccaggcctttccttacatgccctctccttttccctccggcctcccccatctctttcttctcccttccattccatttgtcccacttacctctggagaagttccatccaggtgagtctgtacctgagaatgtcaactctgtcagtaattttcattggaacaagcccttggcctctctcctgtctcactctctgcccatccaaatgcaagacccagaagggaggaagcctcctcctctcagtaatgcgcacagcctgtagtctatactttcaaaatggttagagggagaaattgttttattttagactgggagaagcttaagaagaaggagcgaacaccaatgctgtttagtctccacatcctcactccacacccacaggcaagggcactgccgggtcagagttgggagagcaggtacatcactgggtcacacagggtcatttagcccaggagtgagatgaaacacagcatttagaattcgcctagcataatgcacaccagttatgcctctgttactgttggaatgatgttacactctcatataatcaagtcatgcctgatggatgtgatcagtcacctgtgggagtaaccacgagattatcggcaaatctgtgactaaagcatgtaagaacacccaccgctccaattttggtactctggtaacaatcccaaggaagcaggattagaatgcaattgtgatttccaaagtggaaggaagatcattaggacagaggaggatggtgaggccaaaggcaagaaagggacacgttaagagctggaaattggccagtgttcatgaccatagcctccaaagagaggtgccttccacaccctcatctcttgctggccagggttttgaccctgaagcagagattcaaggcagaggcccagaccctcgaccttgggccctgatgaattatccaaggtaaaggccccttgatgagcccctgacagccccccagcacctcctgcccacccattccccatgcgcatttactgcctttcctctgtattaccttgggctgcactttcctttaaaactataactctacttgttttcatttggaaggtcctaattctttccctatgcaaaagaaatttattctggttaccaagttatgtgtgtgttactttttttaaatatggaaaaaatctgaagaccagtataatcttattcccctcagtgccatcccttgctctcttgcctgatatatagctactattaatagcctggcatatattctttcagatttttcatgtaaatatctctcattctttttaatacttgtacgtattctattgggaggatgtatgatcatttatttctctaatcccttatttgttgcagcagtggaattcttagatcaaagaatatgtacttcccttaggttatagagactgtgggaaaaatagaaaaaaagaaaagaaaacaaagaatatgtactttttaaagatttaataaatattatcaagctctcctacaaaaagaccctaccaattttttatatcaagacaatgaaggggaatatgtgtttccccatgtcctctaccacaccaggcagcgtcagctcatgcactcaggcaagctttgttactataataagccgaaaatatataaaggggttttaattcatacttcttccactatttgtcaggttgaactttttttcccctttgtttattggctctttgttcttttgtaaatcatctttgactttcgcattaatttataagagatcactgtgaaacaaatgactttggcatttattttacaaatatttttcccaatttatcactcatttttcacacgcatactccccccactcgtctgttgttgttgttgttgttgttgttgttgttgttgttttgaggtggaatctcgctctgtcacccaggctagagtgcagtgtgcaatctcagctcactgcaacctctgcctcctgggttcaagcgattctcatacctcaacctcccgagtagctgggattacaggcacctgccaccacgcctggctaatttttgtatttttagtagagaacggggtttcaccgtgttggctgggctggtctcgaactcctgatctcaagtgatctacccacctcagcctcccaaagtgttgggattataggcatgagccaccatactcagcctcgccctgctctttatatacacagaaatatacatgtatctttgtatttgtgtgtgtatgtgtgtgtatcttaattttacgtcaaatctgtcagtcttttatagtttctgtcttggtgtgacgctaataaaagccttttccctcaagtttataaacacatttgatcatgttttctttcagtacttctgtgctttcgttttttatatttaaatatttgatccttttaggcttaattttaaaataataaacgaggcagagacccaattcccctaactcaaataactggtcggttgtcccaaatgatccaactttcccccactgatttgacaggttcctttcgtaatacattgcgttctcacatacacttgtatctaattattctctgttttgtttcattgacttatcagtctactgttaacacctgtattgcattcttttaactattatgtcttgtacattttaatttattttattttattttttagagacggggtcttgctgtgttggccaggctggtctcaaactcctgacctcaagcaattctcccatctcagcctcccaaaatgctgggattacaggcataagccaccatgcctggcccctgtgcattttaatatgggtgacagcaggggtagggaaagcaatccccctcacccacaagacattagtctttttagtccttttttcggaattttcctggctgttctctttctttttatttatttatttatttttgagacaatctcactctgtcagccaggctagagtgcagtggcacaatctcagcttactgcaacctccgcctcctgggctcaagagatcctcctgcctcaggctcccgagtagctgggactataggcacgtaccaccacacctggctaatttttgtatttttagtacagatgggctttcaccacgttggccaggctggtctcaaactcctgagctcaagtgatctgcccccctcgcctcccaaagtgctgggattgcaggcgtgagccaccgtgcccagcttttctggctgttctcacgtttattcttctcattgagctttagattattttatcaattcctccaaaaggtcttattgagctataatccaatttgactgaatctatggattgatttacatagaaatgatgatttacatgtcagttcttagctttgaaagattttgtctgtacttattgtcatggttttatagtttttctatgtagacactatacatttcttaagttttctccccctgaacaattttgtttgtaattgttattgtgacagggctcttgcgttccatttcttcttccaaagattgctgtttctcatctgtcagtggttattttgaccagttttcctctcagaatatggcctcaagcccctaattcctcaggtcgctaacccaccctgtgtagccttcctagtggacaacaaccaccagaaggcaggggaagccgccagaggctgtggcacccaggccagcactaacacggttcattccttcttcccttgccccaccttctagaggccactacttttgctcagtgtatggggcacggctgatggtaccagctggccaggggctcatcgtggtcatctcctccccaggaagcctgcagtatatgttcaatgtcccctatggtgtgggcaaagctgcggtgaggacccagtggcataggagctgaggaggtaaaagacagtgatgttacctatagctcaggaggtacaatccccagtggtcagaatggtaaggctggctcctctcagctcctcctctgcctcatccatggacagttcctttgcttgtgctcctcttggttggctagagtaggcatcacactggggagcgtgggcagctgagaccttggggctcctgggaaggacagggtgggtggagcattcacagtagaagcagagagggcagggcaggaaagtgacatggctaggtggctcttaccctgccttccgcctctccacagtgtgacaagctggctgctgactgtgcccacgagctgcggcgccatggggtcagctgtgtgtctctgtggccggggattgtgcagacagaactgctgaaggagcatatggcaaaggaggaggtcctgcaggatcctgtgttgaagcaggttggcaaggggagggcgaaggaagcagagaacaggggagtcggcctctgcatcctcaataacaagatcagatactcccactcaccaggtgcttactgtggcaggtgcagggctgagcatgggacacacattatttcctttaatcctgtaagggagataccagctccattctacagatggcaaaactgaaacccagagaggtttagaaacttgttgaaggtcacatatgtcctaagtggaaaggctgtctagctccaaagaccatgcacttgacccccacaccagctagcttagaaggtccaaacactatttggcactaccagatccttccacttagcaaagacagcagatcctggtgccagggcacagggctcacctggatgtggggaggagtggctctggcacctgccaatactttgggtcctacaggccctgcttgaggtctttggcctctttggtctttggtctttttctcctggaacagaagttgaaatggggaggagacctgggcagtgctcttggaaattaacccttcacttctctgcccctgtgtttcagttcaaatcagccttctcatctgcggaaaccacagaattgagtggcaaatgtgtggtggctttggcaacaggtgaagtttgggggcagctggtaataagaaagggcatggaggatgtgtagtgcggtagcatccagtgcccagatctggctcgggagttggttgaggaacatgtcattcttttctctgctttttgaggcccaaggggtcagcattcccagtttgaggtctgagagccttaggagcaggctcctgggaagtgtggaaaaagtccaaggcccaagagaaagagctctccagggatcctgagctccagggctctcagcagtgccctgtccaactgggcccaaaccttgtcactctgcatactcccctgcctgccatctccacctgtctgtgtgcccgcagatcccaatatcctgagcctgagtggtaaggtgctgccatcctgtgaccttgctcgacgctatggccttcgggatgtggacggtgaggaccctggcacagcagtcagccttgactgctgttccctctgttccctgcccactcctccctcggtctctccagccaaggtgagggtatctgaggagtgggaaatgagaatctaatcctcctcctcctgttgttcccaggccgccccgtccaagactatttgtctttgagctctgttctctcacacgtgtccggcctgggctggctggcctcctacctgccctccttcctccgtgtgcccaagtggattattgccctctacactagcaagttctaaccctcctggtctgacactacgtctctgcttgtcttctcatttggacttggtggttcgtcctgtctcagtgaaacagcagcctttcttgtttacccatacccttgatatgaagagaagccctctgctgtgtgtccgtggtgagttctggggtgcgcctaggtcccttctttgtgccttggttttccttgtccttctttttactttttgccttagtattgaaaaatgctcttggagctaataaaagtctcatttctctttcaatgtg

SEQ ID NO: 12566 - DNA, 308 bp, Homo sapiens
tctcgggagcctctttcaatgctgacagcgcccggcggaaatatcccagagcttccgggctcaggtgcgggtgcgaatctggagccggctccgagcgcccatccggaggcggccagggttgccgcttacggcctggtaaggggcgccccgaccccttggccccgcgcccccgtttgccaccagctgggaaccggcgccccaccttgtgtggagagcgcggaccctgccccatgtgtgcttcgcgacctgtccggctgcaaaagcttccttaactgcggacggaccttcgacgtcgccaagcgtgcgcc

SEQ ID NO: 12567 - DNA, 968 bp, Homo sapiens
aacactgcagaaaataacagctttattgctacagatgtgagagcatttacaaaatgccaaggaaaaccattccgttttgagtctctggagcctgaactctcaccatgtaccagaaaagaatgcccctctttcgaactttcaaacagttgggattatttttgtttcttatcatcccaattatttgctcaagtttgcctccattgggccccgttcagagtttcttgggctgcttgtactagtcacagctccacttccatctcttctcaggaagaggtgggcacaagacacatctgagccccttagtattgtgatggtggccaggaaatgatcaaagggtagcatttaggaaatcagcaaactaaagcctcaaatcaaaggtggacaaatgcattctcaactcaaacaggttgggtaatgctttcataagatacattatgtttttgtgtacacagcacacaaattttattatgtctacaaacagattcaggaaagacctccaggctatttccccaaatgattgacaaagtgcaaaacaaaacaaaaaagaggagagcacaaatgaatagcccacttagaagctgaatagaaagaatgggaagccatttcgtttcataaaatcttttaatttttggccaggcatggtggcttacgcctataatcccagcacttcgggaggccgaggcgggtggatcccctgaggtcaggagtttgagaccagcctgaccaacaaggtgaaacctcatctctactaaaaataaattagccgggcatggtggcaagtgactatagtcccagctacttgggaggctgacataggagaattgcttgaaccagggagatggaggttgcagtgaccactgtactccagcctgggcaacagagcaatattccatctcaaaaaaaaaaatcttttaatttttataattaacttttatcatgcagcccaacatgtcatcttttcataaaat

SEQ ID NO: 12568 - DNA, 968 bp, Homo sapiens
aacactgcagaaaataacagctttattgctacagatgtgagagcatttacaaaatgccaaggaaaaccattccgttttgagtctctggagcctgaactctcaccatgtaccagaaaagaatgcccctctttcgaactttcaaacagttgggattatttttgtttcttatcatcccaattatttgctcaagtttgcctccattgggccccgttcagagtttcttgggctgcttgtactagtcacagctccacttccatctcttctcaggaagaggtgggcacaagacacatctgagccccttagtattgtgatggtggccaggaaatgatcaaagggtagcatttaggaaatcagcaaactaaagcctcaaatcaaaggtggacaaatgcattctcaactcaaacaggttgggtaatgctttcataagatacattatgtttttgtgtacacagcacacaaattttattatgtctacaaacagattcaggaaagacctccaggctatttccccaaatgattgacaaagtgcaaaacaaaacaaaaaagaggagagcacaaatgaatagcccacttagaagctgaatagaaagaatgggaagccatttcgtttcataaaatcttttaatttttggccaggcatggtggcttacgcctataatcccagcacttcgggaggccgaggcgggtggatcccctgaggtcaggagtttgagaccagcctgaccaacaaggtgaaacctcatctctactaaaaataaattaaccgggcatggtggcaagtgactatagtcccagctacttgggaggctgacataggagaattgcttgaaccagggagatggaggttgcagtgaccactgtactccagcctgggcaacagagcaatattccatctcaaaaaaaaaaatcttttaatttttataattaacttttatcatgcagcccaacatgtcatcttttcataaaat

SEQ ID NO: 12569 - DNA, 364 bp, Homo sapiens
ccatatcgtccaaaaatatcttttgattggacagtaaaatagtatctgttggaagctaaaaactgagataaagtacaggccatggggagtggtaaagctttaatttctccaatcttcttccaaatcaacttattattagagttctcatgacacaggaagaggtggtagctttctacaggagcacacttgggattgattttggttatattccaagtcagggcaatgccattgggtctgaaaacccgtttcactttgagctcaggcttctggggaggaagtgtgtctcgggttttgtctactaattcaggtagtggtgctggtggttctgggagaggtggcaggtgctcaaaggactcaggaacct

SEQ ID NO: 12570 - DNA, 289 bp, Homo sapiens
ttttttttgagatggagtcttgctctgtcgcccaggctggagtgcagtggtgtgatcttggctcactgcaagctccgcctcctgggttcacaccattctcctgcctcagcctcccgagtagctgggactacaggtgcctgccaccacgcccagctaatttttttgtaattaattttagtagagatggggtttcaccatgttagccaggatggtctcaatctcctgacctcgtgatccacctgcctcggccttccaaagtgctgggattacaggcgtgagccaccgcgcc

SEQ ID NO: 12571 - DNA, 289 bp, Homo sapiens; identical to SEQ ID NO: 12570

SEQ ID NO: 12572 - DNA, 364 bp, Homo sapiens; identical to SEQ ID NO: 12569

SEQ ID NO: 12573 - DNA, 35799 bp, Homo sapiens
ttcagagccgctatagctgccggcggtgtgcgactgagtcggtggcgaagacgggaacgcgacgatggcggagactctgcccgggtcgggcgactcgggccctggcacggcttctctcggcccgggcgttgcggagactgggacgaggcggctcagcgagctgcgggtgatcgatctgcgggcggagctgaagaagcggaacctggacacgggcggcaacaagagcgtcctgatggagcggctcaagaaggtgaggcggcgcggggctcgggggtggcgcaggaggcccgggcacgcccccgcctgcacctgtcaccgcggctcccggacccggggcgccctgggttcgccccgcgtcttggccgaccccggttcgaggtgtcgggcacccagggggccggctgtgtgaccttggcccgtcaccgctcctctctgtgcctcccttcctatcctctttccaccttttctcctcaagcgcgctcagcgtgcggtcttctccgctaccagggtggccccgggacccctcctggggctcccgatcgagccttggctctgtgaccttgggcaggtgcctttctctctgtgcctcagtttcctcctccggagaatgggtgtctggcggactccagagcatttacaggaaagggggcggtgcttgttcttgccccagggctttggcctttacgaagctgtccacccgggtcccccagatcttctcgtggccggccccttgttgtcattttgggtctgcctgagacatcaccttcctgagcgcccttcctaatgcgctgccccacctccttgccagctcatcctgcgtttgtgtcgcacctcgctgaaagcaggggctaaatgcaaaatattaaggggttgggaattgtctgtttccgcaactggaacaaacaacttgagcatagggagggagcttgtgggtacccagtcctggacccggcaggtggcaggcactgagggacctgttgaatctccccaggctggctgctgttcctcctcaccagcggtggccagcccttcaccgaggccgggccaagtgcagcctctctgttctaatttgtcccatcatataactttaaagtcgaaggtttggcattgtcgagttgagttgccattttggaactggtccttgaccccaattctggagctcctgctcacagcctccctctcctttgtcatttggacccagagagacccaagttgtgcggggttcctcctccgccttttgggcttgcggcccagatagctgacccggagttgctctttgcaaggacgggtttgcctttgtttcatgggaggttgttacttgtaaggaacagtgtgtgccctgcagctcttaatgatgttgtaaaactcatctctccctaataggcggttaaagaagaggggcaagatcctgatgaaattggcatcgagttagaagccaccagcaagaagtcagccaagagatgtgttaaaggtattgtacatatgctgcttggggcttgagtgttcagagaatttagagaaatggtgtgtagtgtgctcttcccgccttctaggctgggagaatttctctggtactcggtgtccctccactaagagttagctttgctcgtcaccacctaacaggtagctctgtcaagggcacagggaggaggaaagagatgtacaggtgccaagtgcaattaaaatatacgaaaaacgtttcagcttctgccattgggattaaaagtcaactagagaaagacaagctcttaaagctacttctacgggtctgaggaaccaaatgtacctacttggcttccttcctggttcaaaaaataggtcttaacccaaagaaaaggacaccaacctgagaccgaatagaactcagctttgctagggtccaaagtagattgttggggtatttgcactcagcctattttttactattacggtttttgaatgtgaaggtttaattcacagaccgttaaattcatcaggttaaggtgtacaattcagtgcttcctagtgtatacacaaggctctgccaccaccaccaccgtctccttctggattttcatcacccaaaaaggaaacccggtcctcattagaagttagtcgccttacttttctccctccagcccctggcaactactaatccatgttctgtccgcatagatttgcctattgtggacatttcatgtagatggaattgtacaacatatggccatttgcatcagctttcacgtagcataatgcttaaagttcatctgtgttgtaacatgtattgatacttcattcctgtttatggctgataccagttatttttgaaagcattgaattccataaaactttgaagctttgactatcccagttggtattgttaggttttatggtgataaggataatataatttaggtttcctgtgcagggggcctgttttcttggaaaagtgctaaattcaggcagtggaggatcagtgcttagaaagtagaaagaaattgtagcatttttaacaatttcatttttttaatagctttttcttcttaatgtgtttcataacacattaactgtttaaaacatgtgcatgtagtttgaaagattaaatcttttagttaggttgcataagagctttaagttaaagtttaattttgacacatggatgcgtttttgctgttcttgtgagtgtccgtatttcacctagaaggcccagcctgagcacattcagaatgtgagagactggtctacgcaggaaatatagtttatctcttctgtttaggtgttaacttatgcatgatgtgaattttctttttttagtggttgggaaaactgcttaacaataaagtttaaaagttttttatgtaggtgctcattttaaaactgtaaagttcaagacttactactcaaaatatccttggcttttagcaggaatttaacagggattttttttttttttttgcgatggagttttgctgttgttgcccaggctggagtgcagtggtgcggtcttggctcactgcaacctccgcctcccgggttcaagtgattcttgtgcctcagcctcctgagtagctgcgattacaggtgcccgtcgccacgcccagctacttttttatatttttagtagaaacgtggtttcaccatccatgttggccaggctggtctcgaactcctcacctcaggtgatccacccgcctgggcctcccaaagtgctgggattagaggcatgagccactgtgcccggcctagcagggatcatttctaatgatctttgcatcattagaaaaactaaactttagctgagtgctttgaagacctgcctgaatgtctagattaaagcttaggtggattcaaaactacttggagttagtgttttgtcaggaaagcttggatgataaagttcttctgttgctataaaaaggacttttgtagcctcagctctagtgagggttagaagggcttctgatcccttcccattcctttttcagagaagtaaccaagcccagagagagcccaggtcttcaggtggtgctcaggccctgcaggcctcatcttccatcctgagctggtgatgttctctagaggtgtcggggcacgtggctaatggataaagcacaagagccttaggactttgtggttgcagttagggcctgtgattacatacaactgttagatcaggaggaattcaccagttaattttcgtttcaagcactatgcagcagtgttcagttgagtccaaagttggactcattctgggaactcaccagtaactgcttccttgcaaaaactgaagtagccaaacttgttgagggaaaagtgtcctcattataaatcagagtaagggtcttcaccaagattaggagtcctaggcaacattgtaggtgggtttggaaaaaataaaacttggattaaaaatttaagttttagatgccatgtgggattaaagttggattttcttacatctgtgtccccagcagcggcagcttttcgttggccaatgccaggtgccggggattggggcgtcgcctgtctgcgccacattagcttttctgtgatgctttttggtcagcatttctcctatttccggcctatgtgggcactgcaggctactatttaggggcctagaaattgggtgcaattaccaaacatttttagacaacgtatttcaaaaggatatgctgtgtttagatataatgcgaagtgggacagctgagttttagagtgccagctttggagctcaaccaaattctcgtgtcaaatgcagataataaaacctgctagcgttgttaggcgtcttaaatgatagactggaaaaagctcacgttgcgagacatgcaattaaactgcatttcttgagtgattattgataatagtggtgagtgagactcttgaggtgtagaccctgcaggttttttatgtttaattttctttcttttttttttgagacggagtctcgctctgttgcccaggctggagtacagtggtgcaatctcggctcactgcaagctccgcctcccggcttcaggccattctcctgcctcagcctcccgagtagctgagactacaggcgcccgccaccacgtccggctgtttttctatttttagtagagacgggaaagtatgtatttttttctgtttgatttttctttatcggtgtgtatgttagagagactcggtcttactctgttgcccagagcggagggcagtggcatgatcgtggcagcctcaagctctcaggctcggagcatcctcccacctcattctcaccggtaattcagagtacaggtacataacaccatgcctggctaatttttgtatttttggtggagatgggggtctcactttgttgcccgaacttgtctcttaattcctaggctcaagcgagccacctgccttagcctcccaaaatgctgggattacaggcgtgaaccactgtgcctacactgtgggcattttttctgtttcattaaatattctttaaaagcatacattctttaaatattgtgagacattggatggtgtcccacagggtttctcagcattggcactgttgacaatttgggccgaagaattctctggggttggggagtatcctgtgcattgcagggtcgtgaccagcatcactagctactgatgctaatggcgttcccccaggtcatgaccactaacaatgtctccagacattgccagccattccccccggttgtgaaccatatctgaatgaaaatatgctgtaatttgtttcccttttgggtgtttaacaggtataataggacagatatctatgttttgaactccttgtcagatatcctaagactcaaattcctggaacaaagggtatgcacatttgtaaggtttttgatacatatagagcctcaagtttcttctcaaggtttccactcttgaactcctctggcctccttttgcaattcctagcagaattctatcaaatagttattttgtggtcacaaaacccaggatgattctcgactttatggcagcctttgcctttttgccttgggggaaaaaaaaaagttcttgagctaaaaaatgacaaagacctacttgaaatgggtggaatatagggagagccagcaaatcactaactcaatatgttattttatgttgcagttctttggttactagatgggtattgcatttttttgttggtttgttgaaaatgcctgtttttatcctttgctcatttttttgtgattttttttcttaggtttggagtgtttttgaaatatttggaaacttttagatattttgtggaaaatcagagtactctgaatctaagaggaatcctagattttcatctccctgttgatggcttacttagaacaccaattgaggccgggcaccatggctcatgcctgtaatcccagcactttgggagaccgaggctggtggatcacgaggtcaggagtttgagaccagcctggccaatatggtgaaaccccatctctactaaaaatacaaaaataagctgggcatggtgatgcacgcctgtagtcccagctgctgaggaggctgaggcaggagaatcgcttgaacccaggaggtggagattgcagtgagccgagattgtgccgctgcactccagcctgggtgacacagggagactccatctcaaaaaaaaaaaaaaaaaaaaaaaaaagaaaacaaattgagacaaaattacgtgtgacaggagaggggagacttatagtttatcttgtaatgtgttctgttctaagattgaaatctattctgcataaactaattatgaggtagaacttgagtgttatctgattgaacaattattctgtaattaggactgaagatggaggaggaaggcacagaagataatggcctggaagacgattccagagacgggcaggtaagtgatgtcagggtagagatgacaagcagcagctccctgtcctggtccaggtggtcgttaacgattcttcttcctctttacaggaggacatggaagcaagtctggagaacctgcagaatatgggcatgatggacatgagtgtgctagacgaaactgaagtggcgaatagcagtgctccagattttggggaggatggcacggacggccttctcgattccttttgtgatagtaaagaatacgtggctgcacagctgagacagctcccggctcagcccccagagcatgctgtaggtaacttggagacacggcaggatgtgcccatagccccgaggcacctggtgctcgcgtgctgctcgtgtgagggagaacacagctaaaccgccatgaacacacagttctgcttctacaccctggtgttaaaccatgtccatttaaacgctgtgtagctcagggatttactcatagatagcttttctgtagcactggggagtgtttttataattcgaagcatgtggtgagtcataaaatagaaagctctgacataaaagatttttcttttctgagatgaggtctcaactgttacccaggccggtcttgaactcttgggctccagcgatcctcctgactacctgggcttattggcacaggccacagtgcccatttagttttttccttttaaaatacagttttaagaagcaaagatggtttatttatttagagacagggtcttgctctgttgtgcaggctggagtgcagtggggtcatcataattcactgcagcctcagcctcccaggttcaagcaatccccctgcataactgagactacacagtgaaccaccacgcccagctaattaaaaaaaaatttttttttttttagaggcgggatctcactaggttacccaggttgatcttgaacccctgagctcaagcaatcctcccgcctcagcctcccagagtgctgggattataggtgtggtccaccgtgcccagctcaaaaatggtttctaatctcatcatgtagatattcctcctaatgttgtgttttgtttgtttgtttgtttttgagacagagtctctctcagtcacccaggctggagtgcagtggcaagattatggctcactgcaacctccgcctccctgattcaagcaattctcctgcctcagcctcctgaggagctgggaccagaggcatgcgccaccacgcccagctgatttttttatatttttagtagagatggggtttcaccatgttggccatgatggtctccatctcctgacgtcgtgatctgcccgccttggcctcccaaagtgctgggattacaggcttgagccactgcgcccagccacttgactaattttttatatttttggtagagatagggtttcatcatgttggctgagctggtctcgaactcctgacctcaagtgatctgcctgcctcggcctcccaaagtgctgggattatagtggtgagtcaccacgcctagcctgttaatgttgttttaagcaaggttaagcagttacattaaaagatgtaaagtacagtgaagacaagtatcaaccctgctccccaaaaggactgactgtgagcatccttgtatgtaaaggaggaactttgctctgttagggctttcccagcttttcacttctagtgttttggcgtagagctctctggtgaggctgttcaaatatcacaagctgtcagtgtcttcgagctgatcttcattgtactctgactgatgtcacgtgcccagtaggttgttttgtttccttaaggcattgcagctttcagcttgggggtggaaatgcctccataggactgaaccttaaaccttacggtcaaaagtcattgcctccaaatttaccatcctttgacctagggcagcactgagcaactggttagccgcctttctcagtctggtactgctgtgtgcttattgttttcagagtgtgtacttctcagttaatggaggcatcccaggtcatgagttcaaatcgagaaaaggaaaaaagaaaatatttgggagtgctgtttttgtagttcacttaaaaagagcttcagatttagtaaaacttggtgttaacagtttttcttttgtttggcatgtagtaaagagagaaattgaccaagttagatgtttgtttttaataaagtaggctaggcgggccaggcgcggtggctcacacctgtaatcccaacactccgggaggctgaggtgggcggatcacctgaggtcaggagttcaagaccagcctggacatggtgaaaccccgtctctactaaaacatacaaaaaattagccgggcgtggtggtgcatgcctgtaatcctagctcctcgggaggctgaggcaggagaattgcttgaacccaggaggtggaggttgcaatgagccgagatggcgccattgcactccagcctgggcaaaaggagtgacactccgtctcaaatgaatgagtgaatgaatgaatgaataaagtaggctaggagaaagtgcccggttagtgttaccttaagagtattgctaccaggtgaaattggaggggtgcattttatcattttgagttctgctttggaaatcctgtgattggaggggtatgtggtaatcaccagtacttagaaactgcctgggaaattcattcgttcattcacccagtacagacagggcatacccacctgcaggccactgccagagacgctggtggagcagagtcgtggagtgtgtgttctggcggagaggcaggtgctgaactgaatgacccaacagtagacttgcagatggcaaaaggtgccgtgagggaaatagacacacaagttgcctaagcgaggtgtcagccttggttttcatagctccagcctccacgaagtcatcttccattttgtttttcaggtggatggggaaggatttaagaacactttggaaacttcatcgttgaacttcaaagtaactccggtaagttaccatctggttctgcatcgctggaaatgttaatcgagtggttgattttccataatgaaagagcagtgtgtatgtgtatggaaatgactggatactgtgctggatgctggggttaagaggttagcagaagagaaacagtctcagggctggccatctagcaggggcagtgggatcaaaccaaatatgtaaccagaagggagaaagaagtgtgatgagggagcagttctggtggttggacttcataagtgcctggaactcttcccagaggtctgacggataggttgaagagggaaagaagaatttggagcagaaagtttgggtggtgtctctgatgcaaaagagagaggggagcacacagggttggatagaagccagaggtgttgcagagcagctgggcccgcctcgctgagtctgggccaccagaaggattggacctattgtcctaagtgagacagatgtcggaaaaggttttcagcagagtagagagatcattttgttatgacaggtttcagttacaaatcagtttatgttgggagaagtatttttttcttaaatccactgtgacctcttctctgacaaagggggtgtttgccagctgcagcagccactaggtcagcttggtcatggggtgggtggcatggcagggcagggcccaaactcgggagaatgggacagactgttatcactagggacctgctgttaccagggaaactgttaaaatgagctggttttcatcaggttattgtaggatggaatacattttttggagacaagaaagttttgtggaaacaggcatttattcacagatgattgaaagccatatttactggtgaaatgtatgtgccccgtgtttaaagtgacttgtggatttgctttttcttttttaaataggacattgaagaatcccttttggagccaggtactgataagagaaacacgacagttatggtttgaaagttttcacactattattttaaagctgtctatattttaagctgtgttatgatcttgtaaattgctctaatggtggacaatccagatcatacaaggatcagagattggaaacccattcgtatcaccagatctgtggaagagccattctggcttcttgaggtcaaatacatttggtgcaatgtagtagtgattcttttcatgtctaaccacgtagagtggcatttaattcccccgtccccgtgattcctccatgtgtttctacacatgaaacagatcttgtgatattttgctgcagtcattttgattaacgcagttaaggcaggataaagctgttgtcagggcacttaccacctgagaagtgactggattccagaagaggaaacagagtttctccgtgaaaattttcaacatattattccccttccggactgcgtttatctcccaccgtcagaagagattctgattttcatattggattgttctgttaaaagaaattcaaagaaatttggaagttgagctgtcattgaatggtgattgcattcggttcagcaccttggacattggaaaatcagtcagaagacccagacttgaacaaaaactcgaagaagactattgagaaccagccgcgtggttgtaggtgtttaaatctgtgggggccttttctcttccgtgtagcgtagaggcttacctagaggcggtcgcggcgcaggtagtgtaaccagtataactttgtgtacccgcgggttttccaatctctgtgtagctagcagttctcttcgtgttagtgtggcagccgtgccagttccacatttgtgattgctttatttccctggtaattaaaccttgtgccattctattcctgttaaatccgtagaaaatgagaaaatactcgacattttgggggaaacttgtaaatctgagccagtaaaagaagaaagttccgagctggagcagccatttgcacaggacacaagtagcgtggggccagacagaaagcttgcggaggaagaggacctatttgacagcgcccatccggaagagggtgatttagatttggccagcgagtcaacagcacacgctcagtcgagcaaggcagacagcctgttagcggtagtgaaaagggagcccgcggagcagccaggcgatggcgagaggacggactgtgagcctgtagggctagagccggcagttgagcagagtagtgcggcctccgagctcgcggaggcctctagcgaggagctcgcagaagcacccacggaagccccaagcccagaagccagagatagcaaagaagacgggaggaagtttgattttgacgcttgtaatgaagtccctccggctcctaaagagtcctcaaccagtgagggcgctgatcagaaaatgaggtttgttttttctcagttttagaccagacgctatctccttttcattggtcatgtaatgacacacataagctgtttttttctgcaattggccagccagactgacgaaattgtagttttgcttctaaagaatgtttcgtttctctttgtgtgtttttaatgggtgattcaattccttttctttttctcaacctaccatggttgtgttcttaaattgttaattgttatcttcagctaaatcgaattgacttttacaaatctgacattgtatttttggggtcagattttccaatataagcttgcagaggtgtctgttaaaattttatttcagactaattttctggtaggtattcagttttagcacataatcatatttttagttttgttctctttcgtttttttcctgtatgagtaacattaacttttgtctctagctcttttaaggaagaaaaagatataaagccaatcattaaagatgaaaaaggtatgatttaatttaacgtggtagggagccaggtatggttcccttattttgggaggaggggcctggagatatacacactttggattcagtaatttgttttgttatgggttaccggaatcaaccacctaatggtttcttgagagactagttttagaagttcgcaagcacctgcattttatgtttctcttgtggttgtcatctatgggatggtgaaaagcacattacaagaaaggaataattctgctcattgaagactgtttcaaggattttagagactgccgtcttggatgagatctgatcatcaaaagacatttcagttcataactgacatgggcatgattattccttgagtaaggaaactcagtttttgctgtccagattttcagccttctgtgtgttggcatgtgtgtgtgcgttaaattcttaagtcagcagttgggattgggcgtcgttagggtttttaaagagggctgcggtcttaagaatggttgtgcttcctgttaggccttggggtgatgcctaagaatctccctctcgtgccaggtcgggtcggcagcggttctggtcggaacctgtgggtcagcgggctgtcctccacaacacgcgctacggatctcaagaaccttttcagcaagtatgggaaggtatgccttcccttgcctcataccatccactgtgattcagagttaaaaaggaagctctgctgggcacggtggttcacgtctataatcccagcagtttgggaggctgaggcaggaggattgcttgagcccaggagttcaagaccagcctgggcaacatagcaagatgttgtgtttactaaaaaatggaacgacagcagcgaagctcgcccagtcttgtgcagtgcaccttgtttcctgactcacagtaactagggtgcggagcagggcaggtggttggtcatatcacaacagtgctcagaacagctgtataaacagcttctctctcaatgttcttggggttctttctaactggtctcaaagagactggtggtcttttgtcttgtgcaaaacttaaagcttacatgatgagatttttcccttaagaataatttgggaggccgaggcgggcgtatcacctaaagtcaggagttggagaccagcctggccaacatggcgaaaccctgtctctgctaaaaatacaaaaatcagccagccgtggtgttctgtgcctgtagtcgcagctactcgggaagctgaggtgggagaatcacttgaacccaggaggcagaggttgcagtgagccaagattgtgccactgcactccagcctgggtaacagagcgagactatgtcataaaaaaaaaaaaaaaaaaaaagaatgaagtgaataattgactttcatatcatttagcattttaagtatatagtctcataactagaacatgatcgtggttcaaaaataaatcactaagatgctgctcatgggggtgggagaaaaatagtacaattcagcagctttccaaaggaaggtgaggacaatttaaaatgattccactgtttgaaattaattaagagtcttctttttttgtttgtttgttgttctttttttttttttttttttttttgagactgcgtctcgctctgttgcccaggctgaagtgcagtggtgtgatcttggctcactgcagcctccgcctccctcccaggttcaagtgattctcgtgccttagcttctcgagtagctgggattacaggcacccaccaccatgcctggctaatttttgtattttcagtagagatggggtttcgccatgttggccagactggtctccaactcctgacctatgtgatctgcctgcttggcctcccaaaatgctgggattacaggcgtgagccaccgcgcctagccaagagtcttctggtaagcaattggcactgccctggtctcctgggtgcctctggggagtggcttccaagggacaaggttcggaccatttagtgtctggagggtgccctgattccaggcagagtgggccctgtctgacacagttttctggctacagaagccgttcctttgtctaggtctgtgtcacccgatcaggtgttggttaatgtttcattgcttaagaagcggacaggacccggagaaagcgtgctgttcaatttttctctgaacagtctgtgtgttcagcaagggcttaggaaattcttatagccatgaataacctgtttattcagttactttgttgacttcactcggacactgatgattaagcagaggtaaacatacgtggtcactgtcatcacagattttttagtctggcgggaaaaagaccatttaagaaataaacacatatgatgtgttgtgatgagcgtattaaggaatattagagcacgccgtcagtgtgttggggaggccgtgtttagatttgggaggcagcttcagcagagctcgctgaagaagtgacattcagctgaggcgtgagtgacagagttggccttacctgtggggctcagctctggacaaaaacagaaggacgtaggaaggccagaggggcaggacaccactcagctacttgactgaagtatgcagagcctccagggcggatggcatagctcagggatagggacatacaagcttagtatggtgcctgctctcatttgggttttgtctgtcatcagaagagatatacttgtaaggatgattaatttgatgggaaggtagaatgggaagtggcatctgtgtttctctcaggagagtcttctgtccctttggccctggacagattcaggcagagccttgactcctccatttgtgtggtcaaaaccaaggacgtcagatgggaacctcaagcttgtgggttccaccttgtcatttcacagttggggccatgaggtccagagacggggaatgccttgcttaggttgatgccctgagtcagagatagggcagagaccaggactcctgtgtcccggggaaatgtttactctgcgcgccagtggtggtgggcttggcgttagatctactgtcttgttctctattttctgttcatgtttgtttattgatctctttttcccatttatctgccttcttgtgggtcgagtcctttttatgactgatggcttatttgctctaactctgtgtcattgtggtttactgtaggattacagtacacatcttcccttacagtctgtctgcaaggggtgctctgttggtttcagcgtagtgcaagaactctgtgggaatatacttgcatttcccctcccgtcgatctttgtgatgttattgtcatacggtttacttctctttaagaagtcacccaatattttattggctttgacttgttgtggtttggcttttttgctttgaacagttgtgtttttttttgtttttgtttttgtttttgtttgtttttgagacggagtctcgctctgtcgcctaggctggagtgcagtggcgcgatctcggctcactgcaagctctgcctcctgggttcatgccattctcctgcctcagcctcccaagtagctggaactacaggtgcccgccaccaggcctggctaattttttgtattttaagtagagatggggtttcactgtgttagtcaggatggtcttgatctcctgacctcgtgatcctcccacctcggcctcccaaagtgctgagattacaggcgtgagccaccacgcccagccaaacagttatattttaaagagacccagaaatgacaggaaaaaatcatgttcacctcaccaggtgctcttcgttgctttttgttgtatatccaagttcccatcggagatcatcttcctccctcctgaaggaattgaatgtttcctgtagtgcaggtttgctggtgatacgttcttgtttcttttgcatgtcagaaaaagtctttactttgtcttcattttgaaataaattttcactgggtatagaattctaggttaatttaatctttgttccttcagttaccaatttgtgtcttttctctctctttttctgtggctgcttttaagtttcttctggtttttttgttttgttttgttttcccttagagacaggatctcactgtgtcacccaggctggagtacagtggtgctcactgcagcctcgagctcccgggctcaagcgatcctctcacctcagcctcctgagtagctgagaccacaggcatgtaccactacacccagctaatttttaaaatttttggtacagatgtggtttctctgtgttgcccaggctggttttgaacacctggcctcaagtgatctacctgccttggcctcacaaagtgctgggattacaggcatgagccactgtgcccagcctgtgcctggtaattttttactggatgttgtgaattgtattttttgggtgctagttatacttgtatctctacaaatacccttgagcttttttctgggacacagctgaggtactggacacacactaaggcagggccaaagtagccttcagtttgggctgattttgtctcaccactgggcagtgccctctgagtagtgggtctgatggcccgtgaattaccagcctttccaccctggctattgggaagagcaaaccatttgtggccctgagtgcccctccagtggttgttccctctgctcctgattgttccctctgctccttatgggtggtgctgtcccagcctctggtttcctcgcacacgtgtgcactgggtgggaggaaccctctgtgggtctcttcagcttgctctgcgtggctctgtgtggctgtgtcctctctgatactcagttccgtgatttctctctgtcttggtctcagaatctcagtgctgtcttacccatcccccattgcctgggaatctaggcagtgagcaggggcagtcagggagctctcagggattgttgtcttgggcagcctgatgtccaggatctgaaaactgtcgttgcctacgtttcatcacatttgttagttgtttcaggcaggaagacaatgcttagttctcccatctcagccagaagtggaagtcctttccccatggggacatttctgacagtccatgtctgtgtcagagctcttctcaggcccagctggagtggatgggtgcatttcttagtagccccacagctgtttgtgggcacagtggaaatagagaaaacaatgtggatgggtaggacttctggttattagttgtgagtaatgaagtttaatggttttataaccttgcatgtttgtgtgttttccttgtgatgacttatcttgtattaaaagcagttgtatttagtggctgggtgcggtgtctcatgcctgtaatcccagcactttgggaggccgacttgggtagatcacttgaggtcaggagttggagaccagcctggccaacatggagaaaccccatctctactaaaaacacaaaaattagccaggcgtggtggcgggcgcctgtaatcccagctacttcggaggctgaggcgggagaattgcttgaacccaggaggcggaggtcgcggtgagccgagatcgcgacactgcactccagcctgggtgacagagcgaaactgtctcaaaaaaaaaaaaagcaattgtatttggataggtcaggattaattagaaccaattcagtaactaaaatggaaaactaccatatggggagaggtgacaaatagtgaaaatgattctgattgccaggtaataactttagcaagttgtgtggtcatttgtatgagagagtaagagtgccctttttcatgaaggttgtcggggccaaagtggtaacgaacgcccgcagcccgggggctcgatgctatggattcgtcaccatgtcgacatctgacgaggcgaccaagtgcatcagccatctccacagaactgagctgcatggacgaatgatctccgtagagaaggtgaggcagttctcgtctatggtaactcgcaaatggagtttgcaagtgagaagctctgggccacacatcatttctgtctattatattttaggccaaaaatgagcctgctgggaaaaagctttccgacagaaaagagtgcgaagtgaagaaggaaaaattatcgagtgtcgacagacatcattctgtggagatcaaaattgaaaagtaaagtgaattttcaaacctcctcttggaatccctgggaggagggcacgggcagccaccatgggccttgaaaaacacgcatctgtccccacctgtacccacgcagccttgccagcttcctgctggagtctcagctgatttttgtgttctgctgccactttaatattcagcttttatttatttattttttggagacagggactcactctgttgcctaggctggagtgcagtggcactgcagcctccaccttccgggttcaagtgattctcctacttcagcctcccaagtaactgggactactgcaggcgtacaccacccagccaggctactttttatagagacgcggtttcgccatgttaccaaggctggtctcaaactcctgagttcacatgatttgcccgccttggcctctcaaagtgctaggattacaggtgtgagccaccacgccctgccagtcttcagctttctgtgtaaagctatttaacgaagtagcccatgtctttaagaagtggatacagttgatcctcagcatgtatttgtttcctgataactgattagccttttgaaaaaacagtatacacaaaatgtcattttccatattctggtcccttgtacagcctctcagaccttggaatcatttcctcatccacgttgattttcatgcagttctcacttattaatcacagcaactgtcatacacccagtttttcaaagataaagcatcatccaaaggaatttagcctggtctagtgttgcagtgaatgaccttgagtgagcagttggtgctgtgtctgacagatggcaaaagcattgctgtgtttacctcaaaattaaaaatattccaaggcaccctgtgagttcacagtgccaccctgtgagttctcacggtggcaccctgtgagttcacggtggcaccctgtgagttcacggtggcaccttggggtaccttggcgtaccttggcgtagtagttgggaaccatgggtctgaggttctatttttataaaggggtgatttatatctttaatcaaaatggaggtagggacagatctttcaagggaggtgtgggttgtttatatttttaacacaattgtaggcttctcttttgagaaggtagatttccgtgttgtatctgatcatggcagtgtctcagaaggctgagtgtctgccttaagtttacgttgtcaacgcagtttagagggtaaacatgtctgtggacatagttgaactgggtttttgaagatgtaattaccaatttacatcatggccaaattggaattattatttttaattggaattattatttttaaaaaacattttactttttgagacgggtcacccaggctggagtgcattgatgcagtcatggctcattacagcctcgacttcccaagcccaagtgaacctcccacctcagcctccctagtagctggggctacaggtgtgggctaccactcccaggtaatttttaaatttttgatagagacagggtcttgctcttttgctcaggttggtttccaccctggcctcaagcaattttcccaccttggccccacaaaagactgggattataggtgtgagccactgcacctggccccagattgaaatcagtaggcccctgagtaatgagtgtcagatgagccttcatgaacttggaggaggggggtggggggggcggtgagccctctaatttaatcagcaacttcaaaaagacacatcccatcagcattgctaagaaaaaaatgtctgtattggtggaagatggggaactgttgttgcaggtttgcggtgttcttggtatcttgcgtgtttcattaattgtttttctgtatttgtgggaaaggcggtaataattagctaacagtatggtgtggtcctgtggccagcactgggaatgcagcagtttccttggtccttgtagtagccctgtgaggcacttgctctatgtaggagaggatacaggcctagagaggggagcgcgccctgcctgagtttgctgggaaacggcaaggctgggattcaacctatgaagtttgctcggagccccatggctcttaactgggtgatggacttaagatttttttttttttttttttttttttttgagacagagtctcgctctgtcacccaggctggagtgcagtggcgcaatcttggctcactgcaagctccgcctcccgggttcacgccattctcctgcctcagcctcccgagtagctgggactataggcgcctaccaccacgcccggctaattttttttgtattttttagttgagacggggtttcactgtgttagccaggatggtcttgatctcctgacctcgtgatccacccacctcagcctcccaaagtgctgggattacaggtgtgagccatcgcgcccggcgaacttaagatctttaagaccaaactgcatgcaggttgtttgcctaggaggttgagcatttaaaaatttgttttgaccttatttttttcttcaaattaacaccttcattagccttcccttccatttgaaggatttctagattagtggttggccttgtgaaatagagaagctttccaaagaggggaagaagaggggctagcctttgccatcttggatgagtggtggtttttatacagttgttatacagaaagcacatgtaaatgtcaggggtaatcccaacacctagggatgatgctttttgttggatatccttccagtcttttttccagcatatatatttatctactggaaggaaagcagatgaataaacacagaattttgtgcagcaggtgaaaggagtcagaccctttttattccccctaagttctgtctcaggatctaaaggtccttcttatttatttatttatttatttatttatttattttgagatggagtctctctctgttgccaggctggagtgcagtggcgccatctcggctgactgcaacctccacctcctgggttcaagcaattctcctgccttagcctcccgagtggctgggattacaggcatgcgccaccacgcctggctaaatttttttgtatttttagtagagacggagtttcacaatgttggccagggtggtctcgaactcctgaccttgtgatccgcctaccttggtctcccaaagtgctgggattacaggcatgagccaccgcgaccagcctaaaaacccttctttaaagcataccatgaggtgacaaaagtaagcagtgtatgaagtatggcctcgttcgtgtcactcctaagacattcttacaaaatgtcactgtagattactgcggtcaggcagacccagtgattgacactaaggccaccctggtggttgtcgcagggatgagggagaggagatgagatgatttacaatagtcagttctgggatgtaccattaattactatggtgtgtatttaaaatttttctcaaaatggtatatatatattttttttaaagacaactccatgatgtggaggttgagaagggcagaggagacggggcaatcagagaggcttccctggcatggctggagctctgccgggaaccctgcctgggtcggttggaggagaggccaacaggtgcttgctggagggccttgcaggggcctgactttcctgcctggaccctggcatgtcgttggtgttgagtcggtgtgcagtttaattgcctgagacaaatggcattagggaacgcagcagctgagtttgagtggcgaagatgatttatttcactgcttagaagaaagttgcctttggttgaaatggcacttaacaccttcccgtattcactggcacataacacattattttaactccctaaaagtatgcagcagttaccggtcgaggggtgttggcctcacgggtaaatggcctgccgctctgtgcagtgggggcttggtgtcctgccactgtgcctccatcccgttgaggctgtattgggaagaaatgcttttccctataaagcttataaacaatgttccacacatacatgatgaaacattaaactttttagaagtgttcttatgtagttggcgtgtttctcatgtccacctgcacaccactcttgcgtgctagcctgtctgacattttggaaacgcatccccaggaatttcattgtgcatatccctcaattcagcacatactagaagtgggaatacagcctgtatctaaagaggagtattgttattactatgggttccaaataatttttcccacctaattgctgccggggtgatttgttttgtgtggacgtctgagtatgtgtgagtcgaggctctgggtgagccgttcctgttacagagtcttgtgaactcaaatttgataaccatgtctttaaatagaactgtaattaagaaggaagagaagattgagaagaaggaggaaaaaaagcctgaagacattaagaaggaagaaaaagaccaggatgagctgaaacccggacctacaaatcggtctagagtcaccaaatcaggtgaggagagccttttaagagctgtggaaggggaaggcctggcacgggtggggagtgggggttccgagggaaggtgaggacagcaagctctggtgacatggctgtttcgctgttcatatggcagtgttaaagaaacaagagtctgttgatgaaatggcttaaaggagtgtccatacaacatcgggaatccagaagtgcctgggactcagggcttatgtgtattgctgaactcagctgcctgagtttgggctttttcagggcctttggctgattgtagtgtgggatttgcaagagtgagttgtccgagtttcttgtaactaacctgatgctattttgcaggtgtgcagtaaagttttcccacattatgttaaagctggaggtagtaaaaacacagagaaaaatgaaacctccaagcatctgttgaagtggttctgtttggacgatgccacttctgttgtcattttataaaggttcattgtgctttacacctttgaatctgtatgagactcagaatgtttagtggcaaaaaaaaataagccaactccacctcccccatcaaggaagagaaaaacagagacaaaacccaaccatctggagcattgaaatttggtacagcacattacaagctggatcttcagctctcgggctaatttaccctgagtctcacgaggaacgtgtttttaaaatgttcctcaagtattataaatctccccaaataagtcattgttccagtggtttatgcctggtggttctgtcgtcaggagagataattggtttggaagcctttattgctggagatgaatggagggaagcccacccgtctggcaaggcactccctcagagtggcagtgtgattcctagcacaggctggatactgcggagcttcacagaatgtcagggaggagtgacagcatagaccagctccggagctgtgtgggtttagagtggagggtcacggagggctctgcaggatggccgtgcttgtgtgcgtgctgcaggtttaagctgtaggttgggaacaggtccctctagttgtgtaaagagctgtgagggtacccccatgatgctgtgcccgtgttaccgtgttgctcacaatagatgagaattagaggctcccaaggctagtgtcagtcacttgactcacgccttgtgtgttcaaaagcccagggtccatcagagtgctgtttactgcgggaagttggggcgtccacaggttttgatagtttgttgtgttttttcctgaaggaagcagaggaatggagcggacggtcgtgatggataaatcgaaaggagagcccgtcattagcgtgaaaaccacaagcaggtccaaagagagagtgagtattgcctctgccatctcagggccagctgtttctcacgatggctccacggcccgtttgatccgcattatgaaaacagcactgttttgcctttaaaattgaagtttgtaggaggcgcgataattgtgtagattgcggatacagacacacacatgaatcctggtgctttctgcagagcagtgcccatccgtgtttgcttcccttactggctcctgaccgggatgtgccgccttcagacagagcattggttcacacggcagctcaccatagggtgggatgggccagacccaggcttttcgagccggaaggcaggtcctactctttggttgacttaatagcaggctactttcttccattggttttttagtctcctattaaattaaccaaaaaggtagagaccaacctaggacagagagctggtcatgttatcagatcaagagctgtacctctcgagttgtgcacacaactagacgaaatagcgtctcatttgcgtttttcactctgggaaacaataaaaacctctgcttcccagctgcaggttctagctaagatattcatgaggtgacagtacttttttaacgaatgtggagttcaccatattcagccaggaccactttgtgttgttaagacttaacttttttttttttttttttttgagatggagtcttgctgtgtcactcaggctggagtgcagtggcgtgatctctgctcactgcaaccactgcctcctgggttcaagcgactcctgcctcagcctctcgagtagctgggattacaggcaacaggcacacatcaccacaccaggctaatttttttacttttagtagagacgggattttgccacgttggccaggctggtctcgaactcctgacctcaagtgatccacccgcctcagcctcccaaagtgctgggattacaggcttgagccaccgtgcccaaccaagacttagtttttaaaatgaacatttggattttataaagtatcagttcctaatgtcatttttcacatgaaaatcataagatacagagaaatgtagagtagaacattgaaaaagacccatactcttacccccatgtaactgtgatgttgaaaacaagtagtgatgacacatgcatgattagaacatctggtcagcttgaggagatgcagcacgggcatactaaagcctccgtgtgtccagttgggctcctcggcttcctctgcacacacgtcccctgtgcctgccatgggaccacagacagaggatgtgctggagcttgcactttctgtgtaatatgccttggaggtctctacatacagacacatacggtttggcttttttcctttttgcttttttttcttttcgcttttacatatattttttattttatgcatgatatttacctattaaaaaaaataaagggtgggagtgtctcactttgttgcttagcctggcttcaagtgattctctcgccttgatcttccaaacttgctggattagaggtgtgcgccaccactcccagcctcttttaacgtttaaattttgaaataaagtgctgttcagaaaggttgtggaggggacttaaatctcctgggtgtgttgcacctgccaggtcgctagtaagtggctaagctggcctgagaacccaggagtcccgtgctgacactgttgcctgctgtgctgcccactgtgcggtggtatgtgggcatctgtcaccttattctactgcagtgtgtgtaagacatctgcccgtctcgtaggcaaagcttgccatcaaagtgctgggtgatgtgtgtctctcctgtgtctgtgtgcccctttctccccagcctgcattttattaataattggtgtaatgtctcatcttgacctttgcctgtctttctgttgggttggtttgtttttcattgctcgctctttctctcctatgggggctaattagggaaataaactgagtagctttttaaaaatgtcatttcccaggcccctgccccagagattctgtgtggatcagcaggaggcctcaggttctgtgttgtttaaaagcttcctgggagggtctgatgtgtagccagtttgggtgaggggccctggagaaccttggaaatgggagtcagttgttacagctctgagctttatgccacagatagaaaatgatgaatgtaggctgggtgcggtggctcacacctgtaatcccggcactttgggaggatgaagcagcagatcacttgagctcaggagtttgagaccagcctggacaatagggcgaaaccctgtctctacaaaaatagaaaaattagtcaggcatggtggtgtgcacctgtggtctcagctactgaggaggctgaggtgggaggatcacttgatcctgcagtgagctgtgactgagccactgtactccaggctggacaacagaacaagactgggtctcaaacccaaaaaacctacaaaaaataaattacggaagttggctattagtgttctgtaccttattaggagcactgttttgcattaaagcattttggcatattctctttatttatttgagacggagtcccgctctgtcacccaggctggagtacagtggcgcaatctcagctcactgccacctctgcttcccaggttcaagcgattcttctgcttcagcctcttaagtagctgggattacaggcatgcgccaccacgcctagctaatttttgtatttttagttgagacggggtttcaccatgttggtcaggctggtctcgaactcctgatgttgtgatccgcccaccttggcctcctgaaatgctgggattacaggtgtgagccactgcgcccggcctggcatattctatttagagctgtctgcctgagtcctgagccagcagttgagatgtgaaacatgtagtctgccctccagctgtccaaacagctggcctgactgctgtcccctctgaactaatggccacagtggccctgtgcggatgtgcccgtggctctgagaggcctaggtttgctttggattatgtgagtccttggctgtgctatgctagaagaactgtgcctgtaggttttctgaggcgtgggccaacctcttctcttccatgaatgccccttgacatctgaaagcaggattctggattaggcagtaaaatgcaaacttggagggaagcagcctatgcctgggcctctggtctggagaccacagccttccatctacaccatgtggggccagagaatcttagtctcatgcacacgtgcataatctccattgtttgtttgttgcaatcattttcctgacattaataaaccagttttggtaaacagagctccaagagtcaggatcgcaagtcagaaagcaaagaaaagagagacatcttgtcgtttgataaaatcaaagaacaaagggagagagagcgccagaggcagcgggaacgggagatccgcgaaacggagaggcggcggtgagtggagctgggtgaggctgtgggctggtggtttcctctcggggtggctgtccttctcccagctgtacttggagtgcgcagtctgtgtgcccgagagccagtgcctgggctggcgggtgtcgtgcttaacctgggtcctcgaggcaggggccagcacctgttcacacgtgagccgccagacatgccaggtggcatgaaagtcatcaaagggccaggtgcagtggctcacacctgtaatccgagcactttgggatgccagggccagaggatcccctgaagccaggagttcaagaccatcctaggcaatgtagcgagaccccacctctacaaaatatttaaaaattagctgggcatggtggcgtgcacttgtagtcccagctactcaggaggttgaggtgggaggattgctggagcccagaagctcaaggctgcagtgagctgtgatcacaacagtgcactgcagactgggtgacagagtgagaccctgtctcttaaaaagaagtcatcaaagccctttacagtatatggggtttggctatgttgccaggctgataactgctgggcccaagcgatcctcctgcgtcagcctccctaagtgctggattacaggctgagccttctgctggctcaaagtctattttcgcccctcctctgatgttggaccttggcccgtgtggaaggcccagccgtgtgtggctttgatgggatgggatggtgcctgggtgctgaggcctgtcttccctgttgaaacctttcacctaaggtcagaaactgcaagcagagtccagttgtcattttgccgcggctcccttctgggctgtggtcttgaaggaggcttgtccctctgccttgacattcggccttttcatgtcgggatgcccggcgttctcttgtcacttttcctcaaatattgctcagtaaagcaaaagctgtgctcacagcatttggaaaatgttctcgagcaaacctagaaatgttgccagctgtgctgcctttgcttttcttaaggtagctttgttaagtaaggtaaccccctgcacgcgcagctttagggaagcccggtgagcttttggatccattttttttttctgcttccaatacacacccagttttgggcaccgggctttctccttggaggctcacgcagggagttcagggcagcctcacctgtccccgcagggagcgcgagcagcgggagcgggagcaacgcctcgaggccttccatgagcggaaggagaaggcccggctacagcgggaacgcctgcagctcgagtgccagcgccagcggctggagcgggagcgcatggagcgggagcggctggagcgcgagcgcatgcgcgtggagcgtgagcgcaggaaggagcaggagcgcatccaccgcgagcgcgaggagctgcggcgccagcaggagcagctgcgttacgagcaggagcggcggcccgggcggaggccctacgacctggaccggtgagtcccgcccagagcgtgggcaggacggagaccagcgtggcagcggtgttcacccttccagcagaacagcggcttcccttccgtccctgtcggtggggagaatgaaatttgatatggagcatgcgccttggggaccccccgccgatctcactgcgctgctgcaggtttattagttcgctgtcctcaccggaggctgtgtagcatcttcctgaacttgagttattctgggaaacttgatggctgccacttgctgaagggtttgtgatgcttttcctctccacttacccgtggagcatagctgttctctgtcttgcgagacaaccgaacgcccgttaggcccaagttggccaccgctgactctgccggtctcatgtgtccttgtagacagagaggcagagcaggcgctgtggaaaaggaaattgcctctgatttagaaagtaggtttattggtctctagctaccccaggcggcttaattgacagtcacccttcaccccgctctccgtgagcctagttttctggtaaaaatcaggaagaagataattggatgccgtccagagctgtgtgtagttcactatcaccccatctaattctctttgcttttgcaagaaactcagagggagattcaggctcccgtggaaggcagggaaagtaaaagtgtggcaactcgaatgctattccagaagaatcaaatatttcttttcagttgctcatgaggggggatcaaggtaataacagcctcacgagacaatgagctcacagcagtgctccttttgggactgttggatgagaacacaagtgtgcctctcggctgttaatggcggttttaatttatcagatcaaagcaatgatgatcgaatgtttagagattagccctgcaggacattttaaacgatactgggtctggggagagagctcccctccccacctccacctcctccttttttcctcctcctctctcattaatggaatttgtattcttttaaaataaaaaccaacagacgagatgatgcctattggccagaaggaaagcgtgtggcaatggaggaccgatatcgtgcagactttccccggccagaccaccgctttcacgacttcgatcatcgagaccggggccagtaccaggaccacgccatcgacaggtcagtggtcttgtcccctcctttagctacagtcattgtgggcaccggggcatccagctgacctcgttctcagcccagtgcaggggttcctgtgtgctctgaagcctcgtttacttctgagatccacagtggatgactctggccttgcacagaacttgagcgagttgctggaatccccagcttacctcagaggaaggcatctcagagctcattccatccaccgactcttttcataggtgggccaggaggggcctgagtgcaggccatctacactgagctctcttgtgaggcagcagtgtttgtcagcacaacctggttgtgcccaagagctaccagagaattgatggaggacgtgcaaaatttctcatgaggcctgttttgtatttcgagggtctgggtgggttttttagccttttaaaatgaggaatacatctagtttattaaaaaggcagcccttggttttccagtgtaagaatcctgtctttgggctcccctcggctgcacatctctgacccatttccccattcattggctccttcagtcggaatgtcagagcggggagaacaggaaagggaggctgagaggccacactcttaattctgctggagtttggggtggagttggtgtgaattttgatgagtcccacgcattgggtcagaccaaagatgagggatcattggaggcctctgtttgtccctgttcccctaactgagagctccccgaggaattttagttcagtgagatctttattcctacctctttaggatccaacttcgtttctgcccccggggaaaagcctttcgatttgagctagctttttccttttttcccaggccagttatagtttttatgtgatgggatggaaaaagtatcccagtcgcgaaacttgcctgacctgcagaaatgtgtagtcgtgcctggtgctgtttgaacgggatcttttccttttgcaggcgggagggttcgaggccaatgatgggagaccaccgggatgggcaggtgagtagagccccgatgccaagccctggggccactgtactgctgtgcaggcatagcggaccatttctagccaggcggccgcttgatcccagagaggtggcaaccaagtcagcacgtgtggcgggtatgcaagtgtgggttctggccagcgactagaagtacaaatatttagtcggacgtggtggctcatgcctgtaatcccagcactttgggaagctgaggtgggtggatcacaaggtcaggagttcaagaccagcctggccgacatggtgaaaccctgtctctactaaaaatacaaaaaattagccaggcatggtggcgagtgcctgtagtcccagctactcgggaggctgaggcaggagaatcgcttgaacccgggaggcggaggttgcagtgagtcgaggtcgcaccattgcactccagcctgggcaacaagagcaagactccgtctcaaaaaaaaaaaaaaaaaaaaaaagcgcaaatatttgattgttttgtaatgctcaagtttctgtcattttcaaatatgttgggcttgttcttcattgtatccggtagaaacctcatgtgtctcttcattgtccacttgctcagggagcctttgggtcttagtgcctgtggggtcccccaagaacccaaatggtggttgtcgtttagcccacatgtgccagggtcggggggatgggggagcccgggcttccccatgtttcaagtccgtgcttggtgggcacggggggctgaagaccacaagaatggtccctgagtctctgtggtgccatgcgggtgccccgtgcgtggtggcagggtgtgagttctgagaaagcagcagcctggtggagaggtgggaggtgggcggcagagtaatggcctgtaacagcaggcagcacccgcctgcttcctggctgctggctgctccgtgcagagttggttggccagggaggccggaattgtggccctgccagagcacaggggggctgacccacccgagggccctcctgttatcggaaaggaggcggcgcccaacttctcagggaagacagggtttggtgacgtcttagtggatcttgagcagagctgttgagggcagtaatgccagggtgccctggctcctggggcagctcaggtggggcagtgatgcagctgtaggggtgcgaggaggggagccagggagcagagggtcagtgaagcagggcccagcagggctgagactgcacccttcagtcctctctcagctccgccccacctgccaccctggggcctgcagtggacaggccttccggaaggtgggcctatgtgggtgacatggtcagtgtcaccctgttcctctcctgccttccagcactatggagatgaccgccatggccacggaggacccccagagcgccacggccgggactcccgtgatggctgggggggctacggctccgacaagaggctgagtgaaggccgggggctgccccctccccccaggttagtgggtgagccccagccgggtggggagcatctgtcctaacctgggaaaaggttggtgcctggccaggcacgtccccaaggtttgattcagctaggggagctttaggatgggctaccaggggtcctgccatttgaaacccctgactcagaaagtccaggttctcaagaagaaagcatagaacaggctttcagggatggagctgtccaggtcgcccagaatggcccatccccattcttgagctgggggtcgcctgcagttgtgaatgtctcgatcatgggctgcgtacacactgggagagacagcgctgaagctcttagtcctgccccgtccgtggtagagcagcctcgcccctgcctccacgttgcctcttgacacgtgtcttcctcgggttttttctctgacccccagttggtctggggtggatcttctcaaccctatcctgcctattagaatcacttaggaggaccctccacccaggactcagggctgaggacactgggccaggtcctccacaggtgtccaaagccaccttcaccagcactgcagtgggggtgctgttctgagccttgtcagcattggtggggggcagggcttgtctgggaggactctgggtgcctctctagtttctttggccagctgcagtcacccctgcctgtttgtcctgttgccgtctgggctggccgtgaggaggctggtggcaggactgctttgcggctgctgccctgctttcctctgtgagccgagtgtcctgtcttgtctccagccctggcccagggctgcctcggaccctgcccagcgccacagggtgggttttggccccctgtgctcccccgttccatccctccctccgcgctgagaggcacttccagctctgccagggactttgactcggtgctgtgccgagtgtcccaggacacccgaagcttctcctgaatctctgggcagcacagacggtggcagtgctctgatcagttggtgtgaagtgttctctcctgtgagacttcattagcattcctgtcctgtcgcttgctgggtgttatggtaaatacctcgggagtgtaaacgggaaactcacccatggtgagcagcggctgggcgccatcgggtcaccgagggcaggttccacacgggagctttccgctccctccagggcggtattgcacttgcctggcagtgcgcgctgggggctctggtggcccctctcgggcctgtgggctggctcacttggcctgactgtcactgcatccggcaacccacagcaggcaggcactcgtgcagatgggtctggctgctttcctgcacggccactgtgactgcttggccacttgggactcaggacactggactcggattttcatctcccagagtttgtctgaaactttaaacaaatagctttctttaagtatagttcacacgacacacacttcccgtttcacgtgtgcagtcagtggaggtttgcgtgtacgtggatctgtttagccatccccacggctgattctgaagcattttcatcacgtcaaaagaaaccctgccccttttagcagctgcaccctcccccctgcccttggtagccacaggtccctttctggctctggatttgccgtcttgagtcatttcttggcctgcgcggtgtgcctgctgggcctggcttctccctaagccttgggtattcagggctcatctccacatgctgcctgggccagcgcttccttcctagttagggctgaacattccatggtccagacacactacatagtgttatctgctcatcagttcatgggtgttggggtccttctccctttggctgttaggaatcctgccgctaggaacattcatgcacagatgtctttggccatgttttcatttctggcaggtaggaatgggtttgctgggtcatggtaattctgcgcttaactttttgaagaaccaccaaacttttccacagtggccacaccattttacatttccaccagcagtggacaagggttcttccctttcctcgcaccctccacggtgtgtgttattgtgtgattctagcatcccagccagggggaggtagcatctcggtgtggctcggattggcatttctgggtggcgttgagcaccttctcacgtgcttactagcacatctgtctttggggaaatgtcccttcccttgatttgcccacttgacatgcagcccttgttgtgtggcatgacccaccatgcagctgaggtcagggtgggtgcgcctgctgccgacacaaccctggaggctcattagatggctgcatgtctttttcttttggcaaaggggtggccgtgactggggagagcacaaccagcggctagaggagcaccaggcacgcgcctggcagggtgccatggacgcaggcgcggctagccgggagcacgccaggtggcaaggtacggggctggctccagggacgagggtggctgtggcccccacatgtgtccaggggcttccccaggaacggagtgtttgcagacccttcttctcttctaggtggcgagaggggcctgtctgggccctcggggccggggcacatggcaagccgcggtggagtggcggggtaaggtgtgtcgtccgtggaggacggtggttcactcctgctcctcacttcctctcccttttttgcatgtttgatcagctggctgggttggatgttatgaaaacaaagcaaaaagcagctctttgcaatttatgcaaataacgctcttgagttacctggaatacaatgtgcgatgatgatttttctcacctggaaaaaaaacccaagcgctctaaaggctgcgggaccgttactgaacccatgttacgatgaaaacgctgagcacttcaaggggaaaaaaattgtctgactttgttcctaggcgaggcggctttgcacaaggtggacattcccagggccacgtggtgccaggtggcggactggaaggtggcggagtggccagccaggaccggggcagcagagtccctcacccacaccctcatccccccccgtacccccacttcacccgccgctactaagtcccactcgctgcgagttttcgggtgggcagacgcactgttgaatctggtagccagggttccctcgaacttgggggatctttttaaaagcaaagtaaatcctgccaccatgttgtagctcaatacaatgtgaactcactttttttttttttttaaataaatgtgttcttgttctgccatttttaaatcaaggtttctgttaacgaggcattccattttccattaataaagtttaccattcgcagtcttgcgtgcgcgtgca

SEQ ID NO: 12574 - DNA, 104 bp, Homo sapiens
atttttgtatttttagtagagacggggttccaccatgttggccaggctggtctcgaactcctgacctcaagtgatccgcccacctcggcctcccaaagtgctgg

SEQ ID NO: 12575 - DNA, 3345 bp, Homo sapiens
cctttgctagacctctttgatgttttcttgtttccctcggaggtaatttcaatttcgtcaggattaccaccttcatcttcaattgcctaaaaagaagggaaaagtaaagttgatccaaaaagtcagctcacacactgctttcagagagctctcaggtgacaaggaaactgtatttttaagatcaaaaagctgctgccgccctcaccacccaggacctgtggcccatccactcatctgttatctcgctctacactggagaccgactgacgccaccagttcttagctgggtggtcccaggcaggtttacttaggtgctcagtttttgcttcttcctctggaacatgcggctaataataatacagtacttaccctggaaggctgttgtgaggactctactagccatgaaaaggaagcactcaacaaacagtaggcttatctggttcatctccttcctaagcccagaagaactcaaaaagggaaaggcacactctccatttcccctgactttactcacaaaatactctttaaccctccagggactccctccacgccgtgcctgtactcagtactgtgtggacagaatactaatgctcgctgactgggatcctactatgtgttacgcacgagacccgtcacgacatgcatgacctcatccgatccccatcatgtacattcacaaccgactccagtacctcattctcaaccactaggtgattgtgcctcatcggatattgaattataagaatttcttggcacgcccagcctcccaccccaggactctgtcactcacttcaactatgcccatcctcagcacagtgcctggcatcaactaagccatcagtaccgaacacgtcaatcacgatgacgtccctagaaacttagcttcaggtcaagttttactgataacttttccagtctttactctccagtcccatgagcacaagttttgtttacatcatttcatgtactatgttttatctgcagaggtttggaagcctccaagtttcccaggtgggtaagtctgaattgagatagggcctgggggttccacatctcatctttaccagcagcaacaaaaatctctcctctcagaagccagaaaagggactgaagttctttcctgggatcaaggaaaagtacaatcaccaagtccctcacccttttcccggggacaggcaattctgaaacaccaccaggagaagagaagcaatgccctaggcaggtgtcctgtttcccctttttgttcttttgcccttcctggaaaaataaaccaagaaagggacaccaacaggatgacagaaacgggaagagaatgagatcaggaactccagactggcttgggtgagtggcagacagggatatgggctggcggtattcgtgttttgggaccacatcttgaagaaaatgaaaaggagaaggaagaaggaacaaatctgtgctctcagagatgacagcgagtgatgggaagtctcagtcaccagcttgacaggaagatcacagcagcttttcaggcctatggaccgtccagggagaaaaaaaggataaagcctcttaatttggcttagctgatgggaggccctggtggcggggcaccacacctgaccagccgccaatctccactctctgcattttctctgggtaaatatgtagatcagtgggcttcctgccttatctgagtaaagagaatccatagtgaaaagaaacacaagcttgagcttttaaaaggcccatgtgactctggccgagacaactatccacccttgagcccagggtttctcatcaggaaaaaaaaaaaaaaaaaaatccctacttcttctcatcaccaattaataataaagccctgtgatctccgtagttccggagtcaggatggtgggatgtgtcaacagccccactgcctgcaggggctggggggtgggcggccaggcggagcaactacaggggagaggtcccagagtagccaggtggaaaaaaggcagagaaaaaaagctacaggaataaggaaaccgcaggtggctaacctttacttgcctctctgcttttcctagggatccctttgaatcccccaagggaggcgttagagcccccgatctgcaaatgaggactcgtggtggcacagagaggaaaagcgaatcgtgatggcaaccacacaccgagtgtttacatgcgccaggcagcacgccaagcctgctccacgcaaacttatttaatccccaaatcaaagtcctattgcttttttgcttcttacaggagaaaaaaaaaaaaaaagaatagaaaagaggactcagaaggggttcaaggtctcctatgcccaagatcaggccaccgagagctggcagggtccccaagtccagagagactgacggagctgggggagcccaggctctgcccgcctcccgggcagttctgaggctggttttaaagtccacccggggtctcccctcatttcacatttctgatcactaccgtcaacaccacttttccttcctgccacgttacttcaccgagcgagtaccggcaaaccgtgaaaactggattgtggtgggtttttttctatttttccctttgagtatgtcctacgggtgtttcctttgtaaatcagccccgattcaggctggtcggtcccctgtgggtcacaaagcatcttccctggggaaaccaagcagccgaatcaggaatcccagggcctgggttcaaatcccgacgctgcccgtcctcggccgtgtgaccttggccgagtcccttcccctcgcctgggaagtgagggtttcagggtctcccctccaggtacggaggaggggacgagacgaggggagaaccctcctctcagtggacgatgtcacccgtcaccgtttctcctgcacgcgtgccgtttttgtggttctcctggccccattgcggcgttaggatttgaacccaggcccagccggccaaggaactctctccggggcctcggaggagccgggggacgcgagagcgccaggtccggcgaggccgcgaacgcggccgggggcggacgccagggcccgcgagccaccgtcgcggccaagaggaccccagacccaccctgtgcccgccctcggggccccaaatccaccttcttcagccgctccatcaaaacgctcttgttgccgctcgagtccacattccgtttcctcagctccgcccgcagatcgatcactcgcaggtcgctgaggcgccgcgtcccggtctctgacgaggcggagctcagagccgccgcgcccgccgctccagaatcacctaggcctgacagagtctccgccattccagggaccctggctccgccgcccactttccacagaaccgggccggttttatcaggctc

SEQ ID NO: 12576 - DNA, 10680 bp, Homo sapiens
gtctttggctttttttggcggagctggggcgccctccggaagcgtttccaactttccagaagtttctcgggacgggcaggagggggtggggactgccatatatagatcccgggagcaggggagcgggctaagagtagaatcgtgtcgcggctcgagagcgagagtcacgtcccggcgctagcccagcccgacccaggtgaggggcgggagacgcctgcgtgcgtgcggcccgggggagcgccgagcaatctgggggtgcgcgagggagtaagaggggcgaggggaccctgcgaagcgttgggtgccgagccagagcctacaaattggagtcctcggcactttgggggccgctggagggtttggaatcgagagcccagggctagccagtgatggtgccagctgagggctagggcggagatcggagccgggttgggagtccgtgcactcggaggactgggaaaaagtgcagggacccctaaaaggtggtggtggcagatacgagactaggtgctgtgtaaagggggctgggggcagagagcagagcctctgcggaaagaaacagaggaggaaggagatgggtctggtgcctcttcccgcaagggtagggaggataggccggcctcgcagttccaggtcacttccgttctggggttgaggctcaggggcagcggtgattggtggcccagcctcctcacaggcttgctgagggaatttgagcttccggtggtgggaaaggaggtgaaatcgtctcgactcctggggtccgtgtgctctggtagaagtgggcgacagtggctcaatttctgatcagcagcttgcagcctagatgatggcagccaaaggaaagacttggccagcgaggctccctaccactccgaaaaaagagagtgggggtcagcagggtctgctctgctctggggattaaggggctgactagaaggatttgagtctttccttctgtccactgccacagggttcttggagtaactgcagggtttaaactgcagggtctaacttccagaggctggggttccctgccccccagcttagagacattcctgaggtggctgaagagcaggaaggagaatgaatgcacttccagactggcccagagtctcagcccctcctcttccttgtttcccgctggtccctctgggctgtacggcccggatggaggcctgaggaaaatgagggggctttggttctccggaattccggccggggccacaccctcctgtcttcagatggttcatgtacccatccccccttcccgtcctctcctttgtctcctctgtcaccgggactcccagcagagattttttttttgtactggctgtgtaacaggacaccgcatgcagccctcaggaggggctctgtgcttctgtgaggaaggacccctgtgctgggaaggcagacccctgtttatcccgagggacctggggtgaccccctgccctggccttgtttctcccattttacagtgaggtggtcgatctccaaggtccctgtagattggggactggttgtgccctctgcgccaggggcctcctcaccatctctcctttgccggctcccgccctcttcactcttctgttttctttcagaatgaaaaaggcaggcattgacctccctctgaggcagtttccaggtactttagacctctcaagtgtttgggaccctctggtggggtcccatcatctcctccccttcccttccagaccctgctcagtccagctagctgtgggcacagccctggctaggtgatcttgtattttctttgtgggactgtaactcagctaaccttggcctgagggctggcatttctctgtggcaagatgggctgggctgtgggaggctggcctgcttgcagtaacttgccttcccccattcctgctgctgggttcagtggggctgcccttctccccagtagcgcatttcccttcagagattcatgtgcggatgggaagggaactaaggccaagaaggctcctggagtcccctggcaaatatgtggcaccccctgggacctgagtcaggcctgcttcccaggctggaagcccccctctgccggccggtggagatagttcagcctcctgcctgccacgtcaccaccaggagcaggcgctaagctgctgcgggcctagcgggctgcctgaggaatcccaaaccagttatttggagcttgcttgagaagcccctcccagtcctttgaggttctggctggtgggggtgggggctgtcaagatggtacctgccacgtggcatggctgggagtgggctcttcagctgcctcctcagggaaggaaggctgttggcctctgctgtggtctgagctccagcatcactggtctggatcagaggtggcttttgagtagggtggccatatgcctattgtcctggcataataattagtagtgcccattttactcttataagtgtccttgtttgtgcaataaattatatggttgctctgcctttgaggctccagttctggcagggaaggagccagagctgggagggaggtgtcttggggtttattctaggccccaagatatccccttcattttagggtgagactcagatctccccgctccttccagacatttttagatctctgggccttccctcctctccccacctccctccccttggaccctttgcttatcttatactgcaccttcaaggctccgaggagggaggcagtcccgggagatggggagcctgtccaggtttttgggatggcagcagtagaatcttcccagaaatacagtggtccccaggcagccagagtcctgagggtcttccaccaggatttcaaatgttcggtcttcttcaaggatgactacaagttgggatctaccagagcagtgggatcgcagcctccaccaggattccttctatccttccctttgccctgtcatctctcctgtgctgttgcatgatgtagaggaggataatggcccgaagggagagagggagtgtggaagtatcccaggaacagagactgtccaaattggaggccccagagagggaactggggcttgtccttggggccactgctactgctggggcttggggaggaggcctgagggcaaccctgaagccgtggagcagatggcctgtgtggcagtggctgtcagattggagggcagaatggaatctgatgtggctccagcttctttgaaggctgagtgcacatctggccagctgctggtgatggggaagggggtcactgctctattgagctatgtgtgactcacccttttccctagtatcctgtccttgtgctatgtcaggaagcctcctccccagccccaccgagtcttcaaaggagttggtcccccaggagcttttgtcctggggatttcccatccgcactgggagcactgtgggtagatgggcattccaagttcctgcccagacagaagccatgggcatggagacctggacctttcagcttggaaaagggagactgaggctgagtggacacaggacacacacacacacactctcagggtcacccttggggcagcaaagtggagcatcttggctccccatttaatgagtgacccaactggtgactcattaacatcccagagcagaatgaaaggcatgggggcggggcagccctccggctctgtccctcatcccttgcccaggcatctgggtttcctgcagattctcagctcagctgctgctttttctcactggaaaagggctcccagggctatgtgagatcagggctgaccactctataaactgatgaggaccccaggtctggccaagtgaccctgttttaccttcgttcaggaagagctgaggcctactgtgtactaggcacgggagatatagtggcaaccagattggctagcttttctgtcctggaggccacagcctacttaggagcagaaatagttatgaaataaacacacaaataagtggaagtgttggctggccgatgcaggaaatcaataaggtggtctggtggtgacttgctgggaatgcttctttgagtagggaggtaacagaggcctctgagaggctggcagctctgagtcaagtctgggattcctggactgtgggctctcttgcccccatctccaggggacttgtggcagccagagagctgagggtggttgttggggaggaaggccttgggcttcaagaccaccctgtctgtgcaatcctcacaggcccaccgtggtgcacgcaaaccacttcctggccatgcgctccctcctgcttctcagcgccttctgcctcctggaggcggccctggccgccgaggtgaagaaacctgcagccgcagcagctcctggcactgcggagaagttgagccccaaggcggccacgcttgccgagcgcagcgccggcctggccttcagcttgtaccaggccatggccaaggaccaggcagtggagaacatcctggtgtcacccgtggtggtggcctcgtcgctagggctcgtgtcgctgggcggcaaggcgaccacggcgtcgcaggccaaggcagtgctgagcgccgagcagctgcgcgacgaggaggtgcacgccggcctgggcgagctgctgcgctcactcagcaactccacggcgcgcaacgtgacctggaagctgggcagccgactgtacggacccagctcagtgagcttcgctgatgacttcgtgcgcagcagcaagcagcactacaactgcgagcactccaagatcaacttccgcgacaagcgcagcgcgctgcagtccatcaacgagtgggccgcgcagaccaccgacggcaagctgcccgaggtcaccaaggacgtggagcgcacggacggcgccctgctagtcaacgccatgttcttcaagcgtgagtcgggggcgcgttcaggggtcctcctcctcctcccaggaccccctgcaagagttaggacgacattccgtgcgctccattcttcactgcctctcatttatgctgtgacaacccagggaggcaggactgtcactcagctttttgtacagactggaaactagattcagagacaggtagcagcgtgtaaaggaatggttcagggagcggaggccccagagggactccatggaatgtattccgaccgaatttcgtcaaagtgctcgtccttgtgtatcttggaatgaataacatttaataatccattctgcctcagtagtgagctagagaaagaactcaaatcctttttttaaaattatttttattttgagatggagtctcactctgtcacccaggctggagtgcaatggcacgatctcagctcactgcagccttggcctccgggcttcaagcaattctcctgcctcagcctcctgagtagctggggttacaggtgcctaccaccacacccagctaatttttgtatttttactagagacggggttttgccatgttggccaggctggtctcaaacttttggtctcaagtgatctgcccgcctcggcctcccaaagtgctgggattacaggtgcgagccaccatgtgcggccaagacccagaatccttaaagcaaccttgggggcaggcagtgttaccttcatttcacagtgaggaaactgaggctcagcaaggaggaagcagagccaggcctcaggcccagatgcctctgtcttcagttgaagattagatgtagggttaataaatatttttgagtacctccatagacaacactattctcacagtttgctgtgagaatgaagtaaccctcgttttacaaatgaggccaagctaggagagctgaggtctccccgagtcagtggctgagcttggattggaacacaggtctggctgtgagcaagggcagggttcaggccactctcagacattttttgttgttattttctggtcatggagacagaacttgcagaggaaaacgaagggtgggctgagcacagtagctcatgcctgtaatcctagcactttgggaggccaaggtgggtggatcacatgagcccaggaatttgagaccagcctgggtaagatggcgaaaccccatgtctacaaaaaattagccaggcgtggtggcgcatgctggtagtcccagctactctggaggctgaggtgggaggatcgctggagcctgggaattcaagactgcagtgtgtcatgattgtaccactgcactccagctgtaggatggagtgggacggaccttgtctcaaaaagaaaaagataaaaaaaaaattaagggtggtcatggggcactccctgcccagggcacagctgtcccccaggtaccagggagggtagaaagcccacctcagagcatgtttccaaaatatctgacaagtgctagagccgggggtggccatagaggtggctgacctgagggcggaattaattctctatcatatgggagcagcaggcactgactgtagggaaccgcatcctcagatggcatgtcctggggccaagaccccttcccaaagctgggaacatagactctgtgggctgggtgctctatagctgggccctgaagaatggagcaaagacctgtggcaaggataaatcaaggtctgcagccgggggtggctgtgggctgtgattgtgtttgggggcggccatgtgtctctgaccctgtgttttgccccaactacagcacactgggatgagaaattccaccacaagatggtggacaaccgtggcttcatggtgactcggtcctataccgtgggtgtcatgatgatgcaccggacaggtaggtgctgtgaggagcagggtgtcaaggtgggtgggggtccaagggtagttggtctgacccacccctgcacacagggtgcccagtgtcctttccgctcctctcccaggcctctacaactactacgacgacgagaaggaaaagctgcaaatcgtggagatgccctggcccacaagctctccagcctcatcatcctcatgccccatcacgtggagcctctcgagcgccttgaaaagctgctaaccaaagagcagctgaagatctggatggggaagatgcagaagaaggctgttgccatctccttgcccaagggtgtggtggaggtgacccatgacctgcaggtaaggggtggcccagcctaggggcctgcaggccttggagccagggggaggtgcttgggggacccactcaccaattcagcaggtctgtcccaagaccccctggatgtccaggcagtgctgggctctgtgatgggggaagctggggcaggaggtgtgggccatgcccttgggaagatgatgataataccagcagctaaatataacggaacattcctgtatgctaggcgttcttctaagcactttatatgtattattattattttttttttgagatggagtctcactctgttgcccaggctggagtgcaatggtgccatctcgactcactgcaacctccacttcctgggttcaagcgattctcctgcctcagcctcccgagtagctgggattacaggcatgtgccaccacccccagctaatttttgtatttttaatagagacgggatttcaccatgttggccaggctggtctcaaactcctgacatcaagtgatcctcctgcctcagcctcccaaagtgctgggattacaggtgtgagccaccgtgcccagcctttatacgtattaaactcttttaatcctcaaaacgactttattaggtaggactataagtttcatcttagagatgaggaaactgaggctcagaaaggttaagtaacctgtgcaaagtcacacagctagtaattcagacatcttgcaccagagctaaccctcggtcactgcactgcctctgaggtctgaagtgcccccagttatagattgtttaagctagaggattatctaccatccaataatcagactggtagctatgggtcatctaggatggccagaaacttaacacacattctcaagattctcccttgcaaccaccctgggtagtgggcagaggctcagagagaagcaatgactccctaaggttccccaggctcataagtggtggagttgcaattagacctcaaggtaaaaacataatagccgcctttttgtcaatcgagagatatttttgacttacccaaaaaaggaaactttcgtgtcattctttccttggatgccacaaatggttctcacctgcagaatcgatccagacttgctgcccagagagcttggagagataaagctggagatgaagtggggcttaggctccaaaccagggacaagtggagctcgtactggtctgtgctgtagaccctgggagttcctggagaggggtcactgtctctctcctggtcctggccctgatccttccccagccccttctccagtggctgttgtcccacccccttctccccttgttcctctggtgtcttcctggaaccctcagtggagaccccaccccccagatatggggtagattgagttaggaaatttgaggcggatgacgtgtgcaaggtcatccgggtgggaagagctgggcctacctcgaatgcctgtctcatgaccccctgactctcaggacctcaggcctagttcctgtgtggccttgccagggaggtggatgttatcctgaagaatcctggacccggatgctgccattcactcagcccacagccatttactgtcctctctcctgcattgagagccagggagagcgctggacatgggccccgccctcagggagctccaagccaggtgggagagacaggcagcaccagactgataacaggaaggtccagggaggcaccactcatcctgtgggctcgggaaggcttcctgaaagaagtggtttctaaagagccctaatgggagacaggatggccatccaggatataagctgttctgtgaggctgtctggagagtggggtggggcgtgccaagggatgtggctggaggctgccacgtaggcacaggtcatatgttaaagagcttatggttggcttccaagagctgtgcagggccatggaaagatgtttgtgtgtgtgtgtgtgtgtatgtgtgtatatgtgttttaactttttactatcgaacattggaaaaataaaagtagattagtgtaatgaaacctcaagtgtctgtcgcccagcttcaagcattatcagctcatggccaatagtgatccatttatacccactaattcccccctgcatctgattattctgaagcaaattccaggcatcctatcactctggacaggttttcagccccagagtgatgtggacatagttgtccttagatcagtctttctcaaacttgagtatgctaagaaagcacttggggagtttgtgaaaaggaatccatgcccactcccagagattctgattcagggggtctgggctggggtcaggacatgagcatttgagataagctcctgggtggtgcccatgctgtctgtccctgaactgcagctgggcagtgccgggatacgttctcacttgtttttctgagtctcagcttcctcatctgtgaagtggcaattagaagcccttgtagggttgcagtgagaattgagaaagctgtgatttgaagtgccagtgccatgcctggcatacagaaggtgaccagggggtggttctctcctctctgaggagcggtcagggtagtatggggtggagggtttgagggtggaggagcctggcagccatggcctcacctggcacacctccttgttcccacagaaacacctggctgggctgggcctgactgaggccattgacaagaacaaggccgacttgtcacgcatgtcaggcaagaaggacctgtacctggccagcgtgttccacgccaccgcctttgagttggacacagatggcaacccctttgaccaggacatctacgggcgcgaggagctgcgcagccccaagctgttctacgccgaccaccccttcatcttcctagtgcgggacacccaaagcggctccctgctattcattgggcgcctggtccggcctaagggtgacaagatgcgagacgagttatagggcctcagggtgcacacaggatggcaggaggcatccaaaggctcctgagacacatgggtgctattggggttgggggggaggtgaggtaccagccttggatactccatggggtgggggtggaaaaacagaccggggttcccgtgtgcctgagcggaccttcccagctagaattcactccacttggacatgggccccagataccatgatgctgagcccggaaactccacatcctgtgggacctgggccatagtcattctgcctgccctgaaagtcccagatcaagcctgcctcaatcagtattcatatttatagccaggtaccttctcacctgtgagaccaaattgagctaggggggtcagccagccctcttctgacactaaaacacctcagctgcctccccagctctatcccaacctctcccaactataaaactaggtgctgcagcccctgggaccaggcacccccagaatgacctggccgcagtgaggcggattgagaaggagctcccaggaggggcttctgggcagactctggtcaagaagcatcgtgtctggcgttgtggggatgaactttttgttttgtttcttccttttttagttcttcaaagatagggagggaagggggaacatgagcctttgttgctatcaatccaagaacttatttgtacattttttttttcaataaaacttttccaatgacattttgttggagcgtggaagaa

SEQ ID NO: 12577 - DNA, 160 bp, Homo sapiens
atgaagagagggtccatggctgtttgtctattgcagcaaatcctgcacctagctttagcatcatgcacatatcgaggaaggctcccaggaggaggtgatatgggggctgctttaaagggtgagtaggcatttctggatcagaataatgctttgagtgcaa

SEQ ID NO: 12578 - DNA, 7881 bp, Homo sapiens; identical to SEQ ID NO: 11365

SEQ ID NO: 12579 - DNA, 2304 bp, Homo sapiens; identical to SEQ ID NO: 11366

SEQ ID NO: 12580 - DNA, 165 bp, Homo sapiens
cccagcactttgggaggccgaggcgggcggattacttgaggtcaggagttcgagaccagcctggccaacatggtgaaaccccgtctctactaaaaatacaaaaaaattagccaggtgtgatggcacacgcctgtaatcccagctactcgggaggctgaggcagga

SEQ ID NO: 12581 - DNA, 4778 bp, Homo sapiens
gggaatgtcactgcaaatgtctcgactgctgtgaggtgtgggcccctgcggtgggccaggcctttggaatctgctctgggctgctttctggaattgctccgtggctccccagctcctctctccacatgcaggcggcaggagggctgacagaacggctttgtctcacatctcggagttcttgggtggtgagtggtatgtgagtgacacaggaataagaggggagtatcagacagagacaagaggccttggggtccctggcagctttgatttgggggcattgatgacacttttgttggctcccatccatgttctgtgccctgggcttaggattttactcattttttttttcttttcgtcgcaataagtcatgaggcaatgtggctgttattatccccattttatagatgaggaaactgtcttgggaaggtaacgaatttgcccaaggccacacagctagcaaatgacacagctgtgcttatacccagctctgcctcctatgcctgggccaacctgcccaagcctgcccaccactgagcatggcctgaccccacagaacgggcgccagtgtcagggctgactttcacagggtggagcgtggaaatacaggtatcttgggcctaactggctgagagggctttccccctgcacggagccgaggaagctgtatttccagacgtctttcctagatggtttaattgatctgccaacaagtatttattggctcaatggctgagcagaggaggctggcagctagccaaggcttctggtattgatgaaggccagagagagtttgctctcacgatgactacaaggacactgtctccttgccagagctgcactcaagaccttctcgctagacccccgtgcatctcccggggtagtgaggtcctcccagcctccaggacatctggacttggcccctctgggcctggtcgcccctttgcccccatcccttatcaatctgtcctgaccccagctcacctccaggcctcagccgaggactctggctctgcatggggagtttagcactgagttcttctgcatctgcagggttcactcatttttccacccataggccttctttccccaagtggttatgaagttcctcagggcagggatggaaacccaggaggtatgcatggtgaactgggaagattagggacatcatatgtgcctatttacttgatatcgcttggatatttgtttcctacaaatctcgtgttgaaatgagatcccccaagttggaggtgggggttggtgggaggtgattgggccgtggcagatacatcatgaatggcttggtgccctcctcgtggtaatgagtgagttctcactattagttcatgtgggagctggttgtttaaaagagcctggcatctctcttactgtctctcttaccatgtgacacacctactttccctttgcctttcgtcatgagtaaaagcttcctgaggccctcagcagaagccgtgccatgtttgtacagcctgcagagccttgagccaaataaaccttgtttctttataaattacccagcctcagatatttctttatagcgacacaaaacagactaaaacattactcttgaaaggaaagctgtgcatgtggcaacagatttaaatactaccaaagggcgtatggtgaaataacccctcctgtgtatctcggccccccatccgctcctgctggcagccactattagcagtttcttgtctttccagagacatttgtgacagataatttttagatcatactgaaaacattcccctgtatcttgttttctcccttcaatggaccttggcagttatctactatcagttaatgtagagctgcttcattctttcttagcagtcgcatgggtccatgatatggttgtgttataatctaattacttagatccccatatttggacatttaggcagtttccaatctttgagcatacattttgatcccaattgaaatttcctttctgccccctctagctaattaacatccccaagcctcagttttcccatctgtgcagtgggaataattatatgtacctttcagagttgctgtgagtattagaagtgatgcagaaatgaagcactgcccagcatgaggctcacagtaggttaatattgatatgcgttccctgaatttctgattgcggtgctgagctcatcttgcgcacctgatgaaggctcgtgaatgactttgtttccagtttaaaatacagtagaatcacgttaattttttctctttttaaaatttattaatttgatattaaggaggcttcagacacattgttggattaatattatttgaggtgtctaattcagccagtccttacatagtgtgtagtcaacataagacacctagccctttacttcacagaataagcccataatgtgtgtgttttgcttttctgttattgctgctgctgctaatggtgaaagtggtggctctttgctgtggcaactgcatcttggccttttcaaccaccctatagcagcccttgcaacagagtacatagtcggtgctcagtaaatgcatattaatgtcctggcctcccaccaactgaataagcttttctttcctctgccacagggggacttgagtcacagttggctggagcagaggggctggctatgagctgcccctgagtgaccctttttccatctctcattgtgtcctgtgtacagcacatctgtccctgcacacaggccaagcagaggctgcttgatgggtcaggcatgtcaatgcaggatcctgacattcagaaactgccccctaccctttgtttgaaaggaacagtctctcagttgagaaaaggcctcgatcagatgctgtggcccttctttgaaggaggttttcatattaacatagtcataattcggttcatggaagtctggcttgcagaaaggtggctttgaaatgcaggtgacagcatttgaaatcaggcttaatcaggacaagcatcaccgtgggccacagcatggtcttgtgggaagagcagggttcaggggtcttccagcactggcttggcttcagtcctgacttggtttctaattagctgtgaccctgaacaagtcatttcatgcccaagccttcattttctcatctgaaaaacaaacttactttgctacgaggtgtcaggatcatggattaatatatagaaagtgactgatctagtgcctagaacgtagctactgaaaaagcggtaggtttaaaaatggctaattatgactattactgctctcataaattggtaaaattacagttattaaatatagaaataattatggttattaaattttggtccacactgtgaaactgaaggatttcacacgagggaatctgtggtggtttggatggtcttggactcgtttctctctaagatacatgatggaaatgccacctgaggttcacaggccattgtgagtttgttgcaaatgagctgggagtgtttagccttccctgtgagcggtttccggctgcatgtcttattcaagtgtttctctaaaaggccgcagctccccgtggtgacttgcctggtggacatgcattcacaaggatacccaaatgagcagcaccttcaccagctgtgtgcaggcagacattcagcagggatgagctgccgaggtggcggccctgagggccggcgtccacctctgcgaaaatagtgacttggtctagttgtgggctggccattattggacctttgggaaaaagggaaggggaagaggtaaagggtctcaccttttcaggccctggcagaagggtgaaggcaaaggccccagacacagggatagaagagatggtatctggcagccaatgcaagacccaccttttacagatgggagctgactggaccagagagctgggaggctttgcccaaggttacctgccaggtagtggcagaacctgaactaaaacccaggcctccaatcccccttgaaaatgttccccatcagaaacaagggagtgagaattcaatgcagtttctgagtccgtattgaaaaacacagctgtgggaggatgtaggagcttaggaggagagtgattagggccaggggtgatgctgatgggttggagggactttctgaggggaggccttggagcttgggcagagtttagaccagtgtctccccacaacacacacagatgaagaccctccatggcttctcagtgcctcctgcatgtcagagaccctgtcctggccgccgctcagaccatacaaccagggggttagcacagtcacagatacccaggtaagaactggtcttcctgtttagtacctgcgtgacctgggcataagtttcctaactttgcagttcctcggtatcctcacctgtaaagtgggcatagtgatggcacttaccccgtagagttgtcagcaacacttctcaaacctcagtgtgcattcaagccacctggtgaccttcttaaaatgctgattctgacttagtaggactgggtcgggcccaagattctgcatttctaacaagctcctggatgatgctgatgaagatgtaacacagatcaagggcccccaatcacagcttatccccacgccccaccatccacccatctacccgccatgctgaatgatcccgcagccaagctaaaatgcatattccagccgggctttgtggctcacgcttgtaatcccagcactttgggaggccgaggcaggcggatcacttgaggtcaggagttcgagaccaccctgtccaacacgacgaaaccctgtctctactaaaaatacaaaaaaaaaaaaaaaaaaaaaagccagg

SEQ ID NO: 12582 - DNA, 133 bp, Homo sapiens
ggtggctcacgcctgtaatcccagcactttgggaggccgaggccggcagatcacttgaggtcaggagttcgagaccagcctggccaacatgatgaaaccccgtctctactaaaaatacaaaaattaggcgggc

SEQ ID NO: 12583 - DNA, 106 bp, Homo sapiens
ccagcactttggggggctgaggcaggtggatcacttgaggtcaggagttcgagaccagcctggccaacatggtgaaaccctgtctctactaaaaatacaaaaaaaa

SEQ ID NO: 12584 - DNA, 342 bp, Homo sapiens
gagccacagctgacttccagatcttgtcctctttgttgatgtttctccctcaaaatgcaattcatgaggaggtcccagggtgagagcgtgtttgcttctggcgtgttctggggtagaggacagctctctgcctgatgtttgagcctcacgaggaagagcatgggagataccgttcatctcctaagggtgaggggtcacccttctggagtgaggggccacgggtcacaactgagggccactcacagtgcttatgcagaggccaggccaggtgccaacagtgggagtgggctgtttagtgagggctcctttggaagcccagaactcacaagttgcctcaaggaa

SEQ ID NO: 12585 - DNA, 2295 bp, Homo sapiens
tgagcatttttaacatttagtttcacatgcgtgttataaaactaaagtttcaagaaataatcctcagtattccattccatcacaacaaaagcaccctctttttgcagacagggaaaagcccaacatgaacagaataaaccaaaatatacttctatccctccagcttgtacccagtactcttctttccccaccactgaaacccactgacaccttggaaagacttaaaatcagcgggacgaggggagcaacacaaggcaaaattcagttcagcttggtggtttcctctttattgatgtgcctcctaccttccccccacaatttcagtcccttccaactacccccaaaaaagaaggtagtgaaaggaagggattgctggggttctgagccccttgggcagtcagaaagggaacagaaaccaaaacaatcactggatgtgacacagactgacaatcaagaagtctacagcaggatgggaaaggcgggcagagaaaggggaagaaaggagaaaggagagttacaagatgccaactccaccattacccctcctaagagaggctggagagaaagccacaaacattaagaagtgccggtcctgaataagggaggtggtgtttgagcttgaaggaggaggaggtcaagaaaggggggccacctctctctttgtagaatgagacccccctccagctcaggggcagcagcttcacagaccgtagacactttcgtcactgtaggcaatgtagagaaagaagtcttcttcatggtgttcctgggatgaaagcagaaaactgttcagcaactgggctccagtaacttaaaccaaccacgacccagacacgttcttctagaaccacaaaccattgcctgactccttcactgactccaaggcctaccacacgagcagtataatctctgcagtcctgggcaaaaaggcctcaaactgttttctgctgctttggaatggggagggggactgggaagagtcccgaacagatagtttctctagctcactgttctctttccttctctctactcctactgttctgtccaaacccccaacccacggctattatgaaactttaaggcaagccaggaagctagtccaaaactactgatgtaacaacactttcttcccctcacgctcttccaagattcctctccaaagcctccaccacttcccagtcaccatacctggtacagctgacccattgtggcactggtgggtggaatgacattgttgacaaagaaaaacaaggcatcctcagctcggagatgaattcgcttccggatcaagaagtagaactgaccaactgcaaaagatacaagatgcaagaaagtcacagaggtcaaaaatgccctcaaaagaacagctgctaggtggagcctcctcccgcagagactgcactcccacccacaggaagcaagcctgagtcttggatcaggttcccacctgtgagatcagaaggcaccaggtatttctttttgtccaggtctcctatccgagctttgggagccttttctactatcacctgataaagagatgaaaattaggagacagaaggaatgcagccccgaagctgcacctgtcaagaactcaagaaacaatattcctagcacctaaatctaccccagattcatctctttgtctttgtacacgcggtgcagcactgagtcccagagatcctgacctcactgactggagctcatttaaatatccaggatccatcccccaatagggcgtcaccataaacaactatcttagacggaggtgacttgtttgggtcgactagtgattcaatctcgcaaccttagctagctggggggatgaccatttgaagctcaggctgtcaaactctctaaggcctcaaatgctaaggtttctctctcctgtccacatccctctcaaccccacatccaccactaccccactcctttcatcctgggtcccaaggacagcagtttcaggctcgctgccaaccccaccacagccagcagcctgatccctgcgctgcctgtcccagatccaaggccaggctgtggcgtcagcgtaagcgtcccgcgccctcggccctggctactgtcctcaccggcacccggtccgggtatttctttcggatcttctcgccctcagagcggcgcttctcgaacggatgctcttctttgtacacgaacttcatcctcccgggaaccgggctggacagggctgggctgagggaacccaggggggccgggacggggggcggcgacgacggcggcgacgcgcgggcggattcagcggagcgatccacgaatttgcgc

SEQ ID NO: 12586 - DNA, 2299 bp, Homo sapiens
tgagcatttttaacatttagtttcacatgcgtgttataaaactaaagtttcaagaaataatcctcagtattccattccatcacaacaaaagcaccctctttttgcagacagggaaaagcccaacatgaacagaataaaccaaaatatacttctatccctccagcttgtacccagtactcttctttccccaccactgaaacccactgacaccttggaaagacttaaaatcagcgggacgaggggagcaacacaaggcaaaattcagttcagcttggtggtttcctctttattgatgtgcctcctaccttccccccacaatttcagtcccttccaactacccccaaaaaagaaggtagtgaaaggaagggattgctggggttctgagccccttgggcagtcagaaagggaacagaaaccaaaacaatcactggatgtgacacagactgacaatcaagaagtctacagcaggatgggaaaggcgggcagagaaaggggaagaaaggagaaaggagagttacaagttgccaactccaccattacccctcctaagagaggctggagagaaagccacaaacattaagaagtgccggtcctgaataagggaggtggtgtttgagcttgaaggaggaggaggtcaagaaaggggggccacctctctctttgtagaatgagacccccctccagctcaggggcagcagcttcacagaccgtagacactttcgtcactgtaggcaatgtagagaaagaagtcttcttcatggtgttcctgggatgaaagcagaaaactgttcagcaactgggctccagtaacttaaaccaaccacgacccagacacgttcttctagaaccacaaaccattgcctgactccttcactgactccaaggcctaccacacgagcagtataatctctgcagtcctgggcaaaaaggcctcaaactgttttctgctgctttggaatggggagggggactgggaagagtcccgaacagatagtttctctagctcactgttctctttccttctctctactcctactgttctgtccaaacccccaacccacggctattatgaaactttaaggcaagccaggaagctagtccaaaactactgatgtaacaacactttcttcccctcacgctcttccaagattcctctccaaagcctccaccacttcccagtcaccatacctggtacagctgacccattgtggcactggtgggtggaatgacattgttgacaaagaaaaacaaggcatcctcagctcggagatgaattcgcttccggatcaagaagtagaactgaccaactgcaaaagatacaagatgcaagaaagtcacagaggtcaaaaatgccctcaaaagaacagctgctaggtggagcctcctcccgcagagactgcactcccacccacaggaagcaagcctgagtcttggatcaggttcccacctgtgagatcagaaggcaccaggtatttctttttgtccaggtctcctatccgagctttgggagccttttctactatcacctgataaagagatgaaaattaggagacagaaggaatgcagccccgaagctgcacctgtcaagaactcaagaaacaatattcctagcacctaaatctaccccagattcatctctttgtctttgtacacgcggtgcagcactgagtcccagagatcctgacctcactgactggagctcatttaaatatccaggatccatcccccaatagggcgtcaccataaacaactatcttaatcagacggaggtgacttgtttgggtcgactagtgattcaatctcgcaaccttagctagctggggggatgaccatttgaagctcaggctgtcaaactctctaaggcctcaaatgctaaggtttctctctcctgtccacatccctctcaaccccacatccaccactaccccactcctttcatcctgggtcccaaggacagcagtttcaggctcgctgccaaccccaccacagccagcagcctgatccctgcgctgcctgtcccagatccaaggccaggctgtggcgtcagcgtaagcgtcccgcgccctcggccctggctactgtcctcaccggcacccggtccgggtatttctttcggatcttctcgccctcagagcggcgcttctcgaacggatgctcttctttgtacacgaacttcatcctcccgggaaccgggctggacagggctgggctgagggaacccaggggggccgggacggggggcggcgacgacggcggcgacgcgcgggcggattcagcggagcgatccacgaatttgcgc

SEQ ID NO: 12587 - DNA, 4682 bp, Homo sapiens
tataaacacaaaagagcccactctgctttatttacaacacgcaggctgtctgtacaaacagcggccgatattattaaaaacaaaagaggtgagtgagaatcgtcacctttctgctttccttcctcacttggccaggctctagtactccacctttgagctgccatgcccaataggggaagtccaaaattaaaaatacaaccggtgtagaagaaaataaatggggagtgaaatagaagaaaagatgagggaggggagtgctaatatttacactagagttttatagacaactgtcccattccatcccaattccaatcctgacccagaaagtgatggtggcaggtccaagagacagagattatgtgtcgggacacagacagcctcccatccccaaccgtaatggattcaatttcaagtccacagagtggggaggaaggatagggtgggaaagtgagacactcattttcaaacaagtctcccttgagaattcctgccttgaagtgcagacagtatccaagctccaggggataggctgaggaccctgaggctcagttcccaaatcatgttgtcatttggaagttccaggctaaagttggtgccatcagggctctccagatttgggaggcccccctaaccgccgggcctctggcctcagttccttgcatttctggcaataaaagaagtcggggacgttggtcttcttaatcttagcacaggagaggtggatccacgtcccacacaggctgcactcaatcatgggccgccctgcaaagggctttcgacagtaacatgtgatcagatcccatgagtcatcacctggggaaaaaaaggtttgtttggtattctgcctgagctgttggatccacaacaccctcaaacccctcgccccagcccaaacctctcacctgattctaccatgatgtcctcgtccatgacccgcatctcgccttcactggagctggcatctccatcttggcttgtttcagtgctgcccacctccttgctttcactgtcagcaggagggactccttcagggtgcactgtggcagggggcctaggagcctcagggggtgttggcagcacagggactggggcttcaccccctaccactgttgccatctcttcttcttcttcctcttcctcctcttcctcctcctcttcagagtctgtatcactggggggtgcctggggaggcccaggaggtgggagtctatccccccgttctgccttttttaacttccgcttcttgctcttcttgattcgagatctcttttccccatccccaggagttggccgaggcctccgaagcaccccaaagccagccccagctcctggccccaactttcggttctttcggtccttctttcgaggaggatgggagaggtccccctgggaaaggggcacgggggtaagagcagcagggggccgggaggtatgtgtcagggatgtgggggacaaaggagatgccactttgggcccatccagatcaaagagagagtccttgagcttcatcttctcaagcaaggtagcactgtcgggggcctgcagacgagagaaagtggaccttgggggtcctggctgggtgggacctgcttgagctgcccttctcttggatgactttgctttcttaacaaaagtctggatggttcgaagatctgagggggccgagtcccagccatcactgtcggccgcactctctcctcgcaatggagagctggagccagaggctggccagtcactttccttaaaagggggaagagaccagggtcagcagaaccccagtgtcatctcagcccctccacaaacccagcttgaaaaggagtgactggatttaccccaaaatgtcctacctcaaccactaaatcccactgtactccaaaaacttctccccaccccaattcccatcagcatgtcctcttgaccagtccgtgttacctctaccctcaagtctgacacctcaccgctgcccctgcccagggcctgtggaacactgtatcacccagaccggagccgttatgtccttagctctttttctgtatagcctcatttgttaccattttcatctccctaaaatttatccataaacaccttccattcacagcacctcaagactatgccaaaatctcaaccagcgactccaaatcccccttccttttcactgctgttcaagctagctatcccggccatccactccccgcataccagctttcctaccacagccctaagagtctccaacttccctggtcttacatataatttctaggggcctccttctataaagcaatacagttctgtttgaacaacagtcactctatagtcccaccacaccagcctcaagtcagtaattctcttgcccctacctctttgctagggggaatgtaaccagcatatgccaaaacaaaactgcagaatttgttgaaatcctcaattgttctccgccgtttctctggtggctgaaaggaaggagatatggatcacatgcaaagccacacagtttaagaatggcattcccagaaacacagtccctaagtgaggtctagaaaaggggggcggggggcgttgtcaggcagggctactaggctgcaaaggtaaggcaaacctcacctgagtctctggcttaagggtcggaggtggatctggaaaagcaataaaagctgagtcaagacactaggaacaatctgtgtaaaactccccctctaaaccccgttgttcctaagtgaaccccctgctctcccaggtccctctgccaggccagcaggcccccagctgtgttggatccgccccggctcccccttccgccccgcgaggggcggagcctgggcgcggcgccctctgaggcctcgctatagcgctccccttcccccaaccggaggcccggcgccccgcccccccaactcacggtctctctcgactccagtctactcggatccctcagcgccccaccccaccgtaccgctcccggggccgcgtccgggccgccgccagccgcccccgtccttcacacgcgcccggagccccgagttcctacccggccgcgctccaccgcctcgggccctccgagaccgcacacgccgcccgccagcccccagggtccaggatgaccacgccgaaccgctccccgccctccggccccttctactcgagcacgcggcccggcgcgcccctcacccccaccccagacacacacaggcacacgcatccaacgctacttcacggccgggacagacccgggagctctaacccggacgcggcccccacctgcccccccacccgcccataccgcgctccccacaatttcgccgtccctccgcccccatccggggctttggcccctccccgtctccagcttttcgggctccccaccgggccccccggccctgttcctagccctctccggccgccgcccccccctccgcccccgtactcaccacccagttactaggctatggacccctcaactctggccccttccccccaaccagccactctctctctctctccacagcagccaccgctgctgccgccgatgcccccctcaccctcagcaactcccaggctcttaaccctcgcggaccaaccctacccccccgcccgacaagtcgccggtcttaaccccccccaccccgccccaccaccccctacaactacccagctcgcctcgcttcctggctcgctctctccacaactaccccccggtacaggtccgtctgccgtagacaatacccagaccccctcttctccccacaactacctgcccacctctccgacaatcaccgggcattctccggcggcaactactcggagctccggtaccaccgccacaaactaccccacctcggcgaactaccgggcccctcactcagcctcttctacgtcctccctcctgagcaactctccggccactggattcccctaaccttccagttccagggccccaatctgccggtggccctttcgggccctaacccccgaggctccgggtttcaagctcctatcccccgcacccccacaccgtctgatctccaactaccccagcccagtttcccactcctctttctccaaggtctctcaactcgtcgctctcccacctccagggccagcctcccgaccccctccccgaactcccccgctgggctccggggctcgacctccaagtttgccaattgattcctcgcccgccccccgccggctcagcgctctgcaccggtcgagagctcaccttcgggactgggctccgccatggcttccagcatcgccccctcccctcctcccggtccggcgcccccctccccggagccggggatcccggtgccgcctctagtgctcgatgctcccactgcttcgctccacagaagtgtccgcctcagcccggttgagactcgagtccgctagccgctgccgccacctccctctaccactgcctcccgcactcccggaccgggccccctccccccgcgccgccggccgcctgctccctcctcctcctcctcctcctcctctctcctccctccctcctcttctctccctcctccccccgccggcgccgaggcgcagtgcaccaagggttttgtagtccgtccgggaacagcggaaaagggaccgcatgaacctccggaactttgattcccagaaagccacaggctggcgcaggcgcaccaagccgctcccctcccccggggagcggc

SEQ ID NO: 12588 - DNA, 8056 bp, Homo sapiens
ctttggtttcaaagttataatgcatggtttaaaagagagaaaaggaaaaaagacacaaagctggttacaggtctgagggagtctaaggagagaaaaatagagggagagtaaaggggggacaaatttagggaaaatccagtggcccaaaatcccagtatcccacccacagcccagcccttggagcaggagtgaagaattagatcagttttgtacaagagttttttaaaaaaaatcaaatcacaacaaagctgacttggcttctctttgagcctcctggatcaccgtatgtctgtcactctggccagtcctgcctcttcacaaacactgattcggctctcctaggcttccgcctgtgtcccagtctggggtttccatggagtgtgaacacgaagttaagagtgaggctgcttcagagcccctggcccatgtgtccatccagactcccaagtggagtgtagggctcccagggcagagaggggtgggaggggcagaccctgcccaggcagtcctcacattggacagggcatcagacggcatcccaagggctcgccctccctttcccccccaccccaactcaggtggagggggagcagctgtcaccagagccgatgttggtgaaggtttcggctcagcacggaacgaacatcagcggtgaacctggggtgacaataacttgcattggtagagtaccttatagttcataccctcacaacactcttgtaaggcagcatcactggagatgtgggacctaaattatcaccatattcatgattagataggttcaatttgcccacagcctactagctaaagtgatgagctttgaagtaagacgacctgggtccaaatgttaaattcttaagggaacagagttaaaacaggacaaaccttttttattccctctgaggatcccccacctcctcctttcttgagatatccaagtgtccagagcccacttcccttacctgagggcatccagcattgggagcaggttgagaagggctgtgtcgctggggtcactgaaccaggatttgatggggatggcattgtctagggtgggtgaaaatgcagatgagaagaaacagaattcaagagagacggtgtttttctcttcttggagggaaggaggaattattgttaaaaatatatgcctcccactaccggaagtcaacaacctaagtaaaactttcctggtttatgctccgaaactaagttttaatcaccagatctcatacctattgatgcttctagtcaagcttactgccattgtgcctcacttgaaacacacttggccaggcgcagtggctcacacctgttatcccaacactttgagaggccgaggtgggaggatcacttgagctcaggagtttgagtccagcctgggcaacataatgagatcccttctctactaaaaatcaaaaaattggccaagggcagtggcttacgcctgtaatcccagcactttgggaggccaaagcggacgaatcacgaggtcaggaattcaagaccagcctggccaacgtggtgaaactccgtcgctactaaaaatacaaaaaattagctgcgcgtggtggcaggtgcctgtgatcccagctacttgggaggctgaggcaggagaattgcttgaacctggaagtcggaggttgcagtaagccgagatcacgccactgcattccagcctgggtgacagtgcgagactctgtctcaaaaaaaaataaaaaataaaaaaattagctgggcatggtggtgcacgcctgtagtcccaactactgagaggctgaggcagaaggatcacttgagcctgggagatcgaggctgcagtgagctatgatcatgacactgcactccagcctgggaacagagtgagaccctatctcaaaaaataaataaaaataaattttatttttatttatttattatttattttttttgagacggcgtctcgctctgtcacccaggctggagtgcaatggtgcaatctcggctcactgcaacctccgcctcccgggttcaagcgattctcctgcctcagcctcccgagttgctgggattacaggcgtgcgccaccacgcctggctagttttttctatttttagtagagatggggtttcaccatgtttgttaggctggtctcgaacttctgacctcgtgatccgcctgcctcggcctcccaaagtgctgggattacaagcataatccaccgtgcccagccaaaaataaattttaaaaatgaaaaaaatgatataagaaatccgacttatgaaatggacatatatggtatctcatttgaaacacaaaaataacttgcatttcgacttacagcaaactagggataatctagggaatcccagctctcaaggaccaaagcccaggtctcctgcaaaaataccttctcagaaccatgttctggtcctgccagactcaccaccttcccccgtacctggatggctcctgtaagcccctggggagttatccaggatcacaatgctggagaggtcactgtggaccacagagaggtccttgatgtagctgcccaactccaaagtgcagtgctggaaggcaggggatcatgtagcaggcctctctccaggatactctcctcaaacccagatccctccctggtggcctccctcccaagccacactcttagactgggattctagcttacctgtctgtaatatctcctcttaagaatgcttctgctattgtccagtttatctgccacagcagagccatagatctccatgcttgctgtaaacaccaccagctcgtaccactggctcacctgaaatagattgggggagagggcgatgccatacaaggtgatgattcctttagacatacagttatctttcagaaaggcaatggcatagtccttcaggccttccatcaacatcaaatgtctctgaggacacgaaattctgaacccccagcccaaacctccaaactcagtgttaggcatcctacactcttatgattcagaaatgcaagaacaaaagagaaagatgccagcggaaaagaattacatcagcacaacaaatgaaccccaagtactgaaagccactcccctaccattacacagcctcccctctagaaaactgctctaacccgtttctcctcaccccttcctccaaatcctcccaattcccagagccctaaaaccattccttcattacagagctccctttagctctccaaaactcaccacttccaggaagaaatccacatggggcctcttatgtacaaaaaaccggacaggatgtttgtctattaccacctacagaggaacaagatgggctgggggatgtcatgaccaccacaacccaggcctagaaaacgccccacccatctgcttccctcctccaggctgacactggtgccagcggatggagacagatgctctgggactgggaaagggagtccaggtttgggcagaggaacagatggaaccatttcatcactccccaccaccacacaccttgaggatgaagtcaggaggcgtaccaggccggactgtgggcctcaggaccccatcatggtgggagtgaataagtgtctcatccagatccagcaccaggatcttcctcttcacctgggctgaaccagagtggggaggaataatattgaccgacctctgacccagagctagcccctacttcaccctaaaggaggcttcccaccacatacttacctagccgattccgggacacaggagataaggggaggatatcatatcgaacagtttggtactgaattacctacaaatagcacaaaagaggattgaaacccttgataaggaagccttccccagtaacagtaacagggagcacataatgaacatttaccacaggtactatgtatgtaatttaggcttatttcttcttcttttttttttttttttgagatggagtctcgctctgttgcccaggctggagtgcagcggcatgatctcggctcactgcaacctccgcctcccaggttcaagcaattctcctgcctcagcctccctaatagctgggactacaggcgtgcaccaccacgctcggctcatttttgtatttctagtagaggcggggtttaactatattggcctggctggtctcaaactcctgaccttgtgatcctcctgcctttgcctcccaaagtgctgggattacaggaatgagccactacgctggcctttttcatttaatcctcaaaacaaccataatattactgttatacctgttttaaggttaaagaaactgaggccacacagctaggaattatcttaagttgtttctctccctaattaaaatgaaaactccatgagaatatgattttgtctagatcatggctgtattcccagtgcctagaacacagtagcaaaagtggtcagttgatattagtagaatcagccaggcgcagtggctcatgcctgtaatcccagcactttgggaggccaaggcaggcggatcacaaggtcaagagacggagaccatcctggccaacatggtgaaaccccgtctctactaaaaatataaaaattagctgggcgtggtggtgcgtgcccatagccccagctactcgggaggctgaggcagcagagtggcttgaacccaggaggcagaggttgcagtgagccgagatcgcaccactgtactccagcctggtgacagagcaagactccgtcgcaaaaaaaaaaaaaaaaaaaaaaaaaaaagtagaatcaatgaagtgatagagccaggattgtaccaatgcagttcaacccaagaacgtgccctctttttttttcttttttttttttttgagaagggagtctcactccattgcccaggctggagtgcagtggcgcgatctcagctcactgcaacctccacctcccaggttcaagcaattctcctgcctcagcctcctaagcagctgggactataggcgcgcgaaccacgcccagctaatttttgtatttttagtagagacggggtttcaccatattggccaggctggtcttgagctcctgacctcatgatccacctgcctcagcttcccaaagtgctgggattacaggcaagagccaccacccccggccgaagctgccctcttaactgtgatattatcctgctacactgaacaaagaaacgacccccacaacgcaaccttcaccccaagaattatttgtagcaactaccatcattgggaactaagtgcctcagattccctagtgcacatggagtaggagtcgggaggagatccctgggtccttaatgggaatatagaatgagggaatccagaggttgtcaggtcagctaagttcctctggctagaagccaccaggcctattttaaccagccacctgtccacttctgtcccttctagccaagtcacaagttcagagaacctcagccctctgaacagtctccttatcctggtacccagggtgaggcaaagaacactggaaagcccctgccaggctgactggcagggtctggaggaggccagagtgaagtcagggccgttaagtgagaggtgaataagggacaaggacgtcaccacctcatccagctctgcttctccaagcattctctaggggctatttcctaatacgcacatctccccatacaaagcctggcaattccctcttccacacttttcttcaaaggtacaaaccctcttcagtgcatacctaggccccaagccacaccagaaccaggttctcccttctaaacccacagggctctctccccctaatcaagatctgcccttcttttctccctgggccatgatgaggtccgaaagagctccagtgtccagccttgctatctcgggttgcatatgctgggcatgtagggaatgctccaagcatctgccagaagcggggtggggaaagaaaccagattggaagggaagggaggacaaaaggctatggggtcagtgctgcccaaaggagagcaattttggaagtaacctgtggatgagctgaagcaccactccgtatgcccagaaaactgatgtgttggagcgagaacgtcagagaagatggcagtcaacccataaagaaaaccgctggaggccgggtgcagtggctcaatcccagtacttttgtgaggccaaggcgggcagatcacttgaggtcaggagtttgagaccatcctggccaacatggtgaaaacccgtttctactaaaattacaaaaattagccaggtgtggtggcaggtgcctgtaatcccagctattcgagaggctgaagcaggagaatcgcttgaacccaggaagtggaggttgcagtgagcggagatggcaccactgcactccagcctgggcgacaaagcgagactgtctcagaaaagaaaagaaaaccccaggagatagccccacacatatcccagcatctctgaccctaaatttttcttggctcctagctcttgtctcgggggaatagcgctgctgcctacagccacaaccatcctgtactgttcgcgccctaaatcaggaagtggaagcagactggtaaaggacagaatgaacccaaggccagacccattctcccaaatcagttaaatcaaccaccactaccactgagggctttctggaaattctctggaccccaggtcaccccaacctgggtttattctttcaaattgtattgaggtatgctaaggggtacagaccacagtacagacccagaacctgtgtctccgcttactaaattctccccagactccttccgaggattctccctggtggtggtgagaccacaagagcacattcatttaaagtgctgttagctgaaggacctctgaccttggagaaaagctaagggagaggggacccagagatgcttgggtccatccggacagtttccctcagaatgctaggctctcctggagaagcaaacgtcctcattttcaagccctacaactgcccagcgctgtcctctgacagggacacccaaacttcaatggtgggcacagcacccaccttgaactccctcccacaattaaagaggcccatcgtaaaagcatctgctttagtcttcaataaatccagatacctacactcacactatgaaataaattttcacagcctttttggaggaattctcttaatgggaaccgcaggcgtttctccttcacacccagggctttcccaagttcccgtccttgtttgtaacgtatgccctcccacccacctccacccttgacacacaagtctgtctcttccttgttataggaccaaacacacaccgaggttccaaatagggtctttcccaagcccacatccacagatccggctgtcatcaaacaggtgttccccgcctcttggtttctttagcaacaactccagctttcttaaagagcgccccacccaccaccttagcccccaagagttgccaaatcctgtcccatctagccccatcaaaacccccaagggcaaggttctattacaagggtctcccacctcgccccgcttagggtgcccaattctctggcgagaaaagccccagccaggattcccttcctaggcccaaacagaggcccgacactccgaaaacccctgagcaccacggacagatgtccccaacaccgccagacgtccccaacaccgccagcgcccaccctggctcaccgtgcggatctgcctccgcagaaggtaaatgaagaagctccagagcttggcggcgaaggccacgaacgtgcgcagccccagcagacactgcgtccgcatcatcccgatgaccccggcaccgccggccccggggcccccgcggcccagctccgccagccccccgggggcagccccccgccgccgggagggggaacgggggccccgagtggcaggagaggctgcagagaggggcacggagcgggcggctcagaaagccacccctggcgagggtaaagcccagcggaacggggagctgggggacaggcgtgggcagcccgcgggggcccacatgggctgggagtggcaccgacggcttcggggaggttgcgggccgagacaggtagggctaggatggggtcctccgagacctggagggaaggggaaggataattgggggagggggcagtgggg

SEQ ID NO: 12589 - DNA, 554 bp, Homo sapiens
ctttggtttcaaagttataatgcatggtttaaaagagagaaaaggaaaaaagacacaaagctggttacaggtctgagggagtctaaggagagaaaaatagagggagagtaaaggggggacaaatttagggaaaatccagtggcccaaaatcccagtatcccacccacagcccagcccttggagcaggagtgaagaattagatcagttttgtacaagagttttttaaaaaaaatcaaatcacaacaaagctgacttggcttctctttgagcctcctggatcaccgtatgtctgtcactctggccagtcctgcctcttcacaaacactgattcggctctcctaggcttccgcctgtgtcccagtctggggtttccatggagtgtgaacacgaagttaagagtgaggctgcttcagagcccctggcccatgtgtccatccagactccaagtggagtgtagggctcccagggcagagaggggtgggaggggcagaccctgcccaggcagtcctcacattggacagggcatcagacggcatcccaagggctaactctcc

SEQ ID NO: 12590 - DNA, 444 bp, Homo sapiens
atcctacagggtatttaaactgtagctttttggataacctctactgactggacagaaaaaatttattttaccgtagtagttttctgtaagtttacttttaaatttgtagagttataaactgcctgggccttaattgaaattagaaataaaacaattagatgacctcaggtgagcctattacaaaatgctcttgtcataacattaaaagtcatacaattgataccttatttcaggttttgaataattcatttgaaacatgttaatttttatactattagcgaccaacctttttgtatcctctctttttgaaatattaatgtacaggagttttcagaataattaacagattatatagatctgacttgaggctaggagtttgagaccagcctggccaacattcgcaacgagtgaaacctcgtctctactaaaaataccaaaaaacaa

SEQ ID NO: 12591 - DNA, 941 bp, Homo sapiens
agacgagccatgacagagttcctgaagagcaaggcaggtgcactcccaactggcagccccactgtgaaattctaaatattctgctttcagtctcaggttgtcttctttcttgctatcgtggtagcaactgtctgcatcctcttcagaacagggagcccccaagctatggatcttttcccatagaaaaacaaggctgggggcggtggctccgacctataatcccagcactttgggaggctgaggcgagctgatcacctgaggtcaggagttcaagaccagcccggccaacatggtgaaaccccatctctactcaaaatacaaaaattagccaggcgtgatggcacatgcctgtaatcccagctactcgggaggctgaggcaggagaatcacttgaccctgggaggtgaaggttgcagtgagctgagatcgtgccattgcactcctgcctgggcagcagagagagactctgtctcaattaaaaaaaaaaaaaaggaaaaacagctgtcagaaccttcatttgtagtgaagtgaaaataagaccgtcaaatccttaatgtgtttcctttgctacaaattctgcaatttaatggagatcaaagctttaaaggatctcaaactcaaaatacttacgcatagggagcaggcagatttcacagatgagtgaaacagaccatttgagtctgaaaggagtgggatctccaacagcttaggtcagggtgtgtacttccctcatacttagctcagacaacttttggcatgtagcaccttcagttcagtagtgaccttctattgttaaagaaataaaaaaaattggcccagctccgtggctcatgcctgcaatcccaacactttgagagggtgaggcaggaggatcacttgcgtttaggagtttgagaccagcctgggcaacatagtgagaccccatcgctataaaaataaaa

SEQ ID NO: 12592 - DNA, 419 bp, Homo sapiens
ccattgcacgccagcctgggcaacagggtgagactctgtctcaaaaaacaaaacaaaacaaaacaaaatactttagataactgatttttaatgttatttggcctttttaatgcataaggcaaaataataagttacacctcaaagctgctttgtattttggcccaggacgcagccgtaggaaatgacaggacggccagtgatgctccaggagcacccccatgggaaaaggagcatcgccagggcctggtttggctgcaggcacttcaggcactcctcctgcatggaacaagcacagtatggacaaaacctattgcctgaagtgccatggagagagtctacaagttcagccaggtggtccaaaatcctcagggcagggtggcctgtgtcaactggcctggccaattaaaactaaattgttt

SEQ ID NO: 12593 - DNA, 100 bp, Homo sapiens
agagttttgctcttgttgcccaggctggagtgcaatgatgtgatcttggctcactgcaacctctgcctcccgggttcaagtgattctcctgcctcagcct

SEQ ID NO: 12594 - DNA, 6149 bp, Homo sapiens
aaaactgcaaggacaagtactacaactgcaacgtggtggtccaggcaagactctgtgtctacaactactacaagaccgcctgctgtgcctcctgcacccgtgtggccaacaggcagacgggcttcctggggagcagataacactcctgcacccccatcagtagggcagcatcactgccttcccgggggcttcagcagtgcgcctggctggctgctgctccaccacgggccccctggcccaggcgctgccaaccaacttagtcaccacccctgcctccggtgaatgcaccccgtggtacccaggggctttttacacaagatgtttgaaagccacagtcagtcctttaagcatcaccatgtactgatgatcccctccttggacctggcatctgctaatggtgccctttgaaagtcaagcagtgggaagtacatagagctctcagccctgctcccatctggcaccttcaagtcagcagatgggccactgactgagcactgccccgtccctggtgctactggtctttctaaacttagcaccctggagagtccaaggaggcagcgcccccaacccagcgccccactaagccttgctgacacgcgtgcatccctctgtgacctcagcccagatgtgcctgttttcattctcaaagacattagactgttttcctgccctatgacacagatagctcacatgaatattgtgctttatttagcaggtgtactcacagatactagctccttagcagctcacaacatcccagaatgggaggcagggggtgactcattatccccattttactgacagggaaactgaggctcaacttaagtaattgacctgccaggtatattcacccatccagtggaagagctgagtccccgccccagtcatctaccagtatccagcctggggcctgtacttagatgtgaaaggtgctgcttcatttctgaccaagagactgagaagtttcccagaatgcaaacaaagcccaggcccctgaaatctttccggtcaagcctttatcccagcactcagttgttttggatgtctgttcctacttgcccttacccccaaagttacagatcctagttacaggactctgccagctttgttaaactgtccgtgagacaagaaagccattggggaaaccaggtgattgcctgaaattcttactccgttccaagtgctgttcctcccaggaaatcaaaggccagggtccttatggccgtggagccttcccgaccacagagccaacttgtgaagcacacagctctgcagcctgggctctgccctgcctcagccgcctcccccacgctcttcaccacgttcctggagagtccggccaacctgtcccagccaaaacactgctgtattagaaaaagtctctttctggtctttctggttttgtttatgaatttccctctgtggccacaaattcctcccctcccccatgactcacagtccatatggcccacccccagacttgagcaccaagctctgcattaatgcagttggcctgcgacaaggagctgtggacccttccccatctcttccaattcactttccccaactatccagttccagaggccgcaggcctggaaggatgcagtgcatattgaaaggtggaccctctgaaaacagttaagaggaatatatgtatgttttgcccattaagaaaaaatggcaagctaaacaaatgttaaacttacagaaaatttgtcttatggtcctgagcatatttcccttttagagcaagcctggattcttagcaaagtgtttcccccatttgctcttttagctgacaaatctgccactgtgatgatggtttgcagcttttggaagcagtatggcaacctggcctgacatgctctttaggcttccactaacctggggctttcagaaattctatttggcctttctgtgggtagctttccagcttctcttctagggagccccaggcatcatttcccaaaagcatccccatctcctgattctcttggaactcctacagataagcatcctggcagaggcccaggctcccaaaccgacaaagtgaaaagagaccagagaggccaagcatattgactggtgctgttcagggcctgctcttttccactcaccacttgttttgctgcttgtcacgaggagagttgttcctgtatgtggctgctctcagatctttccaagcaagccagtcatttgaagaggttttcttttcatgctggagggcaggctaagatcaatgagtggaagagagaaaggctgttttagctcaagttaaaggaacaccttctagccatcaaagccgcccaacagaggcaagggccaccacacatgagagagcgctctgtccttaaagggaattctctgttgagtgggaggtgaacaccctggttcttccaactcaggaattctcgtggctgggctgggtcagtgatggctttgtctctttatgtctaaagtgccctatggctgctgaaggttacctaaccattctttaaaaggagaatgaccctccatgggaatggccagcctgccaactgtgcaattgaagaagacccgatggatcaaccccatgtctcccttggggagaaagtgcataaaccaggggtctctttttttttttttcaacaaaccattgagctgttcttggagttcatctctggagaggttatacattattagaagtttgattattattatagtttgatcaatttatttgtcttagagatccaatttttactaattccctagttttttatttcagcatctgaatgtctttctccctagcacagtgcatacaatcagggccttgggtatttccagtgataactttccttggagaggatctaagaaaagcccagatttcggtagccatctccctccaaatatgtctctttctgctttcttagtgcccattatttccccttctcctttcttctgtcactgccatctccttcttggtcttcccattgttctttaactggccgtaatgtggaattgatatttacattttgatacggtttttttcttggcctgtgtacgggattgcctcatttcctgctctgaattttaaaattagatattaaagctgtcatatggtttcctcacaaaagtcaacaaagtccaaacaaaaatagtttgccgttttactttcatccattgaaaaaggaaattgtgcctcttgcagcctaggcaaaggacatttagtactatcgattctttccaccctcacgatgacttgcggttctctctgtagaaaagggatggcctaagaaatacaactaaaaaaacaaacaaaaacaccaaaagaaaaaaaaaagccatttaaagccagccactagagggagtcagttcagttccgtaaaggtatgctcagtgcccgctgcctgcaagctgttggggaccccagggagggcaaggcagcctgtccctgcccccagggaactagaacatgacaagaattctccgcactgtgcctacctgtccctttaccttacctctctggcccagagttcttggagggttttttctttattttcttatgtactcatctacttattctcaaagtatttagcattcaacactctttttgctttaaaaagaatggccttacaaagggacagaaaagagaagacacgagcttggtgtattttcatcaagttatgtggcagagaaatccagatattaccaggacctgtctaaacaaatgttgtgggttttcttttcattcggatagccactttatagttggaatatcaattctaatgaggaggaagacataaatataagtggtaaaaagaaacatgacttcccttaaaacaggctggataatctatatcagccttgtgggtggagactagtatttgatccttgccatataaaacattttaatatggtttacatgggaaaatatcgatggcttcctcacaaaatgtatgggtgacgtgaagttgaagagccaatggcttgggtgacacgtgctggatccaaaaagatcagggagactagaataaaacttggatgttaaaaattcaccaggaatccacataaagtactatatttgggctaaaatgaaaaactaaatacaaggtgggagagaggcaagaatttcagttgactaagctcagtgtgagtcaaagtgggatggaaccatgcaaaaacaaaacccacagacatgcaggctacgtgaggagaaaacagtggtgaggatcacatcacattgtgtttgcatttgccggaaccatactttaagaagaaaaccgatcatctataataacatcagtttatcaatgccccgtcctgatgaagtgtgcagactctcagaaacagcaggaaggacttcatgagaaccctcaggctggagaagggactagggcacaaggagagctctcctaggaccaggaccaagaagctacaggcaggcacagtttagctcctgcagagacccagcttttcacaagttggagccttccagagatagagggactgtggtaggtggtgacccaccatcactggaggtggaagcagaggccgtttgccagggatgctggagaggggattcaagcatctggctgggcaacgtgatgctcagggccgtctccactcagggcttaggggagtctgtgagtagaagagctttaggtgatttgtttggtgggggaaggcaagtacacagctatgcactttccgtttctgacttttgccaccctgtcagccatggggagcccactgtgggactgaaaccctgagctgaatgcggcctcatgtctcagagaaacactggcaagttggtcagagccgccgtctgcatcgaggcgtagctgagcggcaggatgggggctgcctgcccagggtctctcaccgtggtgtaagcagagccatggcttgcctaggaccctatagataccatcactctttctcagctcgactggagtttctgcacctttgcaggggcaaagtaactccctgcaccctgaaccaccccccattcctgttcatttcagcagataatgatggagggggggggtgtccatcgtgctgagggtgtgaccgcaagagggtgaaaacttccagccaactttctcagtcctttctcttgcgagagggaagccacctgctatacaaactaataccccctgccttgaccccttccccacgactcagttgacagaaggatatactttgttataacttattattttgttctctgtaaatacaagatgtttataggaaatatgtattctgaactctatctgcagaatgagtcactacaccaaaatagttctattatttagaatgtgttaattttaaagggacctgataggtatttatttacatatgcgatccacatttgtgtgaaagcatgtgatcatactaacccagcctcctggaatgtcgctgtacgatgattgatgtctttttctcagtccatagttacaattgtttagtatgctaatcagtccagttccctgaggtttaagatcaaatataaattactctgcttttcgactcattcaggtagcattgtacctgaacctgattgctactttttcatcttaaatattatatttcctcatctaatctgccttcccctcatccacagacatttggagaaggaaatgggagggtgtctgttatccctttctctttgctttgtccccgttgttagactggcagcgtcagttgctcggtgggcttggttagagccgtgggtgaggcaggtggctggcggggacagggagaggctgagagggaagtggtggcatttactgctctgacacttccactgtccctgctggggatgctggggccaaggcctgtggggcctgtgaactgcacagccaggagcaaggaacccactaaatactccgtcacctccatgtcccctctacagtgttaaattattacataagcaggtgaaaggtagaaggcgaattatgtgagtaaatatggtctgttttctcttcagcaaaaatgactatttttgtgtgtgactaatttatttttattattgtaaagatacaataaaccggttgaaatatctgctttgttgacaagcgtgtgctttctctggccttattcgcgttctgttctcctgcaaatagcgccctctaaaaagaagagtcagacaataaactggttgaaatatc

SEQ ID NO: 12595 - DNA, 475 bp, Homo sapiens
cgtgagccactgcgcctggcctccattttaaccatttccaaacgtacaactcactagtatttaaagcaaccacagtgttgggcaaccatcaccccaaaattccatttattcttcaacagttcaatacaggagtccaccaggcgccggccactctgctgagcacacttacatgagctcatttcgtcttcacagcaaacctatgaagttcaaatattgtttcctcctacagatgagaatattgagactaggagaggtttggtaccccagctgatacttggtggtgctaggatgctacagtcctcttcccctagaggctgaggcttgtctctttgccgcctccatctccccagggcctggcatgttatatggttccagcctatactagttccaacctctttctccacatcagtttcagtcactgggcaacaattgcacaaggactggttgaaaaagtccagcgctgcccatcctaccc

SEQ ID NO: 12596 - DNA, 976 bp, Homo sapiens
cctgcctcagccttctgactagctgagactataggtgcatgccaccacaccaagctaatattttttaaccaataggatttagggtgttttgttgtgtggcaatggatatctgaaacagaaatcaatatgttacaccccttcccacaaatataatgacactccatatcctccttaacttgctgtatttttctcttgttgcatttaccacctggcttactgtgtatctacctatttgttattgtctccctatccccgctggaacacaaactctgggaaggcagagactttgtcttattcattactgtatctgagcgcctggaatagtgtctaagataggccctcaatacatatttgttaaatgaaggcatatatttaatttaacttgataagtttgctttttgtagacatagcaagtccataaaaagaaaagacaaattaatttaaattgcccatgccgacagccttccctcttatggacacaatatctggagatgtctaaaatactgcgatcttcgcctttccactgaagcataccttccaaggggaaaggagtaagattctgctcctttaatacatactgacctcaggagaaagggactagaaatgtatggactgaatgtctgtgtgccttgcaaattcatatggtgaaatcctaaaccccaatatgatggtattaagaagtgagacctttggaggtgattaggtcatgagggtgaagccttcaggaatgggattagtgcccttataaaagagacttcagagaattctctagccctctttatgccatgtaaggacacagtgagaagatgaccatctatgaaccaggaagcaggccctcaccagacatcatatcttccagcactttgatcttagacttcctagcctccagaactgcaagaaataaatgtttgctgtttaagccatccagtctatgatattctggtatagtagcctgaactaagacaagaaaaaaaaa

SEQ ID NO: 12597 - DNA, 976 bp, Homo sapiens
cctgcctcagccttctgactagctgagactataggtgcatgccaccacaccaagctaatattttttaaccaataggatttagggtgttttgttgtgtggcaatggatatctgaaacagaaatcaatatgttacaccccttcccacaaatataatgacactccgtatcctccttaacttgctgtatttttctcttgttgcatttaccacctggcttactgtgtatctacctatttgttattgtctccctatccccgctggaacacaaactctgggaaggcagagactttgtcttattcattactgtatctgagcgcctggaatagtgtctaagataggccctcaatacatatttgttaaatgaaggcatatatttaatttaacttgataagtttgctttttgtagacatagcaagtccataaaaagaaaagacaaattaatttaaattgcccatgccgacagccttccctcttatggacacaatatctggagatgtctaaaatactgcgatcttcgcctttccactgaagcataccttccaaggggaaaggagtaagattctgctcctttaatacatactgacctcaggagaaagggactagaaatgtatggactgaatgtctgtgtgccttgcaaattcatatggtgaaatcctaaaccccaatatgatggtattaagaagtgagacctttggaggtgattaggtcatgagggtgaagccttcaggaatgggattagtgcccttataaaagagacttcagagaattctctagccctctttatgccaagtaaggacacagtgagaagatgaccatctatgaaccaggaagcaggccctcaccagacatcatatcttccagcactttgatcttagacttcctagcctccagaactgcaagaaataaatgtttgctgtttaagccatccagtctatgatattctggtatagtagcctgaactaagacaagaaaaaaaaa

SEQ ID NO: 12598 - DNA, 1753 bp, Homo sapiens
ctcagccccatcatgtgagctcaaagtgcttcacctcactgtgcctcagtttccatgtctgtaaaacagggtagaagtagaacttatctcagaagagttataagaattaaactagagaagaagtgagcattgtttatatgtgcttgttgctatggatccaaaactgccagtaataacaataataataataataataatagcttatgctttcgttgagcccttgctttgcacctggccagtgacaggcacattatcagtaacacaaatgcaagtatctcatctaacccttgcatcaacgctcagagatgggttttatcaacatccccattttacagatgaggaaaactgaggcagagcagttgcacaacgtcgcagctgttcctggtgcttcacccagatcctcattgccagtaaaccactcatcattcagcctttgctgatctgtgcctaatggcttataccaatactttctccggagaattccttagctagcaaaagccatttcacccagggagttatgctctcacatgctgaactggccaatgactaagcgatatgaggcgagaggagtcacacaaaagtccagtcctcctgcttcaaggcagaatacactccagagacccacgtgagatcaaggctagcctcagcctgagagcccattcttgcttggctctgtcccctcccccatcatcctccttccctcactttccttctcctgagaacccccaccttgaataaaccgcacctacccaaatctcattctcgggcttccaaggaacccaacccgtcacacaacttgcagggattcggaccaggttttctccttccaaagggccccacgtgaaaccaccaagctgcaccaggctcatctcaaaatcagagtcatgggatcaaagaacagttgctgatgccaacccctgccggcatgagcccaccgctggggaaacaaggcgaaccagacatctcagactagaggagtgaatccaaggagagaagatgacaggaggtttatttgttctcacgctgctaataaagacctacccgagactgagtaatttacaaaggaaagagggtgaatggactcacagttccacatggctgaggaggtctcacaatcatggtggaaggccaaagaacagcgaagtcacatgctacacaggggcaggcaagagagcttgcgcagcggaactcccatttataaaaccatcagatctcgtgagacttactcactaccatgagaaccgtatgcggaaactgcccccatgttttaattatctccacctggccccgcccttgacacgtggggattattacaattcaaggtgagtttggatggggatacagccagaccatatcaggagagggcacagcattaggacgcagcctgtggtactgtaattcgggtcgggggaggttgctgaaatacactcataaggatagtttaaaaagagcatcatcggccgggcgcggtggctcacgcctgtaatcccagcactttgggaggccgaggcgggcggatcaagaggtcaggagttggagaccaacctggccagcatggtgaaacctcgtctatacaaaaaatataaaaaattagctgggcatggtggcacgtgcctgtaatcccaagctgctcgggaggctgaggcaggagaattgcttgaacctggcaggcggaggttgcagtgagccaagatcattgcgctgttgcacaccaacctgggcaacatagcaagactcggtctcaaacaaacaa

SEQ ID NO: 12599 - DNA, 1811 bp, Homo sapiens
ctcagccccatcatgtgagctcaaagtgcttcacctcactgtgcctcagtttccatgtctgtaaaacagggtagaagtagaacttagaagagttataagaattaaactagagaagtgagcattgtttatatgtgcttgttgctatggatccaaaactgccagtaataacaataataataataataatagcttatgctttcgttgagcccttgctttgcacctggccagtgacaggcacattatcagtaacacaaatgcaagtatctcatctaacccttgcatcaacgctcagagatgggttttatcaacatccccattttacagatgaggaaaactgaggcagagcagttgcacaacgtcgcagctgttcctggtgcttcacccagatcctcattgccagtaaaccattcatcattcagcctttgctgatctgtgcctaatggcttataccaatactttctccggagaattccttagctagcaaaagccatttcacccagggagttatgctctcacatgctgaactggccaatgactaagcgatatgaggcgagaggagtcacacaaaagtccagtcctcctgcttcgaggcagaatacactccagagacccacgtgagatcaaggctagccttagcctgagagcccattcttgcttggctctgtcccctcccccatcatcctccttccctcactttccttctcctgagaacccccaccttgaataaaccgcacctacccaaatctcattctcgggcttccaaggaacccaacccgtcacacaacttgcagggattcggaccaggttttctccttccaaagggccaccaagctgcaagctgcaccaggttcatctcaaaatcagagtcatgggatcaaagaacagttgctgatgccaacccctgccggcatgagcccaccgctggggaaacaaggcgaaccagacatctcagactagaggagtgaatccaaggagagaagatgacaggaggtgtatttgttctcacgctgctaataaagacctacccgagactgagtaatttacaaaggaaagagggtgaatggactcacagttccacatggctgaggaggtctcacaatcatggtggaaggccaaagaacagcgaagtcacatgctacacagcggcaggcaagagagcttgcgcagcggaactcccatttataaaaccatcagatctcgtgagacttactcactaccatgagaaccgtatgcggaaactgcccccatgttttaattatctccacctggccctgcccttgacacgtggggattattacaattcaaggtgagtttggatggggatacagccagaccatatcaggagagggcacagcattaggacgcagccggtggtactgtaattcgggtcgggggaggttgctgaaatacactcataagggtagtttaaaaagagcatcatcaaggagacaggctttccagccttggccttcgggagaaagaaagagagagtgaaaaaaacatgggctttaggcctgacgcgtggctcacgcctgtaatcccagcactttgggaggccgaggcgggcggatcacgaggtcaggagttggagaccaacctggccagcatggtgaaacctcgtctatacaaaaaatataaaaaattagctgggcatggtggcacgtgcctgtaatcccaagctgctcgggaggctgaggcaggagaattgcttgaacctggcaggcggaggttgcagtgagccaagatcattgcgctgttgcacaccaacctgggcaacatagcaagactcggtctcaaacaaacaaaaaaaa

SEQ ID NO: 12600 - DNA, 1002 bp, Homo sapiens
gagagaaggggccaggaaccgctgctttcattagcagctcctctgtactttaactttgtacgatgtgctcatattactatgatttttttttttaaattcaaaagggaaaaaaataagaacaaaatgatgatggttatttttaaaactatgtaattaaacctggaaaaatctcattttgctaaacggaaaaaaagtagcaggatactaaactatattaatagtatggtcataagtatgtttaataaagaaagagaaaaacatatatgggaggagaaaaatctgaagaaatttactaccaaatgatagtgggtgggtttctctacttttctaggtttcccacattttcagcaacgtgattctcatactttcctaatgaaaagaaatacattcattacataaaataaattaactgggccaggcgtggtggctcatgcctgtaatcccagcacttcgagaggccaaggtgggcagatcacctgaggtcaggagttcaaaactagcctgggcaacatggtgaaaccccgtctctaccaaaaatacaaaaattagccaggtgtggtggtgtgtgggtgtgtgcctgtagttccagctatttgggaggctgaggcaggagaatcgtttgaaccggggaggtgggggctgcagtgagccgagattgcgccactgtactccagcctaggtgacagagtgacattccatctcaaaaaaaataaaataaaaatggctgggcgccgtggctcacgcctgtaattccagcactttgggaggtcgaggcaggcagatcacgaggtcaggagttcaagaccagcctggccaagatggtgaaaccccgtctctactaaaaatacaaaaattagctgggcatggtggcacttgcctataatcccagctactcgggaggctgaggcagagaattgcttgaacctgggaggcagaggttgcagtgagccgagattgcgccactgcactccagcctgagtgacagagcaagactccgtctca

SEQ ID NO: 12601 - DNA, 1000 bp, Homo sapiens
gagagaaggggccaggaaccgctgctttcattggcagctcctctgtactttaactttgtacgatgtgctcatattactatgattttttttttaaattcaaaagggaaaaaaataagaacaaaatgatgatggttatttttaaaactatgtaattaaacctggaaaaatctcattttgctaaacggaaaaaaagtagcaggatacgaaactatattaatagtatggtcataagtatgtttaataaagaaagagaaaaacatatatgggaggagaaaaatctgaagaaatttacctaccaaatgatagtgggtgggtttctctacttttctaggtttcccacattttcaacaacgtgattctcatactttcctaatgaaaagaaatacattccttacataaaataaattaactgggccgggcgtggtggctcatgcctgtaatcccagcactttgagaggccaaggcgggcagatcacctgaggtcaggagttcaaaactagcctgggcaacatggtgaaaccccgtctctaccaaaaatacaaaaattagccaggtgtggtggtgtgtgggtgtgtgcctgtagttccagctatttgggaggctgaggcaggagaatcgtttgaaccggggaggtgggggctgcagtgagccgagattgcgccactgtactccagcctaggtgacagagtgacattccatctcaaaaaaaaaaatgaaaatggctgggcgccgtggctcacgcctgtaattccagcactttgggaggtcgaggcaggcagatcacgaggtcaggagttcaagaccagcctggccaagatggtgaaaccccgtctctactaaaaatacaaaaattagctgggcatggtggcacttgcctataatcccagctactcgggaggctaaggcagagaattgcttgaacctgggaggcagaggttgcagtgagctgagatcgcgccactgcactccagcctgagtgacagagcaagactccgtctca

SEQ ID NO: 12602 - DNA, 2155 bp, Homo sapiens
ccgccctgtccgactgtaacagaccaggagggtggcggaggaactcctgccacgccactgtgtcatgaaggaaagtgaaagggaacgaggaagtaggaatgcccacgctcgttgactccgtgggtgaatacagcagttaggacatacacaccatcacctttgaaagtgcttgtttgggggagggaaggacatacgggtaactagaactacccagcgagtcgtccagaggagaggatcaggtttgagtcaggaggctccctgtactggagtcgtcccactattcctcaagaaatcttagaaccagcttgtgaggaaaaacattttttaatgtaataaaaatatgccattattctttgaaatgccaaatgatataaatattttgcctaatacatatttattgtagatgaaatgcactcttctcgatgaggcctcgatttgaatcaatggggtgggccacaggaaatgtcagaggaaccagaactcagaactcttcctcctggacctttcttcccttcccttggaggtatccctttgaatcaggcctctctcttctcatcagtctgtagcttccccccttgtataacctgctttcctttttacatttattaaaagtggattttgtaaaagcatttcattgacacgcgacctatcacagacaatggaattcgtcagtggtggtaagactgaaatcctgatgcttttcacacttcttgtctcttgctatgtatttctgcctctagccttgccatgttttgccttttttttttctttttggccaattcctttttatatgtgcccacaacagaggtggggagacacggagcaccctgggtccttcccagcgctgctgggcaggccccgtctccaggccccagctgttgaaactttgaagggcaacaaacaaccatccacactgccggaccctaggctgttcagggaggcagctcatttccaccccggccccaggacacccagcctgtgccccacaaggatctctctaaatgggagggattgaggctacttttctgccaagccctattaagtagtaatgtggggaaacccactgtgtcagtgcaggaagccctagacaaatgttttcaaataaatttcactgcccagcctgcacagatttccatttgaagtacttcccatccaccctgacacccaaaggggtttttttgttttgttttgtttttgagacagggtcttgctttgttgcccaggctggagtgcagtgacgtggtcatagctcactgcagcctcaacctcctgggctcaagtgaccctcctgcctcagcctcccaaagttctgagatgataggcatgagccattgtgcctagcctattttgatttttttcttagagtcaaggtcttgctctgttgcccaggctgatcttggacttgcgagccaccatgcctggctgggttttttaaaaatagaatctcactgatagcctgcaagaaacagatgcagtgcctgcttccgtatcagtccaaggagccctcgtgtttgccacctttacctttgaacctccccctgcctccctgcctgtgtccgcttttgcagctcaatgcagccatgacaaggaaagaaaagacaaaggaaggccagagagccgcgcagttctctgcaggtgcagatgcaggcagtggaggtggcctgagcaggcagaaggacaccaagcgccctatgttgcttgtcattcatgacgtggtcttggagcttctgactagttcagactgccacgccaaccccagaaaataccccacatgccagaaaagtgaagtcctaggtgtttccatctatgtttcaatctgtccatctaccaggcctcgcgataaaaacaaaacaaaaaaacgctgccaggttttagaagcagttctggtctcaaaaccatcaggatcctgccaccagggttcttttgaaatagtaccacatgtaaaagggaatttggctttcacttcatctaataactgaattgtcaggctttgattgataattgtagaaataagtagccttctgttgtgggaataagttataatcagtattcatctctttgttttttgtcactcttttctctctaattgtgtcatttgtactgtttgaaaaatatttcttctataaaattaaactaacctgccttaagaacagag

SEQ ID NO: 12603 - DNA, 18053 bp, Homo sapiens
aggaacgaagatgccgaggagcctgcctacggagacacggccagtaacggagatccccagatccacgtgggactcctgtgagtacagaccctaccctgtttcccctggggctgggctggagactgggcccaacccgtggctcccacctgcacacacagggctggagggacccttgttacccgaggtctgaggtgaggggacagaggtggcaggaaggagtgacagggaaaagtggctccactgttgtcttccaacatggagattcacagctgagagccgccacttcctggagctgggggctccggcaggcaaagtgtggctctcggggacagttgcgcccgtgtctgccaggagttggttctgctcactgcagcacaggtagcggactccctccctcaccgtcaaggaagtaatccgctggttggcaggacaacaatttttggtttctaattacagtgtcaataagggcagtgactgtgaggtgcccctgaggaaaacagggtgtttgggtcccagccatttcctttgctcactctcgtcacttcagtccagggctcctccacctggcatggttggcatttggtcattctttgttacggggactgtgctgtacctgggctttacccactaggtgcagatgtctcctgcagatagggtggggcagaatcccaggcagtggatggccactgctgcagttgagtcagaaggatggttttacttggggggcacctgccgtccatgactcgtgtctggtttcctaggcgcgacagtggcagcgagtgtctcctcgtgcacgtgctgcagctgaagaacccggcggggctggcggtgaaggaagactgcaaagtgtaagccaggccccagggcagtggccagccagccacatggctgaggagggaaaagacagtttgggagcctgaatttccaggaaagcaccagggagtgtgtgtctgaagtgtaaagtcttcaaaagagtctagtgaatgatttgaggccggtgaaggtgccggtgctggtggcaagctagtgtgtgccgtgttggcgtggaggaagcacttgcctgtgccgtacaggactgcatcctcctggcccggggatggggttgctgatgtcgtcgtgctctgctctgtgatcttgagagacctctggctgggaccagggcatccttgactgagcggggaggaggaaataggcattgggagcagctggtgactttggcctcgatcgtgggagcgctgcctctctgagctccgtggccccagatgggggcctgatggagggtcccacttacccaagcaggtgaccatgcctgtaatggtctgttcaagtcgcagggtggggcccctttggtgagtcttctaaaggcctcaggatccctgagtgtgagcagctgggggctcggctggggttcggccaccccaatgacctctgcagtgctcacagatggctcagcccctcccatgtgccagacttggggcagggagggtgggaaatacgggctaccccatgggtgatgggcagagaaagcagtgggggagccatgcagaaaaaccagaggggcgattcccaaaaaggtggggagcagcagggcctggaagcatccgctgcttcagtcctggcttggaagtcatcctccttgtgagtgacttcccccatccctggggtacatcgttctatgcttagttgagaaaggaactttttgcaaaggactctgagactgtagccacagctgcccaaagggggctgcacgtggggggtctgtgcgcattgtgtaggtcgcgcctgccctgggactgcgccatctgtgagcgccgcctgcacgcgctcttccctcccccgttctgtttgcagccacatccgagtctatttgcccccactggactcgggcacgcccaacacttactgctccaaggctctggagttccaagtgccgctggtgtttaacgaagtgttcagaatccccgtgcattccagcgcgttgacactgaagtcacttcagttatacgtgtgttcagtgactccgcagctgcaggaagaactgctggtatggcgccaggctccgcccgccccgtcctccttccttccttcgtgtttcagtcagccggtcttttttttgtgtgtatctttctttcccttctttctcttgtactcttttgtgatgctttcttaggtttcgtatgtctttgccttttggcctccctctctctcttctgcctccatctctagttccctccctcctttcccctctgccatcctccctttctcccgtggtgggttgcttggaagttgtgatcttcttcagtgtttctgtggctggaaatacaaacagggatgatccaaccagtgatgttgtcaagcaccttgtcctctaaatgtgtcctctcaactagtactcacgaccctgtgggatgcctttgcgtcagccccatcttcagtccagggaacaaagtagggttgacagatttagcaaatagaaatacaagacagtcagctaaattcgaatttcaaataaattatggatgctctttaaagtgtaagtatttcccatgcggtgtttaagactcacagggaaaccctgtgttgtttatttgaagtgcagattcacctgggcgccctgcacgttacctggcaaccccggggcgaggcctcaggagaatccgcagtttgtcctcagtatcccagccatccaaggcccatgccagggttggaagccagggtggattccttccatggccagagtgttctgtcttggttctgtcccctcagcggcacaattagggcatgtagagttcagcagtcgtttcttatttcagaaattcctgagcgaatctgcctcatcactgcagtagagctgtgagcctggcccagcactccaggttgcccattcttttgccctttctgatcccttcccagcactttctgattgggcggaacaggcgaccagggagccacccattagactcctctgcagttgctttcattgtgctgcagtcctttaagtaggaatgaaatcttttatgtcttgtttggttaagattgaagggtagcctgggcacagtggctcatgcctgtaatcccagcactttgggaggccaaggcgggtggatcacctgagctcaggagtttgagaccagcctggccaacatagcgaaaccccatctctactaaaaatacaaaaattagccgggtgtggtggcgcacacttgtaatcccagctactcgggaggctgaggcgagggaatctctcgaactagggagggaggtggaggttgcagtgagctgagatcgcaccactgcactccagcctgggcaacggagcaacactccatcacacacacacgcacacacgcacacacacacgcacacacacaaagattgaagggtgaactggatttttttgagacagggtctcactctgttgcccaggctggaatgcagtggtatgattttggctcaccacagccttctgagtagctgggaccacagttgtacatcatcatgcccggctgatttttaacttttttgtagaggcagagtcttgctctgttgcccaggctggtctcgaactcctgggctcaagcaatcctcccacctcggcctcccaaaatcctgggattacaggcatgagccacctgccctgcctgaactggatattttaaaggactctagtcatcacggcgaaatcattcagtgcctgttctggcatttctttaatacccctgcagggcattgctcagattaacctggctgactatgacagtttgagtgagatgcagctgcgctggcattccgtgcaggtgttcaccagctctgaaccatcaaggacgcgggaggctgggtgtgcaggagagagctccgcccgggaccctgcacacaccatctccatctccggcaagacggtacttggccctgctctaaggagctgatcactgctgccttcgtgaccctgagactggctttgtcttggggaagtcatttcttagaagtgtctttgtagacgtaagtcagtatagtggggtaaaggagtagagtttccatatggccattgcatgcgaatgtttttttaatgcaaatgtgttcatggtcatgggtggtacactggctagttttaaatatgagccctcagagctgcaggagaaggccacatgaatgcctccaccacagacctaggtagggtgagtttcttctcacggaagggcagcagagtggcctcctacctgtgccatgtggacacctgccgtgtgcgcagggtctgctggcctgagctgtcctcacgcaccccctcttcctgcaggatgcggtgacggtgctcctggccagaaccacggcacagctgcaggcggtggagagggaactggccgaggagcgggccaagctggagtacacggaggaggaggtcctggagatggagcgcaaggaggagcaggccgaggccatatccgagcggtaagggctagctcagcgggcaggctccggctcatgccctccctggaaaggagcatgggtgccctgtggtcagaaggctcgtgaaaactgtcaggggggagcacattttctctggggagacagccagtgtgccaggcagcatggctgtctctgaggtgcacttgctttcctcagccatgcctccatagaaggtgctgggcaatccttaggcaccactgcccagaagtcgattctggtggaaattgagtgctggtgtggacgagggcagctccccgaagtctctctcctgactctcacgtgtgcttttcaccttttccttctgtctgtcctggagtttcttgtcgagagtgggactgttgaagcactgccctctcccaggattggatacagtaaggtcccttgaagttgttggatttttttcttttttaacacctgtattgagatataatgtacctcccatgcagttcacccgtttaaagtgcacagttaggtggtttttaggactgaatgggcacagtcaattttacagcattttattttcatcacacactctctgcctgtccctagccaaatgcgctcccaggttctcctctgattccctgcaactacaaatctgccctctgtgtctatggacttgccggtctggacacttcctacaaatggggtcatgcggcgtccctttctgcttcacgtgaagcagcctattggtgaatccttggccccgtggagacctgcatgcgatagatgaatgattccggtgaatgggtgcccctggtgccctggtttgcgttcatcgtctctggaggtgctgtacatattgctgtacttccgcatttttccataaagtgcgccatctttccagggcttcctgctgcttcccagtggctttccctgagtttagtttacagaggaatttattttggggagcgatagtgcatgcagaggggaaggtgttgtgttcagggatggacaggagttgggaggggtttggggctgagtggtgcagttttctgggatcttcagtggctgccattggtgacagagaaagcccctcttaagtacagtccttcaagagccatcttccctggaaaacagaagcgcccttttactttatgagagatgcaacagtcttcaatcattggaaagaaataggttgtattgcattacctctactactgtgctctaagagtagcatgaaatacatcccgtttggtgaccatttgggcttctgcaatgtccgccttcaggagttggcaagcggactcggtggatagcggctgtagcaactgcacccagaccagccctccgtacccagagccctgttgcatgggtatcgactccatcctgggccacccatttgctgctcaggcagggccttacagccccgagaaatttcagccctcgcctcttaaggtaagtagaaaacataggagattgtccggagcccctcaccccaaatattttgccatacgtaccaggtatactgccctggaaggagaggctgtgtgcccccaaattcttcgtgagaagtgtgaggggatgggggaagatgcaccaaaggcaagcagagccgaggctcccggggaggagagccacgtggctgacctgcacacacacacgcagtggcccgggtgttgtggtgtaaaatgggcactgctgttggatttgggggccacagctaaggctgggtttactgtgagccgaggaaaagaagtgaatggcctgagatgtgtaaagggcttgaataggcaccgctgatccattcccaccttcagggacaaagaggctctggagggtttgtgagtcccataggttttggacatttgtagttcctcttccccttttgtgaaatgtagaatagtgctgtccttttgccccttctgctcatctgctcctagctgtactgtcaccctgtctttaggggagaagtctcatgtttatagtgcctgtgaggtcagggaaggcactgtcaatgctgttttgaaactttgtttccccactgttcagctcacaaaagtattttatcaccctcacgcccctgccctcacccagaagcacaaagtgaaatctgcccccggcagcttcccaagctgtgacccacagcaggttcctagttgttgttttggaccaggctgctggtcatggcccttgtccaactttctgagatctcaaaaagcagcagcccaagccagggcgagtggccgtgggagggttttttggtgtttccccttccctcaacttttagttttgaaaaagtgaaatctgcagtaaagttgctagaataatgcaacaaatacctgtacacctcacctggatcccacagttgttagttcttcagcacatttgcattctccctttctgtgtgggcatcacagatacaacaaagttagtatagcgggtgagtaggaaaaaaaaaaaaaaagaacacaaactcccaccctcgagagggaggcgccaaaggagacattgctatcatacgttcatgtcacagagagcaaggcggcttctggagaatgcaatggcagggaagcggacaaacacttgtagagaggtttgcagttttagaaagggttcacatttagaaatgtaaatttatatttacattttacaaacatcaggatgataaaagggtgcaactgctatggaaaacattatggtggttcttcaaagcattaaaaatagaaccaccacaggatcccgcagtcccgcttctgggtatatctgggtgtatatccagaagggttgaaaggatcttgaagaaatatgtgcacacccatgttcatagcagcagcattattcacagtagccaaaaggtggaagcaactaaagtgtccatcatggatgagtggataaagaaaacgtggcctatccatgcaatagaatattattcaaccttaaaatggaaggaaattctgtcacgctgcaacatggatgagctttgaggactcatgctgagtgaataagccagtgtgaatatttatttggtcttcaactctttgagttgcatgttacctggcatgcaactcctaaaatccttagaatctgaaaatctgtcgcccaggctggagtgcagtggcgcgatctcggctcactgcaagctccgcctcccgggttcatgccattctcctgcctcagcctgaaaaaaaatctttttatatgctaatgagttactggtggctggctaagagaatagaaaagcacaaaaagacaaataccgtcgtgaggttcctggagtagtcgaattcacaggggcagaaaatagaatggtggctgccaggagcttggatggggtgcggggatgtgttacagaacggaactggggtccattcgcccggtgcagtaaaaccaggtgtctgcacgaaggtgttttgcactggtggaaagagggcatttatttgcaggtgccaagcaaggagatttgggcagctcacatttaagactcagcctccccatgccttgcagggaagggtttttaaaggcagaggtaaatttcaggaaagcggaagtcacaggcaaaatcctaaaccaatccatggaggttacacgttgcttttggcctagaaggataggatatcttaatgtgggggcttacaggacgtagatggattcaaagattttctgattgcaattggttcaggaggcaaagctttgtctaaaaatttggggtcagcagaaaagatagttagctctgacttgtaggtgtgactccctccagacccctcaggaagagattcagaataaagagcaagggtcagagtgcagtcctcagctcccccttatctgagatctgtgccagcgggtccctttggtgggggtctgggtttctgaaagacagtcggggacatatgttaagatgtctttggtttctttttttcttttctttttttttttgagatggagtctcgctctgtcacccaggccgcagtgcagtggcgtgatctcagctcactgcaacctctgcctcttgggttcaagcaattctcatggctcagcctcccaagtagctgggattacaggcgcccaccaccatgcccagatgaatttttttttttttttaagtagagacggggtttcatcacgttggccaggctggtctccaactcctggcctcaaatgatccacctgccttggcctcccaaagtgctgggattacgggcgtgagccaccgcacctgaccaagatgtctttagtttctctaggcaaccaaacatctccagactctaacttccttggctattgttttaggctactattaccttcttgcttatcaggttacttacttacatctcagggatagcgaggtacctggaatttcccttgaaagaaattgattttcctttatttccatgctcgggaggtctgcaggcccctaaaatggggtctctgctctatctcaggagtgggaatggggagttgtttagtggagaggacagagtctcagatttacaaggtaaagaagttctggagatctgttgcccatcagtgtgaatggacgccactgaactgtgcctgtacaaatggttaatatggtaacttttgttgcgtgtttttttcccacaatattttaaaaaacagggccctgaagggcctcactgagaaggcagtgtttgagtagagatcgtcaaggaagggagctcagagctttgtgcagaagcatgggcaggtgtgggagcagccagtgtgtgttgtggggcggtgctgaggacgaagggagtgtgttgtggggcccactcaggacccttccttttctctgagggcatgagaagctggtgggttttgagcccagtggcaacatgatctgactgtagcttttttgttagtgctttctaaaatttattgagttgaagttcacataaagggaagcattttaaagtgtatgcatcagtggcatttggtccacagtgttgctcacccgccacctctatctagtttcatgacgtttcaatcaccccagagtaaaacccgtccccattgagcagtcactcccattcccctccccctagccacctgcagccaccaaaatctttctagctgtgtggatttacctcttccggatgtttccagaagtggaatcatatactatgtggcctttgccgcatggcttctttcactcagcacgatattttcaaggtttatttacattttagcgtgtataaacactccattggtttttatggctgaatgctattcccttgtgtggataagaccacatcttgttgatccattgatctgtcaatggacatttggggtgtttccacatttggccagttttcctgggatgtccctggttgctgtgttgagaatagatcgaagggcagagaggtgtggaattgggaagactggtgaggcacctactgcactcatccaggcatgagataatggcgactcaggtgaaaggttgctgacaagtgctcaaaacccccttgatcttgaacacagagccagcagggatcgctcttggaccagatatggggtgtgcaaaagagatcggaagtccgggatggccctaacgttctttgcatgaacaaatggaaagttgagatccctgtgagaggaggggccagggtggggttggggagatatcagcctttccattgtggacgtgccacatgtgaaacgccagctaaaccccaagtggagaagtgaaagacatggttgttcccataagtttattgctcacattatgaaagaagccatagtcatgagtgaaccactccctaggttgataaggaaaccaacacggaagatctctttctggaagaagcagccagcctcgtgaaggagcggcccagccgccgggcccgagggtcgccttttgttcggagtggcacgattgtccgttcccagacattctcgcctggagcacgaagccagtatgtttgcagagtaagttggaatccctttgtcacctgtctggaatgttttgtcttccatcccctttgtgattttttttttctgctgttcatactgaaaggcatatgtatttgcaccaataataccaatccatgaactatgaactttataggtatgcggtgatgacattggtgttgtgatctccccgcatgtcctaccatgcttatctgattctggatttgttcaggattcaaattcatcccttcccccagttttcagtgttgtgtatgtattgacctgtggggcaggaagcagggcgaatcatttctacctcagcctaaggaacaagtggaagcaggggccctcttgaatgggttgagctggaggagccgggaacctgagtggcttggagccctgtggggcagccaggtttctgggccagagggtggatggtcctggcaaaggggcagtgggttctcactcacccacatgtaacttcccaacctgtggatgagtgggaggcgctcagcggttctcagccatggctgtgccttgcagtcaaatcatgtcgggggattcaacagatcctggtacccacatagcaccccagagatttgccattggtcacaggtaaggcctgggcgtcagaacttccggaagcacccagatggttctagcatgtcacacaaggctgagaaccccaaggtgggtagagggaagatgcgagccagtgtggtcaatgaaggtaggacagagtgatagtgccagcatggacttgtacagaaagggcttttaaggatgatggctcatgacacagtgacctggaggggccatttggttgagaaccatgacccttcctgcacctctgaattggggctgttgaagaaggcatctgccctggaggtgctcgctccatgagggcagagccaaggcagatcttcggagagggaagggcctcagaccctcaaaggagatgtggcaaacactgtgggagggggcctaggtggccaaaacagcctctcagccatgttggtgagacccgctgctgttgtcccattggtctgaagtgtccctgctggcagctgccccaggtggcgccgcgtccggtccaggccctcccacctgtcacacttcagccccgtggaggctgatgctcaagcgcttggctggacgctctagatggaaggccacgttcaccgccctccttgttccaggctcctgccgagccaccaacgtgtcggctggcggggctgcttattgaggcggggagggtgcaagcaggtagtgttttgcttactcagaggaaatgctctgtgtgcctgcgtaacagctgcacttactggcgatgcttctggatgcttcgctgttctgtatgtttgtatgaacgccgtgcaggtatgctgccaggccgctgcacttcctgaataggtttactggcgtggaaaataaggccacgaaggcagggatgttggatttcacacagattgacactgatcctgaggtgagaccctgccaccaaaatgaaggctgtaatgacttggctcccataaagatgacattctttacttcctgtttaaaagcacgccctgtcctttgatgggcacagctgcagttggcaatgttggcttgtcctactaccagaagtgagtctcttttttggaagtcactttccccagctattgccaaagccacaaatacagcacatgagaaagactgaggaaaagtgaaccgtgctgagggcagcgctagccttcatgggggctgtacagggcacaaaatggcattggtatcgatcacacagagattttgttggctcagttagcctggaaactgggggagggtttcgtttgctttgtttttgttttgttttgttttgtttttttcattttagcagaaactcttctttaaattgaaacccaaagacctgctacaagcaccaataatcataagtgcactcgagggcctgtgaagaggatgaaaataatccattctgagactctgattacacacacacaatgaactgtgcattgctgagaaattgtttctgaacatcattcttttttgtgcagctttatcgtagtgacagcgacagttcaacgctgccccggaagtccccctttgtccgaaatactttggaaagacgaacccttcgctataagcaggtatgtgccctgtaaacaaatatggaatctgtgcttgccctgcgagtgattttacaagccttaaaaaggtaacatttaaggtcatgtaaatgaaaaggtagtatttctatttcttgtttacttaacagatgtaatgtcgtaatgttgctaatatttcttaagatagtatcatgatttcagataatctgtgatctttacattcttcagtataataaataaccatttttatataataggctgttttctctttttttgacaggagagtatatatagtttagaaaagttgagtttttcaacatgttgcttttctgggcagggatcgtttgaataatatatatatatatatatatatatatatatatatatatatatatatatatatatatatagtgtgtgtgtgtgtgtgtgtgtgtgtagagaggaagagagacagacacacaaaaaacccccaatttccacgtggcagttgtgctccaccacatacaagagtggctgctgactgggaagaataagaaagtttataatttgggccgggtgcagtggctcacgcctataatcccaacactttgggaggctgaggcgggcggatcacctgaggtcaggagttcgagaccagcctgtccaaaatggtgaaaccccgtctctactaaaattatgaaaattagccagacatggcagcacgtgcctgtaatctcagctactcagaaggctgaggcaggagaattgcatgaacccgggaggcagaggttgcagtgagcttacgtcatgccactgcactccagcctgggagacagagcaagactccatctcaaaaaaaaaaaaaaagtgcataatttggcttcagaagtgtctctcagcagcaccactgctggcatttcagacaggctcattctttgctgtgggggttgccccgtgcactttaggatgttgagcagtgtccctgggctccacccaccagatgccagtaacaccccatcacatacacagcagttgtgacactcaaaatgtccacagacattgccagctgtcctcccgggggccagattctcctggttgagaaccatgaagctctgctgagaattcagcagtgcttttaaagaatttatatttgttaagttacaacccatatttgcatttaaattctgtgtatgtgcaaaatagcgttgtgtgtgtaaaaagcataccgtgactcaggccactgacccatggtgattggcgaatggatttgtggttttgctgcggtgactgctgtcttagggttctgtttcccattggatgggaagtactgctctcagttccgcagacaagagtcttttccctgtcagggctttcctgagcctaggtatgtttgcttacttgaggcttatatggggagggaagctttggacagcttgcatgtgtgtgtctgcgtgtttgcgtgggagtgtgtatactattttttaaacaacaagcactcgtggtttataacgtactttctttccccttgtacagtggatcattaggatttttccatgtccatatatttttttcaacttgttacaatggctacattttatactggccttgtaatttatttaacgtttcctgctgttatagacttacttttttttttctgtcataaaccttaattggaccacttttgcatgtcagcagttatgcctttcagatgcaagtttgctgtagacatatatatattctcaaatggcccttcagaaagattgttccatttttgatcctgccagccccatataagagcatctgttgctgcacatttctgccaatacataggtcatcattaaagaaaaacaatttgctgttactaaccttgatactgaactagagatttacattcctcttgcccacatctgtgttttttaaccttgggcgtgcttagagaaatacgtgtgcctgacctgtctcctattaattgtggaagaaccttctagaaggcctgagtgagggctcacagctggcgtctcttgcagtcatgcaggtcttccctggctgagctcatggcccgcacctccctggacttggagctggatctccaggcgtcgagaacacggcagaggcagctgaatgaggagctctgcgccctccgtgagctgcggcagcggttggaggacgcccagctccgtggccagactgacctcccaccctgggtgcttcgggacgagcggctccgtggcctgctgcgggaggccgagcggcaggtgggggtcccctgtggccagctcccgcctgcacctcactgctccctgctccaggctctgaagggagcctcccagacacggaggtggtccctgaaataccccaccactgggctcttggagtcccttctccctctgtgggctgcgagggtggcgtctgtgtggcttctgcgtgcatctggaggctgcgggtgctggaggaggggtcacgggccctccccaccttgttgggggaacattctgggtccccagtcgctaggcctgactgcagccaccccctggcctctgtctcctgggaggaattccttggggggagtgtgggtgaggtgggccttactccctcctgtcaccactcactgactgtggttggttcttctgggctccagggttggcagtgaacttactcattcttccttaaaaaaaaaaaaaaaaaaaaaaaaaaatcaataaaatcgtcttgttggtccaacgttgctgttccagacaagacagaccaaacttgactaccgtcatgagcaggcggctgagaagatgctgaagaaggcctccaaggagatctaccagctgcgtgggcagagccacaaagagcccatccaagtgcagacctttaggtatggcggaggcgtggcaaggccggcccctcggccctgcttcctccttactgtcgtgcctttggcatggtaaaaaagtacagtgagtctgtttttgtttttcttctgagacagagtctcactctgtcacccaggctggagtgcagtggtgcgatcttgtctcactgcaccctctgccccctgggctcaagcaagtctcatgcctcaacctcccgagtagctgggattacagatgcgcactactatacccggctaatttttaaatgttagtagactgggttttgccatgttgcccaggctgatctcaaactcctgacctcaaatgatccacctgcctcagcctcccaaagtgctgagattacaggcgtgagcccctgcgtctggccgtgtgagtctgtaaaacccatgggaagttgagaacaaaacaggaatccactgcagccagtagtgtattttcatgtttttatcctgatctttttttcctacagttttttttcatgccacttctaatcataatgcgggttcagtttggcatttagcattttttaaattaaaatattccatattgctatataatgtgctatcttgtttgactgtaatgtctcatctaatagtttactcaaccactatattttataacatgctgctcgtcttcaaatgtttgctattgtaaataacagtgatatacatacacatacatatatgtccccccacccccagacagggtctcactctgtcagccaggctggagtgtggtggctcagtcatggctcattacagccttgacctcccagggtcaagtgatcctcccacctcaccctcccaggtagctgggactgtaggcacatgccaccatgccctgctcatttttgtagagatggggtctcactgtgttgcccaggctgatctcgaactcctgagctcaagcgatccacctgcctcagctgcccaaagttctgggattacaggcatgagtcgctgcacccgaccacctttgctttttcagttaacttttgattaaggcaaaatgtatctgcaggaaagctgcgtatcatacacacatggtccagtgaattgttacaaactcgtcctaagaatcggtcattatcagtgcccccagatcccacactagagtaaccaccaccttgaattctaatagtatagattggttttgtctgtttttgtttttgctgaggggatttttacagatgcatcagtattcttttgtgtctgtaaaaaaaattaagttgaaattcacataacataaaatgacccattttaaagtgaacagttcagcctttggcgcattcacaatgttgcacaaccacccctctgtctagttccagaacatttttaccaccccaaaagtaaaccctatacccattaagcagtcactccccgttctccctcccctagctctgtctctagggatgtgcctttctgcctgtttcataggaatgggatcatatcttacgtggacttttgcatctggcttctttcctgcagctgagggttttcgaggttcatccatgttgtagcctatgtgccagtgtgtccttccttgttaagggcgaataaaatgtgtcttttagccctaatttttgtgtacatttaatattcacatagttttcactttttcattcatttgttaatacgacaggtatttcctgagcacctaatatacaccaggcactgttctaggtactggagatgaagaaacccctgctcttacggttcttcataattaacatttggagactctatacaagcacatgtgttgttggggacttaaattcagtttgttgtatgaataagaaaagccatgattgatatgagagccaccagctttccgtgtcttcatatcagcttctgacctgtaattgtctccggtcccagggagaagatagcattcttcacaaggccaaggatcaacatacctcctctcccagccgacgacgtctgatggagtgcattgtgcacatgaagtatttatccacctgttttattttcatgaagttcttagactagctgaatttgtctttaaaatatttgtgcaaagctattaatatacacattttgtaaaaaaaaaaaaaaaacacgtatatctatacatatatattttataatagtgacggcaacagggcttggtttttccttgttgtgaaatcgacatctctgaagacaggttattttataaaagatcaactatcatgttaagaatgtacagtttttatgctgttttatttgacttaaaggctggaagacagaaacgaagtgagttcaggcaaattcactgtattgtaatttatttatagtacttttttttccttgaaggaaaatactgactttaagatgtattttaagactgaaattttgttctttagtacttttcatgcagtagaacggaacttggggctggtttggtttttgacacctgaaatgcgaacgctatgtgctaaatttgtcaccgtatcatatgtgcatttaccatgtatattgtacacattcactcccttgatgtcatgttaaaatgtcccctgcagtggttcaatcgtgactcggaagcatgtgtgtgttgcagaggtcagtctctggcgtgggccgcacgccaaccgctcatttctgtgttgcctttggaagcatctttctgtgctcagcgtgagtctgaagcaggcgccagggcctctggtgtacggggcttcagcctgcttgcttgtggtggctgtctgtggggcttcagcctgactgtccgtggtggctgtccatgctgc

SEQ ID NO: 12604 - DNA, 1446 bp, Homo sapiens
ataaactgaaataggtcatgcaaatataaaatattatttttaaattatttgtcataagaaacgatggtggccatattttgctttaataatggaaaaaatgtggttagcattctttggaaggtggtcatcagatagtagacattttctaggatttatttctacctgcatatgtggaaatgtgtactactttagatttatttaatggcagctaactcagaggcatcaaaatgtgctaatggtgtaatatggcctttgtcttgctgttctgttttgtaggccttcaatcaagcaggggcagggccgtacagtgaacttgtcctttgccagacgccagcgtctgcccctgaccccgtctccactctctgtgtcctggaggaggagccccttgatgcctaccctgattcaccttctgcgtgccttgtactgaactgggaagagccgtgcaataacggatctgaaatccttgcttacaccattgatctaggagacactagcattaccgtgggcaacaccaccatgcatgttatgaaagatctccttccagaaaccacctaccggtgagtgcaagggagtagaaatctgcatcagcacatcagcacttggggatctaagtaaacctctcggggaaaatgaccaagtggatgtcatctcccagctgtttctaagagcccagatgtccagagtattgtctcaccttgatccctcaggccagaagacctgtgaaaaagccacactggttcagggactcactggacggttttgtgtccactctaacctgcaccgtctctaccccagagtggactcaaatcctcaagtcagtcctctgaacattgaagtcagaaattataaaagggctttggcaatatgttagcccaagaatttggcttcttccagaaattgtgccgaccttaacagtggcttaaatgatggtaaaacttttaagagttctaaaaggatggcattggagatacgttgacttttattaaacaacctatagttgtttaatgacttctaaaaaaatatctggagctcaggggttcaactgagggaacacatgttgagaatcattgtttactaattaaatgccaggtaaccgttgaaattatcaaaaacatcttccacgtaccagaaagcacctcagaggatagttctgttatggagaagatgaaatggtttagtagtgtaggaactatggaaaggtgagcttagatttggatagtaaaacctcaagaccctatttaaaaagtattttatgaatgcagcataaataatttaattcagtgttaatatgccaaggctagtatattgagctgaatgtgaaaagaaactcacattgggagaatgccaccttttccttataagatagctttgaagataccattttagacagatggaaattgaatagctttagaaaaggcaaatgtttgatcttggggaaaaaaaaaa

SEQ ID NO: 12605 - DNA, 12835 bp, Homo sapiens
gtgggtcggctaccgaatacaccttcacccacttgaaaccaggcactttgtacaaactccgagcatgctgcatcagtaccggcggacacagccaggttggttttgtttccatatgaaagtaaacctcattgatcaaattcggacaaactgtctataacatcagaagcaaattgcagtttaaacaatgtatcttggtaatgcaacctaatagtatcatgtcaggaaatgaaaaatagagctttctgaattgctgtttagaggtataagataggcctaaatgattccctactgaattgtggtattttcgggtacatttgtcactcactcatttctcagaaggctttgacataatcacctgtgacagttgaaaattgtctggaatttgcattgactaaataaaggagacctcggttattgcaatgattaaaaaactatagattttagagtaaaaagataagacctgcacagcactgctgttaccacatctatcaattttaagaatttgagacataccttcctcaaggtactttactgccatctgctggaaagttgttgcaaaaacaatataaatccatgatgactgagctgagtggcacctcctgaagttgtgtggtacccaacgtacacatctgtaggcagcatccattcttttgtttctactatttatatgactttagactaacctgttaacatgtcaggagccttagtttcaaccacatagtactctcataggcgcaaaacaacctaataaatatacatggagtactctagaaataattgttatctaaatggttttaacttacactcagaaaagtgaatgagaaacgagatgccaaaagatactttcactgtagagatatttaacattatgatttgaaaccactaaacatttaaaatgaaagagaaggagagatggtggcttacagccctgtgctgggttgacttttcaagagaatacctgccatttgaaggcctaacttttctagtcaacccacttgcaacatcagtttttgtgtttactttcttttgcccccaaggatggtactagggcatctagactgcccatgtagacactgcctgtgaggagaaggtccagctggaccatctttatacagtgccgaagctgtctggaatgcctcccaggtggagtaaatccaaatcaaagctgagattatcagtggtccttcctatgtgtgaggcactacacaaggtggcactgaggctgaactgctcaaatgcatagagttcatttcctctgtgccacttctcaggaagaaaactgaatgtggctgagctgtatagctctacctgattttctcccgtctcaggaagtaggtcagcttccataccactagccttacgcaaccagatcctgcaaaataaaggactgcttattttagcattaacagtacctgctggttgatgtcagaatcaattgattaatattgagtttatttgcttttctgctctgtatgtgagtggttggccatttatggtaccattttaaaatttcatccagctgtcgttttgtgttctcttctgtcctcatgaagggtctttctaattttgatttgaaggaaaagaattgtgtgcttaggatatacagtactcatgtctgctaatctaacttcaaaaataatcattcttgtttttcccagtgccatatgaagtctatagccacccttaaaacacacacacataaatttatatgaagatcttaattacattaaaagcataccataatgtgcacacatttagtgtgtaaccccttttcggtaacatttgcagttatggggtggaatttgcctgatatgtagaggtctgataaattcacagtaactaagagatggttctctctggtgtttctcctgcagtgttctgaaagtctccctgttcgcacactaagcattgcaccaggtcaatgtcgaccaccgagggttttgggtagaccaaagcacaaagaagtccacttagagtggggtgagtgaactaaccttcacattgacattgacaatttggacaattggagatgaagacttatgctttgtagttaagtttcaaagctttcttctaaagaccatatacgtttttgtctgttgaggatgtccatattcttcttgaagtatgttgacccaggttttttatgtgtgtcattccccccatccacacccgcaacactgtccctcaccttcctcttcctgatggtgccacacacatggtttatcccccgcacttcaggggacacatttctagggagtatttcaagaacagccagtctttttcagaaagttttcaactttattcatgggaaaaaaattttgtgctccatttagaatttaaaccaaagaatggtttataagatcacatggaattctttctcgtctttgtttgcaaccacctctgctgcattgtcctgtgtgggtcctgatgtttttacagcattgatttaagctgtattagcgtttcctgttgtgtccagcagtttacaacatgtataattacaagtacaaatgtacagaactctctagcagactatttttcctaccacttatgtctaaagtataataaattgtgccaatttggggtcctgtattttgatttagcatgacctttggtttccaattaaagagatttttcttccctctttttcttccatttacctagcattagaatatgaagaaatatatctaatgttcctataattttgggattattttatcaatgtaattaaataaacttcagtggacccgctttggagagtatggataacatcattcagaaacttttatttttatatctcttttttggtgggcatggattcttttgtaagggagatactgaggccggccacctatgtgatattttgctcaacttgtgtgaaatctggtgcactttggtcaactggaagcacaaagtgttctaagatgaaaaaaattcttcattcccagatgttcctgcatcggaaagtggctgtgaggtctcagagtacagcgtggagatgacggagcccgaagacgtagcctcggaagtgtaccatggcccagagctggagtgcaccgtcggcaacctgcttcctggaaccgtgtatcgcttccgggtgagggctctgaatgatggaggggtgagtataagcccatacaccataaccagaatcagaatgcataatcagaacccaaagtgctagcacttctgtctctagcctcctgaaatttttgacagtcttgatgcaaccttgacaaccattaatgcagtgtctgtaaatcttaattctgagttgatattgttgtgatttcatatagacccagcattagaagttttctgtttcttttgtcctcatatcattctatgaagacagcactcaaggttaataaggatatcaccctgtagatattttcgacagtttttggaaaatttcctattctattgactttatcagttcagggaaattaggattagataatagttctaataaaagttttatactgtcttgtctaaatgaaccagcaacatcttaggtcagtttttacaactagagaagggtagtggccagggacaccagcttgtttttgttttgtttcacgtgaaaactacaggactctctccttctattgctccatttggagttgtcaagttgagctatcaaaaattgagaatatatatgtctatgttatatccataaaggttgttgtcctttttttctttgaaattgccaaatgatgtggatttagggggagatgaataatgagcagtgggagtcccagtaactgtgaggcttttgggtgggctcagagattgatgaagcataaaagggcagaagcgtgtgggtaaagccagctaaatgccccgtccaaagtgccagtggtttgtgtagatgggctccatgcaaataaatagaattaattaattgatgattttttaaaaaaataagacagcccaacttgcagtgactttttgttttaagtgaaagcaagtttattaagaaagtaaaggaataaaagaagggctattccttaggcagagtgcccaaaactggatttctcctaattctccaatagaaaagaatttcagacacaacaatgatacttaagtgaaaacaaaaaagtctgaacattaacgcctatgtacctgaacttataatcatgtaagcgaaaagaagatggatagtgatgagcacactgttgtgtctaccccattctctcatcaacttttcagttactatctgccacaacaaagataaatgtgcaactgggctggtgtgagctgtacttttctcagccctttcactgatttatcctataaagaaactatcttcagcttgggtttattcctgttgtattagaaattaaccatatatatcgctgtagtcaccttctgaggtccatttcagagagcttccccaactccccagcatctttgcatgttatgttgagaggtggttttttgtttcccccctccccgccgtcttttttctctcattttgacaaggacagtcatatattttgttagcctggcaagtttttactctgctccaaacctttgaagtatcaaatatgccaccattaaaatgggtggttcaggtggctgtgactctctcaaagtgtggtaagtctctagcaattcctggctctgagcagtgtggtcactgatggtaacatcaggattgccgtggatacccttgaataggtgaggtgatgggaacacactgagaaaacattacagaagcatttattttcaaaatggaaaataccggtaactagaagaaatacctagaatttgatcaccaacaattccaagtatatttttattcattaaaaattaaactgcagtgggcatctgacttagttttcttggatgtcctctgagaaatatgaaagcagattgccctgttttgtcaaaaatcagcatatttttatttcatgtcccaagaaagggaaaatattttgtcaaccaactaattattttacaattaaaaaaatgacagacatctactactcagggactgtatataggagaaaaacttacacacattgaattgaaagtgaaaatcattgggtaatatttgttaattagttgtgttgatgatgatgttagcctagcttttatttggttataagcttttgtatgcacacacattcacaaacacatacacgcatatatacatacgtgtgtgtgcgtgtgttttctttcagtatggtccctattctgatgtctcagaaattaccactgctgcagggcctcctggacaatgcaaagcaccttgtatttcttgtacacctgatggatgtgtcttagtgggttgggaggtaagtcaggcatattctgcatcaacttctgtttcttctactttactcccaaatacaaataccaattataaggaagctgcaaatccaaaatgcacatatagatgattttttttttttttttgctctgtgtactatagtaatcacccttggcacttgccacttgcttatattatttagggttgtggaagttttactgtagtcaaaactgagaggaaatggtttctcatgcctttctttttgtaaaaaattttattttattttacttattttatttttttgtgtgacagagtttcaatcttgtcacccaggctggagggcagtggcacaatctcggctcactgcaacctctgcctccctggttcaagtgattctcctgcctcagcctcctgagtagctgggattacaggtgcccaccaccatgcctggctagtttttgtacttttagtagagatagggtttcactgtgttggccaggctggtctcgaactccttatcttaggcaatccacccacctcagcctcccaaagtgctgggattacaggcatgagccgccgcacctggccctattttatttttaaatttctaaatctcaaaaaaaattttgtgggtacatagtaggtatatatatttgtgatcgtgcctttcttttatatgtatttgaaatattctggggcatgttgctctctttcccattttagttaattgaatacaagcacagtaggattctcttctcagtggcattattaactacttccatttctgcctttccagagtcctgatagttctggtgctgacatctcagagtacaggttggaatggggagaagatgaagaatccttagaactcatttatcatgggacagacacccgttttgaaataagagacctgttgcctgctgcacagtattgctgtagactacaggtaggttgacattattcagatgttactcacaaggactgctgtcccatgaaaggcactttgggaaacccactcaaaggcttgtggtggaggctgtcaggagggatgatatggaaaaaaagagtccatttaaataaaaatatatttggttgttttggtgttttgcagttaatttccacttctctaggaaattctgaaacttaagaacaaaataagattcttctccattctgcttctcaccacccttgtatcttgtctgttcatcagtttgctgaataaatgacccaagtccaagggaaagatgacacagctccttagggaaggagccttctgtctcattcccctgagatgtacatttcagtgggaaagactcttagaactggtaaaagacagaaaattattttacgagctgttaaatggagccaaaaataatctggactagtctgcattagattacaggaccccacctcccacctcccagtgacggttatcaaggctggttatctataagcttccacttgggagtccagatagaataacatcaagaaaaattggttcatagcctaacccctcagagtgacaataaccatgggtttacttttattttactctcttggctatattattattttttctgtgtaaagccttagtctcttgagaaaatagagttctttgtcctcctctttccatttgttcagtaacatttcttgagcattatagtactttgtaccaggatcaaaggaagatcaggaagagagatacaaagattaatcagatgtggttgttgaccttgaagagctctgtcttcatacacatttagatttgaatagataaagaagcaaagatgccaaagtcaagttcccacctgatttaagtcatggatcaaattcgttattataagtacacccaatgtctctggtctctttggagaaaatattcgcttcataacttaatttttcagatcaactgaagcatttctgttaaattcagaagtctgctgtatttgaaacatttctgattaaactcttttgttatacacctttcttgcttctcgaatgaagcacctgggacataattaaccttttgacaatgagtcagtgtcacagcaaattgtctgatatttataatagtgatgctgagtcactggggaaaggttaaattatgtgccacactcttgtttttctaccaaggcaggatataaataaagagctgtctgccaccccagtaaagagcttcactccattatggtttttgagttttggtgtttctttaaaatgttattatatctccttctctttcagagtctatgttgtcttagcattgacttcccaaagctgcattataaaagatacattaataagaatagtacctgcataatcttgcctcgttgtattaacaggagtagaaatatattttcaaaggtctgtgcttatttataataaaatgagtcagatcttatgaagggagtactacttttaagattaccattgccacactaaaggactattgccaggaagggggtctgttcaaactataccaatttattgttatttgtggaccaaatatgaattattttcattcaacatgattacaaagtcaagttaaaccccaatattttttgaatatatggcacttaagaatttaaatattggccgggcatgggggctcacacttgtaatcccagcactgtaggaggctgaggccggctgatctcttgagccaggagatagagactagcctggacaacataacaaaacccctcctctacaaaaaaaaaaaatacaaaaattagccaggcatctgtagtcccagctgctcaggagcctgaggcaggaggatcacttgagccaggtcaaggctgtagtgacctgtgactgcaccactgtaggccagcgtgggcgacagagtgagagcctgtctcaaaaaaataaaaatttattataatacctgtactgtgttttatagaaatgtggtggaacatttcttgttttgctcaggaatttttgaatttttgtattttcaggactgttttaattaagtaccaacgtaattccattcatagggcatgttgtatattataggcatactattatttacaaaaagttgattttgaattaaatttcatttgaaaactgttaataaaaagtggtgtaaatcaagaaatgttttccatagagccaagctagttaaaaagaaagtaggatcctgcagtagaaaaagaacattggaagaattggtaagattctgattaggtctgtatgttaatagtatagtatcagtgataatgtttttcttttcttttttttcttttttttgagatggagtcacgctctgtcacccaggctggagtgcagtggcgcgatcttggctcactgcaacctccgcttcacaggttcaagcgattctcctgtctcagcctcccgagtagccgggattacaggcgcctgccaccacgcctgactaatttttgtatttttagtagagatggggtttcaccaggttggccaggctggtctcgaactcccgacctcagatgatccacccgcctcagcctcgcaaagtgctgggattccaggtgtgagccaccgtgcccggccaccagtgataatttcctggttttgatcattattctatagttctgtaacatgtttctcttcggaaaagcagagtaggagatagacagaaatttctctgtactatttttgcaacttttctgtaagtataaaagtagtacacaataaaaaggtgtttgaaaaaatagagaaaatactattttgttcataattttcccagtgggaaggaagaaagtgtagctcctactgttggcctgatactctgccagcattttacatattaaccgatttaatctttactgtaattctatgaattaggcattactgtccccattttacagctgaggaaacaagctcagagaaattaactaacctaagatcacacagttgttaaatgatggaatcaaggtttgaactaagcttcaactcttaaaagccatgttcttgtccttctgtgatatggtgatacaaagccctagttgatagaaacattgggctccatgatatcctattttttctgccgcctgtgatacatttatatcagtaccaaaatctcgaaatacatacttataaaataatttgtcatgttaaaatttttccagaaagagagttgaggtattgaggtattgtaatgaaacagaagtgggtatgacaaaatgttgcagtagagtttcaaatgtgatttaatagcaaataaatgctttaagcctgcttctttgaaattaacaaaggagttataagttttgtttagaccttgatttaagagctcaaacttagctgggtgtggtggtatgtgcctgtggttccagctactcaggaggctaaggtgggaggatcacttgagcctggcaagcagaggttgttgcagtgagctgagattgcgccactgcactccagacagagacagaccctgtctcaaaaacaaaaaacaaaacaaaactcaaactcctttagttttgtaattcaacctcataagctgtccaataagctaaatgaaaactaagttttagagtacattcacttttgtaagaaagctgccaaatgtttttctctttgtaagaaagaaaatctttttgataacatttattgaacacatactctgtatcaagtacagttgccagaaatacaacagtgagccagacaggcaactttgcccttatgtaacttgcattctaatcagaggagtactatatactatgtcagtgataagtgtcatgatgtaaagtacagcaaagaagggaaataggaaatgtggaagaccacagaggaaggattgcaaagttgaaatgtgttcagagagggctcgctgaacaggtggcacctacagaccttctctcaaatgaaggtgattgagtgagctgtgcagatgtctggagaaaaagctttctggacaggaggagcagccaagtgcaaaggccatgaggaggcagcaaacttggtgtccctgtggagcagcagggaagacagtgtagctggagcagagtcagtaaaggggagagtagcaggcaatgaagtcacagtgctaatgggtttttgaaggggaatggtggtgaacagcagatcatatagtcctgtagggttttgtaagaacttcaaagttttttctgaataagatggaaacccactgaaggaatttgaaccaaaaatctcgataatcctgattcatattttcactgaatcactctgattgctgtgaatttagactattgggcaagggccaacatagataccagctaggaggtcattagaataaccagatgggagagagagtagttggactagagtaatacaggatgtgctgatggcctggagaggggtatgagaggaagaaaggtgtccagagatgacttaattatgacttgagtgctctgaaggaggagggaaaccacaggagatgcagtcaggtttttgtaaggagggatgggatggggatgaggagctgtgtggacatttgagtttgagatgcctgttggacatgcaagtggagatactcagtggttgaatacagataccctagaccagtattcaaagcaggggactgggccacccatccaaattggggagtaggttatcagtggcgtttactccttgagacaagacgacatctccaaatgtttgagtagaggtagaaaagaggaggtaccgaagtactgagggctgatactcaccagcgttaagagttcaggggatggtggcaaccaggaaaggtgattgagaagcagcaggaggtaaggtaggaggagaaataagtgtggcatcttggagacctagtgatgaataagcatttgaaagacctgggagtgatcaaggtgtcagctgtttctcttgggtaaaatcagataagcgctgacgattgacttcagggatgagtttattattcatgtggaagatagaagatgccttttcctattgctattccaggacagctctagacttaaaagtcagatgaaccggattccggtcccagctttgcctctaaatctgaggcctaagttatcatctgactctgagttcctgtctctaaaaggcggataagaatacctaccatttaagatctaccacagggggttattatgaagatcgtgtaagatgatgtataaactgaaataggtcatgcaaatataaaatattatttttaaattatttgtcataagaaacgatggtggccatattttgctttaataatggaaaaaatgtggttagcattctttggaaggtggtcatcagatagtagacattttctaggatttatttctacctgcatatgtggaaatgtgtactactttagatttatttaatggcagctaactcagaggcatcaaaatgtgctaatggtgtaatatggcctttgtcttgctgttctgttttgtaggccttcaatcaagcaggggcagggccgtacagtgaacttgtcctttgccagacgccagcgtctgcccctgaccccgtctccactctctgtgtcctggaggaggagccccttgatgcctaccctgattcaccttctgcgtgccttgtactgaactgggaagagccgtgcaataacggatctgaaatccttgcttacaccattgatctaggagacactagcattaccgtggcaacaccaccatgcatgttatgaaagatctccttccagaaaccacctaccggtgagtgcaagggagtagaaatctgcatcagcacatcagcacttggggatctaagtaaacctctcggggaaaatgaccaagtggatgtcatctcccagctgtttctaagagcccagatgtccagagtattgtctcaccttgatccctcaggccagaagacctgtgaaaaagccacactggttcagggactcactggacggttttgtgtccactctaacctgcaccgtctctaccccagagtggactcaaatcctcaagtcagtcctctgaacattgaagtcagaaattataaaagggctttggcaatatgttagcccaagaatttggcttcttccagaaattgtgccgaccttaacagtggcttaaatgatggtaaaacttttaagatttctaaaaggatggcattggagatacgttgacttttattaaacaacctatagttgtttaatgacttctaaaaaaatatctggagctcaggggttcaactgagggaacacatgttgagaatcattgtttactaattaaatgccaggtaaccgttgaaattatcaaaaacatcttccacgtaccagaaagcacctcagaggatagttctgttatggagaagatgaaatggtttagtagtgtaggaactatggaaaggtgagcttagatttggatagtaaaacctcaagaccctatttaaaaagtattttatgaatgcagcataaataatttaattcagtgttaatatgccaaggctagtatattgagctgaatgtgaaaagaaactcacattgggagaatgccaccttttccttataagatagctttgaagataccattttagacagatggaaattgaatagctttagaaaaggcaaatgtttgatcttggggaaaaaaaaaa

SEQ ID NO: 12606 - DNA, 260 bp, Homo sapiens
ccagtttttaaaagaggatttcacttcctttgacctctaggcagataagaacagggagaaattcttgcgtaccaccccagacttgccagaagcctcgtggccaagaagtagccccgtgcctggctgcccctgaggcctcctcacaccaggagcatttgatagcttgcccacccctgttctgtgtctcctaccactccctccatgccagcggcacgtttcattatggtttcccacatccaaacctcatagcaaatgtaatt

SEQ ID NO: 12607 - DNA, 792 bp, Homo sapiens
cgcaattcgtacaagctctcagccccatgctttttcttcctctgccgtgtttacccttctggagttgcagaatgaatcacccacccgagggaagcacggttgtttttttttttcttttctttttttttgagacagtcttgctctattgcccaggctggagtgcagtggtgcaatctcggctcgctgcaacctctgcttcctggttcaagcaattctccttcctcagcctcctgagtagctgggagtacaggtgtgcgccaccacgcctggctaatttttgtatttttagtagagatggggtttcaccatattggccagggtggtctcgaatgcctgaccttgtggtccacccgcctcggcctcccaaagtgctgggattgcaggtgtgcgccgccgcgcccggccaggcttttttttctctaggcctgctgtggccaccaaggctggggaccagggggcctccagggacagggatcccaagttgcacgttaatacacggagccctttctgagatgcaggttctacagggaactggattccacctcttttggggagatcaacccagcagcccaaggatcccctgatggtgcctgagcacagctgtgagaagggggtatctggatccttggggtgacaggatgggagaggtggagcatgggcctgcaggctggcccccagaggccttaggtctctgctgactagctagaattctgaaaactgtgttatgtaagacgtttagcatctgcagtgccaaataaaggtgacccccacaacgacataaaaaaaaaaaaa

SEQ ID NO: 12608 - DNA, 640 bp, Homo sapiens
gatgtggtttgagaaagagagggggccggtggcgcatgcctgtaatcccagactttgggaaaccaaagcaggaggacgcttgagcccaggagttcgaaaccagctggcaacatgcaagacctggtctctacaaaaaaattaaaaattagctgggtgtggtggtgcttgggaggctaaggtgggaggatcacttgagccctggagttcgagaacagcctgggcaacatggcgaaaccctgtccctacaaaaaatacaaaagttagccaggcgtggtggcacacgcctatagtcttagctactctggtggcagaggtgggaagcttgtttgaacctaggaggttaaggctgcagtaagccgagattgcaccactacactccagcctgtgtgacagagtgaaaccgtgtctcaaaaataaaaagtgaattcaggagttccagaccagcctggccaacaccgtgaaaacccatctttactaaaaatacaaaaattcgcctgggccagatgcactggctcgcacctgtaatcccagcactttgggaggccaaggcggggatatcactcaaggtcaggagttcgagaccaacctggccaatatggtgaaaccccatctctactacaaatacaaaaaaaaaaaaaat

SEQ ID NO: 12609 - DNA, 747 bp, Homo sapiens
ttaaaacatgcagtcttgaaatagggttcgaaagacaacttttaatgattcacagacactatttggtttcttttaagcaggtagaaaaaataccagaattaccactcaccttgaattttggcttgatttgtctaaattgcaatatttgatttttatacagcataagaaagtttctcgtcaactctggtgtatcttacgccatttgcttcagtgacggtacccacaaggtgggaatcttatggctaaaaggattttaattagtagacactcaagccaccagatggctcccttaggtttaaaaatctccacctgggggaaataaatggacttttcccgagtaaatttagaataatgccctaaacttgtaatgtgagcaggtcttcagagtttcgagctgaagttacaggtttagagttgtccgttggaggtttttgtttcttcgtttaatgatttaaaaacaggttatgatacaagatcttcaaaatggttttaccacatgcatcatgacttagaatcttcgttggctcttttggtttttttcattcaaagttgaaatgcctcacctcttctttctttttctctctactaaccattttctactgagcacaccgtaccttatcagtctcataactgggccacctaactctccctaagacagcactaggagttgacacccagagaatctgtaagtcatgtactgctcatctaacgaacagtccctgctagccttgcctgcttcttttgcat

SEQ ID NO: 12610 - DNA, 176 bp, Homo sapiens
ttttgagaaggagttttgctcttgttgcccaggctggagtgcaatggcgcgatctcggctcaccacaacctctgcctcccgggttcaagcgattctcctgtctcagcctcctgagtagctgggattacaggcacctgccactacgcctggctaatttttggtgtttttagtagaga

SEQ ID NO: 12611 - DNA, 602 bp, Homo sapiens
agaatttgaaaagtagtgtaagttacaaagttatcccctagaagttatagaaatttgcccttcagcatcctcatctgtaagtggagaaaatgatacttcatagagaagttatgaggaattcttagccaaacactgggcacacaatagccatttggcaaatgttggtttcttcccctccggcctaccaaaggatctggacgaggtcagttcaaaggtccttaccatttaaacttgaagctataagattaaaatccctgtcctaacagagtttctagcattaaggcggaaacagaaatgtaaggcatggccctgatcactaaaaaggatgtgatctattgggaactacttggaacaagagtgagaagtagaagagagtaaagagtcaggaaatgtgatttaataagtatgtgacagaatattgaaagtgttcattagtatatctctaacggaggtataatcggtgctctcggggcaggtggaaaatggtgtgggctggaatttgagtgtagatgggaaaaggcagaaaggaaggtgttccggagtcctcatgggaggaagaactatgtgaacaccacatggggaaaagaagaaatgtacgtgaa

SEQ ID NO: 12612 - DNA, 3070 bp, Homo sapiens
ctgaaggagcagagggaacgtgagcggtggcagcggcagcggaaggtcctggctgcaggcagctcgctggaggagggaggagagttcgatgacctggtgtcggccctgcgctctggggaggtcttcgacaaggacttatgcaagctcaagcgcagccgcaagcgatcagggagccaggccctggaagttacccgggagcgggcaataaaccggctaaattattgacctggggaactagccacacaggaggccgggagacagggactggtgagaatggggctgagtggaggaggtggtgatatttaaaccatttggtgcttggtttagagccttgggctgggtcctgggatggggggctgtgtgtggctggaccaggtgtctccccacgcttaccttaaggggctcctcttatctccccttcacatgattccttctgtgccctggccccaggtattattctgaggctgccttggatggcctcaggccaggtaaccccaggctgaaggggccctgctccccatcccctaccatgggcacccatgtgctggcacagaacagttccagatctagactggagaggtccacagccttgtccagagttcctgtgtagcacggggagcaatgatggagggagcccctgagagggaatctggtgagggaatccagactcccttctctcaaggggaggctcaacagaacattgacctgggggcaaactttcctcttgaatgggaacagaggaggcattatatattctagttagatcagctctggtaggttccagagaacagtcaatgttggaaggatgatgcagggaccaaagccatcaggacagagtagcagtgtctgtttcccatgtcacaagtcctctggcctctccctgcatgtcttaagtatctttcccttccttctctaccctcacctccatcctgtctactaatccacagtcctagaagactcaccttgggtttccacagctatggctcactaccaggtgcttgatgaatctggcgaggggctcaagacagacctcatgcatcaccacacctcatgccttttgggcatctcccatgtccccatctcctggacacctggccattgttgtgaagccagacagtgacctcaaatgttgccttggagtcccctacagcccctcagcagagggcagcacttgaatgcttagctccatcccatagttctctacttcatataaattgctcaggccctcccaccccttctctaacactagcttcaaggcagaagccacagcagcctctgtccagcctgcaggtggccacttggaaccatgtgtccactggcgttggggagttggttcctgagaggtctgagggccagagctgccctctacattaacatgctgtctctaagggtggcccctcctctcaggcgttcagatggtgcgaacagcagagcaggcaagggaaactggggagatggggatggaggaggaaggctgatatcctctggggagcacatcacctgaaggtgccaaggaggaaggctgagaggggggccaccccatttctggtacccaatttggttcttcagcccaacttgcaaggggttccttctggtcctcccatccactgccaccttccattttgtccatctcatgctggccttggtggatgggatggctgtatctagacaaaatttttctaaaactccatcaaggctcttattcaataccacgttccgagttggcctttcatcttctttgagactggccctgcctaacctctaccatcaatgagctcttggcccttctgcccttccctgtgtttctcactttccaacctaatccctggctcagggttattgccagtggagactggtgagctgggcctactctcagctgcctatcttctgcctttcacttgcatccaactcctggggctgggaccgtagtagctgcgggggggaagaaacacagggtcggtgagcccagcatgtgcgttggtttgagggggcgggcggtgtgtgtgtgttctggtgggagggatctgagcaagtgcaagcctggctgacacaggtgtgaagaggccatcctggaacccaggtgagggcaagatgaaggcttccaggcagaacagctgcagagagtttggctatatgcatctgcagccccaagagctcccactgcaagacaagtgttggggaagatgggaggttgtgggtgaggcctctaaaggtcctctcccaaactgaccaggctgatgtcaacctaaccccctcaggggcagggaacaggggagggctccacaagcgtgtctggcattcccacccaccatggaagactggatacgcacctggaaacaaaaggactatggaagctgttcaagatacatttgatcttcagaaaagcagaatttggttcaactgttgacagaggacacaaatacgttgttccagagctcagccttctcactctaaaagaaagatatttttctatttattttctacatctggccagtggctctggtgctagatgccactgtagccagatctccaacagtgccttggaccatggactcatactcaactgagtaagaaggggctggtgcccagtcggggtggctgagctggtccttaataggttgtttcttggtcttgctttcttcatgccctccccactgctcctgccacctttagataagtttctctagctaattttgtggccaatgtaaaattcgtcatcaacctaacaaacacaaccttctcagcagcatttctcccctgtgatggaaataaagtgtttagggcagtgggaggagaaaattctccaggtgaatggggaagggtctgttccagcctctccctactcccatcccatttccaccaactggggaactgtgactatctatctcccccgacttctaccagggatgccttcacgccaaggctgttctcaccagctgcctcagatgacaaatgaggctaatggacataatctacagtgtcctttttcacttgcaccttttttataagaatatattgtaatactaaaaaatattaaattcataccatccctacccagtctgcctttaaa

SEQ ID NO: 12613 - DNA, 6234 bp, Homo sapiens
gatctatagaatgcaggcttcaccttgttaatttattgatgcacagacagaggcatgaaggggaggtgctttgtcagggccaacatcaatggccacaccagggctggaacccaggctcaccgactcccaggccactgtgcttggctctgccctctccctgaaccagccttagcacctcaaggcgggagttgatggtcctcattcccttccctctgtgtctccttacagcctagcagaactggagaaggaggtgggcaacctcaggaggggcctgagagcggtggaggtggtgagtaccttgtcagtgcctacctgggtgagggctgctgtcagcaaacactgttcgtcactgcaccctaagctcctacacaggggcaaaaaacaatgggtacagcctctagcacagggtcagccctcccaaaggataactggattactggggcttaagtttgagccttttaaaaggggttacctaagactatacccatgttactgtccaacttggtatctatttggcagtggagtggaatgaaccatacatctgacccatgcctacattggattcaagtgcatgggaaaaagaatcctcatcccttgactgccagctaggggcaggaagcacgcaatgtggcagtgggaccgatgtacccagaaggttcttccttatgtctctctgcctgtttcctgggccagtggaggacccaggtcttttgttcccaccattcccgttctgatggcttctcggctgatactatctctggccctagccttccagaaaacaccagtagaggagtggggaagtgagccagactggcccagtatggggatgtctctaagtcttgtcccccacacctaggaagaagggacccgttccgtcttcactgaggagagaggcagtgggtaagggaagaatggactttagagacagattaaggatgacaaagaacgttttgttgccactacggtgggggaagatgatttccaaatttacaattttatagtcctgttaagtgctactcaaagtgcggtacatggaccagcagcttctgaatcagctgggagctttagaaaaatgtctctttaatttgtgcatgagtcacctggagtcttgtaaagatgagtcttgttaaaatgcagcttctgatcctgtgggtctgagagtctgtatttctcataatttcctaggtgatgctgctggccccaggtcacatgttgggtctcagtgctctagagaaagaaagatggcagggtgggctggctgctaatgttagctcatagtctttgccatccttagaactttgagatgcagggtgttccctcttccaaagggctcaatgtcctgtgagtgacgaggggagatgtggtgacccctgcacccgactctcatcttggcaccagtctaagcagcacttcaccctccctcctcaggagctggagtatcagaggcgccaggtacgggagcccagtgacaagtttgtccctgtcatgagcgacttcatcacggtgtccagcttcagcttctccgagctggaggaccagctaaatgaggccagggacaaggtaagggtgccccaacccccactgcttgccaacccagccttatctaaacaagctccttcacccattcctaccacagacagcccaggagggacaaacccagagttacagagctttgagagaaaaccgtttcttcgctcttaacaagacaagcaatgataaccacataccgcaaagatcatggtccatttatcagatatcaggcaccatgttaagtgttttaatgatttgtcaccacctaccttatgggtttgttgaaaggttatttcccacttgacagatatgaacgctaaaatcagagatgctaagtaacttgcccaagattgcccagctgtaagttatagaactgggttagaatctgacaccacagctcagcagtggacatgattaccatgcctctatctgcttctcacactaacgtgtccatagacctcatgtatgggggtcttattaaaacatggattctcatttaggaggcctggggtctgagattctgcatttctaacaggaggtgaatctgctgctagtccatgaagcacacttttgagtagtgagatctttcttagaggatactgagtgagttgaattaacaatggtagctctcagtaactcagaacagtgcctggcctatataaatatagccactgttttatagccaccaactcatctaaccccccaacaccactatgatgtagattctattattcccatttgacagtggaggaagctgaggcacagaggggttattaacataactagaggatctttgaagttctgagttctgccagcctcttcctgacctcaggaagggcttcccaaggtctatacccctgacctcatgcctaccccttacaggcccaggggtggctctaaggtggactgagtgagcccaactctttacctgcctctccttagccttgtctctgatcctgatgatgatgggggtgtcttctcacctcttccagccctgccccctgtgccaacagtccccagccttgcgctgggctctgctctggctagaacccagctaacctcaggggctgagcccagcatgctccagggcactctccaccaatcctgttctgtcccttgacagttcgccaaggccttgatgcacttcggggagcatgacagcaagatgcagccagacgaattctttggcatctttgataccttcttgcaggccttctcagaggcccggcaggatctagaggccatgaggaggaggaaggaggaggaggagcggcgggcgcgcatggaagccatggtgaggggcagtgccaggcctgggactgaggggagacgggtgctacttggggagaacacccccaaactggggtgtgtgggaggagggcagagactgaggaactgaggaacaccataggggttggatgtcagccccaggagagagaaacttcttcccagcctgagggaagagagtggtgtgaagctgggggcctgtatgtcctaggcaggaagaaagtggggccaacagatacaggcaggcagcatgaccatggcctaggagttagcccagggttggggggctgccctggcctcagcgcctctccctgagagggttcctatctttggccccccgcccgcagctgaaggagcagagggaacgtgagcggtggcagcggcagcggaaggtcctggctgcaggcagctcgctggaggagggaggagagttcgatgacctggtgtcggccctgcgctctggggaggtcttcgacaaggacttatgcaagctcaagcgcagccgcaagcgatcagggagccaggccctggaagttacccgggagcgggcaataaaccggctaaattattgacctggggaactagccacacaggaggccgggagacagggactggtgagaatggggctgagtggaggaggtggtgatatttaaaccatttggtgcttggtttagagccttgggctgggtcctgggatggggggctgtgtgtggctggaccaggtgtctccccacgcttaccttaaggggctcctcttatctccccttcacatgattccttctgtgccctggccccaggtattattctgaggctgccttggatggcctcaggccaggtaaccccaggctgaaggggccctgctccccatcccctaccatgggcacccatgtgctggcacagaacagttccagatctagactggagaggtccacagccttgtccagagttcctgtgtagcacggggagcaatgatggagggagcccctgagagggaatctggtgagggaatccagactcccttctctcaaggggaggctcaacagaacattgacctgggggcaaactttcctcttgaatgggaacagaggaggcattatatattctagttagatcagctctggtaggttccagagaacagtcaatgttggaaggatgatgcagggaccaaagccatcaggacagagtagcagtgtctgtttcccatgtcacaagtcctctggcctctccctgcatgtcttaagtatctttcccttccttctctaccctcacctccatcctgtctactaatccacagtcctagaagactcaccttgggtttccacagctatggctcactaccaggtgcttgatgaatctggcgaggggctcaagacagacctcatgcatcaccacacctcatgccttttgggcatctcccatgtccccatctcctggacacctggccattgttgtgaagccagacagtgacctcaaatgttgccttggagtcccctacagcccctcagcagagggcagcacttgaatgcttagctccatcccatagttctctacttcatataaattgctcaggccctcccaccccttctctaacactagcttcaaggcagaagccacagcagcctctgtccagcctgcaggtggccacttggaaccatgtgtccactggcgttggggagttggttcctgagaggtctgagggccagagctgccctctacattaacatgctgtctctaagggtggcccctcctctcaggcgttcagatggtgcgaacagcagagcaggcaagggaaactggggagatggggatggaggaggaaggctgatatcctctggggagcacatcacctgaaggtgccaaggaggaaggctgagaggggggccaccccatttctggtacccaatttggttcttcagcccaacttgcaaggggttccttctggtcctcccatccactgccaccttccattttgtccatctcatgctggccttggtggatgggatggctgtatctagacaaaatttttctaaaactccatcaaggctcttattcaataccacgttccgagttggcctttcatcttctttgagactggccctgcctaacctctaccatcaatgagctcttggcccttctgcccttccctgtgtttctcactttccaacctaatccctggctcagggttattgccagtggagactggtgagctgggcctactctcagctgcctatcttctgcctttcacttgcatccaactcctggggctgggaccgtagtagctgcgggggggaagaaacacagggtcggtgagcccagcatgtgcgttggtttgagggggcgggcggtgtgtgtgtgttctggtgggagggatctgagcaagtgcaagcctggctgacacaggtgtgaagaggccatcctggaacccaggtgagggcaagatgaaggcttccaggcagaacagctgcagagagtttggctatatgcatctgcagccccaagagctcccactgcaagacaagtgttggggaagatgggaggttgtgggtgaggcctctaaaggtcctctcccaaactgaccaggctgatgtcaacctaaccccctcaggggcagggaacaggggagggctccacaagcgtgtctggcattcccacccaccatggaagactggatacgcacctggaaacaaaaggactatggaagctgttcaagatacatttgatcttcagaaaagcagaatttggttcaactgttgacagaggacacaaatacgttgttccagagctcagccttctcactctaaaagaaagatatttttctatttattttctacatctggccagtggctctggtgctagatgccactgtagccagatctccaacagtgccttggaccatggactcatactcaactgagtaagaaggggctggtgcccagtcggggtggctgagctggtccttaataggttgtttcttggtcttgctttcttcatgccctccccactgctcctgccacctttagataagtttctctagctaattttgtggccaatgtaaaattcgtcatcaacctaacaaacacaaccttctcagcagcatttctcccctgtgatggaaataaagtgtttagggcagtgggaggagaaaattctccaggtgaatggggaagggtctgttccagcctctccctactcccatcccatttccaccaactggggaactgtgactatctatctcccccgacttctaccagggatgccttcacgccaaggctgttctcaccagctgcctcagatgacaaatgaggctaatggacataatctacagtgtcctttttcacttgcaccttttttataagaatatattgtaatactaaaaaatattaaattcataccatccctacccagtctgcctttaaa

SEQ ID NO: 12614 - DNA, 1988 bp, Homo sapiens
ttgtcttttccagagagctggttgtttaatatttgccagcacaccttggcatagggcagaggggaggcaggcagggggcaccactgaggactcaaagacatccaagttagagagcccagcaggccagaactgtgtgtgtttgggatgtgagaaccaggagcctctaattaattgccctctctgatctctctaatagctggtaatgcaagcaatgagctttgaacacccctggccaccacctgacaaaagatttcccttagatggtgcatttctatgccccctactccactttattttcccatagcggggctatacagagagtacacccttaggcctttccaggtccctcctcttcttccctcagggaactgtgtcttgggataggattgattgattgattgataggtgcagccttccctgtgaaactgcagcagctcagtgccctacccacacagtgtcttcattcttgcatctgcaaagttggcatcgtagctttatttgtgcgctgtgagggtgaaggcaatctatcatcaacttttctttccctgatatgctccagaataaagaggggtgggtggaacagccgtgaacagggccaggtgtgggctgtgtggtctggcaggagtccttagggctatggcccatgtgtgcacatcctgtttcagaagaggggggccagaggaaaaggggccagcaggaccgggcaactgttaagctgaaaggctgcaagtctgatgggacacagacttgggcagaaggagagatgaagtcaggacaggacaggacagggcagggctgcggcttcacagacttagggaggcagagctgccggggagaagttgggatccattcttcaggcaagcttgtgctttgctctcctcaagtgggctcctctgcttaatgagcgcttaatctctccccaggaaagcaggagaagagaaaacccaaaatgagaaggaaaagttctgggctggactgtcggaacctggttgtctgaaatagtccacaaagaacatgatttctcagttatctggcattgcttgttgcagtcccgctcccacgaccttagtgtcctggaaggcttaagggcctgctggtatcctccctatagaaaggaagccccattggtcattagagatcatctagcagcaggcctgtttgttagtagtagagcaggctgacttcgggtttactgctcaaggtaaacaaacagtgactgtgattaaaggaacctgacgtctttccctcagcctacattgcatcccagctccaggcctgggtgggccatgggtgagaagggcaggtgctaagcccgatggaagtccccccgctgaccaccagtcttgctaatgagcttgatctcctccaacacgatgtccctgctgacagccttgcacatgtcatacagggtgagggcggccactgcagcagaggtcagggcctccatctccaccccggtggggccccgagcccggcaagatgcctggatcttcacggcatggcgtgtgctgtccagctccagctgcacctggatgtggctcagggccacgtggtggcacagagggatcagctggctggtcaccttggctgcctggactccagccagctgggccaccactagggcatctcctttcttgagctggttctgctggacaagcttgaaggctaccggtcccaggaggaccacggctgaagccacagccacccgctctgtgtctggcttcctgcccacatctaccatagctgcccgtccttccgagtccacatgagttagttgttctgaggttagctggggtcctgagggggcagcagaagcccaggaacctgggctaaggcactttgagttggcatctgagtctgcacgggaagtgtagtgtctctgaaaggagccagaccccagccgctgctgggctagaggaggggtctgggggaccctgcatcctttccataaagtggccacctggctggagaaactcattctgggtctt

SEQ ID NO: 12615 - DNA, 1989 bp, Homo sapiens
ttgtcttttccagagagctggttgtttaatatttgccagcacaccttggcatagggcagaggggaggcaggcagggggcaccactgaggactcaaagacatccaagttagagagcccagcaggccagaactgtgtgtgtttgggatgtgagaaccaggagcctctaattaattgccctctctgatctctctaatagctggtaatgcaagcaatgagctttgaacacccctggccaccacctgacaaaagatttcccttagatggtgcatttctatgccccctactccactttattttcccatagcggggctatacagagagtacacccttaggcctttccaggtccctcctcttcttccctcagggaactgtgtcttgggataggattgattgattgattgataggtgcagccttccctgtgaaactgcagcagctcagtgccctacccacacagtgtcttcattcttgcatctgcaaagttggcatcgtagctttatttgtgcgctgtgagggtgaaggcaatctatcatcaacttttctttccctgatatgctccagaataaagaggggtgggtggaacagccgtgaacagggccaggtgtgggctgtgtggtctggcaggagtccttagggctatggcccatgtgtgcacatcctgtttcagaagaggggggccagaggaaaaggggccagcaggaccgggcaactgttaagctgaaaggctgcaagtctgatgggacacagacttgggcagaaggagagatgaagtcaggacaggacaggacagggcagggctgcggcttcacagacttagggaggcagagctgccggggagaagttgggatccattcttcaggcaagcttgtgctttgctctcctcaaagtgggctcctctgcttaatgagcgcttaatctctccccaggaaagcaggagaagagaaaacccaaaatgagaaggaaaagttctgggctggactgtcggaacctggttgtctgaaatagtccacaaagaacatgatttctcagttatctggcattgcttgttgcagtcccgctcccacgaccttagtgtcctggaaggcttaagggcctgctggtatcctccctatagaaaggaagccccattggtcattagagatcatctagcagcaggcctgtttgttagtagtagagcaggctgacttcgggtttactgctcaaggtaaacaaacagtgactgtgattaaaggaacctgacgtctttccctcagcctacattgcatcccagctccaggcctgggtgggccatgggtgagaagggcaggtgctaagcccgatggaagtccccccgctgaccaccagtcttgctaatgagcttgatctcctccaacacgatgtccctgctgacagccttgcacatgtcatacagggtgagggcggccactgcagcagaggtcagggcctccatctccaccccggtggggccccgagcccggcaagatgcctggatcttcacggcatggcgtgtgctgtccagctccagctgcacctggatgtggctcagggccacgtggtggcacagagggatcagctggctggtcaccttggctgcctggactccagccagctgggccaccactagggcatctcctttcttgagctggttctgctggacaagcttgaaggctaccggtcccaggaggaccacggctgaagccacagccacccgctctgtgtctggcttcctgcccacatctaccatagctgcccgtccttccgagtccacatgagttagttgttctgaggttagctggggtcctgagggggcagcagaagcccaggaacctgggctaaggcactttgagttggcatctgagtctgcacgggaagtgtagtgtctctgaaaggagccagaccccagccgctgctgggctagaggaggggtctgggggaccctgcatcctttccataaagtggccacctggctggagaaactcattctgggtctt

SEQ ID NO: 12616 - DNA, 2510 bp, Homo sapiens
tagattctcaatcaagtcctttagccttattgattaaaatagagacatttactatcacaaaatgatgcccccaaacagcctcaaacctgacacattagtttccctttcctgcctctgcccaaaatgaatgtttttctttctcttcccttgggttcttctctccctcccctcctcttccctccctctctcccttctctattcttccctctccctctctatttgtccttctctgctccaagtcctgccacaaccccaggattcatcagcctccctggacacatcccatccagctcctgaccgctcacctccttcactcctcatcctcagggccctttcctccatctgcctcagcccatgccagcggccatgctgtgcacctggaggggccacccacctgccaggaaacagcacattcagccatgcacctgactgcagcctccactctagcagattagctcagtcacctgtgacacactgttcctctggctctttgggactttcagcccatggacacctccatgcccatcccacaatctctgtttctccacatctctccctttccatctcaaatccatgctccagcaccaaacactaactctttccattctaaactccctctccccattgttcttcccttacaggcacctggcaaaactccagtcctcaacaaatgcagccaatggcgtttgctaatgccagcaggcctggccctgtccaactgtggtctcctccctcagctgggcctgcagcagcatccggcaaccctgctgctcctagttcagctcttgctcccatcctcctcaaagaccacactccacatcctcagactctgacaagcaggccaacccagtggtgtgctggcagatgcttaacaacaggctctagaggaggtggggaaagccctgatttgtagtgtttgcccattcttgtggtataagtattctcacaagaatctgaatatgaggccagactcagtggctcacacctgtagtcccagcactttgggaggccaaggtgggtggatcacttgaggccaggagttcaagattatcctgaccaacatggtaaaactctgtctctactaaaaatacaaaaattagctgggtgtggtggcacatgcctgtaatcccagctactcgggaggctgagatgggaggatcactggaactgggaggtggaggtttcagtgagctgagactgtgccactatacccgagactgggcaacagagtgagaccctatctttaaaaaaaaaaagtaattaatagcctatcaaccaaaaaaagcccaggaccagacgattcacagccaaattctaccagaggtacaaaaaggaactggtaccattccttctgtgttgcaggaattcagggaccccgaatggagggactggctggagccttggcagaggacataaattgtgaagatttcatggacatttatcagtttccaaataatactttcataatttcttactcctgtctttattttaatctcttaatcctgttatcttcgtaaattgaggatgtacatcacctcaggatcactgtgatgattgtgtttactgtacaaattgattgtaaaacatgtgtgtttgaacaatatgaaatcagtgcaccttgaaaaagaacagaataacagtgattttagggaacaagggaagacaaccataaggtctgactgcctgtagggtcaggcaaaaagagccatatttttcttcttgcagagagcctataaatgggtgtgcaagtaggagagatatcgctaaattcttttcctagcaagaaatattaatattaagaccttaggaaaataattgcatcccttgggggaggtctataaatggccactctgggagtgtctgtcttaagtggttgagataaagcctgaaataaggctctgggagtgtctgtcttaagtggttgagataaggccctggtctcctgcagtaccatcaggcttactaggattgggaaaccccaaccctggtaaatttgagttcagactggttctctgctcttgaaccctgttttctgttaagatgtttatcaagactatatgtgcactgctgaacgtagacccttatcgggagttctgattttgtccttgctgtgtttcctcagaagcatgtgatctttgctctgctttttaccccttaaagcatgtgacctactccctgtttgtacaccccctccccttttgaaatccctgataaaaacttgctggttttgcagctcaggttggcatcacggtcctaccgctatgtgatgtcacccccagcagcccagctgtaaaattcctctctttgtactctttatttctcagaccagccaacacttagggaaaatagaaagaacctacgttgaaatattgggggcgggttcccccaatacttctgaaactattccaaacaattgaaaaggagggacacctccctaactcattttatgaggccagcatcatcctgatactaaaacctggcagagacacagcaaaaaaaagaaaacttga

SEQ ID NO: 12617 - DNA, 621 bp, Homo sapiens
catctctataattttgtcatttcaagaatgctatatcaatggaaacatacagtatgaaacctcttttgaatgtagttttagttaaacttttaattctgagataattatagatttatatagagttgtaagaaataatagatcctttgtacctctacccagtttctcccaatggtaacattttatgcaactctaatacaatgttgcaactaggacattgatgttgatacagtcaagatgccgaacattgccatcaccacagggatccctcctgtcaccctttcaaagctgcacctgccttcttacctccttccattcctaacacctggcaaccacttatctgtcctccacctctataattgtgtcatgtcaagaatgttatataagtgaaatcaaacagtatgtaatgtttgaggaactggctttttttcactcagcaacatgccctggagattcatccaagctggtgcatgtatcagtagttcatttctttttcttgttgattaatattccatggtatggatgtaccacagtttatttaaccattcacccattgaaagacattggggttgtttccagtttttggctattacaaataaaactgctgtgaatattcatatgcaa

SEQ ID NO: 12618 - DNA, 22253 bp, Homo sapiens; identical to SEQ ID NO: 11809

SEQ ID NO: 12619 - DNA, 86 bp, Homo sapiens; identical to SEQ ID NO: 11810

SEQ ID NO: 12620 - DNA, 6063 bp, Homo sapiens
tgttagttatctgtaagttttagatattgaaaacattgtctcctagtaatctgaacagaaatgtgtaacaattttgccacacattaattcttctatattatcttaacagctttattttccatcctgagtctgttttttagtctaatgatattgagtagatacttaattatgtcagtctattatgtcagtttttaaactccaatgttcatcttttcttgatttatgctaccaactttattatgtattacattcttataagtagatgagtctgtttctgacgcttgccctctgttctgttctacttgtccatttaaatgttcttgcttgaaattgtttctatgacagtggctttgtagtacatccatggatttggttgggacactccctcccctacttctacttttctcctctttctcaacgtttatttagttatttgtggacctttatttttccatgtagattatagaggttttcagagatcctcagaaaacccaactgaaatcttacttgaggttaatttgggggagaattgagattttatgataataaaccacccttcccaaaagtatagactgtctccccaattattcttctcatcttatatgttctttagactaatttaaaactttttctttatttttttattaaataaggttatcaatactttatagatttttatgctattgtgaattagatcttatttttgaattctgtttttctagtgagttttccttgtctagagaaatgttcttgattttaatttattcgctatgctgtgtttctcaagagcagaggctgcatctttcgtctctgtattcccagtgtttaaaacattgcatggtaagtgatcaatgaatgtttgtttgttgaatgaatgaatgaatgagcaggatacataaagcagaatgggctgctatgatatttgggtccatatagaggcttcatggcaacatccacgacagttccagtagacaccccaccacaaggaccaagggaaggggcagccaattcctttacatggctatcttcctcggtgtgatcaattaattccccaaagtggctcaattagccttagttggtaccctccccagttttcctcagaccacatagatgtttttgaacatagctttttgctatttactatggcttcttctggacacccactcttagctcaaatttacacatgcattttggaagccttcactgccagagtggtggtcagactaaaaagcttgacttgggtctccaagccatagttatgaagtaccataggattggttgtcttcctggtactttcttctcctcagaaatgaagcaagcacttagacctcttaactgctgatgagctgagcttggatccctaaaagcggaaaagagaatttgaataccaagacccagctacccttaggactggagcaagattggacacaggtataggtgctcttggtaatgttagacaaaggcaaaggcaacacacaaggaaagttaggcttttaaaatgacagttcatttattttacaaaaattgtactgagtgcaatataaaggcctttcacagtctgactcctgccttcattcccaggcttccccttggtcactatctttttctgtctctaccatacatgctttgtgctcaagccatacctgattgtttgtcaaaccattatatgccagttctttttttattcctggatcttcctagacagtattctctgtgtctaaaatgctcttcctacctttctctgtctatttatcaaacctctattaattcttttcaatgatgaattcatgttaccttatctctgaaacttttcctgacttctccaagtagaatggttatctttcattctgtggcaccttaacgtattcagtatagccttctgttagtacatttttaatgctgtgatattgtaactaatttatttttattttcttgtctgcttattttccattgcaagcttcttaagatttgggaccatacattctctatctttgtgactgaaagctgagcatagcttctagtatgcagtaggtgatcagttagcaaataattgattaagttgaacaaataattgagtaagttcaccatgaagagaatgagattttgatcctatactggtcatgtggttctagaaaagcaactaatctttctattcatctgtaaaataaatttatatatgtatttgctgaattgtgaagatgttatattagtcatcttgggttgctgtaaccaaatcccataggctggttggctcaaacaacagacgcttatttctcacagttctggaggctagtaagtccaagatcaagatgccaatagatttgactcatgatgggggctctcttcctggcttgcagatggctgccttctcatattctgcagagagaaaggtctggtgtctcttcctctagttataagggcactaatcccatcaagggggatctaccctcctgacctcatctaagcacaattattttccaaatgccccacctcccaataccattgcattgaggttagagcttcctatgtgaatgggagggtggaggaaagaacacgaacattcagtttattacatatcttataaaatattatgaatctggttaaagtattttcaaagaaatgttttaactatggagaccagatgagtgaacaatgaaccttgccataaatatgacagcagagaaaaaatgactatccttgatatggtttggctatgtccccacccaaatctcaacttgaattgtgtctcccagaattcccacatgttatgggagggacccacggggaggtaattgaatctgaaatgctcttcctatctttctatgcttatttatcagtcctctgctaattcttttcaatgattgattcaatgatgaattcccatgctattctcatgatagtgaattaagtctcacgagatctgatgggtttatcaggggtttgcacctttacttctctctcgttttctcttgccactgccatgtaagaagtgccttttgcctcccaccatgattctgaggcctccccagccatgtgcaactgtaagtccagttaaacctctttttcttcccagtcttggatatgtctttatcagcagtatgaaaactgactaatacagtaaattggtaccagtggagtggggcgctgctgaaaagatacctgaaaatgtggaagcgactttggaactgggtaacaggcagaggttgaaacagtttggagggctcagaagaagacaagaaaatgtgggaaagtttggaacttcctaaagacttgttgaatggctttgacaaaaatgctgatactgctatggacaataaggtccaggctgaggtggtctcagatggagatgaggaacttgtagggaactggaacaaagatgactgttgttatgttttagcaaagagactggtggcattttgcccctaccatagagatttgtggaactttgatcttgagagaggtgatttagggtatctggctgaagaaatttctaagcagcaaagcattcaagaggtgatttgggtgctgttaaaagcatttcattttaaaagggaaacagcataaaaatttggaaaatttgcagccagttgatgcagcagaagagagaaacctgttttttgaggagaaattcaagctggctgcagaaatttgcataagttacagggagctgaatgttaatctccaagacaatggggaaaatgtctccagggcatgtcacaggtcttcatggcagcccctcccatcacagaccctgaagactaggaggaaaaaatggttttgtgggccaggcccagggtccccatgctgtgtgcagcctagggacttggtgccctgcatcccagctgctccagccattgctaaaagggccgaggtacagctctgcccgtggtttcagagggtgcaagccccaaaccttggcagcttccatgtggtgttgagcctgcaggtgcatggaagtcaagaattgaggtttgggaacctccatctagatttcagaagatgtatggaatcacctggatgctcaggcaaaagtttgctccaggggcagagccttcatggagaacctctgctagggcagtgtgaagggaaatgtggggttggagcccccacacagaatccctactggggcaccacctagtggagctgtgcaaagaaggccaccgtccttcagaccccagaatggtagatccaccgacagcttgtaccgtgcacctggaaaagccacagaccctaaacgccagcccgtgaaagcagccaggagtggggactataccctgtgaagccacaggggcagagctgcccaagactaagggaacctacctcttgcatcattgtgacctggatgtgagacatggagtcagaggagatcattttggaacgttataatttgactgcctcgctggattttggacttgcatggggcttgtaacgcctttgttgtgggcactttctcccatttggaatggctgtatttacccattacctgtatccccattgtatgtaggaagtaactagcttgcttttgattttacaggatcatgggtagaagggacttgccttgtttcagatgagactttggactacggacttttgggttaatgctgagatgagttaagactttgggggactgtttggaaggcatgattggttttgaaatgtgagaacatgagatttggaggggccaggggcagaatgatatggtttggctgtgcccccacccaaatctcaacttgaattgttatctcccagaattcccaggtgttgtgggagggacccagggggaggtaattgaatcatgggggccggtctttcccatgctatttttgtgatagtgaataagtctcaggagatctgatgggtttatcaggagtttctgcttttgtttctctctcattgtctcttgccgctgccatataagaagtaccttttgcctcccactgtgattctgaggcctccccagccatgtgcaactgtaagtccaatgaaacctctttttctcctcagttttgggtatgtctttatcagcagcgtgaaaatggactaatacgatcaccctcttctttgttctcctttctatttcatctctaattttttttggcatttggagggtgctatacattgcaaaagttggggactcactaattccactgctcactgtatatcaaggtaatctgtcaggggtttggttttatataagaaacaaatgagtccccagaacatacaagttaagattattcaatcaagggaggcagtcattaccctttaacctctgaaagaaaactgcaagtaggcatcaaactaaccctgagatgggagagagtagaagttcccacacccagtgaattgtaggacattaggtaattattggtgggaagtaaatttgagtggggaactgaatttcaactgacttttatccttgaagatggtgcttctattttctcaaattagaaggttatgaaaattgcatctgaacaacaagttgtattagcataagttctagaagaaactgagaaagcaaggctagtctgaggaaaatttataccgctcacatttcccttctgaattggagaatagaattgaatagcaaaattgtaacctacctttcaaagatgcattttatagtgaagtatattttgtgaacttttatatcttctattcttatttttctattgccctattttaaaatctatcttgaatttattaaatgtatatgtctctgtttatatatttatgagtaatatggtagtctttttggtatcagatgagaacccaacacacacaaatacatactgacacatacaaagatgtttatactgcctcttacatctgtcggaagagagagggttccaagaattcctgtgatgagggcttaaagccaaatatttttgttatcattttatacatatatattttattttttttctatttgggagaagctagaaaacacacattacttttttttgtatcttttctgttttagactaaaatctgctgctattcaaagaataaattgtatctttgtgtattctgatagacataataagtaagttgtgtaagttataa

SEQ ID NO: 12621 - DNA, 6063 bp, Homo sapiens
tgttagttatctgtaagttttagatattgaaaacattgtctcctagtaatctgaacagaaatgtgtaacaattttgccacacattaattcttctatattatcttaacagctttattttccatcctgagtctattttttagtctaatgatattgagtagatacttaattatgtcagtctattatgtcagtttttaaactccaatgttcatcttttcttgatttatgctaccaactttattatgtattacattcttataagtagatgagtctgtttctgacgcttgccctctgttctgttctacttgtccatttaaatgttcttgctcgaaattgtttctatgacagtggctttgtagtacatccatggatttggttgggacactccctcccctacttctacttttctcctctttctcaacgtttatttagttatttgtggacctttatttttccatgtagattatagaggttttcagagatcctcagaaaacccaactgaaatcttacttgaggttaatttgggggagaattgagattttatgataataaaccacccttcccaaaagtatagactgtctccccaattattcttctcatcttatatgttctttagactaatttaaaactttttctttatttttttattaaataaggttatcaatactttatagatttttatgctattgtgaattagatcttatttttgaattctgtttttctagtgagttttccttgtctagagaaatgttcttgattttaatttattcgctatgctgtgtttctcaagagcagaggctgcatctttcgtctctgtattcccagtgtttaaaacattgcatggtaagtgatcaatgaatgtttgtttgttgaatgaatgaatgaatgagcaggatacataaagcagaatgggctgctatgatatttgggtccatatagaggcttcatggcaacatccacgacagttccagtagacaccccaccacaaggaccaagggaaggggcagccaattcctttacatggctatcttcctcggtgtgatcaattaattccccaaagtggctcaattagccttagttggtaccctccccagttttcctcagaccacatagatgtttttgaacatagctttttgctatttactatggcttcttctggacacccactcttagctcaaatttacacatgcattttggaagccttcactgccagagtggtggtcagactaaaaagcttgacttgggtctccaagccatagttatgaagtaccataggattggttgtcttcctggtactttcttctcctcagaaatgaagcaagcacttagacctcttaactgctgatgagctgagcttggatccctaaaagcggaaaagagaatttgaataccaagacccagctacccttaggactggagcaagattggacacaggtataggtgctcttggtaatgttagacaaaggcaaaggcaacacacaaggaaagttaggcttttaaaatgacagttcatttattttacaaaaattgtactgagtgcaatataaaggcctttcacagtctgactcctgccttcattcccaggcttccccttggtcactatctttttctgtctctaccatacatgctttgtgctcaagccatacctgattgtttgtcaaaccattatatgccagttctttttttattcctggatcttgctagacagtattctctgtgtctaaaatgctcttcctacctttctctgtctatttatcaaacctctattaattcttttcaatgatgaattcatgttaccttatctctgaaacttttcctgacttctccaagtagaatggttatctttcattctgtggcaccttaacgtattcagtatagccttctgttagtacatttttaatgctgtgatattgtaactaatttatttttattttcttgtctgcttattttccattgcaagcttcttaagatttgggaccatacattctctatctttgtgactgaaagctgagcatagcttctagtatgcagtaggtgatcagttagcaaataattgattaagttgaacaaataattgagtaagttcaccatgaagagaatgagattttgatcctatactggtcatgtggttctagaaaagcaactaatctttctattcatctgtaaaataaatttatatatgtatttgctgaattgtgaagatgttatattagtcatcttgggttgctgtaaccaaatcccataggctggttggctcaaacaacagacgcttatttctcacagttctggaggctagtaagtccaagatcaagatgccaatagatttgactcatgatgggggctctcttcctggcttgcagatggctgccttctcatattctgcagagagaaaggtctggtgtctcttcctctagttataagggcactaatcccatcaagggggatctaccctcctgacctcatctaagcacaattattttccaaatgccccacctcccaataccattgcattgaggttagagcttcctatgtgaatgggagggtggaggaaagaacacaaacattcagtttattacatatcttataaaatattatgaatctggttaaagtattttcaaagaaatgttttaactatggagaccagatgagtgaacaatgaaccttgccataaatatgacagcagagaaaaaatgactatccttgatatggtttggctatgtccccacccaaatctcaacttgaattgtgtctcccagaattcccacatgttatgggagggacccacggggaggtaattgaatctgaaatgctcttcctatctttctatgcttatttatcagtcctctgctaattcttttcaatgattgattcaatgatgaattcccatgctattctcatgatagtgaattaagtctcacgagatctgatgggtttatcaggggtttgcacctttacttctctctcgttttctcttgccactgccatgtaagaagtgccttttgcctcccaccatgattctgaggcctccccagccatgtgcaactgtaagtccagttaaacctctttttcttcccagtcttggatatgtctttatcagcagtatgaaaactgactaatacagtaaattggtaccagtggagtggggcgctgctgaaaagatacctgaaaatgtggaagcgactttggaactgggtaacaggcagaggttgaaacagtttggagggctcagaagaagacaagaaaatgtgggaaagtttggagcttcctaaagacttgttgaatggctttgacaaaaatgcggatactgctatggacaataaggtccaggctgaggtggtctcagatggagatgaggaacttgtagggaactggagcaaagatgactgttgttatgttttagcaaagagactggtggcattttgcccctaccacagagatttgtggaactttgatcttgagagagatgatttagggtatctggctgaagaaatttctaagcagcaaagcattcaagaggtgatttgggtgctgttaaaagcatttcattttaaaagggaaacagcataaaaatttggaaaatttgcagccagttgatgcagcagaagagagaaacctgttttttgaggagaaattcaagctggctgcagaaatttgcataagttacagggagctgaatgttaatctccaagacaatggggaaaatgtctccagggcatgtcacaggtcttcatggcagcccctcccatcacagaccctgaagactaggaggaaaaaatggttttgtgggccaggcccagggtccccatgctgtgtgcagcctagggacttggtgccctgcatcccagctgctccagccattgctaaaagggccgaggtacagctctgcccgtggtttcagagggtgcaagccccaaaccttggcagcttccatgtggtgttgagcctgcaggtgcatggaagtcaagaattgaggtttgggaacctccatctagatttcagaagatgtatggaatcacctggatgctcaggcaaaagtttgctccaggggcagagccttcatggagaacctctgctagggcagtgtgaagggaaatgtggggttggagcccccacacagaatccctactggggcaccacctagtggagctgtgcaaagaaggccaccgtccttcagaccccagaatggtagatccaccgacagcttgtaccgtgcacctggaaaagccacagaccctaaacgccagcccgtgaaagcagccaggagtggggactataccctgtgaagccacaggggcagagctgcccaagactaagggaacctacctcttgcatcattgtgacctggatgtgagacatggagtcagaggagatcattttggaacgttataattggactgcctcgctggattttggacttgcatggggcttgtaacgcctttgttgtgggcactttctcccatttggaatggctgtatttacccattacctgtatccccattgtatgtaggaagtaactagcttgcttttgattttacaggatcatgggtagaagggacttgccttgtttcagatgagactttggactacggacttttgggttaatgctgagatgagttaagactttgggggactgtttggaaggcatgattggttttgaaatgtgagaacatgagatttggaggggccaggggcagaatgatatggtttggctgtgcccccacccaaatctcaacttgaattgttatctcccagaattcccaggtgttgtgggagggacccagggggaggtaattgaatcatgggggccggtctttcccatgctatttttgtgatagtgaataagtctcaggagatctgatgggtttatcaggagtttctgcttttgtttctctctcattgtctcttgccgctgccatataagaagtaccttttgcctcccactgtgattctgaggcctccccagccatgtgcaactgtaagtccaatgaaacctctttttctcctcagttttgggtatgtctttatcagcagcgtgaaaatggactaatacgatcaccctcttctttgttctcctttctatttcatcgctaattttttttggcatttggagggtgctatacattgcaaaagttggggactcactaattccactgctcactgtatatcaaggtaatctgtcaggggtttggttttatataagaaacaaatgagtccccagaacatacaagttaagattattcaatcaagggaggcagtcattaccctttaacctctgaaagaaaactgcaagtaggcatcaaactaaccctgagatgggagagagtagaagttcccacacccagtgaattgtaggacattaggtaattattggtgggaagtaaatttgagtggggaactgaatttcaactgacttttatccttgaagatggtgcttctattttctcaaattagaaggttatgaaaattgcatctgaacaacaagttgtattagcataagttctagaagaaactgagaaagcaaggctagtctgaggaaaatttataccgctcacatttcccttctgaattggagaatagaattgaatagcaaaattgtaacctacctttcaaagatgcattttatagtgaagtatattttgtgaacttttatatcttctattcttatttttctattgccctattttaaaatctatcttgaatttattaaatgtatatgtctctgtttatatatttatgagtaatatggtagtctttttggtatcagatgagaacccaacacacacaaatacatactgacacatacaaagatgtttatactgcctcttacatctgtcggaagagagagggttccaagaattcctgtgatgagggcttaaagccaaatatttttgttatcattttatacatatatattttattttttttctatttgggagaagctagaaaacacacattacttttttttgtatcttttctgttttagactaaaatctgctgctattcaaagaataaattgtatctttgtgtattctgatagacataataagtaagttgtgtaagttataa

SEQ ID NO: 12622 - DNA, 1213 bp, Homo sapiens
cgtccgtgtgaagagaccaccaaacaggctttgtgtgagcaacatggctgtttatttcacctgggtgcaggcgggctgagtccgaaaagagagtcagtgaagggagataagggtgggaccgttttataggatttgggtaggtaaaggaaaattacagtcaaagggggtttgttctctggtgggtaggagtgggggtcgcaaggtgctcagtgggcaggagtgggggtcgcaaggtgctcagtgggggtgcttttgagccaggatgagccaggaaaaggactttcacaaggtaatgtcatcagttaaggcaaggaccggccatttacacttcttttgtggtggaatgtcatcagttaaggtggggcagggcatattcacttcttttgtgattcttcagttacttcaggccatctgggcctatacctgcaagtcacaggggatgtgatggcttggcttgggctcggaggcctgacattcctgccttcttatattaataagaaaaatgaaacaaaatagtgttgaagtgttggggtggcaaaaatttttggggggtgatatggagagagaatgggcgatgtttctcagggctgcttcaagcgggattaggggcggcgtgggaacctagattgggagagattaagattttagtttcctgactccggacatgttgagtaaagctaatttgccagtcctgggtgggggcaaatcctcgagcttgctgtgtagggaaggaagggggcctgaataatccctgaggaatagtagaatagcagatggaacactgagaaattatttccttgaggatagatttccatgatggaaaggaaatgagaggttctgaaaggcgggctagtggcttgtactatagcatagcctgcctttgctggtgtgtggcgattaggcctggtggagctgccatcagtaaatgaagcgtgatcagggtgaggaacaggaaagatatggtaaatgtttcttatcaggccttaggtctgtgttgatgttagtgccggtcggctcttcctgaattccaaaaaagaggagggcataatgaggcatgtctgacccccacttccatcacagcctgaaacagtttttcagcttaactttggaatgcctttggcctagaggaggtgtcctttcagatggttgggaggtctcagaattttgtctttgatttctgaaagtatatatatataaaacctgagaatgacct

SEQ ID NO: 12623 - DNA, 93 bp, Homo sapiens
tgagacagagtctcgctctgtcacccaggctggagtgcagtggtgtgatctcagcacactgcaacctccacctcccaggttcaagcgattctc

SEQ ID NO: 12624 - DNA, 93 bp, Homo sapiens; identical to SEQ ID NO: 12623

SEQ ID NO: 12625 - DNA, 1213 bp, Homo sapiens
cgtccgtgtgaagagaccaccaaacaggctttgtgtgagcaacatggctgtttatttcacctgggtgcaggcgggctgagtccgaaaagagagtcagtgaagggagataagggtgggaccgttttataggatttgggtaggtaaaggaaaattacagtcaaagggggtttgttctctggtgggtaggagtgggggtcgcaaggtgctcagtgggcaggagtgggggtcgcaaggtgctcggtgggggtgcttttgagccaggatgagccaggaaaaggactttcacaaggtaatgtcatcagttaaggcaaggaccggccatttacacttcttttgtggtggaatgtcatcagttaaggtggggcagggcatattcacttcttttgtgattcttcagttacttcaggccatctgggcctatacctgcaagtcacaggggatgtgatggcttggcttgggctcagaggcctgacattcctgccttcttatattaataagaaaaatgaaacaaaatagtgttgaagtgttggggtggcaaaaatttttggggggtgatatggagagagaatgggcgatgtttctcagggctgcttcaagcgggattaggggcggcgtgggaacctagattgggagagattaagattttagtttcctgactccggacgtgttgagtaaagctaatttgccagtcctgggtgggggcaaatcctcgagcttgctgtgtagggaaggaagggggcctgaataatccctgaggaatagtagaatagcagatggaacactgagaaattatttccttgaggatagatttccatgatggaaaggaaatgagaggttctgaaaggcgggctagtggcttgtactatagcatagcctgcctttgctggtgtgtggcgattaggcctggtggagctgccatcagtaaatgaagcgtgatcagggtgaggaacaggaaagatatggtaaatgtttcttatcaggccttaggtctgtgttgatgttagtgccggtcggctcttcctgaattccaaaaaagaggagggcataatgaggcatgtctgacccccacttccatcacagcctgaaacagtttttcagcttaactttggaatcgctttggcctagaggaggtgtcctttcagatggttgggaggtctcagaattttgtctttgatttctgaaagtatatatatataaaacctgagaatgacct

SEQ ID NO: 12626 - DNA, 1891 bp, Homo sapiens
ggtaagaactaaatcactagggtgcatcagtttgttaggcgcctgctgtgaagcactttagatcctcatgcagcctccttttgttctaaccaccaccaccatgatcagcctattcttggcactgatcagcaccaagaaggtgcatctgacaatacctcagccctttacttcccactccagactttcttttgatgtttttaaaagaaaagcaagagcctgacagtagtaaagtggtgaaaacatatttttctattgcagcaggggaaaagagacctcattataaaactgggctcaattctgaatgcagcatggacaagtggggatttatagccaataagcagactgggggtcaggggatagaaagttactaagtggaaacatcaggaaaatttctagctaaaccgatctaacataatgcttgctgaaggcaagtgagggtaattaggtatcacctgggggatgctggaggatgagaaacccagtaagatactgagagtgatcagatattaatggtgcgggggttcttactaaactgacttagcagaattcttcctcttgagtataaggcccaacgacagagactagtcaaagcagggatgagagaagcctggctagagtttggagagagtcattgtcaatataaattttcaggacaccttgggaccctgtttagcacccatgtttttcaacccagaaatatggggagacatagcagtctgtctgtgggcttagcatttcaccaatgagaaacaggagctgatgggtatatttaccattccatttctccacaccttccatcactggactattctgatatatagattgtgtactatattgacttctcagaagaagatccaaagtggctaagaatcagtcatccctaatggcctcaaatcggctctctgtctttgcctgtgattttctttgtcctcacgtttgcttccttggattgaacacctaatgaagtagtagcaaataaaatatttgcctgagagttggctttctaagaatcacaggtaagatactcagttcgaacttttgttgttgctgtcgcaagttgcagaacattcaaaccagaaatgcctggtggtatgcaagttttagaaatgactcaattcagggcagaaacattatcagcaggatgtgatttctatccaattcttgcttgttttgcaatgtcttgtctttattctgaagcttcgtttaacaacaaaatgatagtgtttatgtagttcttgaattccaggtctcagagcaaaattaagtgaccttttcacataacatactgccaatgtatttttaatgtaattgtcctgattgagtcatatttctaccaaattaccaaacacttttgtaatattagcttaagatatgttctcattccttgcattagagatggtgtcagcttgacttgaactttaatggcctgaaagtgagagcaatggtgtttcaccagagggaaattgaagtttggtcgtaagaagaggtctgagtggctgctgcaaagtcaacatttgttatccacataggacacaagctgttgtgttataaaataccatcagagatagaataagcattttcttacttcaaacttctaaatcagaagcatctaggaacatagctgtaattggtgaagcacagaaataaaaagacatttctaggtgaatcaaaatcagaggaagtcattgtcattgtgtgcatggttgcacaaaagcatcagggagcccagcagagtggtgcattaaagaaataagaaaagcaacgtctgccagcagtcaagacaggtatctgaagcagcagttgaaacagatgtgaagtagaggcaatgccatgaatgtcagttgtgtgttttagtgggtcccattgactcttggagattagaaaaaaagaa

SEQ ID NO: 12627 - DNA, 2541 bp, Homo sapiens
ggaacgatcacaaggtcatgcacttagatttatgaccaatcatcaagctattaatttactcaaatggtgtattaatttgttaggacggtcataagaaaatactacagatttggtggcttaaacagcagaaatttgttttctcacaattccaaaagctgtgaaatccaaggtcaaggtgtcagcaggtctggcttctccttaggactctggttgtcttgcagatggccaccttctcactgtgttatctcatggcctttcctctgtgcgcaggcatcgctgggatctctgtatgtgtcaaaatttcctgcttttataaggacatcagtcagactggattaaggcccaccctaaaggcttatttaaattttaatctcctctttagtggtcctatctccaaatatagtctcattctgagatactggtatttagggcttcagcatacaaattttggggtagacacaattcagcccataacaaattgtgctcatgaaatgatttactaataatgattgtggagagagatagtaatccgactgtgaatcctgaataattagtggcttcatgttcataaaagtggactcaataatgggcatgaacctgcacgagggaggcattgcggagaagaatacgtcccattttctgtaccaaagaaaaacaagtacacattgcaaacaataaatctttatcaaattcaaccaccttattttgaactctataatcattcaaacgtggcctagactaacatttgcttttttatagcttttatcaagaggagtggaggtattaaaattattattgaggggtgtagtgattttcaactgacgcaattctaccctccacctctcatgcaggggacatttggcaatgtctagggactttttttattgtaataagtgggaagtagctgatgatttcaagtaggtaaagaatagggatgttaaatctcctataatacacacgacagcctctcacaacaaaaaattatttgacccagaatgtcagtagtgctaaggtggaaaaaaccttatgtgaatcaattaaatcagggagaacttcagagcttttttaagacctttatttatatctagatgattgatattttttaggtattcatgaaaatactttcttttacctttcttgtggtaagcacaagataacactttcttgcctggttaaaaatggacaactgctacacttttaaaataatataaagcattcagtaattcaaaccatcctgtcttctgatttgtctgaattagtgtggctttactgcattttcagggcttattattctttcagtagggagactactaagatttcattaaagatagctgaataaatgatcaaatacattattgtagctccagactaggtaataaacattgagatatgcttttcaagtagtggtgaaaatactaggcaaaattacacatacacttacatatattaagcgaccatcctgttggcctggtatgtgaagctctgctgaactcttgcctaaatgcatggacccatcgattgtgaatgtgtgactacttgtgtgttttcatcataaccagctcatcctaatagcaaatgatatggtttggctgtgtccccacccacatctcatctttaattatagttcccttaatctccacatgctgtgggagggaccctagtagcaggtaattgaatcatgggggcagtttccccatgctgctctcgtgatagtgagtgagtactctgaaatctgatggttttataagcatctggcatttcccctgttggcactctttctccttcctgctgccctgtgaagaagatgcctttcttcccctttgctttccaccatgattgtaagtttccagagaccttcccagccatgtggaactgtgagtcagttaaccatcctttctatataaattacccagtattggatatttttcatagcagcatgagaacagacgaatacagcaaagaacacgttttatgaaggaaaaactttgaaaacaaagggactactttctttgatgagaggcccttcctttcactttaaacaaaacttcaaattatcctcagaatttgttctaattctccctacttctgggtaaaaattattagcagtaacagatttaacttgaatgtatatctccagttccccattctcttctctatgtagtgctgccaaactcaatagatttgaaacaaaaattacccagggaccttccccatctcccatgtccttttttcttatggcccagacctggaagtcctcctaagtgcttcctctccctcagcctaaccactctaccactatccagttgcaggtacactcttcctccttcacctcaccctttgatgccatctccactgctaccatcttgggtccaaccctcatgttatcttgcctgaaaaccgctaactttataactagtctctgttctatcaacatcctcttcctgactgtcatccacagatccactttctaaaatgccatcatgacgcttccatgcttataccactagcttttcagtggctaccaaaaaaaaaaaaaaaggt

SEQ ID NO: 12628 - DNA, 2541 bp, Homo sapiens; identical to SEQ ID NO: 12627

SEQ ID NO: 12629 - DNA, 2223 bp, Homo sapiens
caggacccccacccaggtcttgagacccccctgccccgcactcccccggagacgggctacccctgcagatgcagatagtcaaagctcaggtttcttccaaagcttttaaaaagatattgtaccttgagcactttaaaaatgtcttaaaattgccatacaggctcttaaaagcttatacgtttaaactgttgatagatgggcctttactaaaatgcattcatttattttcctaatcccttggttgttaaataattctggggaagggccccgagcacgacagccgcagtctccacccagaaccagagagtcccccccaacccgggatgtaccctctggccacaccagggaccctgccagaggccgcagactggcagcagcagcctccccacacagtgggggaaggtcagtgtgatgccttcaggccccgtctcctgccagggctctccctccagcctacatagggcctcagagaaatgcatttttagttctggctttggcccagcccagggcaaggcaggaaactctccagcgtgagtccgtgagggccaagaagtcccgccctgttctgggggaggacctggcttttctggtgtctctggtgcccgagagcccggtgctgccatctttagtgaaagagtaaatggtggccgagggctccttttgtgagggatgtgccttggtgaagaaggcatgttccctgccgtgaagatacttggaagctctgggtggagagggaaaagggatacccctggtgctccctgggcctggcggaaggctaggaggaaggacagctgaggtgaggactgagtggggcaggtatcaccctgacaaacagtttgggaagatcaggaaaggcaggtgagacctggtgcagaatccaggttgggtaatagatacatcgtcgaagatgtagcaagcaaagtaatatactcaactctggaacattgcacagaagcttttaaagcactctgtgacactttttgtaatgagggatctgaaggaaacggccccagagtcacccatccccacgggtctggttggcggggctggtgcctttcttctgcactcagtcaccatggctccgtctgtcaaactcaactctttttttttttttttttcttctcttggtgtggtaatttgtttgaagagccactccatccccaaattcaagattagaaagatccctgactgcttctcaagatccagaacattccttgacagagtatattcaccatttagaagtgatccagcaaagattgggaggggtactaccaggtaatgcaagtcctcgccgagtatttattaagctgattatcactgtaccctggaaacgtagggtctgttgaaagatggctggtattcagcttagtaaccaaagtttcagtctgaacaatcagtgtcactaatagtattagaatagaggctacaagtgaagaatctcacagaagtctaagccagtgtactcagtgatacgtgctgaggtcagtttgacttaatcaccgtctggacttttttgtcctttctcttacattgatagcgaacataaagattatatttcgaccaggatataatttgttcagtgtttcttaaatatcataatttaaaccactgtataattcatatttttaccaaaatttacatgaattcagtgatagtgtttcaaaattgtggaattcttttcaaaaaatctgtgaagccttgtaaccaatttgctgcctcatttttatttatatgcagattctacttcaaagaaatcctgccacccgatgattaaacagtgaataaaatgtcatggctctttcctgcgacaattctatttgaggaaaagatttgtttttcccttttcccaaggaagctcgtgggacagcatgggcactactcttcatgtgcggtgacaccagcccccagatgccttgaattaagtgtcctcacctttatgcatgactgcaaagccagctggagcattttctatggagcctccgtatgttttaggcccatgaccttcgtgaggtgacgggcactcactcccatgagccctggctgtgtgctgttgtgtgcctatcggcagatccatccttcctgcctccaaggaggatacacagagaatggcttcctgttgttttgtttattttcttaacgtgtacagatggaaacttcatttaaaaataaaaacaaaacaactcaaaaaggaataaaatttaatcactgttttgtttgtgaata

SEQ ID NO: 12630 - DNA, 5687 bp, Homo sapiens
aggtcggaaaggtctgcttggaagccagacgaaacggctccacagagttccctgaggcgcccagaccccggccggcttccaccagctgccagcgaggaagcacacaccagcaatgtcaaggtaggaacggtgccacgagtatagaactttggtgcttttttaagtcctgggtttgcaaattgcaggcaaagcatttttgtgaccacaaggttctcgtctgccgggtgtagcagtcacatcactaaaggaaaggacgttcacagaataaacttcggcttgaattttgttttaattgtgcacaaatactgagtttctgtgcttgttaagcgtggaacgtggaaggctttgacaaagtcagcaaatggcggcctctgcagcctgagggaggcctggcccaggggcttgccgggattcggcccaagatctgctgcagtctcctgatggcacacggtccccaccccgtgacgtccatctcatgcccagtttggaccttacctaaggggtgaaatgcaagaagcttcataggggctcatttgatgatgctgtggagaggagcttgtggtcctagatcttgtctgacaaacacaaattgatcttccaacagcaaggttgtttctggccacagatactgttggaaggccgatggctctgtgatgatttgatgggaaaaaacaatctgactctttggaaagagcaatggtgttaatgtgcttttgtcagcaagacagtctttgtttcctatgataaaattttactgctttttttcttttagatggaaaaattgtacctgcattacttgagagcagagagctttagaaaagctctgatttatcaaaagaagtatcttttgctgttgattggtggattccaggattctgaacaagaaacactctccatgattgcccatttgggggtatttccttccaaagcagaacggaaaatcacatctcgtcctttcaccaggttccgcacggccgtcagggtggtcattgcaatattaaggtaaatgccatgacgttcagtcagtgcgttccgcgtctgtctccgtgagtgggcagcacactgcatggttttttggtcattttattccttgaaactccataatatgttctttttaaagatgaatggcatttgaggccttagagaaaatacagatgatgaacttgtcttcaagaagtcatgtgtatgaatctctcaccttctaaaactaaagatttaagggcacctttgtattacagaggaacatcttgacttttaatgggtttcgtgccacaaagaacgtgctgaatttctaaaactgtttttccccctaaacactgtgcggctgtgcctgctccctgatgccacagaggtgtttcccaaggccacgcgcgggcctgtctggagtagcagatgcagcagagagcagctaggaatcccgctcctttcagagaccaggtgccgagccagttcagtcatcgcggctgcaggctgggccaaagtggggtgcaggcgaggcctcctgggttgctgtactctcagcttctctggtcctggggcactttgtctcctcgtctctgagctcccctgaccgtaggcctccaccgtccatccttccacccacccatctgtccatcctgtgttcatggggagaacaccctgcaggaggaagcattttaggcactagataggggaggtaagcagacccagatcctacctcctgtcgaggaggggagatcttttgaaggcagtggtgtcccagaaaggagcagtctctgtgtccctgtgagggcactgcctagggtagctgccaccaaggggccttgacaggtcttatggaggaatcggcagtgtctgctatgcctcaaaggagggaagccacaggcatgatgcttgttccgaaggccatcctagcagggcgtctggggccctgcacactgacctgcatgccctcgtcacctgcactctgcatgctcaccatctgacggactcctgcgagggctggggtctccgtgttctgagcctgtccagtggcatctgtgacaggatgaagatgggagggtcctgcacaccaggcgggagcggcatgtgtttcctagtcactggtgtggccggctgactttgaactggagtcgtcctgagctgggccatggtgggtgtctaggggaccatatggtccacggtggggccgcagtgaggctttgtcaggtggttgggcatgggaaggtcgccgccgccggcagccctgcgagcactttggatgtgtgcacccggcatgccaggcccgagtcaacagactggccgaccttggcgtcctggtccccatgggcagcgaggcccccattctgcttgtttggtcacagtggggttttcattgctctttcccttcctgtcttgccgtacttttaagtgtgtcttgtctcttttttttgtagattacgttttttggttaagaaatggcaagaagtagatcggaaaggagctctggcacaaggcaaagcccctcgcccaggtgggactccagctgctgttgaccgctggactcacaaacctttctttctactcttgtttttcattcactttgggtcatttttcagtgttgatggggacgtaataaagcacggtaagaaaatccgtgaattccgtcagagcagtcgtccagagggaaggcgcgcccggcgtagggaggtcagagctcatgttagctatgaacacaggtcacaggggcgtacggcgatgggaaacactgagatgctcaatatattgattatttaatagtgtttagcaaaatggtctttttttattccttaaatcaactgaaactcacttcacgtctctttccttgtagagcatcatgcttatttctggctcactcacatctttgtctcgggagttctctgccgagccattgccccctacagcagagagcacagctggctgcactagtgctgaaggagccagccccagagcagggcatttccaggggctcttgtcccagagcggcaggcgttgtgtgcagagaacgcccctcccacgcagcacagagaacgcggggtgggtgtgtggctccgggcctgtggggcttaggctgcctgaaccaccgccgactggcaccatgactcggcattcctggaagtgccttaccaagttgttgttgttgttttgttgttttttaagagacgggcttgctctatcatccaggctcgagtgcaatggcacagtcacagctcactgcagccttgaactcgtgggctcaagccatcctcctgtgtcagcctccccagtacctgggactgtgggcatgagcactgcgcctggcagctgtatcagtgttgactccacattttaatagttgcttcttgaaattaaaatgctttgattcagccttcaagccatcaggaaagtttgcccctctgagtcacacctggtggtctccagggttcctgcccctccctcctgagccagctcctcagagcggatagaggcaggacccccacccaggtcttgagacccccctgccccgcactcccccggagacgggctacccctgcagatgcagatagtcaaagctcaggtttcttccaaagcttttaaaaagatattgtaccttgagcactttaaaaatgtcttaaaattgccatacaggctcttaaaagcttatacgtttaaactgttgatagatgggcctttactaaaatgcattcatttattttcctaatcccttggttgttaaataattctggggaagggccccgagcacgacagccgcagtctccacccagaaccagagagtcccccccaacccgggatgtaccctctggccacaccagggaccctgccagaggccgcagactggcagcagcagcctccccacacagtgggggaaggtcagtgtgatgccttcaggccccgtctcctgccagggctctccctccagcctacatagggcctcagagaaatgcatttttagttctggctttggcccagcccagggcaaggcaggaaactctccagcgtgagtccgtgagggccaagaagtcccgccctgttctgggggaggacctggcttttctggtgtctctggtgcccgagagcccggtgctgccatctttagtgaaagagtaaatggtggccgagggctccttttgtgagggatgtgccttggtgaagaaggcatgttccctgccgtgaagatacttggaagctctgggtggagagggaaaagggatacccctggtgctccctgggcctggcggaaggctaggaggaaggacagctgaggtgaggactgagtggggcaggtatcaccctgacaaacagtttgggaagatcaggaaaggcaggtgagacctggtgcagaatccaggttgggtaatagatacatcgtcgaagatgtagcaagcaaagtaatatactcaactctggaacattgcacagaagcttttaaagcactctgtgacactttttgtaatgagggatctgaaggaaacggccccagagtcacccatccccacgggtctggttggcggggctggtgcctttcttctgcactcagtcaccatggctccgtctgtcaaactcaactctttttttttttttttttcttctcttggtgtggtaatttgtttgaagagccactccatccccaaattcaagattagaaagatccctgactgcttctcaagatccagaacattccttgacagagtatattcaccatttagaagtgatccagcaaagattgggaggggtactaccaggtaatgcaagtcctcgccgagtatttattaagctgattatcactgtaccctggaaacgtagggtctgttgaaagatggctggtattcagcttagtaaccaaagtttcagtctgaacaatcagtgtcactaatagtattagaatagaggctacaagtgaagaatctcacagaagtctaagccagtgtactcagtgatacgtgctgaggtcagtttgacttaatcaccgtctggacttttttgtcctttctcttacattgatagcgaacataaagattatatttcgaccaggatataatttgttcagtgtttcttaaatatcataatttaaaccactgtataattcatatttttaccaaaatttacatgaattcagtgatagtgtttcaaaattgtggaattcttttcaaaaaatctgtgaagccttgtaaccaatttgctgcctcatttttatttatatgcagattctacttcaaagaaatcctgccacccgatgattaaacagtgaataaaatgtcatggctctttcctgcgacaattctatttgaggaaaagatttgtttttcccttttcccaaggaagctcgtgggacagcatgggcactactcttcatgtgcggtgacaccagcccccagatgccttgaattaagtgtcctcacctttatgcatgactgcaaagccagctggagcattttctatggagcctccgtatgttttaggcccatgaccttcgtgaggtgacgggcactcactcccatgagccctggctgtgtgctgttgtgtgcctatcggcagatccatccttcctgcctccaaggaggatacacagagaatggcttcctgttgttttgtttattttcttaacgtgtacagatggaaacttcatttaaaaataaaaacaaaacaactcaaaaaggaataaaatttaatcactgttttgtttgtgaata

SEQ ID NO: 12631 - DNA, 521 bp, Homo sapiens
gggctcaagcaactctcctgcctcagcctcctgagtagctgggattacaggcgcccaccaccaggcccagctaatttttgtatttttagtagagacagagtttcaccatgttggccaggctggtttgaattcctgacctcaaatgatccatcctcctcggcctcccaaagtgttgggattacaggtgtgagccaccacgcccggctggctgtgcttttttatgtttcactcatactcgcttagactagacagtaatacctagccaaggaccctttatccaaaaatgtactagatgggtataatttttttatttttagagacaaggtctcgctctgtcacccaggctggagtacagtggcacaatcacaactcactgcagccttgacctaccaagcccaaatgatccgcctgcttagcctcccgagtagttgggactacaggtgcgcaccaccacgcctggcactaattttcgtatttcttttagagacaaggtttcactttgtttcccggcctggtttcaa

SEQ ID NO: 12632 - DNA, 226 bp, Homo sapiens
tgccctttcctggtgtagtgtcatacaagttcacacacacacacatccctgtaaccttcataagtaaccaccattcacagagcacacagcgatggcccccccaaaaagagcagcaggcatctccgcctgccacaggccctggctctctcccagaaaggtgtgtcagtggaaccagcccgtctgggacctcctaaactggcttttttcactttttgggttttttttc

SEQ ID NO: 12633 - DNA, 521 bp, Homo sapiens; identical to SEQ ID NO: 12631

SEQ ID NO: 12634 - DNA, 8896 bp, Homo sapiens
aagttaagtaatatgcccgaggtacgttttcaatggaagaggctgactgagggtcacccaacttatatctcgaaatttcacaatttctacaagttctgtcctgggaggcaagagtaggtgaaacgagcacactctacgccaggcaaacaaacctcaacgcttagcctcccggcacctcctagggccggaagcttctcagcccaaagccgctgctggctgcaacctccgtcccgcagtccaattagcagccgcgacccggcgcccgcccacgccgcgtcacgagtcagccaaagatggctgcgcccaggtaatttgagcaaaggccacagtgaactccggcgtggctgaggaaggaggaggcacccacaggctgctgggaggagagcataaggtactggtattccgggggagggggtgaagtaaatgtcccggtgtcaggagaagcacgacgcggtgacacgctagctaccagcagcgctgcgcgtaaatgagagcaagtagaagtgtagttagctcttcctgctgtcttttcactttgcactctagaaggaaagaccttatatttaaattaactcagtagaaaggagaaatgcctgagattgaatttaatcccaggtttactgtcaatttacaaggtgaccacggccaaatttgattttcagaggtcccactttacttctctttcagataggccccacactgcctatctctcagagctcttccaagaatgacatgagataggtaacacaaaaatctttcgaaatatttgtagtttttacaggcggcgttgtctttgatagatatttgttattaatatcggagacaaaatgcccacaggggctgcccagtcagcacttatactgaattgagtgacttaattgccctcagtacaatatatacatactaaatttgattatatatttcaccaccccatacacaaaatcattcagagctcctgtacagcagagattgtgtcttatcatcttatcgtagccaaggccctcaaaaatttgactaccagaaacctagacataaatttctaaggctgctttgtacttattaggttagctttaagtctagagatatggaatgtcaaggtaatcaacatttccaaatgacctcttatcgatataaaacaggtagcaataaatatttaaacgagtgcctgtaatgttgtaggaaatgagaaaatctggtttcataaaagcatgttttcctttgttgttatccctgaactgtttttttttttttttttgtagaccgagtctcgctctcacccaggctggagtgcagtggcgagatctcggcacactgcaacctccacctcccaggttcaagcgattctcctgcctcagcctcccgagtagctgggattacaggcagctgccgccgtgcctggctaatttttgtatttttaaaagacagggagtttcaccatgttggccaggctggtctcgaactcctgacctcaggtgatccgtctgccttggcctcccaaggtgctgggattacaggcgtgagccactgcatccagcctttgtttttcttaactgttaccctgaaacctgagccaaatcttcatcattcaccattcccttcacattttcaccctaactagtgcagacatcaacaaactactggcatgtaggccatatgcagcctatagcttgccttggtacagccacccagctaagaatgatttttatgtttttatagtttttttaaaaacaaatattcaacaaaggctgtatgttacctgcaaagcctaccacatttacatctggccctttaaagtttgctgagccctgatctcaggtatacctagaaatgaaattgctagctatgtgtgtcttctatctgctaaataataccaaattctttcccaaagtgactgtacagtttgggtaaagctaccccacagaatgtacacagaatgtagttttagctaccccgcattcttgccaataattggaattgtcagattttgattttagctaacctatgggtacctattggtatctcactgtgggttgttcccccagttataatgaaggtgagcatattttcatgtttattggccatttaactttcctttttgtgaagtgcctgttcaaatattttgtcagtttttccgtagggctgcttacctttttcatgttgatatgtagttccatgtatgttctgggtactaactactcttttgtcagttctattgcattttctcccccactagcttatctttatggtatatgttgataaccataggttcttaacttcaatactgttagttttataagtcttttatgtttagtgctatttgtgaattgtttaggaaatactttcaaggattatgaagatattctgtatttcctaaaagctttatgtgttgcttttcatgttctggtttctgtttcacttagatttttttttaataatatgtatgcaatgatttttttcagattagctctacagtattatttttagtcttcagaaggtttttaaaattctttgtataaattcttgagaaatgatatcttcatgttttttaaggctcaaaatggaaaatcataaatccaataataaggaaaacataacaattgttgatatatccagaaaaattaaccagcttccagaagcagaaaggtaagatcccttcttaatttaaaaacaccttttatcaggtggattttcaccattgattcattatctcaagtttatctggtttgagtataaacaacatggaatgtgagaaggaaattgcccttttcttgcctggatgagagcgtttaaccattttgctcaacatcacatagctaattgtggaaggtgaggctggaactcatgtctttggacatacctaattgtataatgttttgagtttttccattaggcttggagtatagtaaaatgtaaacatttacagacccatttaaataacaaaactttaacttttaaaatgtcttttttttcccagttcattctgtcagtatgcttaccagtctaagagtaccatagaacacacatagcaagatagagaatgtcagagaaataggatcatggctaaagatctttaagatattattaaagagggccaggcatggtggctcacgccagtaatcccagcactttgggaggccagggtgggcagatcacctgaggtcaggagttcagaccagcctggccaacatggtgaaacctcatctctactaaaagtacaaaaattagctgggcgtggtggcaggtgcctgtaatcccagctacttgggaggctgaggcaggagaattgcttgaaccagggaggcggaggttgcagtgagccgagatcacaccactacaccccagcctgggcgacaagagtgaggatccgtctcaaaaaaaaaaaaaaaaaaaaaaagatattaaagagaaaaaccaatatagggaacatactaatctttgccaggcagctaatgtgtacttccacaaaatgtcttacactttgttgacagtcaagaaggtctctctgactataaaaggatgaaaagcagccacctgggaaggagagagggacagtgtcttaagtagagggaatggcatatgcctagccacaagatagccaaggcttgtggtacttgagtaaccattgttaccgaagtactaaggaagtgggagtaaggaccaggaatagttttgagcagggggatgatgttagcatttctaaagaacattccagctgctttttggaaagcagatttgaggtaggaaagaaaggaaacacaaataccagtagaaaaaatggcacagtaatcctggtgagtggagatggtaggggtggtgacagctgagatgaaaagaggatgcatttaaaatacattctggaagcataatcttgctatcttcaggaatagaaactgaacaaatccccatcttgctgccacttaccatcttaatcagggagaacccataaatcaagaccagtagtgttcagaacaaggatctccaaggggaagaaaaaaaaggccagtagtaagaacttggtgagatcttaaaagctctttcaccccccctccccacactccaactccactcccttctagttgttttcctgaggtaacggaaaaccttttaaagcaaaaaaggaactatgtccatgtttccaggccagcaagatagggaaagtgagaaagactaataaaagagtagtaggctgggcatggtggctcacacctgtaatcccagcactttgggaggcggaggcgggctggtcacctgaggtcaggagtttaagactagcctggccaacatggcgaaaccctatctctactaaaaatacaaaaattagccagatgtgggggcacgtgcctgtagtcctacccactggagaagctgaggcacgagaattgtttgaacctgggaggcggatgttgcatggagctgagatcatgccactgcactccagcctgggcgacagagcaagactgtctcaaaaaagagtagatggtggcagctttgaagagaagaaagcagtctgtcactgggttctttaccaaattagaaagaatacctggaactgcaaagtaaaatttagtttagaggcaataaatgtttcaatcattggcatctaaactaggcagattacagtgtcctgttatctttgccttgttcctattttttctcttcattcccattttattttctaagtttaaatcttcatttcttcttggattattaatcaggtatttaatggttacttggcatgtccttcagtgtatggagctttcttaatatcaaaaacttcattttctgatctacagcaatactttcacgtacatgtttgtcatttgttaaatttgggctatttcatgtctatttcttgtgtatgtcttatcaaaaagtcatgagtttttagttggtataggtacttttttggaaaactggcaaggggctgctaggtaacaattttgtgctaacttttaattaactaaacattttgaccttagctatgggaaaaatctggttgggagagagcaaagtttgctatgcagatttcacttgtactactttttatttatttgtatatgtaacatacttgtaaacaaatggacttatatataacatgtatatatgtattttatatatattatatatacatacaggcaaattgtttacctgagcattgggatttaaaatggggataatatacatttcacatgatttttatgatgaaatattttagaggaagtgttcaagttttttattccaacccccacaaaaaaaaaataggcttttcacatttacatggtttttgtggttggtaggttctccagactgtcatcactaattataatctatgtactccaagttcctgaactgccactgtcttgtaccaccattaccattttcatagacttctgttatatctcgtttacatctctttcttctccagtaatatttaactatgttaaccttgaagatagaaggtaattttttgtgcctttagcactaagtctgctgcatacagtggggttctcaatgagtgacaggcatcatgattgcaaagtgtcagataagaaaagcaataccttatacaacgtaggaagctgagttcctagaaaagctattttaagatgagtgtaagccatagaagttagaggaggtactctgtggctactttggctagttaagagtagtgaaaatcttaagactgtattgtagatggcaatgtaagtggtaaaaaagctaagtcgtagtctgaaaagtttggagtcagtattttcaatattcagcaatcatgttaggtattactttttcccaaaactaaagaatgcataggacataagttaaaagttcatacataacctggcttcaaatccagttctaccactacctgaaaacatcagtttatttctcatcaatgggttgttataaagtacctagcatagggtattgcttaaatgttaatactcccaatcctgacactaatgtttcagggaagagtgaaagaaatcacattaactccacattattgaacatcttctgtgtcaggctgaatacatctttgtatccattgtcttctggttgtttaaagactagtgtagaagcctgacatgtaaatcggtgattatataagatagtactgtcttgtaatgtgttgtgctagagaggttaagtattaattattatgggagctcaggagaggcacccactggctgctgggagaagagcaaaaacctatatataaagcaatttttaagattttggttctataagggatagatgtcgtatccagttagtgtattcccaaagtcctataacacatgtcaagatcgggaaagctcacacacacaataatgccaaagaaaagttctttcttctcaccctttcaggaatctacttgaaaatggatcggtttatgttggattaaatgctgctctttgtggcctcatagcaaacagtctttttcgacgcatcttgaatgtgacaaaggctcgcatagctgctggcttaccaatggcagggataccttttcttacaacagacttaacttacagatgttttgtaagttttcctttgaatacaggtaaattctacttcactatcaccaaagagtttgccttagtatatgttatttgcagctttagtccatacttattaatatcaagtagctgtatgctgtaatgcagttaagattaaatcttgctagcctatataatgtggcaaataattcatattagtatggtctaccaaccaagatgcacatacacagcagttctaaatactttttctttaattgagatggagttttgctcttgttgcccaggttggagtgccctggcgcaatcttggctcactgcaacctccaccttctgggttcaagcaattctcctgcctcagcctcctgagtagctgggattacaggtgcccaccaccatgcccggctaattttttgtatttttagtagagacagggtttcaccatgttggccaggctggtctcaaactcctgacctcaggtaatccacccgccttgtcttctcaaagtgctgggattacaggcgtgagccactgcacccggcaatacttccctttttctaacatatctttctcacagtgctcatttagagtaagaaatatttggaaatccatatatacatatatatgaaaattatatatatggaaatattatatatatacaaatgtatataaataatatgttggctaccttagattttttatttatattttatagagaagttccttaaagggggaaaatatttttatgggaataactctttatacagtaaatctcttaaagcactaaatgcatatacatttatcaaatacatggagatttgatttccttttgaaaatctaccatgtgtgctgaatactttgagtacagttaatcataaaaaaaacttttgattaattatttcaaataaaaatattaccatgggtgctagggaaggcagtccatctaaattttgttaagtgctgctccaaatttgtttaaatttgacgagtattttgttttaattcccatgcaccagtggaaacaatttctatgatcaaggaagacctatcgcccatttaattgaacagactgagtgaaaatattagcctaggtctgttgataaaaaacaaggcagaaagctagcagtagcccaaaccatgagattattatatctaagttgagaacaaattagagaactttttttcctaaaatagttttaccaattattcctagctattttaagttactcatagatgtaattataccttttaacaggctttgtacaattacatttgatatattacctgaaaaatacctgtgatacacaaaagaggatcttacattctttaaatcatgtttgcttgactatcatgaccttcatttctatgactaatttatttcctaggtgatttggattgtgaaacctgtaccataacacggagtggactgactggtcttgttattggtggtctataccctgttttcttggctatacctgtaaatggtggtctagcagccaggtaggaaataaaaaactttttataatatgtgattacctataaaactcacaacttaaagcagcaaatatattttgtttttaaggcatttagaccaaaggcaatgttaccctcttgattagaagttagcaagacctgttttttcttataatgaaattctacttatcaagaatttcaaacagttatacttggtgtgtagttaggctattaaccttaatttgtgtactgaatactaaactaactacaaagctgcaaacagtattatgcatgaaacttctatcatataaacaattatcttggatgagtttgaacacttgcactaaaggaaaattccatcagaaaatgtctagctgttatattagccttctattctaaaataattctggctattctctgttgaactcttgcatcagcaatctatgctatagccttgaagcaaactggataaagaaacaaaagtttttaggattaatagacactgaagacctttactttaatattcagttttatcttaagacttctaggactaatatgtatcacagatgggtttgccatttgatgcaacaatcttttctattgaactatctcaatgttttcttacaggtatcaatcagctctgttaccacacaaagggaacatcttaagttactggattagaacttctaagcctgtctttagaaagatgttatttcctattttgctccagactatgttttcagcataccttgggtctgaacaatataaactacttataaaggcccttcagttatctgaacctggcaaagaaattcactgattttaaacaaatatgtaaacaaaaataaaatggtaaaaacagtttatgtctaatgttatgtctaatgttatgcataaacatagacttgtaa

SEQ ID NO: 12635 - DNA, 8895 bp, Homo sapiens
aagttaagtaatatgcccgaggtacgttttcaatggaagaggctgactgagggtcacccaacttatatctcgaaatttcacaatttctacaagttctgtcctgggaggcaagagtaggtgaaacgagcacactctacgccaggcaaacaaacctcaacgcttagcctcccggcacctcctagggccggaagcttctcagcccaaagccgctgctggctgcaacctccgtcccgcagtccaattagcagccgcgacccggcgcccgcccacgccgcgtcacgagtcagccaaagatggctgcgcccaggtaatttgagcaaaggccacagtgaactccggcgtggctgaggaaggaggaggcacccacaggctgctgggaggagagcataaggtactggtattccgggggagggggtgaagtaaatgtcccggtgtcaggagaagcacgacgcggtgacacgctagctaccagcagcgctgcgcgtaaatgagagcaagtagaagtgtagttagctcttcctgctgtcttttcactttgcactctagaaggaaagaccttatatttaaattaactcagtagaaaggagaaatgcctgagattgaatttaatcccaggtttactgtcaatttacaaggtgaccacggccaaatttgattttcagaggtcccactttacttctctttcagataggccccacactgcctatctctcagagctcttccaagaatgacatgagataggtaacacaaaaatctttcgaaatatttgtagtttttacaggcggcgttgtctttgatagatatttgttattaatatcggagacaaaatgcccacaggggctgcccagtcagcacttatactgaattgagtgacttaattgccctcagtacaatatatacatactaaatttgattatatatttcaccaccccatacacaaaatcattcagagctcctgtacagcagagattgtgtcttatcatcttatcgtagccaaggccctcaaaaatttgactaccagaaacctagacataaatttctaaggctgctttgtacttattaggttagctttaagtctagagatatggaatgtcaaggtaatcaacatttccaaatgacctcttatcgatataaaacaggtagcaataaatatttaaacgagtgcctgtaatgttgtaggaaatgagaaaatctggtttcataaaagcatgttttcctttgttgttatccctgaactgtttttttttttttttttgtagaccgagtctcgctctcacccaggctggagtgcagtggcgagatctcggcacactgcaacctccacctcccaggttcaagcgattctcctgcctcagcctcccgagtagctgggattacaggcagctgccgccgtgcctggctaatttttgtatttttaaaagacagggagtttcaccatgttggccaggctggtctcgaactcctgacctcaggtgatccgtctgccttggcctcccaaggtgctgggattacaggcgtgagccactgcatccagcctttgtttttcttaactgttaccctgaaacctgagccaaatcttcatcattcaccattcccttcacattttcaccctaactagtgcagacatcaacaaactactggcatgtaggccatatgcagcctatagcttgccttggtacagccacccagctaagaatgatttttatgtttttatagtttttttaaaaacaaatattcaacaaaggctgtatgttacctgcaaagcctaccacatttacatctggccctttaaagtttgctgagccctgatctcaggtatacctagaaatgaaattgctagctatgtgtgtcttctatctgctaaataataccaaattctttcccaaagtgactgtacagtttgggtaaagctaccccacagaatgtacacagaatgtagttttagctaccccgcattcttgccaataattggaattgtcagattttgattttagctaacctatgggtacctattggtatctcactgtgggttgttcccccagttataatgaaggtgagcatattttcatgtttattggccatttaactttcctttttgtgaagtgcctgttcaaatattttgtcagtttttccgtagggctgcttacctttttcatgttgatatgtagttccatgtatgttctgggtactaactactcttttgtcagttctattgcattttctcccccactagcttatctttatggtatatgttgataaccataggttcttaacttcaatactgttagttttataagtcttttatgtttagtgctatttgtgaattgtttaggaaatactttcaaggattatgaagatattctgtatttcctaaaagctttatgtgttgcttttcatgttctggtttctgtttcacttagatttttttttaataatatgtatgcaatgatttttttcagattagctctacagtattatttttagtcttcagaaggtttttaaaattctttgtataaattcttgagaaatgatatcttcatgttttttaaggctcaaaatggaaaatcataaatccaataataaggaaaacataacaattgttgatatatccagaaaaattaaccagcttccagaagcagaaaggtaagatcccttcttaatttaaaaacaccttttatcaggtggattttcaccattgattcattatctcaagtttatctggtttgagtataaacaacatggaatgtgagaaggaaattgcccttttcttgcctggatgagagcgtttaaccattttgctcaacatcacatagctaattgtggaaggtgaggctggaactcatgtctttggacatacctaattgtataatgttttgagtttttccattaggcttggagtatagtaaaatgtaaacatttacagacccatttaaataacaaaactttaacttttaaaatgtcttttttttcccagttcattctgtcagtatgcttaccagtctaagagtaccatagaacacacatagcaagatagagaatgtcagagaaataggatcatggctaaagatctttaagatattattaaagagggccaggcatggtggctcacgccagtaatcccagcactttgggaggccagggtgggcagatcacctgaggtcaggagttcagaccagcctggccaacatggtgaaacctcatctctactaaaagtacaaaaattagctgggcgtggtggcaggtgcctgtaatcccagctacttgggaggctgaggcaggagaattgcttgaaccagggaggcggaggttgcagtgagccgagatcacaccactacaccccagcctgggcgacaagagtgaggatccgtctcaaaaaaaaaaaaaaaaaaaaaaagattttaaagagaaaaaccaatatagggaacatactaatctttgccaggcagctaatgtgtacttccacaaaatgtcttacactttgttgacagtcaagaaggtctctctgactataaaaggatgaaaagcagccacctgggaaggagagagggacagtgtcttaagtagagggaatggcatatgcctagccacaagatagccaaggcttgtggtacttgagtaaccattgttaccgaagtactaaggaagtgggagtaaggaccaggaatagttttgagcagggggatgatgttagcatttctaaagaacattccagctgctttttggaaagcagatttgaggtaggaaagaaaggaaacacaaataccagtagaaaaaatggcacagtaatcctggtgagtggagatggtaggggtggtgacagctgagatgaaaagaggatgcatttaaaatacattctggaagcataatcttgctatcttcaggaatagaaactgaacaaatccccatcttgctgccacttaccatcttaatcagggagaacccataaatcaagaccagtagtgttcagaacaaggatctccaaggggaagaaaaaaaaggccagtagtaagaacttggtgagatcttaaaagctctttcaccccccctccccacactccaactccactcccttctagttgttttcctgaggtaacggaaaaccttttaaagcaaaaaaggaactatgtccatgtttccaggccagcaagatagggaaagtgagaaagactaataaaagagtagtaggctgggcatggtggctcacacctgtaatcccagcactttgggaggcggaggcgggctggtcacctgaggtcaggagtttaagactagcctggccaacatggcgaaaccctatctctactaaaaatacaaaaattagccagatgtgggggcacgtgcctgtagtcctacccactggagaagctgaggcacgagaattgtttgaacctgggaggcggatgttgcatggagctgagatcatgccactgcactccagcctgggcgacagagcaagactgtctcaaaaaagagtagatggtggcagctttgaagagaagaaagcagtctgtcactgggttctttaccaaattagaaagaatacctggaactgcaaagtaaaatttagtttagaggcaataaatgtttcaatcattggcatctaaactaggcagattacagtgtcctgttatctttgccttgttcctattttttctcttcattcccattttattttctaagtttaaatcttcatttcttcttggattattaatcaggtatttaatggttacttggcatgtccttcagtgtatggagctttcttaatatcaaaaacttcattttctgatctacagcaatactttcacgtacatgtttgtcatttgttaaatttgggctatttcatgtctatttcttgtgtatgtcttatcaaaaagtcatgagtttttagttggtataggtacttttttggaaaactggcaaggggctgctaggtaacaattttgtgctaacttttaattaactaaacattttgaccttagctatgggaaaaatctggttgggagagagcaaagtttgctatgcagatttcacttgtactactttttatttatttgtatatgtaacatacttgtaaacaaatggacttatatataacatgtatatatgtattttatatatattatatatacatacaggcaaattgtttacctgagcattgggatttaaaatggggataatatacatttcacatgatttttatgatgaaatattttagaggaagtgttcaagttttttattccaacccccacaaaaaaaaaataggcttttcacatttacatggtttttgtggttggtaggttctccagactgtcatcactaattataatctatgtactccaagttcctgaactgccactgtcttgtaccaccattaccattttcatagacttctgttatatctcgtttacatctctttcttctccagtaatatttaactatgttaaccttgaagatagaaggtaattttttgtgcctttagcactaagtctgctgcatacagtggggttctcaatgagtgacaggcatcatgattgcaaagtgtcagataagaaaagcaataccttatacaacgtaggaagctgagttcctagaaaagctattttaagatgagtgtaagccatagaagttagaggaggtactctgtggctactttggctagttaagagtagtgaaaatcttaagactgtattgtagatggcaatgtaagtggtaaaaaagctaagtcgtagtctgaaaagtttggagtcagtattttcaatattcagcaatcatgttaggtattactttttcccaaaactaaagaatgcataggacataagttaaaagttcatacataacctggcttcaaatccagttctaccactacctgaaaacatcagtttatttctcatcaatgggttgttataaagtacctagcatagggtattgcttaaatgttaatactcccaatcctgacactaatgtttcagggaagagtgaaagaaatcacattaactccacattattgaacatcttctgtgtcaggctgaatacatctttgtatccattgtcttctggttgtttaaagactagtgtagaagcctgacatgtaaatcggtgattatataagatagtactgtcttgtaatgtgttgtgctagagaggttaagtattaattattatgggagctcaggagaggcacccactggctgctgggagaagagcaaaaacctatatataaagcaatttttaagattttggttctataagggatagatgtcgtatccagttagtgtattcccaaagtcctataacacatgtcaagatcgggaaagctcacacacacaataatgccaaagaaaagttctttcttctcaccctttcaggaatctacttgaaaatggatcggtttatgttggattaaatgctgctctttgtggcctcatagcaaacagtctttttcgacgcatcttgaatgtgacaaaggctcgcatagctgctggcttaccaatggcagggataccttttcttacaacagacttaacttacagatgttttgtaagttttcctttgaatacaggtaaattctacttcactatcaccaaagagtttgccttagtatatgttatttgcagctttagtccatacttattaatatcaagtagctgtatgctgtaatgcagttaagattaaatcttgctagcctatataatgtggcaaataattcatattagtatggtctaccaaccaagatgcacatacacagcagttctaaatactttttctttaattgagatggagttttgctcttgttgcccaggttggagtgccctggcgcaatcttggctcactgcaacctccaccttctgggttcaagcaattctcctgcctcagcctcctcagtagctgggattacaggtgcccaccaccatgcccggctaattttttgtatttttagtagagacagggtttcaccatgttggccaggctggtctcaaactcctgacctcaggtaatccacccgccttgtcttctcaaagtgctgggattacaggcgtgagccactgcacccggcaatacttccctttttctaacatatctttctcacagtgctcatttagagtaagaaatatttggaaatccatatatacatatatatgaaaattatatatatggaaatattatatatatacaaatgtatataaataatatgttggctaccttagattttttatttatattttatagagaagttccttaaagggggaaaatatttttatgggaataactctttatacagtaaatctcttaaagcactaaatgcatatacatttatcaaatacatggagatttgatttccttttgaaaatctaccatgtgtgctgaatactttgagtacagttaatcataaaaaaaacttttgattaattatttcaaataaaaatattaccatgggtgctagggaaggcagtccatctaaattttgttaagtgctgctccaaatttgtttaaatttgacgagtattttgttttaattcccatgaccagtggaaacaatttctatgatcaaggaagacctatcgcccatttaattgaacagactgagtgaaaatattagcctaggtctgttgataaaaaacaaggcagaaagctagcagtagcccaaaccatgagattattatatctaagttgagaacaaattagagaactttttttcctaaaatagttttaccaattattcctagctattttaagttactcatagatgtaattataccttttaacaggctttgtacaattacatttgatatattacctgaaaaatacctgtgatacacaaaagaggatcttacattctttaaatcatgtttgcttgactatcatgaccttcatttctatgactaatttatttcctaggtgatttggattgtgaaacctgtaccataacacggagtggactgactggtcttgttattggtggtctataccctgttttcttggctatacctgtaaatggtggtctagcagccaggtaggaaataaaaaactttttataatatgtgattacctataaaactcacaacttaaagcagcaaatatattttgtttttaaggcatttagaccaaaggcaatgttaccctcttgattagaagttagcaagacctgttttttcttataatgaaattctacttatcaagaatttcaaacagttatacttggtgtgtagttaggctattaaccttaatttgtgtactgaatactaaactaactacaaagctgcaaacagtattatgcatgaaacttctatcatataaacaattatcttggatgagtttgaacacttgcactaaaggaaaattccatcagaaaatgtctagctgttatattagccttctattctaaaataattctggctattctctgttgaactcttgcatcagcaatctatgctatagccttgaagcaaactggataaagaaacaaaagtttttaggattaatagacactgaagacctttactttaatattcagttttatcttaagacttctaggactaatatgtatcacagatgggtttgccatttgatgcaacaatcttttctattgaactatctcaatgttttcttacaggtatcaatcagctctgttaccacacaaagggaacatcttaagttactggattagaacttctaagcctgtctttagaaagatgttatttcctattttgctccagactatgttttcagcataccttgggtctgaacaatataaactacttataaaggcccttcagttatctgaacctggcaaagaaattcactgattttaaacaaatatgtaaacaaaaataaaatggtaaaaacagtttatgtctaatgttatgtctaatgttatgcataaacatagacttgtaa

SEQ ID NO: 12636 - DNA, 7569 bp, Homo sapiens
ttatgctacttaaaattataatttagaaaaggcatctttgtgagtgaaactggcctttagcttctgtttaaagaaaaacataaagctgtgctgccaaagatgaaaaactcatgtgaaattaataaaatacaatctcaatttttcagaaagcaaagatgatttgttctttcaacaggcacataaaatatattatctaccaaacttatataaaaaatgatcccagttatgaggcaaaagaatctatgtgcacaagagactgaaaggaagcatgccaaaatgtttactgtggatattctatggcttatagagttataagggtgatttttcttttcttcttgattcctttcaggatattccaagttttctataaagaatatgctttacttttacaactagggaaagaaagacagaaaaatatatataacatttaaagggcaaaacaatatagctgtttattttacaggctaaaatatcaagatgaaaagctctgatcccaaatcatccattttacctatattctgtcacttttactaaaagcagagttctactcatcccagtgaaaaaaacaatgaattaaaagtaatttctggcgttaacccaagtaccgagttaagactccttaagaatatagaattatgtaatcaacttagataattcaaagcccaatgatataactaagttctttgacgattgagcacacattgtttccttacttatctttaaacattcctagtccaattactccctagcataataccatttataaatgaggatgagtttacaatggtttctgtaaccaaaaagtatttctaatatctgtcctctgccacatatttttaaattatcttttccattagcagaaatgggcaacataagcaataaatcatgttaagtctgttgctacaaatttactttgccaaaatttttgttcagagggcagatatctgcattatttaaggacatttagtcatttgtagctaacacctgaagtaaactaccctcaatcaatttttatatttcagtctagtcactgtagacaaactatttaaatcttttataatttactttgtgtagttatttggcttaaaaaaaaaaaaagagggctcacattctatttaaattaagacaatatattttataaagcccaaattatagtacactaagagccagaggggtctagggaattgatctcagtgggtatacagcaaagacaaaatttggaggcagacgctaaaggaagttgagataaataaaattcaaatcagtgtattaacagaactacacaaatgtttacaacacagtaactacacttttcaattagttcattgtgaaaactgagcaaaatattttcaacaattttgggtcaacaaaaagtatggaatattttaagacaataaagagtgactggtgttgagagtactgaggctacacagaggtactgaaattcaaatctgaaaaatactgtgctggccacacaacactacaaatttctaatggaagaattccctttttgatccgcagcttaggtggtaagtaaataaaaaaacagctcagaaaaacagcaaaaatattaacatttaggagtctcaaaactttgtattggctgtgagtctgggggaaaaaaacataaatgtcatactaccaattaaactttcaagagtcatcagattatttagctttaaaattttactaaatcagaccttaaactacacattcaaaatgctgaactagataatcacatattaaaaaggtaatgactcattatcagtgaattacccagtctgttctatcaaagtagtagttaaggtcaccaaataatgttggtgcctttggttctggaattataactagctgtactgtaggagcatcagcgcctaagttttaagccagtgggaatactctgctgcctggcttcacaggcactgaatacacttaaaatggtaagaaactgaatggatttaataagttttgaataatacaataaccaactgtatatttattatgaagtaaaagccaatctcctacccaatccctcttctatcagctgcacatttccaagtaagtgagataaaatgactcaatctaaaccacgtgaaggaatgtattaacataatccaacaaaaatgaaataaaacaatccagagttttgagtgttttttcacacttgtaataaactgaaaaaatatttcaattaaaacaaccatatgccacaaaaagccactcccatcatccacaatactaaagtccttatacaacactagataaatttttatataaaacagtagaaactagcataccattaattagaaacctcaaaatattcagaaaacagtatcaagtactcaagagaaagctcaagaagccaaaacctcaagaatccatacatcctggttgttaccctaaattgtaattaactacccacacatttaatcataatcaactttttcaaagatatacaaatcaatgcatctatttaaaaggactactctttatagttcagaactttacattaacttttatattctactcagcagggtgtctgtctgtactccaaattagctctcatgttccaggaaataaatacaaactcatatgccttgtgatcactgatggcctgcttatgtaattctagtccactaaatgttaattccatagaatatgctcttgattatgtaaaaactctaatttcttgatgaaatactgtaattctccaaaggttacaattttgtaaagatatgcaataactgagtatcactcccatgaaagacaaaaaaagtataattttgttccaagattaacttagtctcatgtatctctattaagtctttcaaggattccagagaatcttttcatatctccatttctggaaagtgaaatcagtatagaagtaatttgggaacttgaaaatggcattcatttttttcagcagatgccaaatttttgaccgacatggttctcacaattactttgttaccaacagtccagtcagttaacaggttgtaggaaaagattcgtttttgcagacactgctaagctgttcaaagagaagagagagagattaatttagtgattataaaatgcacaaatatttaaaatattttgaacacttcttgttggattatatcagaggtgtgactacattttaacaaaagtggactttttaagataagtctggtcaaagaagtgcagaaacagtaagtcaatatgatagaaatagtaggtcaaaatatgatgtgttagttcaattaatgtatgaactcctgccaccatcaaaagacaaatattaaaaagctacatctttagtctagttctgtattttaccagaggcacatttagaagaaaaacaaaagggtcacccaaatactaaattgttttcaaccattacagtaaatagagccaaacctagaaatttcaaaaacaatccattttatattccagaaatctcctttatccatgtgctaatcatccagaacacaattttctaaaaatagtaagacaacagtttcacattaatcataacttttttaattaacaagtagtgaatcggacactttaagatattgtttactacatactgaaataaacagatctgtttaaattcagaaacccaaacatttacagtaaaatgtgcttacacataaatatgaccaaatttatttaaagcccctattagatagatcctaagtacatgcaattaccatgtaaaaacaagaccatgaagttgatgtaaaaaatgacaaaatcactaagtcaccaaaactagaaaaaaaaaaatgaaatggaaactgagaaaagacagttaataaaacataaggaacctaacaaagcagctttaaaaataggccatactaatccttccattttcaaaagttcttatcaagtaattccaaaaactgccatttataaaatgacattctaaaaatctacacttggaatttcaaagtatctcaattcagaaagctttgactactgtttctccccagcccacaatttcaaataatgcaggaaaagtattgacgtaaggaagaaaatactccaacagaatgttatagtttttagaaaaatgaacttactgctttccagaaccttttaagacccacagtcagcattaacaatcatttttcctattttcatccattattttccaatatcatgttagagatgaataaattctttgagcccataactaaaagatcaacaaacctggttttattatgacaccatatttttgtcattggtactgcacaaaattatatacaaagaaatatatacaaaatgttcaagtattagttaaatttcaattcaaggcttctgtttcaaaaaagctacatttaacatatttcataaagatagcacaaattagtcatttcaaataatctttccaactacttttggtttatatatatatatatatatgtatatatatatataattcagtaggcactaaaaacccatgcagctgcattgtgaggggcttgctcctgcccttaggtataagcaggttcatcactccaatttgtgagtttggctactacccattcatgctcaagtgcagtagtagatgattttacaaaatatgctgtgatgcactggaaaccaaagaccaattcaggtctcaaatcgtattatctagcaacaaaacatttacagttgtgcaagaacaaggattccattttcataaccaaataacaaaataaaacattttatgtgtaagataacttacatctttggactgctggaaaatactttttaattatgaacatgttaaaaataaaaaacagcagaagccctgatattacctctttttcctcatttcttatactaccttttaaaataaagcaggaaatgtggccagcagctggtcccgtctcttctgccccaacagctgtatccactttagcacaaagaaaaacaaggatgctaaatacgtatatactttatcaagcagtgatgtttcacaaagaatttcttaatgcctcttacactgaaggacaccataattcaatttatacaactggttaatagattcaagggaataaatcccaccttaggaaaatagtaccaatcgtgtcatttaagtggccagaaccactcaatttaaaaaattattttaaaataggacaaatacttttgaaacacagagaataagattctttgtgaagcctcactttacacgttttcattcacatttcacaaccttcaatatctaatcatacatatataaatttaacctaaaattttaatacaacaaaaataaagatgttcaacaatttattcaatctcagtgatagggtaatcactgctggtcctcaaagaaacattagccattcttattctccaattaactaaaacgcaggagtctcatatgtatgttaatttccaacttctctaatggtgagacattaaaatgttactccattatagactgtttctatatctcatactgaaaactaaaaggcattgttgatatttaagagatacctgtcacctccagcaaaataactatcacatttgtgcatgccccaaatacttaactgtcaacctctgaaaagttgccctaaaatcggaattccaatttgcaccttgtacaactcggaacttccattcaacttcacctgtttcactgtctccaaactgtctctctataagcaggtttcagtgtacagttggaaccgatgtcatccaaggccatgtccacactggggacagaagagctaggtacacgcaagtctgaataaggggacacattaatagctatttcaaccagaagaggcatcttaaatacattcttgaccagcacaagtctgtttccagggtggacagggcccaaattagatttccctcccacctaccaaaacagaaaaaaaaaaaaaaatctcacacacacaaactgatatgttgcccattaaagtagacaaagcagcatagcatgagcgttacgggaagagatggatccttaccaggttgtgaggcgggaacgactgttctgtaacccctacaacggagcctggcaggaaggaaatcacctaaaaaagaaactgtcagagagatttaatagtcacatgttatcattaggagttggttactgtgtcacattcatgcttttagctaaacactttaagattcaatattactttttttctctcctctgaaatgtgtccggtgaagatgtcccactaaggtaagtttgacatggtgtaagggagttgaaaggggtaaacgcggataaagagcagattacttgaccctacattttaagagaagacgacgccttccgggcgcacgccgagcagaactccaccgacaccttatccttgtccacatggagacagactcctcccgccgagtcgtcctcttccagcaggtcctgcttctgctttcccaccggcagagcgtagtcgtggtcaccggcgggcgagtctctgaagagcgaggtggtcagccgcagtcccacgccgctcagccggctcagcaagcgagccagtccagtctcgttggctaagactgcccgtaggtagcgactctcctcctgcagtgcctgtacgcgtttgcccagctcccgattctcggcccgcagctcctggttctcggctgccagaccccggactcgactctccagccccatcacgtactccttcttcttcagtcgattaaggcgggcagcggccgccgccgccttccggggactctttgtcgccgcctggttgttgtcgttaccgctgccgccaccgccgcctcctcctggggactttctccgcctcttttcggcgctgccactgtcactgctgctgctgcagcctccgataccgtttaacagcctttgcagcaggtcagagaagcgctgcatttcagcagccgcggcctcatcgtcatcgtcccctctccacaggccgccgctatccgagcctccgccagacgaggagagaggccccggcgagctaagcccggggtccaggtgccagtccggttgcctggggtccaggagatccgccagttccagcccagacagaaagtccatatcctccgtctcttcccccgggaggctggcgatcgcctcctcctccatctcctcgggggagggcgcgcgcacggccacgccgccgcggctccccctcccggcttccaactctccttcgtcgccaaactgctgcttgcggccgggagatccggccgccgccgtctcctcctcccccgctgcagcccgggtcaggtcagagggcagcgaacaagttgcagccggctccgggctctcactgcgggttggggagttgctgcccgaggctgccagcagcttggtcaggctatgcctcatgagggccagcggcgggccgcggtaggccccggccgctaagagtgggcctcacgggccccaaggatcccaggccccagggcgggtagcccccggcactggccgaaacgaaatgcagggaaaggtccgagtcgcctcccgcctcacttggctagtcgaccccccgcgccaaggcgcggggagggacgggagaacgaagcggtgaggccctgcgatgactcgaccgcgccacccagacaacggcgtagccggaagtcagt

SEQ ID NO: 12637 - DNA, 7569 bp, Homo sapiens
ttatgctacttaaaattataatttagaaaaggcatctttgtgagtgaaactggcctttagcttctgtttaaagaaaaacataaagctgtgctgccaaagatgaaaaactcatgtgaaattaataaaatacaatctcaatttttcagaaagcaaagatgatttgttctttcaacaggcacataaaatatattatctaccaaacttatataaaaaatgatcccagttatgaggcaaaagaatctatgtgcacaagagactgaaaggaagcatgccaaaatgtttactgtggatattctatggcttatagagttataagggtgatttttcttttcttcttgattcctttcaggatattccaagttttctataaagaatatgctttacttttacaactagggaaagaaagacagaaaaatatatataacatttaaagggcaaaacaatatagctgtttattttacaggctaaaatatcaagatgaaaagctctgatcccaaatcatccattttacctatattctgtcacttttactaaaagcagagttctactcatcccagtgaaaaaaacaatgaattaaaagtaatttctggcgttaacccaagtaccgagttaagactccttaagaatatagaattatgtaatcaacttagataattcaaagcccaatgatataactaagttctttgacgattgagcacacattgtttccttacttatctttaaacattcctagtccaattactccctagcataataccatttataaatgaggatgagtttacaatggtttctgtaaccaaaaagtatttctaatatctgtcctctgccacatatttttaaattatcttttccattagcagaaatgggcaacataagcaataaatcatgttaagtctgttgctacaaatttactttgccaaaatttttgttcagagggcagatatctgcattatttaaggacatttagtcatttgtagctaacacctgaagtaaactaccctcaatcaatttttatatttcagtctagtcactgtagacaaactatttaaatcttttataatttactttgtgtagttatttggcttaaaaaaaaaaaaagagggctcacattctatttaaattaagacaatatattttataaagcccaaattatagtacactaagagccagaggggtctagggaattgatctcagtgggtatacagcaaagacaaaatttggaggcagacgctaaaggaagttgagataaataaaattcaaatcagtgtattaacagaactacacaaatgtttacaacacagtaactacacttttcaattagttcattgtgaaaactgagcaaaatattttcaacaattttgggtcaacaaaaagtatggaatattttaagacaataaagagtgactggtgttgagagtactgaggctacacagaggtactgaaattcaaatctgaaaaatactgtgctggccacacaacactacaaatttctaatggaagaattccctttttgatccgcagcttaggtggtaagtaaataaaaaaacagctcagaaaaacagcaaaaatattaacatttaggagtctcaaaactttgtattggctgtgagtctgggggaaaaaaacataaatgtcatactaccaattaaactttcaagagtcatcagattatttagctttaaaattttactaaatcagaccttaaactacacattcaaaatgctgaactagataatcacatattaaaaaggtaatgactcattatcagtgaattacccagtctgttctatcaaagtagtagttaaggtcaccaaataatgttggtgcctttggttctggaattataactagctgtactgtaggagcatcagcgcctaagttttaagccagtgggaatactctgctgcctggcttcacaggcactgaatacacttaaaatggtaagaaactgaatggatttaataagttttgaataatacaataaccaactgtatatttattatgaagtaaaagccaatctcctacccaatccctcttctatcagctgcacatttccaagtaagtgagataaaatgactcaatctaaaccacgtgaaggaatgtattaacataatccaacaaaaatgaaataaaacaatccagagttttgagtgttttttcacacttgtaataaactgaaaaaatatttcaattaaaacaaccatatgccacaaaaagccactcccatcatccacaatactaaagtccttatacaacactagataaatttttatataaaacagtagaaactagcataccattaattagaaacctcaaaatattcagaaaacagtatcaagtactcaagagaaagctcaagaagccaaaacctcaagaatccatacatcctggttgttaccctaaattgtaattaactacccacacatttaatcataatcaactttttcaaagatatacaaatcaatgcatctatttaaaaggactactctttatagttcagaactttacattaacttttatattctactcagcagggtgtctgtctgtactccaaattagctctcatgttccaggaaataaatacaaactcatatgccttgtgatcactgatggcctgcttatgtaattctagtccactaaatgttaattccatagaatatgctcttgattatgtaaaaactctaatttcttgatgaaatactgtaattctccaaaggttacaattttgtaaagatatgcaataactgagtatcactcccatgaaagacaaaaaaagtataattttgttccaagattaacttagtctcatgtatctctattaagtctttcaaggattccagagaatcttttcatatctccatttctggaaagtgaaatcagtatagaagtaatttgggaacttgaaaatggcattcatttttttcagcagatgccaaatttttgaccgacatggttctcacaattactttgttaccaacagtccagtcagttaacaggttgtaggaaaagattcgtttttgcagacactgctaagctgttcaaagagaagagagagagattaatttagtgattataaaatgcacaaatatttaaaatattttgaacacttcttgttggattatatcagaggtgtgactacattttaacaaaagtggactttttaagataagtctggtcaaagaagtgcagaaacagtaagtcaatatgatagaaatagtaggtcaaaatatgatgtgttagttcaattaatgtatgaactcctgccaccatcaaaagacaaatattaaaaagctacatctttagtctagttctgtattttaccagaggcacatttagaagaaaaacaaaagggtcacccaaatactaaattgttttcaaccattacagtaaatagagccaaacctagaaatttcaaaaacaatccattttatattccagaaatctcctttatccatgtgctaatcatccagaacacaattttctaaaaatagtaagacaacagtttcacattaatcataacttttttaattaacaagtagtgaatcggacactttaagatattgtttactacatactgaaataaacagatctgtttaaattcagaaacccaaacatttacagtaaaatgtgcttacacataaatatgaccaaatttatttaaagcccctattagatagatcctaagtacatgcaattaccatgtaaaaacaagaccatgaagttgatgtaaaaaatgacaaaatcactaagtcaccaaaactagaaaaaaaaaaatgaaatggaaactgagaaaagacagttaataaaacataaggaacctaacaaagcagctttaaaaataggccatactaatccttccattttcaaaagttcttatcaagtaattccaaaaactgccatttataaaatgacattctaaaaatctacacttggaatttcaaagtatctcaattcagaaagctttgactactgtttctccccagcccacaatttcaaataatgcaggaaaagtattgacgtaaggaagaaaatactccaacagaatgttatagtttttagaaaaatgaacttactgctttccagaaccttttaagacccacagtcagcattaacaatcatttttcctattttcatccattattttccaatatcatgttagagatgaataaattctttgagcccataactaaaagatcaacaaacctggttttattatgacaccatatttttgtcattggtactgcacaaaattatatacaaagaaatatatacaaaatgttcaagtattagttaaatttcaattcaaggcttctgtttcaaaaaagctacatttaacatatttcataaagatagcacaaattagtcatttcaaataatctttccaactacttttggtttatatatatatatatatatgtatatatatatataattcagtaggcactaaaaacccatgcagctgcattgtgaggggcttgctcctgcccttaggtataagcaggttcatcactccaatttgtgagtttggctactacccattcatgctcaagtgcagtagtagatgattttacaaaatatgctgtgatgcactggaaaccaaagaccaattcaggtctcaaatcgtattatctagcaacaaaacatttacagttgtgcaagaacaaggattccattttcataaccaaataacaaaataaaacattttatgtgtaagataacttacatctttggactgctggaaaatactttttaattatgaacatgttaaaaataaaaaacagcagaagccctgatattacctctttttcctcatttcttatactaccttttaaaataaagcaggaaatgtggccagcagctggtcccgtctcttctgccccaacagctgtatccactttagcacaaagaaaaacaaggatgctaaatacgtatatactttatcaagcagtgatgtttcacaaagaatttcttaatgcctcttacactgaaggacaccataattcaatttatacaactggttaatagattcaagggaataaatcccaccttaggaaaatagtaccaatcgtgtcatttaagtggccagaaccactcaatttaaaaaattattttaaaataggacaaatacttttgaaacacagagaataagattctttgtgaagcctcactttacacgttttcattcacatttcacaaccttcaatatctaatcatacatatataaatttaacctaaaattttaatacaacaaaaataaagatgttcaacaatttattcaatctcagtgatagggtaatcactgctggtcctcaaagaaacattagccattcttattctccaattaactaaaacgcaggagtctcatatgtatgttaatttccaacttctctaatggtgagacattaaaatgttactccattatagactgtttctatatctcatactgaaaactaaaaggcattgttgatatttaagagatacctgtcacctccagcaaaataactatcacatttgtgcatgccccaaatacttaactgtcaacctctgaaaagttgccctaaaatcggaattccaatttgcaccttgtacaactcggaacttccattcaacttcacctgtttcactgtctccaaactgtctctctataagcaggtttcagtgtacagttggaaccgatgtcatccaaggccatgtccacactggggacagaagagctaggtacacgcaagtctgaataaggggacacattaatagctatttcaaccagaagaggcatcttaaatacattcttgaccagcacaagtctgtttccagggtggacagggcccaaattagatttccctcccaccttccaaaacagaaaaaaaaaaaaaaatcacacacacacaaactgagatgttgcccattaaagtagacaaagcagcagagcatgagcgttacgggaagagatggatccttaccaggttgtgaggcgggaacgactgttctgtaacccctacaacggagcctggcaggaaggaaatcacctaaaaaagaaactgtcagagagatttaatagtcacatgttatcattaggagttggttactgtgtcacattcatgcttttagctaaacactttaagattcaatattactttttttctctcctctgaaatgtgtccggtgaagatgtcccactaaggtaagtttgacatggtgtaagggagttgaaaggggtaaacgcggataaagagcagattacttgaccctacattttaagagaagacgacgccttccgggcgcacgccgagcagaactccaccgacaccttatccttgtccacatggagacagactcctcccgccgagtcgtcctcttccagcaggtcctgcttctgctttcccaccggcagagcgtagtcgtggtcaccggcgggcgagtctctgaagagcgaggtggtcagccgcagtcccacgccgctcagccggctcagcaagcgagccagtccagtctcgttggctaagactgcccgtaggtagcgactctcctcctgcagtgcctgtacgcgtttgcccagctcccgattctcggcccgcagctcctggttctcggctgccagaccccggactcgactctccagccccatcacgtactccttcttcttcagtcgattaaggcgggcagcggccgccgccgccttccggggactctttgtcgccgcctggttgttgtcgttaccgctgccgccaccgccgcctcctcctggggactttctccgcctcttttcggcgctgccactgtcactgctgctgctgcagcctccgataccgtttaacagcctttgcagcaggtcagagaagcgctgcatttcagcagccgcggcctcatcgtcatcgtcccctctccacaggccgccgctatccgagcctccgccagacgaggagagaggccccggcgagctaagcccggggtccaggtgccagtccggttgcctggggtccaggagatccgccagttccagcccagacagaaagtccatatcctccgtctcttcccccgggaggctggcgatcgcctcctcctccatctcctcgggggagggcgcgcgcacggccacgccgccgcggctccccctcccggcttccaactctccttcgtcgccaaactgctgcttgcggccgggagatccggccgccgccgtctcctcctcccccgctgcagcccgggtcaggtcagagggcagcgaacaagttgcagccggctccgggctctcactgcgggttggggagttgctgcccgaggctgccagcagcttggtcaggctatgcctcatgagggccagcggcgggccgcggtaggccccggccgctaagagtgggcctcacgggccccaaggatcccaggccccagggcgggtagcccccggcactggccgaaacgaaatgcagggaaaggtccgagtcgcctcccgcctcacttggctagtcgaccccccgcgccaaggcgcggggagggacgggagaacgaagcggtgaggccctgcgatgactcgaccgcgccacccagacaacggcgtagccggaagtcagt

SEQ ID NO: 12638 - DNA, 12458 bp, Homo sapiens
ctgccgccgctcggggtcgcctggagccccagattcccgagcgctcggggggggatggcagccgcttcggcgcccggccccgcggccagctaggggcggccccgcgctccctcacggcccctcggcggcgcccgtcggatccggcctctctctgcgccccggggcgcgccacctccccgccggaggtgaggactgcggggacagggcgcggtggggattccaggccccgcgccgccgccgaacccagcgcggcggagatagaaaggggacgtgggagagagtggtggtggcgggggggggggctgtcggagctgtggggcggagactgctcgctgccgggaaccgtccttccctccggcccccgcgtcccctccgtgctcgaggccgcctctcggcgctgtccccatcccgcggacccctccgtcctgactacgatcccaaccccagccattcccgcgcctggcctcgctccgcgatgcccatctttcccctccttgcagaccccgctcccgggttcctgtcttcgctctcctcgctctcttcgcctgctcaacccttccctgcccccatcctcccgctacccccatccccttcttctgtcccggcgcccctctccctcgtcggctcctgtcacttggaacccgtatccgtgccgctatctccgcgtccggccgcctcccaaccggtgccgtcccacaggtgtccacgcgtccggccgtccatccgtccgtccctcctggggccggcgctgaccatgcccagcggctgccgctgcctgcatctcgtgtgcctgttgtgcattctgggggctcccggtcagcctgtccgaggtgagcgcgcccgctgggctccagtcgcggccctgtccagccgtcctcgcttgcacgttgacctctgccggccggaggcggcactgcagtcgctccgacccgcggggcaagcaagaccgaggttgcctttttggaatgggatgagtttctgtgttatgtcctgccctagggttgagtccgctcagttactggaaccccaatcctctcctgagtcccgcatcccagcgagctgtgccctgactcagactcacccctcccacatcaatctcttgcagccgatgactgcagctcccactgtgacctggcccacggctgctgtgcacctgacggctcctgcaggtacctgtcctgagcacgtgcccccaaaccctttggtacccatttctaagcccttcacgtgcacaacagtgtctaggggcttcagactctactcttcatgcctcatcactcctatggctgactggccagtccccctttcccctttacctcacctctcttgcttcttctagtttttatctccccacttctttaatctcccaagtctgatccagggattgtctgaactcctgacagggagagagacctaaagcttgagagagcttggggattgggtgccatgaggaaatggaaagataaaggaaaaagggaaagagaaatggtttagcctggaaaagaaatgctgcagggagagttgctggggagaaacacttacaatgaaagaggatctttcttgatgagtttgagtagttgactcactgggagattgggcaaattctgtagcaggaggaaagtggacataaggaaatgagttgatgaggcaggtagttcaattggctgggggtctttgagactcttcacccctggagggcttttaaaatatgggtcaagtgtttgccctggaatcatggtgggaggatagtcctgatgaccttttttgtttttatttttattttttgtttttgagacagagtctcgctttgttgccaaggctggagtgcagtggcgcgatctcagctcactgcagcctctgcctcttgtgttcaagttcccctgcctcagcctcctcaataatggattacagatgcacaccaccatgcccgggtaattttttgtattttttgtagagacggggtttcacccagttggccaggctggtcttgaactcctgacctcaagtgatccacctgcctcgacctcccaaagtgctgggattacaggcgtgagcaaccacgccccggccctgatggcctttcaaggtcattcttctttaaatgtttgtgagcacctcagacatgccaggaggggtactggaggcatttacagacatcttatttcttcctctactcaaccctgcaaggtgtatccccaatttacaggtgagaaaactgaggctcaggttaaagtacagaaccagggtttgagtgctggtgtctgatggtctgattccgtatatgtgtcctatgaccctgcacagtcctacacctacctgggacaggtctgctttcccttaggggctgtcatatgtcctcttggtttctagaagctctggttctgtctcctccatttcttcacatccatgacccagagccctgaccctgtgcttctccccgtcaggtgtgacccgggctgggaggggctgcactgtgagcgctgtgtgaggatgcctggctgccagcacggtacctgccaccagccatggcagtgcatctgccacagtggctgggcaggcaagttctgtgacaaaggtaggggggaggaagggtagcttttggttgggaaccccatgttcttaggggaacagccatcagtatttattgagtgcctattttgtccttgtcaaaccctcaaatacatggtattttatcatttttttaaatcttagactttttatatgttgtctgaattgatcctcaacataaccccatggggcaggaaacacagctgctaaaaattgtactcattttacagatgaggaaactaaggcccacagaagagctataacctgctcaaagtcaggtttttttgtttgtttgttttgttttgagatggagtctcactctgtcacccaggctggagtgcagtggtgcgatctcggctcactgtaacctccgcctcctgggttcaagtgattctcgtgcctcagcctccccagtagctggaattacaggcacccgccacttcagctaatttttgtatttttagtagagatagggtttcaccatgttggccaggctggtctcgaactcctgacctcaagtgatccacccgccttggcctcccaaagtgctggaattataggcatgagccactgtaccggcctaatgtttgtatttttagtagagatggggttttgccatgttggccaggctggtcttgaactcctgacctcaagtcatctgcccaccttggtcttccaaagtgctgggattacaggcatgagccacagtacccagcccaaggtcagtttgagacagactgagagccagggccaggagcctcctgactccaaattcagtgttgttgtctctccctagcataccacgccagcctgggctgggtttgtagtatagccacacctacagaacctggggcctggaaggcgtggacaagtctggtctggggaccagatgggaggggttatcccagagcctttcctgtcccctctccagatgaacatatctgtaccacgcagtccccctgccagaatggaggccagtgcatgtatgacgggggcggtgagtaccattgtgtgtgcttaccaggcttccatgggcgtgactgcgagcgcaaggctggaccctgtgaacaggcagggtgagtgctgggccctcagggtgagtggaaggttagaccagaacctggtgatgggatgagaaaagaggcaggactgttgggagggtgggggactgagagtcagacccacacggggacactcagataaaacccctgcatgccaaagtgttcctagttcagggtttctcaacttttttttttgtaccttctgagccatttcttcaacaatctataggagctagaggggtaacaaacgtgtgactgttctggttggggagggtgggtgtggggagactgaagggcctgggtctctcctcatcctctcctgaacgctggcttgcacccttctgtgtcacagtagggatgaggaaacagcctgcagggctggacttgtcctcatttccgcatcaggcccaggagcctgtgaggataataatagcacacttaccctgagccctgccttctggctgggccctgtgctaatggcttgacattgattatttcactcaaccctcacaattagggaagctgggtactatttttattctcatttttaaaatgaggtatttgaggctcggagtgtgtagcccaagatgacatggcgggcagtggtcaggatactgacctgggctgccctacaggtgttggtaagttggttatcatgtcctctctcacccctaccacagctccccatgccgcaatggcgggcagtgccaggacgaccagggctttgctctcaacttcacgtgccgctgcttggtgggctttgtgggtgcccgctgtgaggtaaatgtggatgactgcctgatgcggccttgtgctaacggtgccacctgccttgacggcataaaccgcttctcctgcctctgtcctgagggctttgctggacgcttctgcaccatcaacctggatgactgtgccagccgcccatgccagagaggggcccgctgtcgggaccgtgtccatgacttcgactgcctctgccccagtggctatggtggcaagacttgtgagcttgtcttacctgtcccagaccccccaaccacagtggacacccctctagggcccacctcagctgtagtggtacctgccacggggccagccccccacagcgcaggggctggtctgctgcggatctcagtgaaggaggtggtgcggaggcaagaggctgggctaggtgagcctagcttggtggccctggtggtgtttggggccctcactgctgccctggttctggctactgtgttgctgaccctgagggcctggcgccggggtgtctgcccccctggaccctgttgctaccctgccccacactatgctccagcgtgccaggaccaggagtgtcaggttagcatgctgccagcagggctccccctgccacgtgacttgccccctgagcctggaaagaccacagcactgtgatggaggtgggggctttctggcccccttcctcacctcttccacccctcagactggagtggtccgttctcaccacccttcagcttgggtacacacacagaggagacctcagcctcacaccagaaatattatttttttaatacacagaatgtaagatggaattttatcaaataaaactatgaaaatgcaagtgggctcctatgccagaaaaacccacctggcgttccagatgcaagagggccagagcagaggcctggttctggggaagcctcaggatgctgcccaccaaggagtgatttccaaagagtaatccagggtgcccttttcccttctggggaagtgtggagaggtagagccccagaggagaatgtaaacaagcagccagcacctctgtataggcccggcctggatcagagagaggggagaactctgcagggtgtgggattgggctcagggacctccgagtgaggcagggactccctgctggctgctctgcagcagctgctggaacagggagtggggctggttgcgcagggtggccggggagtccagctctaccactctccccgcttgtagcaccagcacccggtctgagttcaggatcgtgttgagcctgtgagggggaagatggtcagtgtaggggatgagggacaatgccctaagtaagaacactgacctgctttccctcctctcccctcgggacaccacaggtctgtccccacaggctttagcccctggcttggtgctggggaagggactgcagagtccctcagataatgtgctataaagggccctaggcagtgctataaaggacccttctcgtccctggagaaggaggagctgagatctgggggggcaggatctctaaggccctgaccactggggtccctgaaagcaacggaggctctcggtgcatgctaccacagtccctgattaggctgttaccaggcgtttacatacctatgggcaatggtcagcactgtcttgttggcaaagcgtttgcagatggtctgctggagcagctggtctgtcttctggtccacacttgctgtggcctcatcgatacacaggatctggaatatgggaatggggtaggggataagaaggaaggagaggctgcagggtgggttgggcctggcccaagcaacagcccctaccacagctccccacttccagctctaaaaggaaaatgaacttggtcccctaaaacctctccccactctacctccccacctcccggcccccagccttcttcctggccctctctaatgtctctttctctcaccttaccttggcatctgtgaggagagccctggccaaacacaacagctgcctctgcccaagagataagctccggcccccctcacccagctcaccatccagaccacctgcaaggaaagcatcttcgttgcagggcccaggccatccctgctcccttcttgctctaaggtcagggtccagcactcacccatggatgtaatcacctcactcaggtggcactgcttcagggcctgccacaaggccctgtccttatgtaggccctgggggtccaggttttcccgaacagtcccactgaacaaaaagggctcctgggggatgatagccaactgggatctgggggacaatgacatggagtctagtggttggagatgtagccacttctgctcccagctcagtttctgactacagggctagcacctccatgaaagcctgggtatgagacctgaacataaccccactctgctccccaccccatccccaccaaatgatctgttagtagctgggtacctagaactgtgccagtgctatgagcaataccaaagaaaccaaaggctggactctgtcctcaaggtgcctacatttcacggaggtgcacacacacaaaccagacaaaacaaatgggctaaactgtgtggcactgactccaggggtggcagtggctacgcagggaatgaccagagcgactgaaagggcaggtgacacttcaaggttggagtgggcctagaattgggtcctgaagacatgatggagctataaggtagggccaccacagcttagaagagaaggcagaagaggcaggcctagggctttaggatacagcttccctaccttttccatgtcaccgtactcagagaaaatgatactaggttgacctggaggtaaggaagggttgtataccctccagtgaggccacctgaagccaagggcaaccggttcaggtctcaagctgtctgaagcactgcctgctgagcctaggactcaggggatcagtatcttggggcacaagagtggagggtgtatggtaggaagtacaagaaagatgaagctggaaaggtggcctgggtcagggcgaggaagaccttgagatcaccagccatgaatctggacctgggcactaggagttcgctgtccttgcctgctcatcctgtcctccatttcagccccctgatcagccctggctgctgtgagtttatataaagccttcctggctatgccctcctctaagtgccagtagttctggttcccccttcccctcccaagtccatctcccccagacctgagctgggccagctccagctggctggtgtccacgccgtccagcagcactcgccctgaactgggctctagcagccggaagagcaccaacaacagggaagacttgccggagcctgtgcggcccacgatgcccaacttctctccaggctgcacgcagaaggtcactccatccagggcattcggcagccctggccggtacgccaacaccacgtcctggaactccacgcccccctgggtcagccagccggtgcccagctggtggggtccatgggtgggagacagacggggaaagggagataggggagatgaggagcgatggtgaggaggggagaataatgagaaatggacagtgtgagaggaatgagagaatgagagatggggaagaagggacatggtgaagaattgtggtcatcatgaagagaggttatgggagctgagaaagatgggtgggcaaaaagaaaggaattgtgagggagactggggccttcagggttccagagctttggcctggggtgggggtacaggcccacctgcagtggctggccctggggttcctggggcaggtcacaggtgtactcttccagccgctcgacgctcaccagcatggcctctgtctgtgtgaagctgctcaccaggcccgagagcaggcccgtcagggacagggcataagacagcgacaagcccaccagccctgggggagagaagtaccagctgctgggagagcttggacaccgggacgtttgtgggagactccccaggctgtggactgctggcatttaaaggaagcaacagaggctgggcgcggtggctcacgcctgtaattccagcactttgggaggccaaggcaggtggatcacgaggtcaggagtttgagaccagcctggccaacatggtgaaaccctgtctctactaaaaatacaaaaattagctgggcgtggtggcaggcgcctgtaatcccagctacttgggaggctgagacaggagaattgcttgaacccaggaggcagaggttgcagtgagccgagatcgtgccactgcactccagcctgggcaacagagcgagactccatctcaaaaaaaaaaacaaaacaaaaaagcaacagagaagcaggagggtgataggacctagccaggagcacaggaggccagatgcagggcagggggtgggcctggagaagctgggagggacggcatgtgggagactgaagcgggctggggcagtgtggtggggacggggtggaagcagggaagggactgagaccagcagctcagaagactcattctagtccccaagccaccaccacctgggcaagtccctcctggggattgtctcctcaactccaaacgggggtgatgatgataatcatgatacatcctcacagggaaccctgggtgggaggtgaaaatgttggggggatggtgcagggagagatctgggagaggggtggactaacttgtgggtgaggtaggggtgaggggtcctgggtggcacctgggttagcgaggccctgctggtgctgcaccagagcgatgcctgcgatagcgctgaccactgccgcccccatgagctgtagccgaatgtccagccactgcattgtggcactggtggcaaactggcacctctggtttagctcaaggagtcgcaggttctcctcctcaaacctagggaaggccagagggatgtgaagccactccactgttgccctgagccacccagcctcagggcctcaacagggaaggcccttattgagcagctccttcttgggagctggtctgtatacccacaggcctccctcagggctgcagatgccagtgtgctctttcaaagtgggggtccactctgcctccctatctccttcttctgttgctttcctccttccccatcccttgtccccaggagggctgaaccaaccataccctgcatattcctcttcttgggggtctctcttttcctctccccccaacacctcatccccctgggctctggttcacacacctgtaggtggcccctgtggcccggagcacagagaggccagccaaggtatcggccagatggctatacagtggagacagggtgaggctgcccaggcgccgcagctcccgtgaggaggccctgtagtggcgctgcacgtgatagtacatgatgctcaaaggcggcagcaggagcagcagccagggcaggccagagcccagcacggccaggagccccagcaggcctgccgcgttggccaggaggatgttgaggatgaagggcaggctgtcatccgcacaggccacatcagaggagaagcggtttaggatccggcccgtgggtgtggcattgaagaaagtcactggtgcctgggagaaggacgctgattgggccagggcagagtctggcagaagaggggttggcaggcagcactgggggaggtggggtggaggggaaggcccaagatagagaatagggaaggactaaaatatccccagaatttgggggcagagaagagagattggcagaggttgaggaagaatatcccagggcaggaaagactctcccatccccagtggagcccgagtattgggaggacactccacaggggctaggactgcactcccctacccccgaggtcccagcccctcaccataaggactcgatgcagcaggcggcgatgcagagtggcagctgcttgaagggtgcctgctgcaaagagcactgcccggagaagggtgcagagggaatttacaccagcaatggtcgcatacacggtgaggtagaaacggatgtctgaggagccattgggggcagctttgggcagtgggaacactgggatgctgggtggtgaggagggggctgtcggtaaccaaaactagggccactcgggggtcctttctcctcccccatgccatctctcccaccctccagaagtcacagcatctggaataccggccacaaccctcactccctgcctggcgaccactctgagagcaccaggcctacccccagccccagccactcactagaggtttccaggggaaaagaggagcagctgcggagagaagagccccatagaagctgggctggtggagggttgcgcctcctgggagctattctcagccttcagctgagagatccagtgggagagccaccagtcagcagcgttccgcgtggctgggtggggacaggaaggaaaaagctgtaagaggctcctctcccttgttcattctattccaatgccccctttctccgcccttgcctctggttcctgcccatctccatccgcctggcctggcctccccaccctgccactaccccatatcctccctagtgtgggcttctctcataggcccgtcacccttcagctctggggagaacaggatctcagacttgcagaatgggagctaacctagggggcagaacagaagccagctatagagcacatgcctctggcccctgggcatctctcagaattaggagtatggcttttgtcccagctgtgacccatgcttggtgagtctctgggctttgtaatgattagtgcaaggtaatgggcacctagacagcacagccgttacgatgtaagagactcccaggcacgctctcaccttgcatgagaagcagagagaagaggatggctaaggccaagccctggcccacggccttccagtaagcttggtacacgtgcaaggccacggcgccctccttcttgctttcttcctgcagcaggcgaccagatgtgctctgctcctcctccagcccctcctttgttttctctgggttctgtactgactgggctgtggctgtgagaatcaggggtcatggaagaattaagcttgcagggtgccagctgaaaactcagtatttcagaggagcgggcagccgttgtagaaaaagctctacagtgtggcagggaaaagcaagcccttttctcccactggggagccatacctgagtcagactcttgtccattctcagcccaggctttggggacagcttgtaccagtggcagaatctcagagggaggtcctggagggtagaaggggagattgggagaggactgttctgagtctatactatgcctttctcagtgcgtgtgcagatcccacctctcatcctctcaggcctccccgtctaacccaccctagcaggatacccctagacctcgagcaggactcttaggcctccctctctaacccaccctgctctggatacccctagacctcgagcaggactcaagtccatccttgtaaaccttgattccgaccagcagagagggacgaatgtccatccccaagaggaccgccagagctatgcctgccactctgtccagggttacttctcattactgcagagctttttctcatgcttcgctcaattcctaatatctggctggagcttcatttcctcctatttctctcccagtaaacttgcaggtggtcacatccctctgcataaaaatctttcagagtttaaaaatttttgtttttacaaaaagaccattctaaacctgactcctttctcttctctgaagatatgagaatgttctcagagaccctgggcctttaagttcccaagagcacccagtcacaaagcccatgagtcccaaatacactggcattttaccaacgtactccttttccctcctgttctcccagttcctcacaccagttctgtgaaggcgggaggcagcaatgactggctcagggcacacatgcagcagggggcagagtctgtacttcacaatcccctgccagacctgggcagacacctccctcacacggggctcctgcccccattaccagcccggatgaggcgcccggcctccatcagcagcaccgcgtcagccctctccaggtactcagtgcggtgggtgcagagca

SEQ ID NO: 12639 - DNA, 5109 bp, Homo sapiens
ccctccctcccagctcctgcaccaggaaacggcccggatcccggcagcggcctgacccgtgagatccctaacctggcaggcgggcggggttggagactggctgaggtgggggtaagggaggagctgggcctttgggctgcactagggggaaccgggaatagagatggtgtcggcaggaagcccttggccttgggtttcccgggaggacagtcattaaacatggattcggccacacagctggtagagcgttgggggcaggggcctaggcccagagctgcaaccctagcccttcccaggccagaacctgatccctggccttcccctcctggttctgatctccccctcccctttccagggctccacgctggccaggaggatgaaaggccccagctgggggctccttgccaccagtgctgtgtcttaagagctgccatcccggctgggtgagtgtctccttcctttctctgtctggagtaacccattgcgtctcccacctttctcttcagcccatctgctccccctcatcttgtgtctctgccaacatctttacatcttgcatttggggaggtcctaagacccttcctctagccaagaaggtgtggactaaggagacccgggggtgggggtgttgtaggggtgtcattgagctgacgttgtcttattgtgaaaagaatctaaagtatcctaaacagaaaatttacttgttttacatttaatttggcatattaggaatgtaatggccagccactcacagcctagtctcatatcatgacttaattcccttgttcttgcctctccctgtccagtgagtcctgagcatttcctctctcctcctcatctcactgggttggtcaaaccagaagtgctccttctgattctctcttcatatattcatgccagtctttcatccttgcctcttatagccgcccggatggcgaccccagcctcggccccagacacacgggctctggtggcagactttgtaggttataagctgaggcagaagggttatgtctgtggagctggccccggggagggcccagcagctgacccgctgcaccaagccatgcgggcagctggagatgagttcgagacccgcttccggcgcaccttctctgatctggcggctcagctgcatgtgaccccaggctcagcccaacaacgcttcacccaggtctccgatgaactttttcaagggggccccaactggggccgccttgtagccttctttgtctttggggctgcactgtgtgctgagagtgtcaacaaggagatggaaccactggtgggacaagtgcaggagtggatggtggcctacctggagacgcagctggctgactggatccacagcagtgggggctgggtaagaagcttctcaattgccgctctgcacatccttctgcaaagctggtctccagggggaagatgggggctctgattggaggctgaggcagctatgttgggaatgaggtacggggctgagtctccccgtctggatggaattagattgagagatgcctggactctgcactccagggctgccatgcagtcaacactggatgggctcatggtcccaagcagaggacagaatacacacccaaggagtgcctgcaggggaatgttgtcagggactttttacatctgagtcatggcgtgggaggtggggaggaccagggatgggtggtggtcaggcaagccttggcaaaggatgctagttctgagcagaatttttcgccaaggaaaggatggaattcactggaggcagagtgggcagatgaaccagtctctcagggtgggggtgcacctggggggatcagaggggcttgcagggagaagagctttggccagagaggagctgggtatggggtagtgctcgcagtggatggaactggaactcttcctctcctcttctctccactctttcctctcctgatatccctttctccttctttctctcctgcttcccttctctcccacaggcggagttcacagctctatacggggacggggccctggaggaggcgcggcgtctgcgggaggggaactgggcatcagtgaggacagtgctgacgggggccgtggcactgggggccctggtaactgtaggggccttttttgctagcaagtgaaagtccagggccaggtggggctaggtgtggctgggggccaggagagcaggaacagaacagagaaatgcccttggaagaagtggagttggtggatgggtgggcatggaacaggatgggcagagaaagggtagtgtgtgagggagctgagtaggccaggtaggcgattggaagagtgagcaggacacagaggggaggggaatgttttggcaagtttaggggcacaggagatgtagtcgttccagggctgggggaggtgggagggatcacgcctataggtgtgggcacatgaaacgacctggaacttgcttcacagccctgaggaaggtggacttacataagcagctgtattccattagatgagtgggatttagggaacgcagaaggcacatccctttggaatggaagcttaggggttctcaggtgatagggagaggtggctgttaacagtgggctgcttggacacgcgtgtgcatgtgcacgcatgctggtgtgcatgctgggctgcctggcaaatctggtggtgatgggattcctcaaggagaaaacattccctcttgcaatggcaagaactaggggcagttctctgtccctcctcccaacccctcctttcccctgcccttgtcctgatgcctcaaggcttagagagaaacattgtatccagaccgagggctctgctgcttctttccagaaagtgattggcaaggctttggagagaagagcagttctgcagctggccttgttccttcatcatcccccttccttgtgcattatgcacttgctgctgcctcctgggctctgatagaagggcagggctgttgagcctggatgggtggaggcttaggtagccggacctgcctgccaccctcctctcccactcaggcacaatggtgcctaaagtgtttccaatctctgggacctctgtacccaaactgaaactctaaattggggccctaactaattttccttttgaggttgtgggcataagtgctgatctagaatacagtctgggtcccacactgtgtctcagtgagactgttgatgccttgagatgaccatttcagatctgaatcccatgggtgtgagggtgatgggtactccaggactggcctatgctgtgttgtgggctttggttcggctttatcaggggccaggcatatgggttctagagtacctaccatgacctagaagcatttatgatttatttgaagccacactgtttgcatgggtgttacttgtctgtacctcagagtctgaggatgttaactttggaactcgcagtcctctagaacagcttcagattatggctttttcttttgaggaagaaattattcactccagatgcatgccctgagccagacctcactgctgcactttccaaggtgctaagattgctgctctccaatgctaactttctgacacagtgctctagaaccctgcctgtggtcctgagcactgatcaccttagctagaccatggttgactcttcttggagattttcacttggtcctagaatgtggcaacgtagttgtgctcgccagaacgtgggaccaaattggcctcaggtgttgagtccagacttctgcttttgagagagggctgcactttttcatggtatttctaggggaggtggtaggctgcatgtgccacttggtcttgttgtgagtatgctgacaccagaaactcagagccagcttgtggcaagcagttggggtggggggtctctgacttgctcaggacaaactaggccagtggttttcaaactgcttggcagagccctgaagtttcctaggggttgcctcaggagtccttggggagatgaagggggtggggagctgagcaggctgggcaatttgccctcaaacagaacagctccccttgtagctgtcttacatattggggttcagggtaagattttatttgcattaaggggtttgctgctgaaaaaaagttggaaaaccactgactagaccatcggctccaaattggagtctgtgcttccttccccaggtatggagcacactcttcaccctaccctctaccacaggacacatatccctgttagcattccccgggacctttagccaagaggagctgcagggaccatggccaggttaccaaaatgccctgctctgaagccttgacacctgggtggaaagagaggctgttttctgaaagggtaaagggcttggtctggattcccagaagcatagcttagatgggaccacagtgggcaattttgacctgtcctgcccttcttagcttgaagggaaaccccagagactcttctgtcagggaaaactagggactctcttctagagccatatagttccttgggattagctcttggccaagaaggctgagtatggttcccaatttttaaatccatttcattttttaaaaaataagggaaataaatgtaattgccatttttcaaagattaagtaggaggagaggggtttcttgctctccagagcccaaagggacaaatagggactttgtttaggccaaggaaggagcggaagtagggcaactcggtcctgcgattattaatcccactccccacttattctagggcacacaaacactattttacttttttaaaatcataaaacggcagaacagatttggttagtttagaagaaaagaaagctctataaatataaatctatattcctgtatttttatttaataatttataaataccaagttcatttgacttttatttttgtgtaatatgtaatgatcgtattaaaaacaataaataaagcccagaagtttaatgagaaggactgaacagggtttgtgacttctacactgtatagcctggggtcaggacatttccttgatccaatcatctcttcatgaccttgttaaaggcaagaattagaataacagggatttgagaaagtgttgggatcattaagaaaaaaagagtctttcccccatcctcaccccactcctataccagccaaatggtcaa

SEQ ID NO: 12640 - DNA, 247 bp, Homo sapiens
gtgttgcccaggctggagtgcagtggcgcgatctcggttcactgcaacctccacctcccgggttcactccattctcttgcctcagcctcccgagtagctgggactacaggcgcccgccaccacgcccggctaattttttgtatttttagtagagacggggtttcaccgtgttagccaggatggttaccatctcctgacctcgtgatccgcccgcctcggcctcccaatgtgctgggattacaggcgt

SEQ ID NO: 12641 - DNA, 3619 bp, Homo sapiens
attgtccctcttcctccactaccttcccatgcccagcaagttctaatggagtaggagccatggcagctgccaggagatggaaaagcaatgaaagtgggcgggccctctgcaagggagccagccagctgcaggtgcaggggagttcagaggacatgtgagcaggaggcagcccgcctcccacgcctcgatggcccagacatgttctccaaggttgggactcagacacccaccacagcaatgccctacggcccagaccccatcctctcaaacgtcctcctagccggatacattgtcctccaaactctcagctgtcccaggtgatcatgagtgaagcccagttgtgctcacttctaactgcagcatccattctaaggaaaatctccactcccctcctctaaacctcatggggccaacatcgcacagtctgaacaacaagtgagccatcttgaaaaggagggcggctgtgcgtgtgaatgagcagggagaaaatgaaacaggagccccaccttacccccagtcacctcactgaatagcaccaagccaagtggggtgacatcacttcccagcaatcgggactcatagatggtcacggtgggcctagttatctgttttagtgaatggtgctgtgcaggtggcctcagtgcagaacagactgtgtcagacaaacatattgatgcactgatgaaggagaaggaagctgggaaaagctccggtcattatgacccgcgacaccaagggcaggctctggaggagccatccgtgcacagctgcatctattatctgctaactgaacaaacacagaaggtatccaccagaacaagtctactcagatacaggtggccctgcgaggaggttggttggtgttgggcttagacttgacaggttgtccggtggtgattcagcatgaaggtgtggctggctctgagattattatctcagattatcccctcacaaatgaaaatataaaaggaatcccagaaatctgtttatttcatatttgaaatgttatgtagactatagatgaattttttttcttgaattatctggtgattaaaattgttattcttgttttgcttattatgtttttaagggatgataacgtttcaccctagtgtttcagggctgatagagacttagaagtcatctaactgccctcatcttacagacttaaaaagtggcatccaaattgatgaagggactccctgagtcacgcagcaaggtggcaatgaagtccctcagctcttgcccctaccccatgcttgtgtcttcctgggcagcggtccccatcctttctggcaccagggaccagtttcatggaagacagcttttccatggtttgggggtggagaggatgtaattcaagtgcattatattttttgtgcactttatttttattactacagtgtaatatatgatgaaataagtttacaactcaccataatgtagaatcagtgggagcttgtttttctgcaactagatggtcccatctgggtgtgatgggagacagtgacagatcatcaggcattagattctcataaggagcacacaacctacatccctcacatacacagttctcagttctcagtagggttcaagctcccatgagaatctgatgtggctgctgatctgacaggaggcagagctcaggtggtcatgcgagcaatagggagcagctgtaaatacagaagaagcttcgctcgcttgcctgccgccccctcctgctgtgtggcccagttcctaacaggccacaaaccacaacctatcaagaaaaactggcttcctaagaaacataaaattgtttctcttccctttcgctagtgcaattggtctaaatcgttttagaagtattgatagaagaaacaaacaggacaatcattagtttccaaaactttaaggagcgacatgtttgttggataattggatacctgaataaaaataaaaaatagcaaaagtttcttgttattatcactattacacagcagttcctatcattcatggagtacctagcaggtgccagattcagtactaacctctttacatatatatatattttttcatttcatccttaatgcagccatgtgagattagcatttttctgactttacagctgatgatgttaatgtataaggttgaacatctgtccaaagtcagttgaccaacaagacctgccatgggcaatgcaagctcctcctggtccacacacactgtgtcctgctctcacgctctctcccagcaccttctcacccagggtctgactgtaccaaggagctccctcacggcccttggtcctcctggcctctctcatctgtctcatgatctgggcaccctcctcagctcactttctcatcccagtccccacctgaacatggcgctggctgtcttctgctccccgcatctctagcctgcacctcctctcttctgtcctccgcttcgcacctatccaacatgcattttaattgcattattgagtgcttgaaagaactcgtatcactccctgtttcctgggtcaaaatccagagtcccatcattcatccacgaagttgattggaccccgccggactctccactctgacctccacctcctggcccagccccgctctatgctccagcctttggggtttgcttttgttttagttttctgagcccctggtgttcttacatatgttcatgtctttcgcagattgttttaattgggatgtattgaaatgctttgtttccctcccagacatcctttacatatctgtgaaagctcatcagcagcctcacctcttcctgaaagccttgctagcacccgtgcatgcctgccctctgtgtacaggacatagagccctctgcacgttttcattatgggatttatcacacttcatcctttcattccgcaaatgcctattgagtgtctatgacatgccaggtgtttggtgcatggtgtacacaggagtgagaggttctaaaatggtatttgtgacttgtctaaatcccttgttagagcataaagccttggtgtgaagatctgtgccactcatctctgaactccagcatagcccatgacccaaaatagaggagttgcccaaatagtacacactggtcagggtcatgactgaatgatcattcactaccccagatccaaagccaagctagtcaaggtgtgcaggagcccccctgcagaataatgggccagtgagagaggccacacctctcaccctgcagaataatgggccagtgagagaggccacacatctcaccctgcagaataatgggccaatgagagaggccacacatctcgttctgcataaatggagtatttgcctgcggtagtttgcctctatgtctcccctaacccacctatttttttgtagtatatatattatttctacaacaaaagtgaatttgtaatgtagctttgaaaatcattctttctcaatgagaacacttggaaacaggatggggaaaatcacacactggggcctgtcgtggggtcggggaagcggggagggatagcattaggagatatatctaatgtaatataccaacatggcacacatatacatatgtaacaaacctgcatgttgtgcacatgtaccctggaacttaaagtataataataataaaaaaaagaaaa

SEQ ID NO: 12642 - DNA, 1455 bp, Homo sapiens
ccactcagagaatgtccagagctaagtctgagcaaagggccagcttttgcttttggggctggggtacaggcagattcctgttggagagcatttattttacttttcaagtgtgggctttctggaaggtaatgggaaactgcaaggtgtcttgcaagcaggtgtttggcttatggtgatgtggttcccagggtggcttttgggcaggggcagggcggggtcctccaggagctgtctgtcggtgctgagctcagtctgcttccctaccactcagcccactgcttggatggttccctctgtcactctcatcttacactgtccaggttttagcactgaaagtcatatgtgtgggaagcctctcagtcccaggccaaccagaacagttggtcgccccgtgtctaacatacctgtctaactgtctccagggcatggctcatcagcgtggctgtggcaccctctccctgccttctcttgtctccttcactgtcaagtctgggaaagggctcctggtgggtgtccgatgaggcacagctgggtgacaaagatggctccagctctggttggggcgtgcacctcatggtgacacctccctctgtgggacctccgagggtcaaggaaggaggcaccttccatcctaggtttaggattcattgcacttacacaggattccccgtggcagatcacctgtgttccagaggctgtgtagttcagggtgtgtgtgaggcagttgcatggtaggggggcacctataactgggggtaagtctgtaatggtgcaatagatgatgttagaacagtgggggtccccctccctctcaggcctcaaaagcacaaccaccagagctggtgggtggcactgggccatggggagacctgaccagcaaggctccctctttcctctgtccaggccacccagcctgagatacagtgctggtcactctagggaatgctgtggcccccaggggacaccccttgggtggctcctccctggcttctcactgctggctggcaggcaggctggtgggcgggcaagcgtaatattacccctaagataaatgaagaagagtttcagcccttattggattatagtttttattgaactttataaattccaattagcagacccctgggcaataagcgacacacagcccgtggctcgctttatagcgtgattatgaccctgtttatcctcccctgaacgagaagtattaatggaggaaacaaaggaaagggactcaaaaatacataaaaacagatattggtgacacagagataaacagacaggagtcagggagagaaaacaatctccgggcaggcaagggggaacagagaatcagagattctaagaacccatgtgctcagagccaccgtgagcttggatgtccttctggcctccctcccagggcacaaagccccctaggctcctgaaggctgctggggcctgaagagcaccctccca

SEQ ID NO: 12643 - DNA, 705 bp, Homo sapiens
ctgagcagctccagggatggcccagtgtggttccttacagttttaggtgtcttctttgccctttaagaatctgatggacattaacatgcattgattctagaaaaatgtctccatacatgcacatgcattatgtacacatgcacgcacaagtaattttgcctataggtacagggggttgtccaagctctgaaaactgatcatgcattctgccccctcctccaggggactgaaagcataagattaagaatccttgagtttgaattgaaccaagtaagatctgtctcccaggagcttccacctggaggtcctgagagcccacagacagatgggcagcctccaagggcctggccacagctgggaatgccctccaaccccacctgcttttcatttcttcctggatactctggtttgcgttcatcagctttaaatttctaacagccatgacccagaacagcagctgggaagaagctgtccctagagaggtgtgggggtgagctggggggtcctgagccagccaggtgggtggtggtactgctcttctggactgaaacccttgcccgacttgctgcatctcccaggagaaagaagtgtgctcaaggatggcgtgccctcctcactttgtctggctttgtttgcgccttcctcccccttctgcaggtcatctttcttggaggcttcagtggaagattaaaaaagaaaaaaaaa

SEQ ID NO: 12644 - DNA, 31127 bp, Homo sapiens
caatcagtttatcatcagtaggactcaagctctaatgttgcacattgattcttttattgaggtaagacttgttcttgtctccctcccaaccccccagctttttttttttgagaaggttaggtgatgctaactgcatgtagttttgctttaaaacaagaatcatttataattctaaactcaatatttaattaaattatttctgatagtattaaaactggatatgggatagactaacttttgttagctgagaaggcacttttactaatttttctacttgtatcattctacaaacactgattttggtggcggggtatgtttagtatcttgactactttaaaaatttttccttcaatatactgttcaaattgcatatggaaaccaagtccctcagctcatgcagtttttgaaatgtgaaaaattggtgaggttagattaagttcatttggtagaatctgaaggcacagactacaaggacagtattttccattggtttccattgtaaaattagaggcatcaggaaaaatagactctttaggcattttgaactttctgataaaagtggaaagaaaagagcataattttctggccaggaaccataagcaccacaatttcttctcaaaatctctgctacttgataacaattaaaaggattgttaaagttccttaagcaccttcacttttattttcatgaaatggaattttaaaagtcccttagaagtcagactgctgatactactgttgggaaattataaggaagagtagggggggttacgttactttttttctcgtcacttaaattgaccagcttctttctgagcatcttttaccaataaactaagagtagtagccataaagatcctttagccatttacaagttaaaaccaaaatgtgtcttaaatagttttactgactactacctactatggaacagatactgtgtttgatactagggatacttaaattttatgcctgcaaggtgttttctttcagtctagtctagaggtagtataatgtagtggataatactagaggtctggagtagactattggtgttcaaatccagcgtctcagtttagtagcttttaaccttagatgctttatttaactgatgttttctttatatcatctgtaaaatgagtcaataattgacctaccttgttggattgttataaacctagttgatataagtaaattggaacaatggctgccacagagtaagcaggcacttcatgttagctattaaagtattaatagtagtatttctgttgcaattatcctggtgttttcttttagtattactctttcacagtttaataaaggggacaatgatagacataccagcaccttataaggaaatataatctaaaataaatgaaattgaattatctctgaaaataaaaatttcataggacggtactcagcaagtgaggcagaaacattttctaacattttaaaatattttgctttactattaaatatgttaatatttgtttactacttgatagtcctacaggatttagccaattctctaccctacaaaaacagtaaacctctggaggaagtgcctctaacatatagtaggccctcaatagcaatttgccaagtgaataagtaaactgattttcttcacttgccattgttttcatggtatcatgtctgctaagtctaacatattgatgaaaagtttattggttaccagtacatggctataatgtataaccttggcaaagctgggtattcattgacagtagtaacaaaagtgacaaatgcaagatgatggcattgggtatccccacccccaacccagttgctgttctctagagtaaattaatgaaatcttttaataaaatttaatggaggatgtactgttaatggcaatgcctgctgggaaaatagtgctcttttgtatgtaaaatacaattaaaacaggaactacgtagttttgagagtgtcaaatgtggaagcaggacttggggaaatcaacattttaaaaatgctgcaatagtacttcacacagtgtcccatttgatcgttgaatttctcctctttcttataatgagattttaggttcattttgtagaggatttctgtgatttcctggaaaaagacagtgggacacattggatgttacttaactttttaaatgcttgttttactgcttttaatacatgtatgtgtaaataaagtaagactttatgtgtgacatgaggaaggcttcattgtgttttcctctcacatccccactctgagagatgtctttttcttctagtggaagcttgttggtgtagggaaatgagtgtgtgaactctgattccatgaaagccagattcagatcttctgctggttatcaagttacttaacttctattaatttatttccttatttgtaaaattgaataataacgtcttagagttttgaagataaaatagtctgttgtccattcagacattgctttttacttgcagacgtagggaacagcataatatttattactaattttatggaacaacatcagtttagggttaagttagaaaatcagtgtatactaatatttgtcgattattgaatctgtatcacctttttataaatcttgaatctattaccacctctcaccttaaaaatcagggttggtagggaatagtcttttgtctctgcttctgggtgagcaaacaaatgctcctatgtcctaatgacatggtttcttaaaaactaaaaatttcctcaaagtacagctgattgtactctatcagaaaagaatagctcttcatcttttatcaaaatcataatctttgtcagttattccacatttaattcttgtaatctaatattgtaggccaattcagtcagtttttggtacctttgtagggtttctttaaatgtcaccaacttgcagattacttattacttgtgtgtaagcctttctaaaactagaaaaaattatttcttgtgcaacagaatctctttgcattagctggtgatgaagaaccagaggtacggaaaaatgtgtgccgagcacttgtgatgttgctcgaagttcgaatggatcgcctgcttcctcacatgcataatatagttgaggtaacactggcaatttaaaggctctttcatcatctttcccctaagagaaatactagatagaaaatacaacataccggatgggaaggggactataaaatagttataattgtcttaaaattataagttatctttgtggggagttttgtatttctgggtatagttgtacatactgtataactttggaagtgttttaagtagtatgttatctagagcctccttttcacttccaaagttccatatggtggagagaagagaggatcttttttaaaggttgcagtctaagatctgttaaaaggctagcattcgtggtatgcagcaactcctgttctaaaactttacacatggctgcatgaggtaggcctgttttttctttgaaaagtcaggcgggactgattgaaagtttagtgttaactaaagtgaagaaattttatcagttgcttggtcacagctggggagcctaatttataatgttacagttctttcttccacaatactcagtagcaaaagagtaggacatgatgtatcatgtaataggggttggcctatgacactgttgtgtgggcatattttgttaggtgagatgtttcagtccgtaagaggatgtgtacagtctattagttggcacttctaccctcaggtacgttgtgaaaatcacgtgagtgaatttggcttggtgtgttccagaggacatgagaaatctattttgttgagaattacaaattatattcgcactaagagatgtcactactacttcccaaatgaaaaattatctttataatttcagtatgtatatgtcactttaaatacgtgaaagtctatatacaagagacagcttgagtagttgtagagtcttcattttaagaaatatataatgagttcttaatttttatgtttctaagaaggcttaatatttgattaacattcacatttcaaaaatctcagtagtatcataaaaaaactacacagaaacaatacattcactgaacacttttcattgagtagcagtttaaatcagtgtttcttaaatttaactgtattttatagtcacctaggaaactttaaaaattcaaattctggccgggtgcggtggctcacacctgtaatcccaacactttgggaggccgaggtgggcagatcacgaggtcaggagatcgagaccatcctggctaacacggtgaaaccctgtctctactaaaaatacaaaaaaattagccgggtgtggtggcaggcgcctgtagtcccatctattcgggaggctgaggcaggagaatggcatgaacccaggaggcagagcttgcagtgagccgagttcacgccactgcattccagcctgggcgacagagtgagactgcatctcaaaaaaaaaaaaaaaaaaaaaaattgcctaggttgaaaaccataaggtcaaaagcttgcttgataataggactgaattgatactaatggtgtgatttttaaactgactaatattaaggatattgtgtttccagtacatgctacagaggactcaagatcaagatgaaaatgtggctttagaagcctgtgaattttggctaactttagctgaacagccaatatgcaaagatgtactcgtaaggcatcttcctaagtaagtgttccctcttataaatgctgccttgttctttaatttcttaagtgattcttcattttcatatttttataaaattcattcttttgccatcagggagtgagattctaaagaagccagacttaattttattgttggtaaagagatttttcaaaaagcaattgcctattttaaaaaaaattatgtgagtatggtttgttctaaattataattgatttcggataatttacagcacagtatttttgtggggtttttttgttttttgttttgttttgtttttaaaaaacaatccttgttatttaaccacagactctattgtgaagttttgttttttttccaaaaaataatttcccactagttgtgatgcaacagaatttagttaacttaatgttaagcccatttttctaaaagtaaagtaatataagctcgtgggaaaaaactaaattgcagaaaattttatattttccgcattttcaccaccctgagtaatcactggtagtattttttatgtcatcttttaatgttcttttctgtgaaagtaccgtatactaaatagcatgtattcagggggtttgagaaggaatttgatttaataatatataatacattaacatgacatcttgcctatagttagtgcttaaaattttaaatatactatttaatggtttgttcttttcagttattgtatgctgtgtgctttcctccatgtcattagtctttaaaacttcagtggaggtatgctattccatcatggtatacataaccatatttacataaatgacgattatatatgtgtacgctatagagagagagagagagactgttctctgccattgaatatttaggttgttttggctttttttcccctcataaataatcctggagtgaatatctttctttgtcaataaaaggttgtttctttttgttataattactaggagtgatttttttcctcaaagtatatgagcattttaatgttttttcacaatattccaaatagttctctaggaaatttatagaaccgtataccccactgtgtgtctattctgtcacaactttgccagccatgaattttaatttctcaaatcttagccatctggataagcaaaaaaaaaaaaagtttttaatatgtcttcatagtaaagggtttttttttttccccagatgtttatggtacttgaatgttcctattttcatatggtcaactgagttttttctttccatcaagaaagcaacgattccagtcagtgtatttggacggtaaggttaagcaaggtgcgtcgtatcttgcttaaccttgccctcgaaatacactgactggatttttttctctttaggaaatctattaattgttcttccttttctctttactttgtaatgccactttaatgatacgtttgagtttctgtggggtcatataattttaaatgtcatagatactaatttttataaaaactgcagagattttctttttttcttcaagagcagaaatccgcttttatttattgacttttcgttagtttaaatccttgaggggtacagcatcactcagattttgtgtccaatggtctcagcaggaagattgctttgaaatttggcacgaaccatgccactgtttccatgggcccagattactctggctttgtttagtttgccgccaggagtctctgtgttgttctttgttttatgtacataagcacatctcttgcccaaagagaattctgtttcacctcatgcgtcaacatcttcaattttaacaagagctgtgtgtttcctttggttctggagaccctgcttttagccagcagaaaaggccttgggccacagccttccagacatacttccttttagaagtcctattcccagcaggctgcagttatttgcccccaaatttcagcagcagctgcttcactccagagattttattaatgaaaacctaggctataacataaacctatgctataacaaacctatgctaatgaaaacctaggctataacattagagatgatgttaaaaatatggaattataactaggtactctaactctattactgcactaatataatccaaatattcgtaaaccaagcaggaaattaaaagattagcaccacccattttgctgtgctaattagtgccaacattaaacaactcaagccagtcatgactgagttttacttatgtcttccctactactgtgagaggcggtctcactgtattgcccaagctggtcttgatcctcttgcctcaagcaattcatactgcttggcctcccaaaactttgggattacagccatgggccacggtacccagtgggagccacttttatatataaaacgcagctgtttttattgttttagataatgtattgacaggatagcagaatatcaacatcaatctgatgctgagattaaaaagcacagtgaaataacttgtttttcctatttattaaccacacttgcctagtataatacgagcaaaaagtgtttgcataggaattaaaattgtgtgtgttacaagatcactcataaatataaactcatttagaaagcaccattgtaggctgggcacagtgactcatgcctgtaacctcagcactttgggagcctgaggcaggcagatcgcttgagctcaggagttcaagaccagcctggacaacatggtgaaacccgtctctaccaaaaatacaaaaattagctgggcgtggcagcacatgcctgtaattccagctacttgtgtggctgaggcaggagagtcacttgaacccaggaggcagagactgcagtgagctatgagccgaaatggcaccactgcactccagcctaggcaacagagtgagaccctttctcagaaaaaaaaagcaccagtgtaacaaggaggatattaagttctattatcattctgggctatatagtctccctttttttatttttttaactagtactatttttattattgaacattaatgtattttgtgatctggtatagcagctcttgatttctctcgtttttacaaaattgttttggctttttcccacctttattcttgtacattaatgtcttatagggctgttgtgtggattttccatgtgaaacaacccaatgctcagcccatatttaagtattcagtaaacgtttattgtctatgttattactttatgtgatgttgcattaaaaaactcatttttgactgggtgcagtggcttatgcctgtaatcccagcactttgggagtccaaggcgggtgtatcacctgaggtctagagttcaagaccagcttggccaacatggtgaaaccccatctctactaaaaatataaaaaattagccaggcatggtggcgtatgcttgtagtcccagctacttgggtggctgaggcaggagaatagcttgaacccgggaagtggagattgcagtgagccaagatcgtgccattgcactccagcctgggtgacaagagcaagactccatctcaaaaaaaaaaaaaaaaaacctcatttttaatggctacatgggggcttcaggagaaatcttcacaattagacctgctcaaaaataagagtttgcctagcatgattagacttgggcaggcacatgccaaattgccacatggtcacggttaatttccatgtcttattttctgacctcattttttcttatttgcccagctttaccagccagtcctttatttcttgcaaaccttactaggcccatctgccaccccattccaaggcccttgacctctttgtgttctaatctgattcttttttttattattattattttgagatggagtcgcactctgtttcccaggctggagtgcagtggcgcgatctcagctcactacaagctccaccacccgggttcaagtgattctcctgcctcagcctcctgagtagctgggactacaggcgtgtgccaccacgtccagctaatttttgtatttttagtagagactggatttcactatgttggccgggctggtctcgaactcctgacctcgtgatccgctcgcctcgacctaatctgattctttttattctctgtttatctgacaaacatcagagccacgaataaaccatactaacccaaaacttctatctaccctgctctagactaattgaactctgaagtcttttctttaaccaggttgttgaatgcctttggggaaatttacactcccctagggggattgttggctatagaaatctgtggtcttcaaccgcaagtggtctcttcacaatctgctaattcatgttccagatcagcttttatcttttattcaccaagagcaactgtttgaaacctttattactcttttgatattctcttaattcactttgagcacttaggctcgtaaagaaagcaggtgaccctttatcttgccccaaaacttacagatagtaatttcatatgagctgttctctcctaaccaattttctccttaaggtctgtatagtataaatttttcttatacccagagaccctcaccgtaccagataaatattcactcttagcttctccttgttgcctcattttccataactttataacttgctgcagttttttgtcttcaaaaaacaaaaaaactcaaactttttttgagtgggacttactgtcttcacttctttaacccacatcttgttaactcttcattatcttaacattctgatgtctgtcctcaccatttccttgaaattgttgataaagatcatcagtgattaactgttagtgatccagatacacctggttctcctgcaaaatacctgtatcttacaaaatatagctctatgtattgtaagtcttacctagttaaattatgctagctctaatgtttaattactactaatctttctattttagaatttagaaggactttgagcatgaaagtttggctggcccacatttcttaaacctatccaggggattttatatttgactgcttccttttctctattagcgtttcttcagttaatgagagcagacatatatcactgaataagttcaaagacaatattaccattgattatctcattggttttattagtacatgtaaggttaagacttattaattattctcttgagatcttaaggtctttgtttcatgaatttctttctttataggttgattcctgtgttagtgaatggcatgaagtactcagacatagatattatcctacttaaggtaaggaagcttttttgatgaatagggaacaagatttttatattgacttagtacatctttggatttggccaataaaacattcattgagaatagatctcctgtaaatagacttcctattatccataataggatagaagcataagtttaagtaatgataaattcttgcttaatttggtactagatggtgacattggtagggttattattaatttccccttaattacttggagttattttaaaaacattcttatatatgctgctctgaatttgattcaggtaacttagattataccagccagtggaggccatgtagttggctgaaagggccgtataacctaacaggtgtgttaggtcagtctattcgcccctccataaggaatatgttctgtacatgggcgtggttcttaatcactctggaagtatatttcagaattctgtgcatgaccccatctctggatattctgtttctcttactcatgtacatactattagcctataatgaatgccaccaaaaatttctcttaaaaaaacaacagggtgatgttgaagaagacgaaacgattcctgatagtgaacaggatatacggccacgttttcaccgatcgaggacggtggctcagcagcatgatgaagatggaattgaagaggaagatgatgatgatgatgaaattgatgatgatgatacaatttctgactggaatctaagtaagtcagaaagggaaaagcacagttgcctactttgatgataactttattggggtataattcatctactgtacagtttactacccattaaagtatacatttcattggtttttagtatattcagagagctgttcaaccattaccacaatcagttgtagactatgttttcatcacccataccctttagcagtaactccctattgttcactggctctgggcaactactagtcaatattctgtctctgggtttgcctattctagacatttcatgtaaatggagtcatacaatgcattgtcctttgtgaccatcttctttaacttagcataaagttttcacggttcattttgtagcattcacttgtattgtgaaataatatttcattgtaatatgccacatattctccattcattggttggtggacatttgtgtttctctttttgtagctgttgagttgtgatgctataaatactcatgtataatttttgtgtgtagactttttttgtttgtttgtttgtttttttgttttgaggcagggtctctgtcacccaggctagcatgattatgcagtggcgcagtcatggcccaccgcagccttgacctccctgggctctggtgatcctcccacctcagctccccaagtagctgggactacaggtgctcaccaatacacctggatgaatttttgtttttttttttttggtagagacagttttgccatgttgcccaggctggtcttgaactgttgggctcaagcgatccacccgccttgccctcccaaagtgctaggattacaggcgtaagccactgtgtctggcccaatgtgtattcagttctcttgggtaaacactcaggagaaggattgttggggtcatatggtaactgtatgtttaaccttttgagaaataaccaggatgttttccaaagtgactgcaccattctgctttcctagcagcattgtctggagggttccagtttcttcacatgctcacttgctttattatctctttattattatagtcattctagtggacgtgaagtggtattttgtggttttggtttgcattttcctggtggacctgctcttattttatcattattatattcttaaactaccatttctcaaaaggctgtttgttttaatactgtaagaacattgccacaagcttttttggtttttctaacatgagtgttttctgtctggtaatttgcatgaaaattggctatcataggtaattctaaaataatataagttgctttattatattcaaatttattataagttgctttgttatagtcaaaatttatgaaatatgcttcttaaaatatgttaatttccaaccttagctgcaaatcatatcacctgtggagctagcattctggcccacgcttcctaattggggatgaacctaaacacctgtgttctgattttgcttgcttgtttgctggattttaaacctctactgctctagttcagggtttctcagccttggcactattggcattttgggccacataattctttttttttttctacatgtgaatgccacatcatgcatgtaattctttgttgcggaggctgtcctgcacgttgtgggatgttaagcagcatccctggcctctacccaaagatgccagcagcacaaacacagttgtgacaaccgttatctcctgggggaacaaaatcaaccccagtttagagccactactctagttcaaagtgttgggatttctaataactatgattaaagcagttaagaacagacattatcagtctgggctgtgttcttcatttggttagataatgctaatttctctgttgcctcttcagtttcctgtaactaacattctatttagagtgcctaatgtgccaggcactaggccaaggactttgcatgcatatcaaagtctgtttaatcataagtaagaataaagtcatatttaacatttccaacaaccttgaataggcaagaaaactgcagaaagagagatatacccaaggttagcatagctagtactgatagcacatctagtactgggacccaagtctcacttgttaagacaacacatggtgtttactactattacaaattacttcccagtgtatccctactttcagattaggggagcaggatggctcaagatcattacacagaaaactctacaaaataatatacatacatggatgggggaacacttcctcttcacatcccattctttgtatccttccaaaagcttttctgtgcgtgcttgggaaaacatacaggcatcttttttagaggagaagccagttttctaaaagtgaaatcagattatatgtactctgctgctttctttctgtgtatcgtatgcctcattcttcctcagtacatacagatttagatttccttttgttgcatgtcagtgtactgtttagttgtatggctctaccatgtggtataactaagatccttattgatgggtaaggtgttaatttctggccaatgtaatggttttgttttggtttggtttggtttttttttttttttttgaggattttattattgtctagtagtttgtgattagccatttactatgcctagttcacgttggaaatttctgatattttcttagtccattttgtactactataacaggatacctgaagttcagaatggaggggctgcatctggtgagaacctccttgcaacatcatctgatgacagaaggacacacttaagagctcaattcacgcttataataagccaactctcttgataactaacccactcctacagtaacgacattaacccatttatgagggcagaacccttaagacctaatcatctcttgataggccccacctcccatcttcgttgctttagggattaggtttctaatacatgaacttcaggaacacgttcctacccataacagttaaatgatatttttgttgttctttttgattttgttgctcttgtctaaattattattataataaaatctgggttgatttatagtcccatagttaattctttgtaaagagtattttctagcatgcgttatgtttcatgtgccagtgacttttcttccagtttttgtgtctaaagtccagctaagtaattgtctgtttaattctagatgatatactgctggaaatgttaagtagagttaataatgtatgttttttgcgtgattgtaacagtgattgtaatcatgattgtaatatgagtgtatcatattgaatggttatgttagaagcactgaattgagtggcacagtatttgttttactgtatagacagaattctagtatgacagttatgtacagaatacaatgtgttcacaattaatttgccaagtaagttcttgtcataaaaaatattcatcttaatagaaaatgtttttggctgggcatggtggctcacacctgtaatcccagcactttgggaggctgaggagggtggatcacgaggtcaggagtttgagaccatcctggccaacatggtgaaaccccgtctctcctaaaaatcagctgtgcgtactggcacacacctgtaatcccagctactcagggggctaaagcgggagaatcacttgaacctgggaggcagaggttgcagtgagccaagatcgcaccactgcactccagcctgagcgacagaacaagactccatctcaaaaaaaaaaaaaaaaaaaaaaaccacaaaatgttttcacgtgacaaactacctcctattcaattgaattcttattttaaaactccgtattagagatacgaataaaatgttacatatacaataaataatatataagtaataagaggttaatgtaatatttttgaattaaatatttccttaggaaaatgttctgctgctgccctggatgttcttgcaaatgtgtatcgtgatgaactgctgccacatattttgccccttttgaaagaattactttttcatcatgaatgggttgttaaagaatcaggcattttggttttaggagcaattgctgaaggtaagcctaagtccagtttgaattatgtaagttggcttcttactactattaggtactaataaggctaggctactttaaggaatttctattttgaaccagataactagtattaaacagccataggccgtcttctaaccccagctagatattttgcaaaatgtttttgttataataaaggtaacagaggccaggcatggtggctcacgcctataatctcagcactttgggaggcttaggcgggtggattacctgagatggtttcaagaccagcctggttaacatggcgaaaccacgtctgctaaaaatacaaaaattagctgggcgtggtggcatgtgcctgtagtcccagctacttggaaggctgaggcaggagaattgcttggacctgggaagtggtagttgcagtgagctgaattcgtgcgattgcactccagcctgggtgacagagcaagactccatctcaataaaaaataaaaacaaaaaaattaagggaacagaatgaaaggctctgatgtctgaagcatccccattgctttaaaaaaaaatccttgattctttaggtaagtataggaaacacaataaggcaagactctcttcattctctatgaagggttattattgattttgtcctggcagtaaacatctattagaagaaattgaaacactgtaagatgcttgggagcaggtagctctaacttcagggttttaaaaataattttggtataggttattgtagtatgtgtatagcagtagaaatattctgaattttttcatagatacgtgttttattttcataatcaaccaaaataatgttaactaaattttagcattttgaaagatttattttttttctaggttgcatgcagggcatgattccatacttgcctgagcttattcctcaccttattcagtgcctctctgataaaaaggctcttgtgcgttccataacatgctggactcttagccgctatgcacactgggtggtcagccagccgccagacacgtacctgaagccattaatgacagaattgctaaagcgcatcctggacagcaacaagagagtacaagaagctgcctgcaggtgggacagattcataacacagtgttctttgtggcagtgaaaaacttaattttcaaccttctgatggagtgttggtgttaaacctataatgaagtgtttcgtaattgaaaattttccagttatatcagaaagcttagttttcttttttcttcttggtgaagtgttttgcaggatctgtagcttttgggtttgcatattagcgtattttatacattttgtttggccaggagaattttgtcatgtgggttttacctgatgattttgtagatctaaatgtgacaacatcgatcttagctgtttcttctttggctcatttttcccactcagtggttattataacagaactatcttacaccctaattccctcagacatctgaactagtgatggcaggactcctactcttgaaggaataacaacgtttgagcagattgacatccttagactacaggtcaaccaccataactcagaaagtcccacagggacctgtggtctgtcacttaccagttaaaggtctttgagtgcttagtagttctgctctagtagccattctattggttggtttggtggctgtctctttatatcaagccagcagttgcttttattactacaaatattccagtttcctgcaatatacctttatattttaaaagggccttctgcttatgtttatagttcttaatttttcgagtaggtttgcttttaccattgaccttgatagtaggaaaaaataactgttgaacaaaaaaaaggaaaattttattttattttttttagatggagtcttgctctgtcgcccaggctggagtgcagtggtgtgatcttggcttactgtaacctccgcctctcgggttcaagcaattctcctgcctctgcctcctgagtagctgggactacaggtgtgcgacaccatgcccagctaatttttgtatttttagtagagatggggttttgtcatgttggccaggctggtcttgaactcctgacctcaagtgatccacccatcttggcctcccaaagtgctgggattgcaggcgtgagccaccgcgcctggcagggatagtaaatttgagtttgaccttaatccatctgaagcagtcatatctggaagatattaagggagggaggatatagattatgtttgagatcctataatttattcattcagtacctcggtttttttttttagctattaattgttaagcatatactaaatgctgagtttacataaagtccctgccatcttgagacttacaggttagtaggaaatacaaagcagcaacataattatcatttatggcaagtgctatggaagaaatcggtaaataattcacagtgctgatgaccagggctttcattaacagatggcttagaccattttaggaaattcctgattgggtaaaacagaacataaacattttagcaattaagagttagatatatcttacagtcaataagtattctttttttttttttttaaacagtgcctttgctaccctagaagaggaggcttgtacagaacttgttccttaccttgcttatatacttgataccctggtctttgcatttagtaaataccagcataagaacctgctcattctttacgatgccataggaacattagcagattcagtaggacatcatttaaacaaaccagtaagtatctgttaagaactattagggaaaataatgtgtagcatagttacaattaatagattagcatatatttggaaattaagatgttttgggagatgtgaatagttagcgttagctactttaagagtatagatcttacaaaggcagcaagtatatcccctttcatgtggtattcttaaagtaaatacatacttggtgtggaaactacagcagcatttcacatgaatgctctgatactttttagaatgactaaagcaaagggataaaaaagtttttataatctggatatctgcttttacttaattcctaatgtttttgaatctaccacttcataaacactgtagctttagagtaccatatctagacatctttgttttttcagcaggtacggggagtatactgtataaaacaaatagaaattggggtagtaggtttaaaaatgctaaatagtaatgcaaaagtgccttgtttccagtagtgttagtagaagaggaggatggatttgtctaatgaggatttaagtgatagtagaattttaatatagctccacataccctgctgaatagacttctatatgattgctatatccaaagtcttaagaaattgttttatttttaagttacacttaagatttggtacagggcagtttataggtttgctttgctgttggttgtttggtttggcttttgtgggggtttgttttctgaatgtctttagagtctgtgcccctgtttacatgatcactatgtttagtcgttttatggatcattctttagtttgacacttaaatgattttaagtttgtttttctacaaaagcatctgtgtaagtttacctgttgatttaaaaatgtactatatagtaacagccatattacacgttacagttccatgactaaaaggaatttttttgtgtgtgacaaggtctcactctgtcacctaggctagagtgcagtggtgtgatcacagctcattgcaacctccacctcccgggctcaagcgatcctcccatttcagcctcccctgtagctgagaccacaggcgtgtaccaccattcctggccaactttttgtagagatagttttgccatgttgcccaggctggcccaaactcctgggttcaagtgatctgcctgcctcagcctctcaaagtgctggaattacaggtgtgagccaccatgcccagccccagaactaaaaatattctgtaacttaaagagaaaaacttaggtctgggcacagtggctcacacctgtaatcccagcactttgggaggctgaggtgggcagatcaaaaggtcaggagatcgacaccatcctggctaacacggtgaaaccctgtctctttaaaactacaaaaaattagccgggtgtggtggggggtgcctgtagtcccagctactcgggaggctgaggcaggagaatggcgtggacctgggaggcggagcttgcagtgagctgagatcacgccgctgcactctagcctggacgacagagcaagactccgtctcaaaaaaaagagaaaaacttagatcttccttgattgtgacttttttaagtaatagattttgattagctgtgtgtttattgatagactctttttttcaacaaggataaaagatcagtagatcactagttctagatctaaaactagaacacggtcatgtaagtataaaggtaggcaacagaaaggaaaactttaaaagggactgtgcagagtgaagaatgactcttaaaatgccttttgtaatgattttacacaattgctcaaaatggattttaattttcaaagactcaaaatggtcttgttgacatgtgatagtggaattttatatgtttttcatcattgtaaataggaatatattcagatgctaatgcctccactgatccagaaatggaacatgttaaaggatgaagataaagatctcttccctttacttgaggtatgcagggctagtaatatttaatctgttgccaagaacacatgttcaaatccaaaatgggtatatatgataagaaaagtgttaataaatttatattctgaagtagacggaggaaattatatgatacatactgttctctaacctgctttacttaattgataataaattagagttttaagttctcttatgttatctactctctatatagagtagatagcatactactctatatagtatagagtagataacatactgggaggatatatataccgggatatatatatatatcttttcactcatacatatatgttgagtagtgggatttggtgccagtaaggaggtacttattttcaaatttgaaaatgtttccatgtgtacttaactacttttttttttaacacccctttcattgcaaacttttatatgatgttctcgtaactgaacacactgtgaaatgtagtcacttaaacttagttgaattgacattgatagaaccagttcaggccttttcattcttgctccctgttatttcaaggttcaccatcttctaccgtggattgttcttagccaaagaagttaaattttctatgaccaagagcaattctgggcccagcaaaacaagaagaatcattatggttcattttttgtatgcagtcgtccctcagtatctgcaggggattgtttccaggactccccttggatacagaaatccagcgatgctcaagtcccttatataaaatgatgtggtatttgcatatggcctatgcacctcctcccaatatactttaaatcattttaattgtttttctaaatacttttgattcaagattggttgaatccatagatacagagggccaactgtatatatattactttccggcaggatctcagaatgtgcccagtaaagtccattcacaacattgaccaggatgggagcatgaaatgaatctcttcaatttgagggaaaaatatgaacacataatactcaatctgtcctttaaagataatgtttcttgtagaaacgcttcctctgagtaaacctgacctgattggctggcaaactaacaacaatgaatggcttccaaaagagagggttggggtggggggaggggaacctgctactgtagaaactagtagagcaagctcataaatgatcaggatcctgttgagcgcagtttcaagcattcatcataatcttcagtatacccagaaagtttagcatgtgtactttattcttcctagtgcctatcttcagttgccacagcactgcagtctggattccttccgtactgtgaacctgtgtatcagcgttgtgtaaacctagtacagaagactcttgcacaagccatggtaatttttttaaaatgtcttcctcttcttgacatggtggacatttttctaaagataggtataatgtatacagactttttaagtagttaattaaaaccaaacttacaaaaaacattgtgtctaatttcagctaaacaatgctcaaccagatcaatatgaagctccagataaagattttatgatagtggctcttgatttactgagtggcctggctgaaggacttggaggcaacattgaacagctggtagcccgaagtaacatcctgacactaatgtatcagtgcatgcaggtgagacttgaaaggtgaaaatgaattgaagcctgtttctctgtgtcacattggggttaatttcttcttatttcttgtaggataaaatgccagaagttcgacagagttcttttgccctgttaggtgacctcacaaaagcttgctttcagcatgttaagccttgtataggtatgaatattttctactgctatgaatatggttttttaaagttaacatttacatcagctttgtttttttattattaaactgaaattgcatggaatcccaacatttataaatgtacactttattggttaaagtaaacttgctgtgattgaaacaggcaagatggcaggaacccctaatatttccttgagcttgccatcatctcagctttttaggtactcctgtgactggaggaaagcttagtaatatactttagagtaaaggacatgcccaccagggaagccttggtaccatggactagttaatagattcttttttgagtagccacctttttggtagaggtacacagaaatagtaataatcaggttttcttctctagcaaaccagcatactttttcagatattgcagaaaacttccaacaaatgtcactttaactgagactgggcctgggggctcacacctgtaatgccagcactttgggaagccaaggcaggcagatcacttgaggtcaggagtgcgagattcgagactagcatagcatttgtcttggccttctgtgacaatgataagaaattccttgaatgttgtacccggaattgttcttaaacctatgggttataaatgagttatgggatttttttcccccttttctgcatctcagcatgttgggtaacaattattttaatacagccgggcacggcggctcagacctgtaatgccagcactttggaaggccaaggcgggcaggtcacgaagtcaggagatcaagaccatcctggctaacacggtgaaaccccgcttctactaaaaatacaaaaacttagccaggcgtggtggcttgtgcctgtagttctagctacttgggaaactgaggcaggaaaatcgcttgaacccgggaggcagagtctgcagtgagctgatactgtaccactacactccagcctgggcaacagagcaagactccgtctcaaaaaaaattattttaatacttcatttaaaccttaatttaaaatattaattgaatgttttgtcatctgatataattgtgcttttggataaccatttctcaaaaaactaacataattaacattaattatgatatattaagaaccatcaagtttaaacctaacagtgtaatgaattcttatgggaagcttatcattctcatatttaccacctaatttagttttttagttgaaacttatatgaaaggatttaatttttttattataaagtgtttaagacgtacaaaagtagaaaaaatgtaacaaacctcctatcacccagcttcaactgtccagtcctgtttcctatatactgttgtcagtggtgagacacatagatctcagatattttggagcaaatctcaaacacagcatttgaagtcttaatattttagtacatactatactatctcttcttacaattgttttttgttaaagaaaccatgttttttattctaaagagtttcctttactgtggattttactgattgcatctttgttgtctttaacatgttcctctgtccgttgtatttactgtaaattgtttggatacagagactgaggtttaatgagatttacgttgttttgtttttaagactttatagatggtattgtgtacttagtgtacatagtgtctagttgtccctcctttttttttttttaatgttaccaatcttgatgattgtctcaattagtggttctcaactaggggcaattttgccattcggggaacatttgccagtgtctggagacattttgtttgatgctggagaggtgccattgatgtctagtgggtagaagcaaaggatgttgctaaacatcttataatacaggagacagctccccttccccccaacaaaaaaatgatctggcccaaactgtcaatattgctgagatcaagaaaccctggcttacatctcctgatttattaggagtttaaaaaattatgatattctaattcttcatttaataatgaagatacttatatagggagacatttcccatatcaataaattactatcctgaggtaaaatcatatagcagaggcaagataaatacttgattcttttttttatttaccaattttcaaaataatgaattgattcctatcatcctccaaaggtatctttgatgtttcagagttttgtttttgtttgattgtttttagtgctagtgtgacttcatgatgttcaagctgttgtactgcttgcagtgagaacttaagttggctcccgagtcctttcattatgacaagatagtccacttattttgcacatttcctgcctttgcctgtaatgtgacgttttctgagagtccatttttttttagtggaaaatgttattcagagaccacaatcagagcacaagagtgaaaattgctttaaaagccaaaatcattgattttttttttttagtctaattacaagagattactctgaccaactctttttagtggtatgtaaaatatacccaaacttgtatttcctgttccacattatttgaaagttcattggccagatactgttttcttcagtttcttaagataaacattaccaactcctttaaaaaatatttttaaatacagttgcctagtttatttccaccaattttaaaattgatgttgcagtaatttttttaatggtgaaacttgttatttcttgcttagatttctgtttccacctagtagatttcctttaaagtacaatatactgctattgaaaagtttactacatagtttaaattttttttctagctgatttcatgccaatattgggaaccaacctaaatccagaattcatttcagtctgcaacaatgccacatgggcaattggagaaatctccattcaaatgggtaagatgtttttccctatttaaaagcataaggcctggcgcggtggctcacgcctgtaatcccagcacttcgggaggctgaggcgggcagatcacctgaggtcaggagtttgagaccagcctggttgacatggtgaaaccccgtctctactaaaaatacaaaaattagctggcgtggtagcgggtgcctataatcccaactatttgggaggctgagtcaggagaatcacttgaacctgggaggcagaggtttcagtgagctgagattgcaccactgcactccagcctggtgacggagcgaaactttgtctcaaaataaataaataaaatataaatttttaggtgccttgatatttttgtaattgctttaattttaattatttgtatttctatatttatatgacatgtcagagttaatacgggaagcaaaatatttcacattgatattttaacgttcaattttttcttttttgtttttttctttttgggatgatctctaggtatagagatgcagccttatattcctatggtgttgcaccagcttgtagaaatcattaacagacccaacacaccaaagacgttgttagagaatacaggtaccatatgactgaactgtttcagtgaagagaaaatttgttgccttttaattttaatatgcgtagagaaaccaaagcaaaactagcttttaaaatcgagcttattttgtatttaattgctatttcggattttcagtaatgaaatagactgttgcagctacattctataaccagttttcagtggttatatattcagtggtataaccagaaaaacacttttttcccctattccagtgttttaatacttcctgcaatggatcccagcaaagataactattgaaccacctgaattttgcttttaaattaattcggagagtaactgggagctgggaagtaatttttttttttaatctgtccaaatgtagtcaaaaagattcagtggcaaattggttaacagtggcatttgtagtttgtatttcatcatataattttcttcgaattgggaatttaggcagtatgttatgggattttttttttaatttatttttttttttttaggaagcttgtttctcttttgcatttatagagagcatgtttatattaaagagtaccttccatactatagaacacatttgtgggtggattcggtccttttctttctaccctccctgattgctgctaacaatccagaaagacagaaattttgttttcattcaggcacattcctttctttacatactaagatgattcccataatttatttataattcaatgagtattctaccaaaatactagacaaagattaaaataaggttttccaaataagaaagttacttttcaaaggcatttttatttggtatttttaaattatagaaagttcattttattctaatgctattaaaattgataatgtttattggtatggaaggaaatcttttaattatgaagcagttatctggctgtttggctgtatgggtactgtttatttcacaaagtgaattagattttcttgctgaaaagtacaaaaatctatgtataggatgggttatgaaatcttgttaggattttatcttttcagaatgcagtacctatacatgacattcagatttgaaagacttgccattataaaattattgtggaacctaaagaaacttctatttatttttaaatgtgaatgcttaactgcaaataaatgttgagtgtaatgtatatgaaagtttcttgtgggatatcagctggtgaatttgttacatagtttgtttaacaaattggctttatttataagattatattttaagtatgattatatcctacataaataagtcataatgccctaaagttgatggattaaattgatattattgagaaacacacttgggattcattagattacctcttatcacaagtggctgcataaagtattgttttctttatttcttacccaaaaaagtggggttttttaattattaaaatcattgtcaatggctaatatctagattttagcagcttttaattaccattatctcaatatttcataaagccaattccttagtctgccgttaatttgcttttttccgattagtatatcctgcactgaactttttcaatggaccatcatctgctttatcgcatgtttcattggattgttcatacttgcctgtttaatgagaatgttgcatagtttgtgtcttttgaacataggttttctttctcttgcttcatatgaatctgctggattttagtattatctgtgtagtttgcttcaagtaatccttaaacatttttctttaccccccaccctttttttatgaaaggttaacctgtaagtttttgagagaacaccattaaagcacttcatggtttgttttctgtttgtattttttcctgttgtgtatgaatgtatttacatgtacgtacctttgaattgcagaatgcagttccgagttgcacttattttagctctttgtaagtttaaagacttcctcaatttttatggtgaatatatgtttgcccacttcaaaattgtaaaaaaaaatagtgtgtaattagtataatgtattatctattttgtgctatacctttaatagcagaaacagaatatttattttttcctgtggtccacatatcatatgtcattgcagtggactgtaaatttcctttattagaattttatttcaaacatggcttaaagttagtggactgttacctgagttatcagaggtttgacaacatgagatttgacattgtagcatagcaatattctaatccattcattcagtgagtaccatgagacttaaaatctgacagttgattttgatgtaaggtaacaaatttccactggttggtttggcaaatgttaatcaaagaaaaaatttttgaaactaccaaaaatttggtttaaattccctagataatttccaaggaatggaaatcactttcacctgtattagtttgagatgcttgagaaatataatcacatttactgatattttctcatgaaaaaaactatagattttattattaaattctgaaattttggctggcttttgaatgaaggttctctaaatttgtccatttaactgctcatcttattaacagaatgataccttgacactcgattgagcgagaaaagcaatttcatcatggtttttggtgttctctcaatctttagatttttttaattccttttgtttttctttttccaagagtatgccatatatgttgctgccccttattttagggggtggtaataaacagcactggtgaaatcttatgtttattatcatacacaaattctgttggtttctgtttctgagttatttgttgttttttctttattttttctccttccccctcatttgctcatgtcttggttggcgtttggtggtgtataaccgtgattgcgttaccttagcaataacaattggtcgtcttggttacgtttgtcctcaagaggtggcccccatgctacagcagtttataagaccctggtgtgtattattcaatctttttttttaattcatttttcttcactctttctttctctatctcacttttagatatattttcagttggttacaaaaatcacaatcctttatcattgccaaccatgtgactaatcttgtcctatcaggtttgtgaggtttttcaatagcatcgtcatgtatatttattttatgttgtggctaacgactaattgatgcatgggataagattgtcacatgcttgctgtgttaaaaaagcttgattatacataaaaagcatttaaatatccaccagaaaaataaagatgcatgcaaattctataaatttaggtttttgcattacgtttcttttttagaattaatttggaaacttggattgcattaagaaatacatgtttaaatttgttatgtataaaaatattatttgcttgttaatgtaaaagttaaacatctacaccataagctatatagtaatagtttatattgtggcactatatcctatgttttgcttctttcaattgataatctttcaattcaaatcattttagtagtgtttaatggaatacaagtcatgagtacaattttaaaagttaatttggtaatttgttcttcttggctcaggctcattaatagtttaaatgggagattcaaattagttatctactttataaatgcaatttattaagaaaatgtggatttcactgtttctactgtattgagataagatgggcccaacaaacaggaagtatgagtaaacgaaactaaagctttccgaaaaactcttttaatataatcattatctatactgtggtgcttattccattaaatactgtccattagtattgtcattgaatctgcttgttacttaaatgctaaactcaattctgtaattcaataggtgcacctctctgagaaacataagagacaatgaggaaaaggattcagcattccgtggaatttgtaccatgatcagtgtgaatcccagtggcgtaatccaagtaagatgttcacaaagatttgtttttaatgtctaattaataaaattttaaaggaagaaacattctaatactttaattataaaaagttaactattttcaaaggtatcaaaatacagttaaacctttaaaatgtatatttcttaatatcttgaaattgtaatgccttttttttttcctaaattttttttgtcatgaaatgagatagtaacagcagattgggacaacaaggttatattcttgtcttgaatcaggccatggcttctttcatccaaatttcagacctcatttatttactttgtccctgcctcccatccctggatatcagtttgtggatatctacagttaatagagtgaccaaatagtaggaatactgtctctctattctgaataaaatactttgaatcagatttagaaataatgaataaaatacaaatcagccattgaaattgctctaattttgagagcttatgatttattcatctttgttttccaagttcaagttatatgtagacattttaattattcggcagtagtattgaacatgagtccagttaagcatctggatccaactgccaattttctagacacacaaaacaaaaacatgttgaattacaccatgtatattcagtgaacaaaatgctaactgtgggactctaggttaaatacctggattcttcagcagacacgtttaaggaaaagaaagcgtggaaggaatcctgtagacaagagacccaagatacatcaaatcaattgaaaaacgtagttgaggccgaggcaggcagatcacgaggtcaggagttcgagaccagcctggtcaacatggtgaaaccccatctctacttcagataaaaaattagccaggcttggtggcaggtgcctgtaatcccagctctcgggaggttgaggcaggagaattgcttgaacccgggaggcagaggttgcaatgagccgagatcgcgctatggcactccagtctgggggacaagagcgagacttcatctggaaaaaaaaaaaatgtagttgagggagggaagcaaagaactaaattttggtttccaggaatgcacacaagagttataaaactgccccaaaaaaatgcttttatagcaataactttctcacatttcttaattttcaagaaaattgaaactttccactccgagaggggtgttttgaacatttttaaattgtgaccttttgatgtttcctagctcgtattgtggtttttcttaactcggttttagaaacgttaattctgttttataaaattcaaattgatacaggtgatagacgttgaaaacctacaagttagaattagaaaataacttctgactgatttcacactcataaaatattcataacttactgttagaacaagccagtgccatcttgagaggtttctagttacaaaataagcttttgacattttctgggtttttgtttttttttttaatacttaagaactttgtgtgatctcaaatgtgtgctagaggtatctgatatgacatgtaccatctttttcaaaagtatcttccgaccaagattttattgtttctttgtttttgaattaatgttttaagatgataaaagtagcacatgtatgatcataaaattgttaccaacttaagagttggtagaaatttctgttttataacttttattcacataccttattttggatatggttaaaataaaatgtcataggtttatttacatttaaattttttaatcacaaattctgggtatctgtgcatttaaatttttaacatcagatttggtatttggaagacataatttgaataaattgtgttaagcaaatcttttttgcttaaataaacatacacacactgtagtattaccaaattttttgaaattagtgaagttttctgaatataatagtaaaatttatagttgacatgtcagaaaatcagcaatatgttgaatgctgtttgttgaactgttagtgtttcagtatgataggcaagattgagaatattttaatgaaatgcttaaagcatattattatcttgttcttatagtcagaatagcctgattatcttttaagtaattgtccaaaagttgggttttttgttcttgtttggattgggtatttgtaattacataattagtttttcttcaattttttggttgtttcaactaagttatgtctgaaaatggaccttgaaattactaatttctctatttcaaatcaaggtcatttaatatatatttagctagctttaatttctttctaggccagtcaaaactgtaagatcattggttttatgtttttctttaatccggtaaatgaaagagtatttttatgggtgtcgatttggtgctttcagttcatttctgatgctgaacatttattgcacagggggttattttgttgtgtgatgcaggacattaaagtccagtataaactgaatgagttgaggttccttgactgtgggctaatagggacagccattaaggtaatctcttctaattccttatgatcatagttaatttttaaatgtttccttttttaagctagattctattgtgacataaactctgaggtttacatatatcttttgctgagtttgacaaatacaatatcaacctaagatgtatttcttgcttgttacaggattttatatttttttgtgatgccgttgcatcatggattaacccaaaagatgatctcagagacatgttctgtaaggta

SEQ ID NO: 12645 - DNA, 5217 bp, Homo sapiens
caatcagtttatcatcagtaggactcaagctctaatgttgcacattgattcttttattgaggtaagacttgttcttgtctccctcccaaccccccagctttttttttttgagaaggttaggtgatgctaactgcatgtagttttgctttaaaacaagaatcatttataattctaaactcaatatttaattaaattatttctgatagtattaaaactggatatgggatagactaacttttgttagctgagaaggcacttttactaatttttctacttgtatcattctacaaacactgattttggtggcggggtatgtttagtatcttgactactttaaaaatttttccttcaatatactgttcaaattgcatatggaaaccaagtccctcagctcatgcagtttttgaaatgtgaaaaattggtgaggttagattaagttcatttggtagaatctgaaggcacagactacaaggacagtattttccattggtttccattgtaaaattagaggcatcaggaaaaatagactctttaggcattttgaactttctgataaaagtggaaagaaaagagcataattttctggccaggaaccataagcaccacaatttcttctcaaaatctctgctacttgataacaattaaaaggattgttaaagttccttaagcaccttcacttttattttcatgaaatggaattttaaaagtcccttagaagtcagactgctgatactactgttgggaaattataaggaagagtagggggggttacgttactttttttctcgtcacttaaattgaccagcttctttctgagcatcttttaccaataaactaagagtagtagccataaagatcctttagccatttacaagttaaaaccaaaatgtgtcttaaatagttttactgactactacctactatggaacagatactgtgtttgatactagggatacttaaattttatgcctgcaaggtgttttctttcagtctagtctagaggtagtataatgtagtggataatactagaggtctggagtagactattggtgttcaaatccagcgtctcagtttagtagcttttaaccttagatgctttatttaactgatgttttctttatatcatctgtaaaatgagtcaataattgacctaccttgttggattgttataaacctagttgatataagtaaattggaacatggctgccacagagtaagcaggcacttcatgttagctattaaagtattaatagtagtatttctgttgcaattatcctggtgttttcttttagtattactctttcacagtttaataaaggggacaatgatagacataccagcaccttataaggaaatataatctaaaataaatgaaattgaattatctctgaaaataaaaatttcataggacggtactcagcaagtgaggcagaaacattttctaacattttaaaatattttgctttactattaaatatgttaatatttgtttactacttgatagtcctacaggatttagccaattctctaccctacaaaaacagtaaacctctggaggaagtgcctctaacatatagtaggccctcaatagcaatttgccaagtgaataagtaaactgattttcttcacttgccattgttttcatggtatcatgtctgctaagtctaacatattgatgaaaagtttattggttaccagtacatggctataatgtataaccttggcaaagctgggtattcattgacagtagtaacaaaagtgacaaatgcaagatgatggcattgggtatccccacccccaacccagttgctgttctctagagtaaattaatgaaatcttttaataaaatttaatggaggatgtactgttaatggcaatgcctgctgggaaaatagtgctcttttgtatgtaaaatacaattaaaacaggaactacgtagttttgagagtgtcaaatgtggaagcaggactggggaaatcaacattttaaaaatgctgcaatagtacttcacacaggtcccatttgatcgttgaatttctcctctttcttataatgagattttaggttcattttgtagaggatttctgtgatttcctggaaaaagacagtgggacacatggatgttacttaactttttaaatgctgttttactgcttttaatacatgtatgtgtaaataaagtaagactttatgtgtgacatgaggaaggcttcatgtgttttcctctcacatccccactctgagagatgtctttttcttctagtggaagcttgtggtgtagggaaatgagtgtgtgaactctgattccatgaaagccagattcagatcttctgctggttatcaagttacttaacttctattaatttatttccttatttgtaaaattgaataataacgtcttagagttttgaagataaaatagtctgttgtccattcagacattgctttttacttgcagacgtagggaacagcataatatttattactaattttatggaacaacatcagtttagggttaagttagaaaatcagtgtatactaatatttgtcgattattgaatctgtatcacctttttataaatcttgaatctattaccacctctcaccttaaaaatcagggttggtagggaatagtcttttgtctctgcttctgggtgagcaaacaaatgctcctatgtcctaatgacatggtttcttaaaaactaaaaatttcctcaaagtacagctgattgtactctatcagaaaagaatagctcttcatcttttatcaaaatcataatctttgtcagttattccacatttaattcttgtaatctaatattgtaggccaattcagtcagtttttggtacctttgtagggtttctttaaatgtcaccaacttgcagattacttattacttgtgtgtaagcctttctaaaactagaaaaaattatttcttgtgcaacagaatctctttgcattagctggtgatgaagaaccagaggtacggaaaaatgtgtgccgagcacttgtgatgttgctcgaagttcgaatggatcgcctgcttcctcacatgcataatatagttgaggtaacactggcaatttaaaggctctttcatcatctttcccctaagagaaatactagatagaaaatacaacataccggatgggaaggggactataaaatagttataattgtcttaaaattataagttatctttgtggggagttttgtatttctgggtatagttgtacatactgtataactttggaagtgttttaagtagtatgttatctagagcctccttttcacttccaaagttccatatggtggagagaagagaggatcttttttaaaggttgcagtctaagatctgttaaaaggctagcattcgtggtatgcagcaactcctgttctaaaactttacacatggctgcatgaggtaggcctgttttttctttgaaaagtcaggcgggactgattgaaagtttagtgttaactaaagtgaagaaattttatcagttgcttggtcacagctggggagcctaatttataatgttacagttctttcttccacaatactcagtagcaaaagagtaggacatgatgtatcatgtaataggggttggcctatgacactgttgtgtgggcatattttgttaggtgagatgtttcagtccgtaagaggatgtgtacagtctattagttggcacttctaccctcaggtacgttgtgaaaatcacgtgagtgaatttggcttggtgtgttccagaggacatgagaaatctattttgttgagaattacaaattatattcgcactaagagatgtcactactacttcccaaatgaaaaattatctttataatttcagtatgtatatgtcactttaaatacgtgaaagtctatatacaagagacagcttgagtagttgtagagtcttcattttaagaaatatataatgagttcttaatttttatgtttctaagaaggcttaatatttgattaacattcacatttcaaaaatctcagtagtatcataaaaaaactacacagaaacaatacattcactgaacacttttcattgagtagcagtttaaatcagtgtttcttaaatttaactgtattttatagtcacctaggaaactttaaaaattcaaattctggccgggtgcggtggctcacacctgtaatcccaacactttgggaggccgaggtgggcagatcacgaggtcaggagatcgagaccatcctggctaacacggtgaaaccctgtctctactaaaaatacaaaaaaattagccgggtgtggtggcaggcgcctgtagtcccatctattcgggaggctgaggcaggagaatggcatgaacccaggaggcagagcttgcagtgagccgagttcacgccactgcattccagcctgggcgacagagtgagactgcatctcaaaaaaaaaaaaaaaaaaaaaaattgcctaggttgaaaaccataaggtcaaaagcttgcttgataataggactgaattgatactaatggtgtgatttttaaactgactaatattaaggatattgtgtttccagtacatgctacagaggactcaagatcaagatgaaaatgtggctttagaagcctgtgaattttggctaactttagctgaacagccaatatgcaaagatgtactcgtaaggcatcttcctaagtaagtgttccctcttataaatgctgccttgttctttaatttcttaagtgattcttcattttcatatttttataaaattcattcttttgccatcagggagtgagattctaaagaagccagacttaattttattgttggtaaagagatttttcaaaaagcaattgcctattttaaaaaaaattatgtgagtatggtttgttctaaattataattgatttcggataatttacagcacagtatttttgtggggtttttttgttttttgttttgttttgtttttaaaaaacaatccttgttatttaaccacagactctattgtgaagttttgttttttttccaaaaaataatttcccactagttgtgatgcaacagaatttagttaacttaatgttaagcccatttttctaaaagtaaagtaatataagctcgtgggaaaaaactaaattgcagaaaattttatattttccgcattttcaccaccctgagtaatcactggtagtattttttatgtcatcttttaatgttcttttctgtgaa

SEQ ID NO: 12646 - DNA, 902 bp, Homo sapiens
aaaaatcaactgtttttggcacagtggttaagacaaagaaaggttttcatggggttatatttcagaagaggagacaggacagataatgaataagtaatatgatttcatacagtcatgagtacaatggaaaaataatgagatcagggatagacagtgattcagagatactttatgtaaatggctgtctgtaaaggaaacgtttgtgcaaagactgaacaaagtaaggaagtgagtctatgaaagatggtgaaggatgtttaagacagaacagcaagtgagaagtctctggaattaggaatcagccttttagagtgacaaaagaaagaaactttgggttgtagcagcataatgggaattgaagttagggggtaagggaggagccacagtataaaggaatgtctaggcaagtagtcagcaaactatgtcccatggagccaaatttagcccatgacctgcaaggtaaggatgatttttaaatttaagaggttgtaattaagagggaaaaaaatgacaacaaaggtcttcatgtggcccataaagcttaaaatatttactgtttgaccttttgtagaaaaagtagattaagttttattgcagcaatctgaatgagagtatagtgtggtctgtgtgtgtcaaacaggctgtagtggggtttggcacaatggaagtcaggaaaccaagtacagcctatttcattaaccctggtaagagatcagagatcatggcttggttgagagaaatgaaagcagtgagaaatgattagattaagagtaaatttttaaagttggtgtcaataagaactgctgagcaattgaattgcatatgccagaacacatggactattctccatttttagtttcaaaaggaatgtttacctatcatttttaaatctgtaggcatct

SEQ ID NO: 12647 - DNA, 735 bp, Homo sapiens
ttaatgatacgtttgagtttctgtggggtcatataattttaaatgtcatagatactaatttttataaaaactgcagagattttctttttttcttcaagagcagaaatccgcttttatttattgacttttcgttagtttaaatccttgaggggtacagcatcactcagattttgtgtccaatggtctcagcaggaagattgctttgaaatttggcacgaaccatgccactgtttccatgggcccagattactctggctttgtttagtttgccgccaggagtctctgtgttgttctttgttttatgtacataagcacatctcttgcccaaagagaattctgtttcacctcatgcgtcaacatcttcaattttaacaagagctgtgtgtttcctttggttctggagaccctgcttttagccagcagaaaaggccttgggccacagccttccagacatacttccttttagaagtcctattcccagcaggctgcagttatttgcccccaaatttcagcagcagctgcttcactccagagattttattaatgaaaacctaggctataacataaacctatgctataacaaacctatgctaatgaaaacctaggctataacattagagatgatgttaaaaatatggaattataactaggtactctaactctattactgcactaatataatccaaatattcgtaaaccaagcaggaaattaaaagattagcaccacccattttg

SEQ ID NO: 12648 - DNA, 901 bp, Homo sapiens
aaaaatcaactgtttttggcacagtggttaagacaaagaaaggttttcatggggttatatttcagaagaggagacaggacagataatgaataagtaatatgatttcatacagtcatgagtacaatggaaaaataatgagatcagggatagacagtgattcagagatactttatgtaaatggctgtctgtaaaggaaacgtttgtgcaaagactgaacaaagtaaggaagtgagtctatgaaagatggtgaaggatgtttaagacagaacagcaagtgagaagtctctggaattaggaatcagccttttagagtgacaaaagaaagaaactttgggttgtagcagcataatgggaattgaagttagggggtaagggaggagccacagtataaaggaatgtctaggcaagtagtcagcaactatgtcccatggagccaaatttagcccatgacctgcaaggtaaggatgatttttaaatttaagaggttgtaattaagagggaaaaaaatgacaacaaaggtcttcatgtggcccataaagcttaaaatatttactgtttgaccttttgtagaaaaagtagattaagttttattgcagcaatctgaatgagagtatagtgtggtctgtgtgtgtcaaacaggctgtagtggggtttggcacaatggaagtcaggaaaccaagtacagcctatttcattaaccctggtaagagatcagagatcatggcttggttgagagaaatgaaagcagtgagaaatgattagattaagagtaaatttttaaagttggtgtcaataagaactgctgagcaattgaattgcatatgccagaacacatggactattctccatttttagtttcaaaaggaatgtttacctatcatttttaaatctgtaggcatct

SEQ ID NO: 12649 - DNA, 2300 bp, Homo sapiens
ttcctaggagtgggtgtctcacaggtcacggcacctggaagaaaggtatgatcacattcattgctctgtcctccagggctctaactgggctttttggccttcttctataaggctattagccctggagacaggtatagacccaagctttcctcagagtggagaccccactgggtctggcacagggactccaggtggcttctccactcactgcttccctagtacttatatgaaaaggttttcctcagaaacatcctaatttctgactcctcttagatatctaggcaggcatctatagccaggggcctgctcccagctgttaagctaataatttgcatcattaaagggatcttggccaacacatttattttacagtctctgccagacacttctgccctattccctttctcttaggactgcataatggcctgccccactcccagcacctgagacccagatatggacccaagcctcccatacctagtattctcagactacttgagatggctcaaatgcacctctcatttgaggcaggaagacatatcttcaaaaatgaccctatgattgtgtcttttaaaaaggccaagcccaatcctcttcaaccccggctcaccctctggtgggcccacgttgggcacaacttccccaactgatgggcccttggcttcagctatcctccttgccgcaatttcctgggcaaagatgcttctcttaccagatgttgctgatttcccctgtggggcaaaaagaaaacccaggttactgatgctcatcatcccactttcctctcaacctctttatatcaaggcctctggaacaaagagataaaaggggatttgctcaatttccagggatcacaaccctagttctcagaaaaaggagaggtctataagagtaaaggtcttagactctgacagacttgggttgaagttctggctcttctacctattagatgtgtggtgttggacaagttatttatctctttggggtctcagtttcctcatatgaaaaatgggaataaggactcctcatccccaaggtatcatcatgatacctgccttatatgtttgttatgaagattaaaagaagtaatgggtatgaagtgcttagtatgatcctgctttgtaaattaaattgcttatcatcattaaaactacctgcctggagaagatgcactatgagactcacctgtctgtctcctgagcaccacctaagcttacccttgcctacctgtgtgtcccgcgagcgaaggaacacagcagggaaagcaacaccactgggcacaggcagattcacggccactgaacttgtatctcgttcctgtagcaacaaagcacaaagttgtgaagcacaatggagaaacttccccaggctggacccgatcctattagcccagttctgaacgatgagaacctcactctggggggttacggaccctcctcccttcagggcagtgattctaacccagcccccatcctgacctcaggggtaaaagtctacctttctgaagcaccctccactgataagcctcacccaccccgagcatccaatatccctgttgccctagaacatcttatcctactcagccagagtgagacgcacaataatcttagtcaagacagcagtgatgtgctgatcatgcctcctcagcctctcttctgggtcctcatcctcaggcaggcagtggccagggctgggcctggctctctttggaggagaagggaccaaagctgggggcaaatctgggagatctgagaaagaaaagatcccaaacgtgagtatatgcacaccttcctaggaagacactgcaggctagggaagaaagacagctgccatggggccctggctcaagctgtgtcatcttgggtaagatatttaacctctttgagcctcattttcttcctctgtaaaatggggctgcagaaacacaggctatgcagtgtctgaaataataatgatgtgtctgaatccaaccacaacaggaagagggaggggcccgaggctgtaccctctctacttctcagcctcacatccatgggaactcactgtccaacatcaccacatcccgatggtcctggagcggaggccggtctgagttggcatcaccaccgcccctatttcctttcttcaccaactgcactgctggggctgcaccagctgcgagaaactgactctggaagtgcagcaggtccacctcggactcccctggcttcggtctcgacagcatcttgctgctccagctgcctccccagtacgactctctccagcagtgtctccgtgtgggggttccctcttattcatcc

SEQ ID NO: 12650 - DNA, 2300 bp, Homo sapiens
ttcctaggagtgggtgtctcacaggtcacggcacctggaagaaaggtatgatcacattcattgctctgtcctccagggctctaactgggctttttggccttcttctataaggctattagccctggagacaggtatagacccaaactttcctcagagtggagaccccactgggtctggcacagggactccaggtggcttctccactcactgcttccgtagtacttatatgaaaaaggtttcctcagaaacatcctaatttctgactcctcttagatatctaggcaggcatctatagccaggggcctgctcccagctgttaagctaataatttgcatcataaaagggatcttggccaacacatttattttacagtctctggcagacacttctgccctattccctttctcttaggactgcataatggcctggcccaattccagcacctgagaaccagatatgggccaaggctcccatgaccttgtattctcagactacttgagatgggcaaatgcacctctcatttgaggcagggagacatttcttcaaaaatggccctatgattgtgtcttttaaaaaggccaagcccaatcctcttcaaccccggctcaccctctggtgggcccacgttgggcacaacttccccaactgatgggcccttggcttcagctatcctccttgccgcaatttcctgggcaaagatgcttctcttaccagatgttgctgatttcccctgtggggcaaaaagaaaacccaggttactgatgctcatcatcccactttcctctcaacctctttatatcaaggcctctggaacaaagagataaaaggggatttgctcaatttccagggatcacaaccctagttctcagaaaaaggagaggtctataagagtaaaggtcttagactctgacagacttgggttgaagttctggctcttctacctattagatgtgtggtgttggacaagttatttatctctttggggtctcagtttcctcatatgaaaaatgggaataaggactcctcatccccaaggtatcatcatgatacctgccttatatgtttgttatgaagattaaaagaagtaatgggtatgaagtgcttagtatgatcctgctttgtaaattaaattgcttatcatcattaaaactacctgcctggagaagatgcactatgagactcacctgtctgtctcctgagcaccacctaagcttacccttgcctacctgtgtgtcccgcgagcgaaggaacacagcagggaaagcaacaccactgggcacaggcagattcacggccactgaacttgtatctcgttcctgtagcaacaaagcacaaagttgtgaagcacaatggagaaacttccccaggctggacccgatcctattagcccagttctgaacgatgagaacctcactctggggggttacggaccctcctcccttcagggcagtgattctaacccagcccccaacctgacctcaggggtaaaagtctacctttctgaagcaccctccactgataagcctcacccaccccgagcatccaatatccctgttgccctagaacatcttatcctactcagccagagtgagacgcacaataatcttagtcaagacagcagtgatgtgctgatcatgcctcctcagcctctcttctgggtcctcatcctcaggcaggcagtggccagggctgggcctggctctctttggaggagaagggaccaaagctgggggcaaatctgggagatctgagaaagaaaagatcccaaacgtgagtatatgcacaccttcctaggaagacactgcaggctagggaagaaagacagctgccatggggccctggctcaagctgtgtcatcttgggtaagatatttaacctctttgagcctcattttcttcctctgtaaaatggggctgcagaaacacaggctatgcagtgtctgaaataataatgatgtgtctgaatccaaccacaacaggaagagggaggggcccgaggctgtaccctctctacttctcagcctcacatccatgggaactcactgtccaacatcaccacatcccgatggtcctggagccggaggccggtctgagttggcatcaccaccgcccctatttcctttcttcaccaactgcactgctggggctgcaccagctgcgagaaactgactctggaagtgcagcaggtccacctcggactcccctggcttcggtctcaacagcatcttgctgctccagctgcctccccagtacgactctctccagcagtgtctccgtgtgggggttccctcttattcatcc

SEQ ID NO: 12651 - DNA, 540 bp, Homo sapiens
ggtgaaaccccatctctactaaaaatacaaaaaattagctgggcattgtggtgggcgcctgtaatcccagctacctgggaggctgagacaggagaatcgcttgaacctgggagatggaggttgctgtgagccgagattgcaccattgcactccagcctgggcaacaagagtaaaactccgtctcaaaaaaaaaaaaaaaattgtatgtctatgcactagcaaagaacatgcagaaaatggaattaagaaaacaattgcattggccggatgcggtggctcacgcctgtaatcccagcactttgggaggccaaggcgtgtggattatgaggtcaggagatcaagaccatcctggctaacacggtgaaaccccgtctctactaaaaatataaaaaactagccgggcgtggtggcgggcacctgtattcccagctactcgggaggctgaggcaggagaatggcgtgaacccgggaggcggagcttgcagtgatctgagatggagccactgcactccagcttgggcgacagagtgagactctgtc

SEQ ID NO: 12652 - DNA, 501 bp, Homo sapiens
tttttttttttttttttgagacattctctgttgcccaggctggagtgcagtggagtgatggagtgatctcggctcactgcaacttctgcgtcccaggttaaaccggttctcctgcctcagcctgccgagtagttgggattacaggtgtgtgccaccacgcctggctaatttttgtatttttaatagagacggggttcaccatattggccaggatggtctcgaactcctgacttcgtgatacgcctaccttggcatcccaaagtgctgggattacaggcatgagccacagtgcccggctaatgattttgagcatagaatacggttaagccaggtttatccccctcttccctggctgggcctgactcctaagccttttcacatctggcagaagccctcccactcattcttatccttcctccaagcttgggaccttgagcaaggctgaggtgtttgatttggccagaagagcagaactgaaggtgtctagggggagcctacccc

SEQ ID NO: 12653 - DNA, 300 bp, Homo sapiens
tactattttttttgagatggagtctcgctctgtcgcccaggctggagtgcagtggcatgatctccgctcactgcaagtccgcctcctgggttcacgccattctcctgcctcagcctcccaagtagctgggactacaggcgcccgtcaccacgcccggctaatttttctatatttttggtagagacagggtttcactgtgttagccaggatggtctcgatctcctgacctcatgatctgcccgcctcggcctcccaaggtgctgggattacaggcgtgagcctccgtgcccggccgtaagc

SEQ ID NO: 12654 - DNA, 10024 bp, Homo sapiens
caaccagagcatatccctgcgccggcctcgcctcgcttctcagtatgtatggcttctacttctgtgaggcatatttcctttgagttttagcattgggtagcatgtaagctaaaaagctatcaggttgaaccaaatgaaattgccaatactcagccatttttcacctacaaaaaaacagtaataagcagcaattccatatgatacaacctatgactgtctaaatgagcacatagagtaaatgtcatcagtgcataacctagtaatttggcactaaagatccactgtctggaggaaaaggttgttggagagtgatttattaatacttgactcttctgtgtgttgtgtatgcaaataatttttatgttataaactttaggaatcctgccatctatgccttgaccaaatgacttaatttctgttttctgcccccatctgtaaattgaaattaatatggttcttgcttatagggaggttaagtggattatattcattattacatagaacttggaccagttccctcacagaaagagcctactaagaataaactattactatttttatcttcttattaaatacctacaacaatatttttatcagtcattgactacgtatgttgctaaaagttaccataaatgtacagtatatggtgactgcatatgaaatttagagacaatagatagcacagtagattggaatgaaggaggcttaggttgaggatgaacggttttctaaaggataagggagtgaatagactagagacacagtaaagaacataaaggtagaaatgaagtgcagaaagaaaaaccatgtgactagaattatagtaagaataattttgctgaatagatgaagtatgattgtaaaaggctgaaaatgcaaacttgatcttgtaggcaggaatgagtcacagataattttttttttttgagatggagtctcgctctgttgcccaggctggagtgcagtggtgcaatctccactcactgcaagctgcacctcctgggttcacgccattctcctgcctcagcctcccgagtagctgggactacaggcgtccgctaccacacgcagctaattttttgtgtttttggtagagatggggtttcaccatgttagccaggatggtctcgatctcctgacctcgtgatccgcccgcattggcctcccaaagtgctggcattacaggcatgagccaccgcacccagccacgagtcacagagaatttttctgtagaagaatgacattgtgaaagtagtatcctaggaagttttaatagcactgtgtaagatatattaggcaagggaaaaactgaaggccagaaagccagatgaaaagctatgcagtacttcaatgtatggggcagtgaaaattcagatcaggatgcttactgttggaccagaaggaacataaggagatgttttgaaggaagtaagaaacaggaggtagtatcagtaactcattggatatagaggagtagagtagaacctgctgaactttaaatagagatttggaagttctctgaagaaggcagagaaaagcagagagcagggaactgagtcttaatccctggctcaaccatagtagccagggaacaaacacagacaagagaaaaaaagaaaataaacaaaagaggtaggaatagtcagggaggtaataggaagagcatcaaaacaaagcatggttggtgctgtgatcccaaggaagcagagtttgaagaagctggggcaggggagcactgagtgggtcagtgagataagtgccacaaagggctggaagaaaatgctaagtgtgattggtgacctcattgagctcctgattttgaagtctaattatccttgttagttaccagcagagggcaatctaaacatatactatttctgcttaaagaaggggctctttggcaatagattattctgttccatttcaggtgtttaacggagaaactctgggaaaccagattgcaccaagagtaagacattaggaatggaacagttggtgtacagcggagagagcagggaatccaaaataagatctgagtttcagtactgactttatcactcatgcaacctttagcatatccttaatgtgtgtggtttttttgtttgtttgtttttttgaaacagtatctcgctccgttgcccaggttggctcaatgcagcagcacgatcatgactcactgcagcttcaacctcctgggttcaagcactcctcccacctcagcctcccaagtagttggcactacacgcctgcacccctctgcccagctaattttttattttttatagagacagggtcttactatgttgcccaggctagtctcaaactcctagcctgaagaagtcttccctccttggcctcccaaagtgctgggattacaggcaagagccaccacactcagccacctgattttattgttggtatttatagtggtaaatggtttatgttgggctgaaatgtgcttcactgtaatttcactataactttaacaatttgatcctatttgggctctctcacataacttataatgagtctcctccctcttctgcattgtatgttgtcaactctttgaagagaaataactgttatgcctctccttaggtcttctcttctgctggctaactcttttggtttctcatgtatgcctcaagtggtgttttatcttatcctcatcatccttatcacaatttcttatatttgttttttgggggttggttgtttttttttggagacatggtctcagtctgtcacctaggctggagtgcagtggtgtgatcataccttactgcagccttgaactcctgggctgaaatgatcctccttcctcagcttcctgagtagctggggctacaggtttgcactatcatacctggctttttttttttttttttttttttaagacagggtctcactgtgatgctcagactggtctcaaactgccgggctaaggcgatcctcttatgtcagcctcccaaggagctgggattacaggaaccagccagtttcttaagtttgtttaatgcttttttcatccatgttctcacttgatatgcatactgtctccatgaggtgaaagtggtattcagtgaaatcggtgttaccattcctgccttacagagatggaaacgggcactcaaagggttaaatagatgcatcataaaatcaaagtcaggtggccaggtgcagtgactcacacctgtaaacctaacactttgggaggccaaggcgggcagattacctgaggtcaggagtttgagaccagcctggccaacatggtgaaagcccatctctactaaaaatacaaaacttcgccaagcgtggtggcacatgcctgtaatcccagctactcaggaggctgaggcaggagaattgcttgagcctgggaaacggaggttgcagtgagctgagattatgccactgcactccagcctggcgacagagcgagactctgtctcaaaaaaaaaaaaaaaaatcaaagtcagtactcaaacccagatcactaccttctgcgttgcacataccctgccattgttcttgttaccttcctctggttgtgatctagtttcttagtgtttttccaatagtatctgaaattgaataggaaactctagaataatccgtctggtacagcagatagtccctgtttaggatgtatgtttaatgatggtaagactggaaatgtgtctaatactgtgaaagtgtttatatttgggtaatggactaagtgctttttgtcccccttgttaccactagatccaaggctcgtgacactaaggtattgatagaagacacagatgatgaagctaacacttgaattttctgaagtctagcttaacatctttggttttcctactctacaatcctttcctcgaccaacgcaacctctagtacctttccagccgaaaacaggagaaaacacataacacattttccgagctcttccggatcggatcctatggactccaaacaagctcactgtgtttcttttcttttcttctggtttaattttaattttctattttcaaaacaaatatttacttcatttgccaatcagaggatgttttaagaaacaaaacatagtatcttatggattgtttacaatcacaaggacatagatacctatcaggatgaagaacaggcattgcaaggaccctctgatgggacggtactgagatatctcggcttccgctcagcccggttttgactggttgaaaccggacattggtttttaaattttttgtcagtttatgtggagaatttttttctttccttcatacccagcgcaaaggcactggccgcacttgcaggaaaagtgcaacttaaagcagtaccttcattcatgaagctactttttaatttgatgtaacttttcttattttgggaagggttgctgggtgggtgggaaatatgatgtatttgttacacatagttttctcattatttatgaaacttaaccatacagaatgatataactcctgtgcaatgaaggtgataacagtaaaagaaggcaggggaaacttacgttggatgacatttatgagggtcagtcccacatacctctttcaggagacaacttgcaccagtttgaccttttcttttctttgtttttattttaagccaaagtttcattgctaacttcttaagttgctgctgctttagagtcctgagcatatctctcataacaaggaatcccacacttcacaccaccggctgaatttcatggaagaggttctgataatttttttaactttttaaggaacagatgtggaatacactggcccatatttcaaccttaacagctgaagctatgccttattatgcatccacatgtatggtccctgtagcgtgacctttactagctctgaatcagaagacagagctatttcagaggctctgtgtgccctcactagatagtttttcttctgggttcaaccactttagccagaatttgatcaaattaaaagtctgtcatggggaaactatatttttgagcacatggaacaaattatacttcctcattcatattatgttgatacaaaagaccttggcagccatttctcccagcagttttaaaggatgaacattggatttcatgccatcccatagaaaacctgttttaaaattttagggatctttacttggtcatacatgaaaagtacactgcttagaaattatagactattatgatctgtccacagtgcccattgtcacttctttgtctcatttcttccctttgttccttagtcatccaaataagcctgaaaaccataagagatattactttattgaatatggttggcattaaatttagcatttcattatctaacaaaattaatataaattccaggacatggtaaaatgtgttttaataacccccagacccaaatgaaaatttcaaagtcaataccagcagattcatgaaagtaaatttagtcctataattttcagcttaattataaacaaaggaacaaataagtggaagggcagctattaccattcgcttagtcaaaacattcggttactgccctttaatacactcctatcatcagcacttccaccatgtattacaagtcttgacccatccctgtcgtaactccagtaaaagttactgttactagaaaatttttatcaattaactgacaaatagtttctttttaaagtagtttcttccatctttattctgactagcttccaaaatgtgttccctttttgaatcgaggtttttttgttttgttttgttttctgaaaaaatcatacaactttgtgcttctattgcttttttgtgttttgttaagcatgtcccttggcccaaatggaagaggaaatgtttaattaatgctttttagtttaaataaattgaatcatttataataatcagtgttaacaatttagtgacccttggtaggttaaaggttgcattatttatacttgagatttttttcccctaactattctgttttttgtactttaaaactatgggggaaatatcactggtctgtcaagaaacagcagtaattattactgagttaaattgaaaagtccagtggaccaggcatttcttatataaataaaattggtggtactaatgtgtatccagagacatttgaattattaactttattctttattagtgaatctctatgatggcacacataaaatcttacagttgacttctgctgtttgaattccccagtgtttttacattaatgtatcctatggccagtttagtctttcttcaactgttacagttctaggccctaatcggtcttattctttcacatatgatgcaatgatagatgtaatccttttctgaagtgtttgtcggattggcatagtctattcaaaaataaggcttatgtaactttcagcttgctatgtgacagaagtttaaatgtgtatttaagtacacagctttatgttcctcttaaagctgtaaagagaaaagaggacttttcctcatcaagagagcttgggagacaaagcatacatttaatttttttctttcaaaaaaggcaatgtgcactttcctctcctaaattttatatgccctagcagttgcgaatgttgtgtccaccttacaatttgattggaggctcccatacactgaaactctcaatagaattcttaaaaatgaacatcagctgggcgcagtggctcacgtctgtaatcccagcactttgggaggccaaggtgggcagatcacgagctcaggagttcgagaccagcctgaccaacatggtgaaaccccgtctctactaaaaatacaaaaattagctgggcgtggtggcgcatgcctgtaatcccagctactcaggagactgaggcaggagaattgcttaaacctgggaagcagaggttgcagtgagactagatcatgccactgcactccactgccactgcctgggcaacagagcaagactccatctcaaaaacaaacaaaaaaaatcacagactcattttaaaggagcagcaacctaaccaaatacaaacttcatttgattttaggtttagaaattctagttttattttggagaatcactcagtttttaatatcaattaaaatagtcctcaaaggaatgaagaggaagtctaaataaatgaataaaactcatttttcattttatggtagtatagaaagcattgatgtgtgtagagaaattaaaagacaagagtggtttactgtctatgcacaaatgagtgcctatatttaaggctgcctataccattacagtggcgtaattggtgatttcatagcatacagagaaacaatgaaatcaaagattaaatcattaggttatgatggtcatttgtaagattggaaagtagtcaaaaacccatgtgcaactttttttcagcactctaccattaggctccttaggcaagctgcttaacttccgtcagaagcaaaggtgtgggagaacaccattcacctcagtagtaacttataaaaaccgtttaaagaaggaaaatgggccccagcccctaggatccctgacttcctgatattctaaacatgagagttctgtgactttaactgagctctttaccagaagtaacgtgttgatgtatattatctttccaccatgctttgaccaaagtacattcacagtaactagagaaagcagatcatccatttctggataggtgaactacggcaaggtaagaacagaaaaaagtaaagtagtattgagtcatgcaggtatcagattaacagacattcattgaagataagtgaaataactttggagatagcagagaagagcaagaagatgttggacgttggcagtaagccgcagcaaggcagttaggaaagtacgtgagcctgatgacgcgaaggtgatgcctccatctgtccgcttagtggttattaaattgctgggaaagacctgcctttattttcctatcatcttttccccattactttgcattattcaggaaataattatttattcccaaatgcagttttctaagcagtgaccacaaaaatttcttattctaaggaaaataattaagaaaataaccctatctgtggcattgttttaaaatgtgggatacaaatctggtaagcagatttcaggtcattattgttttcttttaatggtttacatgaaattttcctctcaaaaaacaagtacctcttactgtataacatttgagtttttaaaattgagatagcttctgagagaaaaaaagaaagttgaatttgtagctctctcaactacaaaatcaccacacttttctcaaatctaataggaattcagtgtcattacagatacggtctctagtgaccaggtgaagacaattgaagctttggtagaacttctgcaaaagttaggtaaagaagaataaatccaatttatcagctttgttcatattctttttctgagtgatctaaatttttcttgcttgtgatcattagctaagacaaggagtgttaaaggttttctaaatgcaaacacatacgtttctgcatttcagaagtcagtcttgatagtaaatcctacaaactctcaactttctgcattgtattttaagtctatacaatgttagagcacatggtaatgtgggacagagttgattatatgatagcatgagaaatttgcactggttggtgttacaaaccaatgatctaaccagcatactctccaaatatgaaaaagtaaaaacatctcattaggtttggaagagcctaaggtagtccatacaggaagtttgcctgagaacagagaggagcctgttgattggcatggctcatgatgcctttcttgtatgaattatcaaaactgatactgagttgcccctagaaaacagccttccagaatatgtttgcttatttatggtggaagaggaagtgagaacaagatgagagtttcccttaaagtgaggagaatcattatacaactttgcaactgaagtatgtttccttgtagcaaacctttggtttattttatcgtcaaatcaaagccaccctcagttttttgtatggtgccatcaacctaaggaggacaatcaaataacctattgtttgccttggattcagtatatctactaagtacacagtctcgtataccttcaaaccagttacttgactaaacttccaccatattaccttagttcttcctatgccctttcctctgtgccaccacaaatcagagggaaagactgcagtacttctagaaagttgtggacttctaagaaagagccaggcttccatctcactatcccttgatcattatctctgaagtccctacctgcacttccctgattgccctgtagcaacaccagcatggtgggaattggagggaaagattgtggaaaatccctaaagggtcattgttcatgacgttattttgaattgtaaaattgtgagccactcacatttcaattacaaaaagaacagaactcttaatcacgttgtgaagattaatttcttgccattttctggattagcacagaagcttgtatcaatgaagagtatttaggaggggaatagggggaaaattgtatttttctgttcaaactctctccttctatttgtgtttccttcacccctctccctccaccacactgtgttggtcaaatgatactattctatgaaaccctgagctatagttgtcaaaagtaactatggattgtgattagtcctctgtgggtgcttccttccctcttttttctccctcactctctttctcagtctccactctggtaaatggaaaaggtgatgtcgaagaattgatgcttgcttggactcatgttgtatctgtgactatgctattagctgtctcctttttccttcctatatgggtagaattcttatgacttatgaagttcccttcttgataagtaggttaaatgcacaatgtggtactgttttatagtttctagatggttgtataaagcaaaaagttaatgtggttatgtgtttttaaagaaaataagtgattggtcactaaactctgtccttttttcattattacaatttctctctgttttccaacagtttgctgactcctttgtcactggtgaa

SEQ ID NO: 12655 - DNA, 188 bp, Homo sapiens
gtgtccaattacattttggagaggtggacactgctatcactgcatacccatgccctgtgagggaacataggacttttctgcagaattcctggactaattattattccttatatatatctaggaaagattacaaaattaactgaccctaagatgaatatacccacaatgcaaagggaaaaataatttat

SEQ ID NO: 12656 - DNA, 2068 bp, Homo sapiens
acagtgaaagtcagaaattattaaaatgaaatctttaatgtgctgaaagaaaataactgcttacctagactctgcccagtgtagatatctttcacaaataagacgatataaagatattttcagataggtgtataacattcgtctaagtcaagatcgacaaacactgcctgttaaaataagacagaagctggaaacggaagataaacctgagagagaaagcatgactctggaatccacctgccatcagagctctctccagaccagtgctccttcccttcctcaccttcctgaatgcctcggcctggcacctgaactccccatcgctgctgccaccttcccccacccacttctttctctttcatgtgtgctacttcatcaattttttaaaagaaattctagtaaaaaaagaaaaatacctcatgacgattttctttttaaaatcatttgcttactaactaaatcaaatgttctatcccatttaaaacaaacaaaaaaaccatctttagatcagctttctctctccaactactgcccatctttctgctgtcctttatagcaaaactcttcaagaggcgtctgcacttgctgtctccactctcacttctctcccattctctttttcattcaagtatgtattcccaatactcaaactaaaccacttttgttaataatctataataataatattgtagtgcctactatgtagctgacagcgttctaagccttttacctttattaaatcctcacaacaatcttaggaagtaggtgctgttatcatgtcttttactgatgacactgaagcataggttaagtaactcatccaaggtcattacagctagcaagtggtagagccatgatttgaatctagacagtctcccagagcctgtgcttttagatcgtactgcccattttgctaaatccccttgtcagttctctgtacttatttaccttactttacttcccagcaaagcactttcttcacttgacttctcagaaactacagtctcctgtctcactagctattccttgtccactcctttactggttcttcctcctccccccaaacttttaagtgttagagtgttccaggatttaatcttctgccctcttgtctcctctagttgtattattcctaaacctattatgtgaaatactgtctttatgctatctccagccataaactttcccttgaactgcagactctcgtccacctctctactgaattctcccatatctaatgattagctctaacctaacaggaacagccctgcatctctgatcttagtaaatggtgtcacctttcccttagaccaaaaaccctaagacgactcacatcgcatgtcagtaagtcctgtcagctccatctttataaataaatcctttgtctgtctgcttctcatcacttctgttattaccacctttaagtcaccatcatctcttttctggactgctgcaacagcccttctaattggtctgtcttcagctgttcttgtctccctttgatctcttcaccattcagcaggacctttttcaaacaaatcacttcattctcctgttgttctctcattgttctccattagacctaaaatttaaactatgggttataaggccctctgtgggtgggccctcttccacccctccatcattatctcctgctattttaacctcacttattcttagcccccactgaccttgctgttgtttccaacttgcctttttatacttgccattttcctctgcctgggatgctttcctccaggatttttacatgacttgcttctttgtatcagtcaggttttcaatagctgccatgtcttcaaagaagctttccctaaccagtcttaatgatggcatactctattcccttgtcctgctttattttcttcacagtagttatcattagccgattgattgtttacttgctcattgtctgtctccaccactagaaattacaccccataagggcaaaaaggctttgagtcattctgtgcctttactgccttatggcagacattcagtaaatatttgtcaaataagttgaaagaatgagcactctaaaactgcattg

SEQ ID NO: 12657 - DNA, 4045 bp, Homo sapiens
tgtcacccaggctggagtgcaatggcatgatctcggctcactgcaacctctgcctcccagattcaagcgattctcctgcctcagcctcccaagtagctgggattacaggcatgcatcaccacacccagctaattttctatttttagtagagacagggttttgccatgttggtcaggctggtcttgaactcctgacctcaggtgatccacccgcctcagcctcccaaagtgctgggattacaggcatgagccactgcgcccagccgggatgtgcacacttctatgcatacacatacacctggcacagacaagcacacgtactgccacgttcatggtgtgaatccctggaaataagggtgccgtcaggggaccagcaagtgcatggtatggtctccattcctgggtgcattgatgtggcctgccatgccctgctgggttgaggtgggcctgttctgtctgctctgagtcctggctgggtcagtctttccaggagtgtggggatacggtttctatcaggcatgcccaacatatccccctggtcttggatcagcagggcaggctggcaggaatgcctacctcagagcccctaagcagggtttaggtcagtgacctctccactccccaccctggccagcggtcctccagcaacgatgccaaggatgcttatttgtttgtttgtttatttatttattattatttttttgagatggagtcttactctgtcgcccaggctggagtgcagtggtgcgatctcagctcactgcaacctccgcctcccaggttcaagtgattgtcctgcctcagcctcccaggtggctgggattacaggtgtgtgccaccatgcccagctaatttttgtatttttagtggaggcggggtttcaccatgttgcccaggctggtctcaaactcctgatctcaggggatccgcccaccttagcttcccaaagtgctgggattacaggcgtgagccaccgcgcccagccccaaggatgctttcttaggtcaaaagggcaagcattgttgctgccctgtggccaggcaaacaagctgctggctttgaagtcacaggggatttgctcaggctggagttgggagtctgaaggagaggcctccatgccttcctgaagcctcactgcgtttattaactccacctgcctacccgggcctggtgtgtttgatgtctcgggagaagcaggaggagggaggcatgctctgggggtcctccgagggacatctttcagcccctgctgagcctgccatcccacctggtctgaacagaaggaaaaccaggcccaagtccagaagggctagtgacaggcctgtagtgaaggggacacctagtccccctcccttcaaggtagtttacaggagtgtgttccagggccagttggagagcaggctgcttcccttggtcattgtctttattcaggtggcatccggtgagaatgaaagtcaagggaagacttgaagagagaaagaggcatccagaggcagcactggtgccttaaggggccacagcaggtctctccactttgccctgaggtccccaatcacgcctctgccaggtgcctccccaactcctgccccatgcttcaccccttctccccaccaaagcagcatgagtgggcaatttgccatttcccagcgacagctcagaagccttaggtaatgaccagagacattccccacccaccccctactcacactcaataaaatgcactgatgaggaatccatggagtggggaagaaagttctagagagcaggagcctgcgtaaaacaatgctcgcctctctgggcttgccttgccccaggatttcactatgttccaaatcatgttttattacctttcagggttgggccatgggaatgggataagaagcaaagcattattattaaccagttccatgtcccatacaatattagccatgaatagctccatctctcccccacaatttccctatcagccacattctaatgccccccacccccaacaccgctctctagtctgtctgtctgcctgctccccctgcccctgacatgttgcaattcagaaagagcttgtttatgataagaccttgaaatctggagttataaatcctgcccagggcggccgccctatctctgtgctaatgcttgtggtgccaaaaggaggctcacctggttgtgacccagtccctcttactccctgaggagttccctgctcctcctctgcaaacacaggacaatgggcaaatgggagttacctgttccaacaggtgttagctgggcctcactttcctacagggtgatgagaaggtcaccctctggcccgcccacgctgggcattcctgtgactgtgaaagcccaccttcgaacatgaccctccctctcccccaccctcccatgacttcagctacaggagactgagcccacctcaatggctttaaaagtccccacttgaagcttctgagtctaccaactagagagcaggcagcacctgcactggctggagggcccttgtgctgcctctttattctgtacaggcctctgtcattgtgtttacaccatattgcagttggcagttgttagccttccctactaagctatgggccccttaagggaagacactgtttctgattcatcattgaattcctaggcccaaaagactgcacagaacataaatatttgttaaatgactaggtgaatggtgtcatcattaccagcacatatttcttcagggtatcttatgtgcagcgaacctgctaagcagtagggatacaaagattaattggacaccattcccactctcaggggcttatgctggagtcggggagacccactgaagcttcacttccctagaggtcagaggaagagctggatctggggaccccaggaagctgctttgacaaccagaggcctagggtcttgggaaagtttgcccagagtgaacttaccacagatgccagagactcagatacctactcaccattggtcttggtacattccagagtggaggtgataacttgccaactaacagcatgtggagacttttcctttgtgacttgtatcctcctctcaacaatgggaataaaagtaatttctagtatcttcacttggaatggatttttcagccctttagctctgggaagaaaagaagtgaaactggcccccactgggccctagctggagctgtgcttgttagctctgccccataccatttggtttaggctgcctgtggatttgaggccacagctgcctccaccctcaggaggaaggaacgaggaggtccaggcatctgtctggagttcagttcatcccaacacacattaattgaatgcctcatctgtgccaagcatgctggacagtgggaatagagaaattaacatcgtgggtgtagctcctcctttcagacagggactgatatctctgagaacctgtgggaagaaggacaaccagttgatctcttggggactgagagtcagcccacatgatatgagaggctgttgcatcccaatgccattgtctcatggaggggacctttactgtgtggagtgggggcctagcagtgtatgtgtgggcagtgtggtgcagtgtccatgggtggtgttttctgtgtggctgtttgcagtcagcgcttttgaagcttttcatgtgaagtaccattagtggcagagagtgaattcacacttcacaaggggcatggggttttagatcactgcacacagaaactttcttcgaagccccatgttttgtcttaaaagtatgtttaggctgcgcatggtggctcacgcctgtaatcccagcactttgggaggccaaggcaggtggatcacgaggtcaggagattgagaccatcctggctaacacggtgaaaccccgtctctactaaaaatacaaaaaattagctgggtgtggtggcgggcgcctgtagtcccagctagtcgggaggctgaggcaggagaatggcgtgaacccgggaggcggagcttgcagtgagccgacattgcgccattgcactctaacctgggcaacacagcaagactccgtctcaaaaaaaaaaaaaa

SEQ ID NO: 12658 - DNA, 1052 bp, Homo sapiens
tcacgcctgtaatcccagcactttgggaggccgaggcaggtggatcacgaggtaaggagatcgagaccatcctggctaacacggtgaaaccccgtctctactaaaaatacaaaaaattagccgggcatggtggcaggcgcctgtggtcccagttacccaggaggctgaggcaggagaatggcgtgaacccgggaggcggagcttgcagtgagccgagatcgagccactgcactccagcctgggcaacagagctagactccgtctcaaaaaaaaaaaaaaattattgtttatatttgagatgagaattcttgatacattttttggtatattaaaaagtgagataaattgtttgtgctttaacatgtaaattgcatcgtagattcataaaattcatcttggatttatttctagcacagtactttctattgaaagcagtttactatcaagaaaatctatcaaaggggatggaatcccattcttcattttcatgaattgttttaaaaagtgttcttctggccagggtcggtggctcacacctgtaatcccagcactttgggaggtcgaggtgggtggatcacgaggtcaggagatcgagaccatcctggccaacatggtgaaacctcgtctctgctaaaaatacaaaaatttgctgggtgtgaccgcacgtgactgtaatcccagctactcgggaggctgaggcaggagaatcgcttgaacctgggaggcggaggctgcagtgaaccaagatcgtgccgctgcactccagcctggcaacagagccagactccgtctggaaaaaaaaacaaaacaaaaaacaatgccgggcgcggtggctcacgcctgtaatcccagcactttgggaggccgaggcaggcggatcacgaggtcaggagatcgagaccatcctggctaacacggtgaaaccctgtctctactaaaaatacaaaaaattagccgggcgtggtggcaggcgcctgtagtcccagctactcgggaggctgaggcaggagaatggcatgaacccgggaggcggaacttgcagtgagccgaga

SEQ ID NO: 12659 - DNA, 300 bp, Homo sapiens
agcgcggtggctcacgcttgtaatcccagcactttgggaggccaaggcgggaggatcatgaggtcaggagatccggaccatcctggctaacatggtgaaaccccgtctctactaaaaatacaaaaaaattagccaggcgtggtggctggcgcctgtagtcccagctactcgggaggctgaggcaggagaatggcgtgaacccgggaggcggagcttgcagtgagccgagatcgcgccactgcactccagcctgggcgacagagcaagactccgtctcaaaaaaaaaaaaaaagtgcaaac

SEQ ID NO: 12660 - DNA, 184 bp, Homo sapiens; identical to SEQ ID NO: 11836

SEQ ID NO: 12661 - DNA, 235 bp, Homo sapiens; identical to SEQ ID NO: 11838
  misc_feature (230)..(230): n equals a,t,g, or c

SEQ ID NO: 12662 - DNA, 175 bp, Homo sapiens; identical to SEQ ID NO: 11635

SEQ ID NO: 12663 - DNA, 296 bp, Homo sapiens
gggtgcggtggctcatgcctgtaatcccagcactttgggaggccaaggcaggcggatcacgaggtcaggagatcaagaccatcctggctaacacggtgaaaccccgtctctactaaaaatacaaaaaattagctgggtgtggtggtgggtgcctgtagtcccagctactcgggaggctgaggcaggagaatggcatgaacccgggaggcagagcttacagtgagcctagattgcgccactgcactccagcctgggcaacagagcgagactccatctcaaaaaaaaaaaaaaaaagg

SEQ ID NO: 12664 - DNA, 150 bp, Homo sapiens
  misc_feature (21)..(21): n equals a,t,g, or c
ctgtagtcccagctattcggnaggctggggcaggagaatggcgtgaacccgggaggcggagcttgcagtgagccgagatcgcgccactgcactctagcctgggcgacagagcgagactccgtctcaaaaaaaaaaaaaaaaaaacaactt

SEQ ID NO: 12665 - DNA, 267 bp, Homo sapiens; identical to SEQ ID NO: 11850

SEQ ID NO: 12666 - DNA, 246 bp, Homo sapiens; identical to SEQ ID NO: 11851

SEQ ID NO: 12667 - DNA, 193 bp, Homo sapiens; identical to SEQ ID NO: 11643

SEQ ID NO: 12668 - DNA, 294 bp, Homo sapiens
ctgctgggtgcggtggctcacgcctgtaatcccagcactttgggaggccagagcgggtggatcacgaggtcaggagatggagaccatcctgactaacatggtgaaaccccgtctctactaagaatacaaaaaattagctgggcgtgttggcgggcacctgtagtcccagctactcaggaggctgaggcaggagaatggcgtgaacccgggaggcggagcttgcagtgagccgagatcgcaccactgcactccagcctgggcgacagagcaagactctgtctcaaaaaaaaaaaa

SEQ ID NO: 12669 - DNA, 187 bp, Homo sapiens; identical to SEQ ID NO: 11645

SEQ ID NO: 12670 - DNA, 246 bp, Homo sapiens; identical to SEQ ID NO: 11858

SEQ ID NO: 12671 - DNA, 153 bp, Homo sapiens; identical to SEQ ID NO: 11649

SEQ ID NO: 12672 - DNA, 280 bp, Homo sapiens
cggatcacgaggtcaggagatcgagaccatcctggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcttgggcgacagagcgagactccgtctcaaaaaaaaaaaaataaataaaaaaaaaaaaaaaaaaaaaaaaaagaaaagaaaaa

SEQ ID NO: 12673 - DNA, 2364 bp, Homo sapiens; identical to SEQ ID NO: 11271

SEQ ID NO: 12674 - DNA, 261 bp, Homo sapiens
ggatagtgaggtcaggagatcgagaccatcctggctaacacggtgaaaccccctctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaagaaaaagggataaaa

SEQ ID NO: 12675 - DNA, 193 bp, Homo sapiens; identical to SEQ ID NO: 11654

SEQ ID NO: 12676 - DNA, 310 bp, Homo sapiens
ggacgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggaggttgcagtgagccgagatcccgccactgcactccagcctgggcgacagagcgagactccgtctcaaaaaaaaaaaaaaaaaaaaaaaaaaaat

SEQ ID NO: 12677 - DNA, 279 bp, Homo sapiens; identical to SEQ ID NO: 11658

SEQ ID NO: 12678 - DNA, 320 bp, Homo sapiens
atggtggctcacgcctgtaatcccagcactttgggaggccgaggcgggcggatcacgaggtcaggagattgagaccatcctggctaacacggtgaaaccccgtctctactaaaaatacaaaaaaattagccgggcgtggtggcgggcacctgtagtcccagctactcaggaggctgagacaggagaatggcgtgaacccgggaggcagagcttgcagtgagccgagattgcaccactgcactccagcctgggcaacagagcaagactccgtctcaaaaaaaaaaaagaaaaaagaaaagaaaagaaaagaaaacgaagtc

SEQ ID NO: 12679 - DNA, 300 bp, Homo sapiens; identical to SEQ ID NO: 11661

SEQ ID NO: 12680 - DNA, 322 bp, Homo sapiens; identical to SEQ ID NO: 11663

SEQ ID NO: 12681 - DNA, 270 bp, Homo sapiens; identical to SEQ ID NO: 11277

SEQ ID NO: 12682 - DNA, 296 bp, Homo sapiens
aagccaggcacagtggctcacgcctgtaatcccagcactttgggaggctgaggcgggtggatcatgacgtcaggagatcaagaccatcctggctaacatggtgaaaccccgtctctactaaaaatacaaaaaaattagccaggtgtggtggcgggcacctgtagtcccagctacttgggaggctgaggcaggagaatggcgtgaacccgggaggcggagcttgcagtgagccgagatcgcgccactgcactctagcctgggcaacagagcgagactccatctcaaaaaaaaaaaaa

SEQ ID NO: 12683 - DNA, 158 bp, Homo sapiens
ggcatggcggcacatgcctgtaatcccagctacttgggaggctgaggcaggagaatcgcttgaacccaggaggcagaggttgcagtgagccgagattgcaccactgcactccagcctgggagacagaatgagactctgtctcaaaaacaaaaacaaaa

SEQ ID NO: 12684 - DNA, 268 bp, Homo sapiens; identical to SEQ ID NO: 11890

SEQ ID NO: 12685 - DNA, 131 bp, Homo sapiens; identical to SEQ ID NO: 11892

SEQ ID NO: 12686 - DNA, 3086 bp, Homo sapiens
gtgtgaagggcctgggcattgctatcaaggagctgtttgcagggaagcctgtgctgcggcatcccctggcttggattctgctgctgagcctcatcgtctgtgtgagcacacagattaattacctaaatagggccctggatatattcaacacttccattgtgactccaatatattatgtattctttacaacatcagttttaacttgttcagctattctttttaaggagtggcaagatatgcctgttgacgatgtcattggtactttgagtggcttctttacaatcattgtggggatattcttgttgcatgcctttaaagacgtcagctttagtctagcaagtctgcctgtgtcttttcgaaaagacgagaaagcaatgaatggcaatctctctaatatgtatgaagttcttaataataatgaagaaagcttaacctgtggaatcgaacaacacactggtgaaaatgtctcccgaagaaatggaaatctgacagctttttaagaaaggtgtaattaaaggttaatctgtgattgttatgaagtgaatttgaatatcatcagaatgtgtctgaaaaaacattgtcctcaaataatgttctttaaaggcaatctttttaaagatttcactaatttggaccaagaaattacttttcttgtatttaaacaaacaatggtagctcactaaaatgacctcagcacatgacgatttctattaacattttattgttgtagaagtattttacattttcatcccttctccaaaagccgaatgcactaatgacagttttaagtctatgaaaatgctttattttttcattggtgatgaaagtctgaaatgtgcatttgtcatccccactccatcaatccctgaccatgtaaggcttttttattttaaaaaaacagagttatcccaatacattatcctgtgatttaccttacctacaaaagtggctcctgtttgtttgatgatgattggttttatttttgaaatatttattaagggaaaactaagttactgaatgaaggaacctctttcttacaaaacaaaaaaaagggcagaaatcaccccaaggaacgatttctcaggttgagatgatcaccgtgaatccggcttcctctgagcattcgatggccttagcacctcatcaagccagcacatcctgcctgctgttgcagcctggctgggtttattcttcagttaccctaatcccatgatgcctggaaccttgattaccgttttacatcagctcttgtacttttcagtatattttcataatgagttatattgtcatttagactttgaacagctctgggaaatagaagactagggttgtttcttaaatttagctcatgttataataaaaagttgaaatgaagttcttattctaaaagtctgaatgcttagaacaaacttaacatgtttatagaatatggtctctttgtaccaagtactttgcttaagagctcctttgggccactacatattttggtttctagaaaatgtttgtttatgaagaagtcgatggaaaactgcaaacatatgcagaaaaggtagaataataaaaaaggtctaatgaactccattcagctttgaacctatccactcataaccattgactggcctttaaaaaaaagtattggcagaattaatttccacctaggtgatgggaagaaagtgttcgcctgttccagcctgtggctcctgcctggaggttacccagtggtgcgccagcgccaagccatcactccccgagggcctcccctgccaatggtgctggtatcccatgcagctcaccactggctgcgtggaaactcccttttttccaactttattattggccttctaaggagctgttttagatgttttttctaactgcctcctcccatgccattttaatactacagatgtactacgtatctgtttatatactgtacctacatctgtgctttgtacataaaagaaccagttttctcccccttgaggacagagactcatttgaacatgcataggttaataaataataaattcttatttaacattttgtagcacttgagattgtcttatacctaaggtattacatatttggtatataattaagccttataaaacttggtaattgattaagttttaccataatttttcatcctattctgtagtttctaagataagcacagctaccacctctaaatctgcagcagaatgctggccccagggttattaattcacattaccaaaagcatttttagggaactttttataaagaaagaataattgtttgttaggcttcatgtcacttgagtgagtttggcagtgtaacaggatggttcgtacacttactacttttctgtgccgtgcatcatatgcttctggacagtttccaaaggcctccggaaaagtaggcgaggcctgctttttatggcaacttggcatccatagaaaattttaaaattggtgaaggttgcaatactccaaataatgtaaaatgactgccaggctacaatataaagtgagttcagttaatcatgctggacttgtgtttatctgtagtattcatctacaataaacaggcatagcatctttttccattcagttagttaggattttcagaacctcattgccttagtactttttaaaatatggctttagtttctcaaacatgttcgtgactctactggtagtctagaccgattgtttttcattctgacagatcatgtgaaccagctccagccatgtgagccctgtggatcggggacagctgaaggctggactcggtgctcccggtccctttgtgcagcacccactgggcctgactgatctcctcccacattgctggcttcctccaggtcatgggcacaggtaacagagaggcactgagtagcctcttcatatccagattggagcagccaacacggccgttttacacctcatttgcctgcggaaccctaaatataaagctaaacctgtgctgaggtgagcggtatatgggatggtgtcacggtcccatcccacctcagccttagaggtgacctccatcccagctggcctggtatgtgagttcaggttagagttccttgccaagccaggcag

SEQ ID NO: 12687 - DNA, 4706 bp, Homo sapiens; identical to SEQ ID NO: 11895

SEQ ID NO: 12688 - DNA, 8530 bp, Homo sapiens
ccccctggagaatgtgccccccgccctggctgtgctgctcatcactgtggtcatcgccttcttcactgagtttgccagcaacacggcgaccatcatcatcttcctgccggtcctggcagagctggtgagggtccttctggggaagaggggagcacccctcccccaacacacattcagaaatcttcccccgccaagggaccttcactgggggccacagttgccattgctgtcttccaaaatacatgaacgtatcagaaccacagtacaatttttttaaatactggatgttttccttcaaaaaatgtatacatagagtaaatattttcaaagtgctcccaattctctcttctgggaaaattaacccatggtgacatggagagttttctagaacaggtaaattaccaattttggatgaagaagaagtagaaaatctgagtaaacaaatggccataggagaaattctaatggaagcaaagcagtagcctccctctaaagcaggggtttcaacactgttgatagttggggctggatcattctctgtatggggctgatccgtgcactacagggtgtgtagtggcatccctgggctctgctcactagagacaagtggcgcctccctaaatcatgacaatccaaatgtctcctagcattcccaaatatccccgtcaggggaacaaatccttccccctacccagctgatgactcctgggctaaaaatcaccagccccaggccgggctctgccactcatgcctgtaatcccagcacttttggaggctgaagcaggcagattgcttgagctcaggagtttcagactagcctgggcaacatggtgagaccccatctctgcaaaaaatacaaaaagtagccaggcttagtggcaggtgcctgggcaacagacccagatccagatcctgtctcaaaacaaaaacaaaaacaaaatcaccagccccaggtggtttgctgggtgagagctagcagatttgcaaggaacagagagttcccaactcacccaaactgttcaccagcatagaaaaatagacatggccactcaatttatagctagcaaaaccctggccccaaaaccaggtaaggagagcaagggaagagaaagctataattcaatctcctgtaaaaagaaatgcaaatagcaaaatgaaaccatgacagaatgaaaagaacaatatacacatgatcaggtagcttttatactaggagttttaaaaaggaaactatcaatatagttttatatttaaacagattaaagaccagaccatgtaattaccttaatgtaacccacgctgataaaattaaatcaatgatgcaagtaaatgctttgtatgcaaacagtgatgccccagcacacatacctgcagcaccttgtctttggtttctgtctgcttattttatgcatcaatttatctgtgttagcacacagatatacactgtgttatttttcaatgacgggagaatattccattataaatggacagttgttggtttatttaagcaatctctctgcccaatggaaatataggtatttccagactttgctgttactcaacaatgacgtgtcacctgagccttgtctatgcattcattgattacatctagagaaattcctgtgactgagattcctgggtcaaagagcatgtacgtttaaaatgtcgttagagatgaggaaattgccctccaaagtggctcaccattttatagcagtatggggtgggagtcctcagagggacctggtcactgagagaaatgagagtattatagggggtatggggacggagacggagcatagaacccagccaggtctgtaaggggcagcttttgctggaaaagacacttgtaaatgacacattcttgtaaactttgcttatcatcaaaatcaaaaaacattttacatgcaagggggtgattttagagctttttgagaaaataaatatgctttgggttgcaaaaattccctagaaggcccaaaaatatcctatttaagtaaaacgccataaaagtgatcagtatgaattgtaggcaggagaggtgacaaactggtggcccactagctgaggccagctcataggggggtttgatacacacagtcttagaaatttggaagagctgccaacagatgctctcatgagctctctttctcactgaaatccagggatgcccccaacaagaggtatccagaggccaactctgggttgagattgtttggctgagggaaggagcaggcagaggaagtattttaaagccctggttctcagtgtacagtccttagaccagcagcaccgggggaacacgtcaggaatgcagattcttggatcccaccccagacttgctgaatcagcaattctgggtgaggtggggccagccatgtgggctttaaccagccctccaagtgcttttctgcactctcacattggagaaggagtgttctaggtacaccaccccagcccatccctgatcaaaccacagtgtggcccttgaatgtcactaaccctgggaatgttctctccacctctctctcgatctggttctcttcttacctgcttgtctctgtttctgcctgtgcatgtgtctttctgactgcctttctctctctgtctctctaactctctcttctcacttgtccctgttgttctctgccactctgccaatctctatggatgtctttgtctctctgtctctacgtctttgtgtccctctttccaactgcctctctctctctctctccctcttgctgtggtcgctctgcgttggtctctctccgggtctctcccaccttttcctggcccaggccatccgcctgagagtgcaccccctgtatctgatgattccgggcacagtcggctgctcctttgccttcatgctcccggtctcaacgccccccaactccatcgccttcgcctctggacacttgctggtcaaagacatggtgagtctgggcatttcccagcagaggccccgggatgtgggtgggccgcaagggggcgggcaaggcctctatgcaggactcctgcacgctgaccccactccccagtctctgaatagatctttctgagtgggaccaggaacatacatttagcagagactctgggatgattcctgcacttagacaatctcaggaaacactgccttagtgactactttccaaaatttgctccagaggcaaggaacttccccttccctctggaccccacttcgtgcccagaatcttcgggggagagaagcagcagacacaccctaggactcaggggtgggcctcagtgctcagccagctgggaaggagacagaagcggaggactgtagcagtgggaggaccccaccagctttcagcagggcccagccattggcaatatgttccctcccccggaaggtccctgctgaaccagctcctcccttcccgctcctgactcctgcggccttttccctctccactggctttgcaaataacccttccaaagctgtcaaagccaagacgggcgacctgcttaaccaatcgcgatgcaggccctccaggcacaagacccctgcaggacacatggggagagagagcgagagtgagagcgaggcagaaagggagacacagagcaaacagagaagagacgagacagagactcattgatttgttcgttcattacagcactatttactgagtgcattctatgttccagccactgggggcactgcagagtgggagagacaccgatccgcctcctaggaggctgctttctattggtggagacagacgtgaacaagttcagcagattttcctaaattatgtaaaatttcaatattgctaggtgctcagaaggaaataaaacatgaggaagtgtaagaggacgggggagaggggtggcagggaagccctctccaggaaggtgacatgggagctgatgatcatgggaagccgccagcctcacagagaaaaaggggaagagcagtcccaatggagggcacagcaggtacaaaggcctggaagagaggaatagcagcgagtgctccagaaattcagggccaggaggctggggtggctgcagtggagttggagaaggatgaggttggagacacgaggtcagggaacagcggggacaggacagacttggtatcttattcaaaccacagtggggaccctcggtaagcagggcaatgatgtgatttcacttctgtctgtagaagatcattttggctgctggctggagtgaatcgttagggtgggagggacaagtgtggaagcagggaggctacttagagaaaaagactgagagggcagcaatgcaaacagcatagatttggagaataaagacagccagagaaatggagagtccccaagaggtagagacttgcaagagatgtggaggggtacaaggggcacccccggtcagccagtcccgggcagggatggcccacctgcaggttcgctcctgagagtaatgagttaggtgttaatgaagtagctaacatgggaccagcaggaattttgagccctggcaaagggagacccaatcctcccccagtttccccaacatgtcggcccgactccctctaatcctccgaaggtgccagggcttccacctctgtgcccttagaagagaggcaggacagcacacgcagtatgtcccccacccgtccgtggtaatatttatttaacacctttactaaatcagcttgacattaaaaaaaaaaaacaaaaaaaaacttgaataagaatattccagaagaaatgtttccagtgcatccatcaatggaaaaccggtattattaatatatgccatggccagtaaacctaaaaataaatgcaaagcggcaaaaacaaaagaattaagctctccctgatagcagctgcctggagaaggttctgggcctctccttgttaaaagggcaactgacaggagcagagaagtgctgaagccatggtggcccctgtgaaccccaaaaatctgagacaggtctcagtaaatttaggaagtttattttgcctaagttaaggacatacgcctgtgacacagcttcaggaggtcctgacgacatgcacccaaggtgggtggagcacagcttgattttatacattttagggaggcatgagacatcaatcaacatatgtaagatgaacattggtttggtccggaaaggcgggacaactcaaagagggcagggggctaccaggtcataggtatataagagacaaatggttgcattattttgagtctctgatgagcctttccaaagaaggcaatcagatatgcattcaactcagtgagcagagggatgactgaatagaatgggagacaggttggccctaagtagttcccagtttgacttttctctttagcttagtaatttgggggccccaagatttattttcctatcacacccctaagagagactttctctgggaggaatagacagaaagagaattagaaaggaagtaactgtctcaccatgtgattcagcctgggctatgtgaaggcggggcagccagaagacccaggtgggaaaacaaggattttcagcccaaggtggactgaatggtccaagaggccagccagggtagggagcagatgggcacattctccaccgacagaagaaaaatgcttcccaatggacaagggtagtcttgactaggactacctgactggactggacctgaagtgtgtgtgtgtacctatgtgtacatatgtgtgttcctacatgcatgcgtgtgtgtgtgcatgcgtgtgtgtatatgtgtgtgggatgggggtgtttagtgatcagacaagattattttcaagttaggtgaccttggacaagtcaacttctctaggtctcatttttctcttctataaaatggggattaataagaatgacctttgtaaggttgctttctgggttaaacagcataaccctgtgacaactgcgtagcacacagtgcctggaacctagaggccatcaatgaatggggacacttgcagctctttgagtgacagcctagggtagtgtaaagattgaagggtcccaggcatttaccgacctgggtctgtgtcctggctccatcacttcctggctgtgcgatcttgggtgagtgacttcctgtctctgagtctgaatgtttccatctgtatggtgggtcaggtgctgacccctccctctgtctgggctctatttcaggtgcggacaggcctcctgatgaacctgatgggtgtcctgctgctcagtttggctatgaatacctgggcacagaccatcttccagctgggcaccttcccggactgggctgatatgtactcggtcaatgtcacagcattgccacccaccttggccaatgacacatttcggaccctctgagtccccctggaggactcccttgaggctgaaccctctcaaagggctgtcaccatcacctgctgctaggacactacaaaacaatcaaataattcttttctgtaatccaatatgcagcaagcaagggtgacctccagtggcccactcaagtccatgagccattatctaggatactttctctctctttcatgcagttcaaagcccaggtatctctcagatctgctgcctgagaaataagctcctttatcagttagctgttttatcattaggatacaagacagcccagtgtcatcaacagtgagcaaatctggcatggtgtttgtctcgtacagttgggataggaggccattcattcccatgggcacagctaacattatcccccagtgattactttcgattacactgaagagaccaccttgtctttaaagatcactttcctgggctgcaatgttccaacccagttgttccagctgttcacaaccagtgtgtgattttgcttagttggtgcccattctgcaccagttgttttacccctgccgataaccagcagtcagagattcttttttaatccttggagacagggaaagggacagatagctttccaaggacatgagactgtgcaaagcctctttgctgtttctctgggctcctgagcataccaggggaagttctagaaaccgcagctgacatctcgacccaagagatttaggattctcctgtttcatctgggtcagtttggccataattctggggtcaggccaggcctgggtcctgccctcccatggggtgactcatgacccctccagccaggactctcctacatgtggcccccataggcctctgtggctgcaaggcggtcagttgctgcttgtcccagcaggtggccttgatctctccatgccccaccttaagtggtaagcatgtttaattatcaaaggccccatttgtcaggggtgagagaaaagtcaaaagataaattggggccttgtaaaaggccagggtaaaatgtctcaggcaagcaaaagattgtccccttctgcatatgggtaaaactgagacgtccccgtgagcccgaggctggaagtggtgtctgccttcaagggttaatccctctttgttccaagcagaagcattctggcatcccagtgaagagctcaggccctcaggaagtgtctgctgaatggaatggcccagcattagcccagtattggaaaagacaccagcccaggggccctgactcgtcacacttccctttcctaagcctctgagggtggagattcccctaggagcgcttggccagctgggaaggcagcgcccagctgcacttgttgttgatacagcataagtgaatcatgggcatttccctgagagcagtgggagaggccctctgagttggaagttgagctccacctcctttccaagtgagcactcagtgttgaatcacagttacaacccactggggctggtgggagatgcgttgtatgggactggaagcaagaggttcattcaaagagaaactcatgggatttgtaaccagatgaatcatgatttctaagacttctgatcaaaaatactgtgaaataaagaatgttaatcaactttggacctggagatgatttgcctttctgaacataagagagcttcaaagccccaaattcctgggctggggattccacagagttgacctctctgattttctactgctcttccctcccctctccagctacatactctgcctcagggccttcgcatgtgctgttccctctgcctagaacactctctcccaagtatatgtctggttccccgactcactttattcaagtccctgctcaggtgtcaccttccctgagaggcttccctgacctcctgtctaaaatgtcaccctcattactctccacccccttactctgctataatttctccttaataggacactgtataacttattttcttattatcttcttctccctctagaatataaatttatgaaaatacaaatgttattttttttactgctgtaactccagttcctagaacaatttccagcacatagcaagtgttcagtaaatatttgctgcttgaatctgctccagaattaacaagaaagccatctcttcctctgatctggggtctgttttgttcattactttgttcactccttcttccatttattcattcaataaacatttattgggaacctgt

SEQ ID NO: 12689 - DNA, 8537 bp, Homo sapiens
ccccctggagaatgtgccccccgccctggctgtgctgctcatcactgtggtcatcgccttcttcactgagtttgccagcaacacggcgaccatcatcatcttcctgccggtcctggcagagctggtgagggtccttctggggaagaggggagcacccctcccccaacacacattcagaaatcttcccccgccaagggaccttcactgggggccacagttgccattgctgtcttccaaaatacatgaacgtatcagaaccacagtacaatttttttaaatactggatgttttccttcaaaaaatgtatacatagagtaaatattttcaaagtgctcccaattctctcttctgggaaaattaacccatggtgacatggagagttttctagaacaggtaaattaccaattttggatgaagaagaagtagaaaatctgagtaaacaaatggccataggagaaattctaatggaagcaaagcagtagcctccctctaaagcaggggtttcaacactgttgatagttggggctggatcattctctgtatggggctgatccgtgcactacagggtgtgtagtggcatccctgggctctgctcactagagacaagtggcgcctccctaaatcatgacaatccaaatgtctcctagcattcccaaatatccccgtcaggggaacaaatccttccccctacccagctgatgactcctgggctaaaaatcaccagccccaggccgggctctgccactcatgcctgtaatcccagcacttttggaggctgaagcaggcagattgcttgagctcaggagtttcagactagcctgggcaacatggtgagaccccatctctgcaaaaaatacaaaaagtagccaggcttagtggcaggtgcctgggcaacagacccagatccagatcctgtctcaaaacaaaaacaaaaacaaaatcaccagccccaggtggtttgctgggtgagagctagcagatttgcaaggaacagagagttcccaactcacccaaactgttcaccagcatagaaaaatagacatggccactcaatttatagctagcaaaaccctggccccaaaaccaggtaaggagagcaagggaagagaaagctataattcaatctcctgtaaaaagaaatgcaaatagcaaaatgaaaccatgacagaatgaaaagaacaatatatacatgatcaggtagcttttatactaggagttttaaaaaggaaactatcaatatagttttatatttaaacagattaaagaccagaccatgtaattaccttaatgtaacccacgctgataaaattaaatcaatgatgcaagtaaatgctttgtatgcaaacagtgatgccccagcacacatacctgcagcaccttgtctttggtttctgtctgcttattttatgcatcaatttatctgtgttagcacacagatatacactgtgttatttttcaatgacgggagaatattccattataaatggacagttgttggtttatttaagcaatctctctgcccaatggaaatataggtatttccagactttgctgttactcaacaatgacgtgtcacctgagccttgtctatgcattcattgattacatctagagaaattcctgtgactgagattcctgggtcaaagagcatgtacgtttaaaatgttgttagagatgaggaaattgccctccaaagtggctcaccattttatagcagtatggggtgggagtctcagagggacctggtcactgagagaaatgagagtattatagggggtatggggacggagacggagcatagaacccagccaggtctgtaaggggcagcttttgctggaaaagacacttgtaaatgacacattcttgtaaactttgcttatcatcaaaatcaaaaaacatttcacatgcaagggggtgattttagagctttttgagaaaataaatatgctttgggttgcaaaaattccctagaaggcccaaaaatatcctatttaagtaaaatgccataaaagtgatcagtatgaattgtaggcaggagaggtgacaaactggtggcccactagctgaggccagctcataggggggtttgatacacacagtcttagaaatttggaagagctgccaacagatgctctcatgagctctctttctcactgaaatccagggatgcccccaacaagaggtatccagaggccaactctgggttgagattgtttggctgagggaaggagcaggcagaggaagtattttaaagccctggttctcagtgtacagtccttagaccagcagcaccgggggaacacgtcaggaatgcagattcttggatcccaccccagacttgctgaatcagcaattctgggtgaggtggggccagccatgtgggctttaaccagccctccaagtgcttttctgcactctcacattggagaaggagtgttctaggtacaccaccccagcccatccctgatcaaaccacagtgtggcccttgaatgtcactaaccctgggaatgttctctccacctctctctcgatctggttctcttcttacctgcttgtctctgtttctgcctgtgcatgtgtctttctgactgcctttctctctctgtctctctgactctctcttctcacttgtccctgttgttctctgccactctgccaatctctatggatgtctttgtctctctgtctctacgtctatgtgtccctctttccaactgcctctctctctctctctctctctctctcttgctgtggtcgctctgcgttggtctctctccgggtctctcccaccttttcctggcccaggccatccgcctgagagtgcaccccctgtatctgatgattccgggcacagtcggctgctcctttgccttcatgctcccggtctcaacgcccccaactccatcgccttcgcctctggacacttgctggtcaaagacatggtgagtctgggcatttcccagcagaggccccgggatgtgggtgggccgcaagggggcgggcaaggcctctatgcaggactcctgcacgctgaccccactccccagtctctgaatagatctttctgagtgggaccaggaacatacatttagcagagactctgggatgattcctgcacttagacaatctcaggaaacactgccttagtgactactttccaaaatttgctccagaggcaaggaacttccccctccctctggaccccacttcgtgcccagaatcttcgggggagagaagcagcagacacaccctaggactcaggggtgggcctcagtgctcagccagctgggaagaagacagaagcggaggactgtagcagtgggaggaccccaccagctttcagcagggcccagccattggcaatatgttccctcccccggaaggtccctgctgaaccagctcctcccttcccgctcctgactcctgcggccttttccctctccactggctttgcaaataacccttccaaagctgtcaaagccaagacgggcgacctgcttaaccaatcgcgatgcaggccctccaggcacaagacccctgcaggacacatggggagagagagcgagagtgagagcgaggcagaaagggagacacagagcaaacagagaagagacgagacagagactcattaatttgttcattcattacagcactatttactgagtgcattctatgttccagccactgggggcactgcagagtgggagagacaccgatccgcctcctaggaggctgtttctattggtggagacagacgtgaacaagttcagcagattctcctagattatgtagaatttcaatattgctaggtgctcagaaggaaataaaacatgaggaagtgtaagaagacgggggagaggggtggcagggaagccctctccaggaaggtgacatgggagctgatgatcatgggaagccgccagcctcacagagaaaaaggggaagagcagtcccaatggagggcacagcaggtacaaaggcctggaagagaggaatagcagcgagtgctccagaaattcagggccaggaggctggggtggctgcagtggagttggagaaggatgaggttggagacacgaggtcagggaacagcggggacaggacagacttggtatcttattcaaaccacagtggggacctcggtaagcagggcaatgatgtgatttcacttctgtctgtagaagatcattttggctgctgggtggagtgaatcgttagggtgggagggacaagtgtggaagcagggaggctacttagagacaaagactgagagggcagcaatgcaaacagcatagatttggagaataaagacagccagagaaatggagagtccccaagaggtagagacttgcaagagatgtggaggggtacaaggggcacccccggtcagccagtcccgggcagggatggcccacctgcaggttcgctcctgagagtaatgagttaggtgttaatgaagtagctaacatgggaccagcaggaattttgagccctggcaaagggagacccaatcctcccccagtttccccaacatgtcggcccgactccctctaatcctccgaaggtgccagggcttccacctctgtgcccttagaagagaggcaggacagcacacgcaatatgtcccccacccgtccgtggtaatatttatttaacacctttactaaatcagcttgacattaaaaaaaaaaaacaaaaaaaaacttgaataagaatattccagaagaaatgtttccagtgcatccatcaatggaaaaccggtattattaatatatgccatggccagtaaacctaaaaataaatgcaaagcggcaaaaacaaaagaattaagctctccctgatagcagctgcctggagaaggttctgggcctctccttgttaaaagggcaactgacaggagcagagaagtgctgaagccatggtggcccctgtgaaccccaaaaatctgagacaggtctcagtaaatttaggaagtttattttgcctaagttaaggacatacgcctgtgacacagcttcaggaggtcctgacgacatgcacccaaggtgggtggagcacagcttgattttatacattttagggaggcatgagacatcaatcaacatatgtaagatgaacattggtttggtccggaaaggcgggacaactcaaagagggcagggggctaccaggtcataggtatataagagacaaatggttgcattattttgagtctctgatgagcctttccaaagaaggcaatcagatatgcattcaactcagtgagcagagggatgactgaatagaatgggagacaggttggccctaagtagttcccagtttgacttttctctttagcttagtaatttggggcccccaagatttattttcctatcacacccctaagagagactttctctgggaggaatagacagaaagagaattagaaaggaagtaactgtctcaccatgtgattcagcctgggctatgtgaaggcggggcagccagaagacccaggtgggaaaacaaggattttcagcccaaggtggactgaatggtccaagaggccagccagggtagggagcagatgggcacattctccaccgacagaagaaaaatgcttcccaatggacaagggtagtcttgactaggactacctgactggactggacctgaagtgtgtgtgtgtacctatgtgtacatatgtgtgttcctacatgcatgcgtgtgtgtgtgcatgcgtgtgtgtatgtgtgtgtgggatgggggtgtttagtgatcagacaagattattttcaagttaggtgaccttggacaagtcaacttctctaggtctcatttttctcttctataaaatggggattaataagaatgacctttgtaaggttgctttctgaggttaaacagcataaccctgtgacaactgcgtagcacacagtgcctggaacctagaggccatcaatgaatggggacacttgcagctctttgagtgacagcctagggtagtgtaaagattgaagggtcccaggcatttaccgacctgggtctgtgtcctggctccatcacttcctggctgtgcgatcttgggtgagtgacttcctgtctctgagtctgaatgtttccatctgtatggtgggtcaggtgctgacccctccctctgtctgggctctatttcaggtgcggacaggcctcctgatgaacctgatgggtgtcctgctgctcagtttggctatgaatacctgggcacagaccatcttccagctgggcaccttcccggactgggctgatatgtactcggtcaatgtcacagcattgccacccaccttggccaatgacacatttcggaccctctgagtccccctggaggactcccttgaggctgaaccctctcaaagggctgtcaccatcacctgctgctaggacactacaaaacaatcaaataattcttttctgtaatccaatatgcagcaagcaagggtgacctccagtggcccactcaagtccatgagccattatctaggatactttctctctctttcatgcagttcaaagcccaggtatctctcagatctgctgcctgagaaataagctcctttatcagttagctgttttatcattaggatacaagacagcccagtgtcatcaacagtgagcaaatctggcatggtgtttgtctcgtacagttgggataggaggccattcattcccatgggcacagctaacattatcccccagtgattactttcgattacactgaagagaccaccttgtctttaaagatcactttcctgggctgcaatgttccaacccagttgttccagctgttcacaaccagtgtgtgattttgcttagttggtgcccattctgcaccagttgttttacccctgccgataaccagcagtcagagattcttttttaatccttggagacagggaaagggacagatagctttccaaggacatgagactgtgcaaagcctctttgctgtttctctgggctcctgagcataccaggggaagttctagaaaccgcagctgacatctcgacccaagagatttaggattctcctgtttcatctgggtcagtttggccataattctggggtcaggccaggcctgggtcctgccctcccatggggtgactcatgacccctccagccaggactctcctacatgtggcccccataggcctctgtggctgcaaggcggtcagttgctgcttgtcccagcaggtggccttgatctctccatgccccaccttaagtggtaagcatgtttaattatcaaaggccccatttgtcaggggtgagagaaaagtcaaaagataaattggggccttgtaaaaggccagggtaaaatgtctcaggcaagcaaaagattgtccccttctgcatatgggtaaaactgagacgtccccgtgagcccgaggctggaagtggtgtctgccttcaagggttaatccctctttgttccaagcagaagcattctggcatcccagtgaagagctcaggccctcaggaagtgtctgctgaatggaatggcccagcattagcccagtattggaaaagacaccagcccaggggccctgactcgtcacacttccctttcctaagcctctgagggtggagattcccctaggagcgcttggccagctgggaaggcagcgcccagctgcacttgttgttgatacagcataagtgaatcatgggcatttccctgagagcagtgggagaggccctctgagttggaagttgagctccacctcctttccaagtgagcactcagtgttgaatcacagttacaacccactggggctggtgggagatgcgttgtatgggactggaagcaagaggttcattcaaagagaaactcatgggatttgtaaccagatgaatcatgatttctaagacttctgatcaaaaatactgtgaaataaagaatgttaatcaactttggacctggagatgatttgcctttctgaacataagagagcttcaaagccccaaattcctgggctggggattccacagagttgacctctctgattttctactgctcttccctcccctctccagctacatactctgcctcagggccttcgcatgtgctgttccctctgcctagaacactctctcccaagtatatgtctggttccccgactcactttattcaagtccctgctcaggtgtcaccttccctgagaggcttccctgacctcctgtctaaaatgtcaccctcattactctccacccccttactctgctataatttctccttaatagttaggacactgtataacttattttcttattatcttcttctccctctagaatataaatttatgaaaatacaaatgttattttttttactgctgtaactccagttcctagaacaatttccagcacatagcaagtgttcagtaaatatttgctgcttgaatctgctccagaattaacaagaaagccatctcttcctctgatctggggtctgttttgttcattactttgttcactccttcttccatttattcattcaataaacatttattgggaacctgt

SEQ ID NO: 12690 - DNA, 530 bp, Homo sapiens
gtcatctctcacctgtcttacttcttccagatctggtctctcccattcagtctgttgttctccacccaggagccagagtaatcctttaaaaatgtaaatcagattagattatttatgtatgttagtcatttctactactttcattaattactggttcatatttatcatcccatttgataaaaaatctccagcatttccttttgcacgtgtataaaatccaagttagctgttaccatgtcgtgtatgatgtttctttcccttgctcctttttcaggcttcatcccatgccacttgccccatcacctgtaatgctaattctagttattttgttgttattttgtccttcctttcagttccttcccatcagcttttactccttcaatgtctatgcatttgccttttctggaatttctcctcctagctgtttgcatggctggcttcatttcatccaaagtagtttcttcctgttatattctgataacatcctgttttctccttcattgtatttataacaggctttaattatttgt

SEQ ID NO: 12691 - DNA, 17121 bp, Homo sapiens
gctgctttgtaccgcctcagtggagactggaatcccttacacattgatcctaactttgctagtctagcaggtgagttgtctttaatatgtatcaatgaaaaatattagctattcgatatttaattaaataatgtaaagacactactacttatgactggtagtttgagtagcatttaaaaaaatgttattttatttattacatttatgcaaaggatatggaaaggtaggaaatgtgttcagaaaatagtgcacttgaaattcagattatggtggagggaagttcccgctagtgcgaggtctaggataggaccacgagggtgggtgtgtgagttatcacaaaggacaaggtcattggagagagagcaaggaactgaaaggttagggaaggatcatgtacctgtgtggatgttgagagtaccctggatgatttcatggttacaaccaaaactaaacaaaacaattgtgtttccagatctctcacattcttttcctgttttgttttttttttttctttctttctttatttcataatttcctcccaggaaatactctttaaaaaatatctactgtgtttcttaaaatagatggtataattcctgctaatgcagtctaaggacatttttaaagtcctgaattaactacacttgatttttaaactttaaaggtacctgtatctaactcagtgttctctcttttcctaggttttgacaagcccatattacatggattatgtacatttggattttctgccaggcgtgtgttacagcagtttgcagataatgatgtgtcaagattcaaggcaattaaggtaaatgtgtattactacgtaatttgaatattacttcctttttctatctttagagaagaaaaggggttttagtgatttaattgaaaatagatattgtactacagcaatgtacatttttattatttcattgacctggcaatcagcacactttctttttgtagctataaatagctctgttgcacatgcaccaggaaggatgcacagttgcaattttgacagattaactgggttgctttataaattaattaggtgcatatattatatatatatatatcagtacgtatgccttgaaaactcaagatttgctttttttaactgttttatcattttcattaatttaattaaaaatgttaagtggctgattaagtccaataaacatacatctacagcaatataatgactgcatattgttttaactctgtactttttagttgatttcaaatttttatccattataaataacaaggaaaaatatccatgcccatattatttttgtgtatgtttaagccaaaagatgtacacttaaaaaagtttaaggggttgtcaaatagctccaaaagcttttaatttatcctccatgcagtagtgaaaatatattttctgatgcattgcctttgataacactaattactctcatgcttttcattttgtttacaactattttttattatccagtaatatatacacagagaaaataatataaaaaattatgaaataaaaagtggaattattttgccctgcatactcaccccaggcctcattccttagacttaatttgtaccacttttaactgtttctttaagttgttctgatgtacctatataactcacctaatatgattatggttttatttcttgatttgtcaagataaaaaacactattttttgattccatactttgaaagacaaagaattggcttacttatattagttacatctttattttactaattttatcatattatacttaggtcttttatgaatttaaatatctttaaaccttgatttttttttcttttgtgctctctagtttcctttccaattttttcctcctacaagtaaaagagtttccttttaaaacatttttaaccccacaattcttttttaaaggctcgttttgcaaaaccagtatatccaggacaaactctacaaactgagatgtggaaggaaggaaacagaattcattttcaaaccaaggtatgaattttgctttttcacccttctcacatgctttatcattgtgttccatcttaccatttttttttggttagtactatggatagaaagttctttttaagtaatggtaaattttaattaaaaataagatacagcttgtctggtgttttcaaaatttttatttatcaggcaacacttaataaaatagaagtgttttgcaccctgtgttttattttctcttttattttcaactaaattggtagctatctatgtagcagtggcccagctattctgaaaacccagccaaccatgtctttttggctcaactagtcaatcaagtcattgtcaaaatatcatcttaaaaaatttaaaggcatgactcagacagatatacagtgaaaacatgacagaaatctatctgactcattaatgaaggatcttgcaatatgataaaacatgttcgaaaaaaaattagaacaacagtttatatggtccaataggaaagttattctaaaataattttgcagagttagagacaaaattagttaatatcctatagaacaataaaatcttatcctttatgagttttctctggacagaaatcatatgcatcttgattacacaaaaaatccacaaattaacaagttacatcacagagtctgggcctaacaaatagtaaatgaggttattttggggtgaggctgttagcaatgctccagtaaaatactaaaaggacatgcaatcattgttttatttgcaagttattaaaagacagtttttgttaacacagttgaccaggctaatactttttggcttgatcatttcatgctatatagagcatattaaacaactccaatgataataggaacagctttcatttattgagaacctataaactggcaatagtattttctttaatatgcataataaatctgtatgtaaatataagaaaatctaggttcctaagaaaatctaatctaggtgtcctaaataacttgctcatggtcacacagcaagtggttgagctgggatagaaacccgatcagcatggcttcaaagctttgattacaggccccaaatgtcttttctgtatcatgttttctttcacaaatagataactgcaaaattcttcttacatggttgctttactcctaattcctttctgctggttgcaatatcattttcctgcttaatttgtacatattgtttattttacttttcaaattcctcctgtccttcaggcttaagttcaagctccactttgctcttagagacagtctcttactattccccactttcctacccatagatacactcaaattggtgttctctgaaagcctttgcagctaatatctgtgccacatattttggagccctcacattttctaatttgttttgtatgagtaagttttgctttttgattaagattatgaactctaaaagtgttaaggaccatgactatattacaggtttttattttcctgcaattctggtgatgaatagtatgtaaataatttctatggatacaaacttgaagggctgagaaatgattaaatgtctaaatataatgtattcttgccattttgttaaattctaagcatgctgtcttatcttttcagcatatttgctatatttttcttcagtgattatagatattctttttctattagttttaggactccttctctccctgcctccttttctcactttctccctcccttcctcctttcctttctattcttaagatataagaaacattttaaaccagtgttttaaaatgatttgcttgatttggtaacaataaagtaatttactgaagtgcattttgttcattaattatctctttccatgcttttcaatgtatgtaatttgaagtaaagtgaacaaattacttgaaagatcttttttcctccaaaatatgatgagatgtagtcaagagaatgatcttcttgattgttaaaaatcaaagttttaataaacgctatgttaaactttagaaacttatcctatacatttgtagcaataacaatttttatgaaagaatagccattggaataatttgaaatgaaggactgggaattagaatttgaattcctttaatgactattttgataaaagcctatttagacatttagttcatgctgtgtacacttcctcttgaaataagacctggaattactacttaaaaaacactattatgatttgttcctagccaattttattctatattagcagaacaaatgtactttgagtaccattacctcatgtggctattgtgctatgccttttactatttataaggattcagcatggactgaattctgtttataagagtgcatcccctgatccccacttcccccccaaaaaatgcccaaaataccaaggcccagtctctatcagtgtatttacattagaattttgggggatgggacctcatagggtttctttgtttgtttgttttaaagggctccagctgattataaagccaggtttagtaacagttgtattaaatcagaaagcctttatgtttgttcatcttgacatttactttagcagccttttattttatctggattattatattctttttcatatgaggcaaaaataataaattttaaactttgtactgtttcacagtgaaattacacttccattgtaatcagaataaatcttttttttttcttctcctcctaaggtccaagaaactggagacattgtcatttcaaatgcatatgtggatcttgcaccaacatctggtacttcagctaagacaccctctgaggtaggttataaaaattagtatccaagccacttcctcatttaggaatttcagttaaggtgactttaagagtggttaggctacgttagaaaattaacaaccatgaaactattcttaattcttgaagtgaaaaacattaattcaaaacagcttggaatagaaggaatactctggcaatttatgaactttaaaaaactcgttttgcaggatactaggatatctttcaagagaacataattttctagttttagaataaataaatcagttgtttaatcagaatcttaagcaaacagcgttttggagaaaaatagattaaaaagttgaatatcctgtacctttttcttgatttaaaggtttatataaagttttgtatgcaaatatataaaccagcagcgtgtataatttattaaaacattgtattatttattagcatgctgagacttttgataaaaatgtttatattctatctctgaaatattaactttgtaatgttgaggtttcgatacccatgatctttaattgtctgtcataaaccatataactgactgaaaattaaaatcccttaagaatagtctaagaaaaaaaaaaacttagagcgggctcggtgcctcacgcctgtaatcccagccctttgggaggctgaagtggttaggtcacttgaggtcaggagttcaagaccagcctggccaacatggtgagactccatctctactaaaaatacaaaaattagccagccttggtggcaggctcctgtaatcccagctactcaagaagctgaagcaggagaatcacgggaacccgggaggtggaggttgcagtgagccaagattgcactactgcattctagcctgggcgacaagtctgtctcaaaaaaaaaaaaaaaaaacaaaaaacaaaaaaaacccaaaacttaagttttagagctgtaaagaaattcagacttcatgtaatttagtattattttataaataaaaaaaatgagaccatagaagttgattaatttgatcaggatctttctaaagttagctaaaacataggttgtccagttcctatttttcttttaaaatattatttctgaattctaataaaagtaaaatcctgttattaagaggactgaggttctgagtgatgtatacaaataagaaagtatgaaagacacattgtatgaagaaaactgacttatgtacagagttttaaaaaatcttttttttgcacatgttttataatcacttttctccatgagttatttttacagaacttttaaagtttattttgttgtcgttgttagggcgggaagcttcagagtacctttgtatttgaggaaataggacgccgcctaaaggatattgggcctgaggtggtgaagaaagtaaatgctgtatttgagtggcatataaccaaaggcggaaatattggggctaagtggagtaagttatagccctgattttataatattctaaggtaattcttagtaaataaagtatctttttaacaattaaagacctttgaaggtaggtaaatcttacctttttaggtaagttttttttcttttcccgtgggaatgaataggtttgggaatgtccaaaggggggtgtgtgtgtgtgtgtgtgtgtgtgtgtttgtgtgtgtgtgtaagagatgtagggaatcaattgaaatgaaaataacctgttttaagatttcattgtaatccttgaaagtagtttaaacagtcatcttggctatatgcatctttatctaatcttcagcttcttaaacataaggcaaattcatcaagtcaaaatgaagtatttttaagtcatgatatttgacagttacaaaattattttattcataccaaaacaataatttggattatcttaattatcaatataaaatcactattttctagatatatacagattatggtcaaaggtgtttgtttatctaatctagggaaattatctattagagtgccatgcacccaatataaaacatcttgccgcagaaagaaagcagtcatatttcttttcactgatgtggaggtccaaagagaccctggtaccattttgtgaagaaagagaaattagaggataaaaagaataaagaaaaaatattctgtcagatcttttgcatctgctgtgtaactcacatccttaatcatggcacacactttaattatggaatattctaacctcacctttattttcctagagattcttcaattaggttgaaaagatgaaaatggataggaggtagagcagtaagtccctgaattccctttcagcagagtctgttgcttgtcacagttatcttactgtattatggtcatttataattgtatgttttctctcatttgactttgggcttaatcctgagaaatggctgcagtttgtctatttctagcttctagtatagtcaataacacataataactagcctgattctgtatatgttggaatgagtgctaaaagccatgtagaaagcatagttttagaaaatagtatggctgccttttaaaaaaaaggttctgaaattgatgctttaccttctattaaaataatgtttattgtatggatagtgatgtttattttttgtttagtatgagtgaaatatgtaagtataatatgatactgagatatttcataaataactaacatattttatagtatttattactattaatttctaaacccagccagaagttgttgtagtaaaccctttgaatcctattttattgttctaagcaacggtaaaaaatcggaggaaatgaaagatgacataaaggcataagggagataaagaatcagaggatttatgtggcctacagaatagtctgctcttgaaaattaaaacataggtactcttatctgaaactccagaaaccaaaaagctctaaaaataaacagttttttttctcatgattcactggtggtgaagtctgacttgaacttatatgatgctgttgattgtctttaactcagctagtgtgagttagacaagtatagaagtaatatgcacgtttatagattgttgcaccattgggggccttttgtaatatggaatacatgttttatgtattatatttcctttctaaaatctgattccaaattccaaaacacatcagcctgaagcagttcattcagataaggacttgtggacctgtacatgtatataaataattcttgtagaacacaagtgataagagacatggaaaaaagtgctctctgctttcagagaatgggaggattggttcattcaatgaacatttgagtatttatatgccaagttctctgctaggtggagactacaaatatgcattgacaggatgccttttttttttttttaaatccatagggataattatttacaggctgtgtgtcaggaaaggtgaaatactggggttgaggaaacaaaggttgttgcattgcagagtgaaaggaagacctcaattaaggaaatagtaataatggagaggagagggcctatgtggaactattgctaagattgaattggctaacttagctactgattatgtctaaaaatcaagaggaatgagaaagagtcaaaactaatactgtggttttgagcttgtgtgcttgaggatgttgactgcattactagaagtatgaaacaggtagaggagggaggtttgggagagaagaaggtaagttgtggtaccaacactgtagccaaccaagatctggactagattgtggggactgtgggcctggaatttaagagtaacttcatagctagaggcagagagttggaaagcatatttgaggaattagtagttggaaccaagaacgttggcttcattcaccaccttgcttcatgacatgcaggaagaaaatggaaggaaaatctttgttggtcctgctgttcctgttcactttatggaataatggttctaaaatttccatttgtctgtaaacaaaatgaatatcatagaatttggcccacaggttttaaatatgcaatttatcagtattttaggcaaagacaatcctatactttcaaatagaaatatattgtttgtatgtatccaatacctgtaaaataatattactgaaactttttataaagatttatttccatgtgttgaatacaatgttgctgagcaaaatctgttttgttttctttaggatgataggtttaagctggttagcattgagcagtttggttgttttcctcctgaatttaaatttggtttcctttcacatgtttgtaatcatttccattataggaacataagtggaatttacatttagttggcaagatactatggatttttgtttgaatattgtttttgtttgaataaataataaaatgagccgagttttaaaaggcacgtactataattagttgtgtagagttaagtctgcatatctggactaaatccaagcctccattatgtactatatatgtactgtatgatgatgtgactggatgaggatgttctttgactgttagaggttatctattttgaatcttagacatttgccacagtatgtaagaatgtacagaggtttgggaactggcattcttttgataccagaataattaattcttgaggataccatgtgatcattaaaacctctgagctcctgggttggtgctcatcttctagcagtcaaaccagattgccgcttaggattctcaacttggatataaactaaatctcaagggtgttggttccaaacattggatttggattgaaatgagtgtctcatgcatttatagaaaagtcttgaaagattttccttgaaaaggaatatgctctccagttaggaatgggggcctgtttgttggaggtgtatctgcctcagggttactctctattcccaaagcaacagtgactgtttcttctcttactaacagcagctcctgactgcgtgctcatgtacatttatcttcaaaagtacacacaagtgcacaaaatcatttaaaacaatttctgactttccatcttctctgtgttattcatcttaataacatcattttgtacttttttttgtttgaaacaatttgagaattatagaaaagttgcaaaaatactagagaacttttgtctttcatccagtttcctcaaattgttaaaatttgtatctcatcttctttactatttttttccatcatatgtgtttttttcttctgaggcatttaagagtaacttgcagacatgatgtccctttatgcctaagagactatgctactagcattttctaagaacaaagacattctcttatctattcacacaacaaagatcaatatcaggagattaacattgatgcagtatgttagctaatctgcagatcttgttaatatttcaattgtcccaataatgtcctttatagcaaaacaataataattattattcattactaaaatgaagaaagaaaaagaattgatcagggtcccatctgggattatacattacatttggttcttaggtctctagtctgctttaatctggatgagttcctcagtctttgcttttcccaattttgagatatttgaaggctggagaccaattattttatagcttgtttcttggtttgtttttagttgatgcttttttcatgtttagttttagtttatgaacttttggcaggaataacacaaaagtaatatgctcttggtgtgatttttaaaaacttaatttttaacctgggtttttttctttgtgtttgttattactaatatatattttatatatatatatatatttttgggggtagacatccttctttcatgtgcttttccatttatcaaataattcctaagtattttctcttcaaggaagtataggggatacaaagacaaaacatgtttgtgccagcaaagacctaatattaagggaaggtagcataaacaaaaacagttccttctttctcctgtagtgaccctttgtgatttgtaaagtatatatcttaataagatcctcaggggtctccaagttttcaaatgccatattctcatctgttacctcacccctccctcattaaatgctgtgaagtatgactgaaattgttatggactctttcagaagcttagttattaataaatacagagctaaaaatcaacagtaagatgcctgtaatgaattctgccactaagagaaaatgaatacaatctctttcttcacttctgaaataagattagctgtgatcttataggtgtctataaactcaaggtgatggtggtggttgcagaccatgacctgagccactacagaactggaagttccacttctttacctcaaatttctgtattcttgtatttctatattttgctttttttctaaatgacagataatgtataattgatagatagaatatgtgtagaataagtgccacattaacatggaaactatagaaatgtctgcattttacttggtttattttaccctcattttgttggagagaaaaagatacacattggtttcttcctatttttcccagctattgacctgaaaagtggttctggaaaagtgtaccaaggccctgcaaaaggtgctgctgatacaacaatcatactttcagatgaagatttcatggaggtggtcctgggcaagcttgaccctcagaaggtaatgttctcaaatgttcatttattcattgttttattgtttcctcttttgacaattgcagtttttaagctgatgcccaaattctgatttataagccaggtttcttacaactctgaagatgacacagttgctactgatactctggttgacaggtcatatatttcttttttaatggagtttcacctgacactttttaagactgaacccacatctagattttttaatatattctgttatgtgttcaaaggtgaaaaaccatatgacattagtaggtactacataaaattagacattcccaataaataagattaagaaatcattgaatattggaactagaaggatattttaacctaatagcccatgtcttacttagggtgaatcttagaggcatttcagtggaaaatcatgattaacagaagagtgccttctgtgacgattatttagttaatattattatgaaacttttgaccaatccacaaatatacaaaattaaagtaattgatgtggcaattagaatggaggagaaaaatttgttattttcaatttgtgattatgtagctagaaattccaagggaactaacttattgattcttagaatgaaggagttcaaacaaatggctgagtgcagttatttaaaaatagctttcacataggagtaatttgaataaatgaggaaatatatgattttcctgtatagaaagactaaaaggaattgtaaagtagtatagtaggtaaaaagtagtctttggcatcagataaaatctaaatttgaatcttgcccctgtcacttcatccaaaaaccttaattttctcatttgtaaaatgagtttaataattttaatgtttacaaggcttattataagaactaaacccaataatatgtatgaagagcttagtacagtgcttggcaatgcagtgaaccctctgttaatttctttccaggaatttatttagtacctattcaggttgtaggtattggctgaattaagacaaaaccctactgtatggagcttcttttagtgtactaatgcaaaagaaataaaatctcaagttagagaagagtaagcctgagtatagtgttagagcaatgactggcaaactttttctgtaaagggttacacagtaaatattttaggctttgtgggcaagatggtctctgttgcagctcttcagctttgccattgtagccttaaagtagccatagagaatatgtaaacaatggagtgtgactgtgttccaataaaactttatttacagaaacacacagccactagatctggttctccagctgttgtttgccaacccttgagttagaatgtgacaggacaggggaactattttaaataggttgtttaaaataccttctggggttttctaaggtacctgaaatgcctgacagagatttgaacagagtatcagaatgagtcatcagactaaggaaacaactaatacaaaggcctgccgtgcgaggaacttggctccacttagtcttctctgagctccacagtgagagaaccatccctctacttgaccactctgatgggaaactttctggcatgtcaaacttactgtgaccaaaatagaacttgtgatttatttttctcccccagtctcttccttcttaattagtggcaccatcatctatttacccaaattaataagcccagaaatgtaaaaattatcttagattccttctgcccttctgtatcctttccttccttacttctgtctgatctttctccaaaatatatcttgaattcatcttctcttcctctctagggatatcactgtgatcctagcctctgtcatctctcacctgtcttacttcttccagtcttgtctctcccattcagtctgttgttctccacccaggagccagagtaatcctttaaaaatgtaaatcagattagattatttatgtatgttagtcatttctactactttcattaattactggttcatatttatcatcccatttgataaaaaatctccagcatttccttttgcacgtgtataaaatccaagttagctgttaccatgtcgtgtatgatgtttctttcccttgctcctttttcaggcttcatcccatgccacttgccccatcacctgtaatgctaattctagttattttgttgttattttgtccttcctttcagttccttcccatcagcttttactccttcaatgtctatgcatttgccttttctggaatttctcctcctagctgtttgcatggctggcttcatttcatccaaagtagtttcttcctgttatattctgataacatcctgttttctccttcattgtatttataacaggctttaattatttgtttacattttactttttgactcccctagtttaatgttagctctgtgagaacagggacagatattcagcctagcctagaatattgcctagtatactgtagacattcatactcaggtagattaaagcaaatatagaaggaatgaaagttcaatgtcagaagtttaggctgtatagaaattagaaacttctgcatgtcagactctatagtatatttccataaatcgagggaaaaaaataaaatgatgatacagagtatcattctaaaaattctggaaagcactacaacctcaatagaaaaagtggacaaaagtccatcaatgatagactgcattaagaaaatgtggcacatacacaccatagaatactatgcagccatagaaatggatgagttcatgtcctttgtagggacatggatgaagctggaaaccatcattctcagcaaactattgcaaggacaaaaaaccaaacaccgcatgttctcacatgtgggaattgaacaatgagaacacctggacagagggtggggaacatcacacacggggacctgtcatggggttgggggagggggggagggatagcattaggagatatacctaatgctaaatgacgagttaacgggtgcagcacaccaacatggcacatgtatacatatgtaacaaacctgcgcattgtgcacatgtaccctagaacttaaagtataataataataataaaaaagaagaagtggacaaaaggtatggaacaataattaatgaaataaatagaaatgactaacatacaaaagaaaaaaatttttcccagtatccaaaaatacaaattaaagcatgttatttttgcctcatattttcaaagtgtaagaaaatagtatttttaaggttgggataagataatttacacacactggagggaatataaaattggtataggccagggacaatgtctcgtgcctgtagttccagcactttgggaggccaaggcaggaggattgcttgagtccaggagtttgagcctgggtgagacagtgagacccctgtctctaccaaaaaaaaaaaaaaaaaaaaaattagcctggtgtggtggcacacacctgtagtcccagctacttgagaggctgagttgggaggatcacttgagcccaggaggcttaggctgcagtgagtgtgatcatgcagctgtagcctgggtgacagagcaagaccctgtgtcaatcaatcagtagttggtatagcctttctggaaagcacagtgcttccagaccttcttcctttatggcagtttatagtcttactactttttgcatggcactcctaggccaaaccatatacctaacagtttcatttatgaagtagttcaaaacaattagttttttgtgttcaaccagtatgactgtatttccctcccaaattaacagtattgggaaagtgtccctgagagagtttgctgtgatgtccggtgcatggcagtgcagagtttggaaactggcaatatggacgtatggttaagggctttaagaaataagaaaatagataggaggaaagatttatgtacaaaattcttctgctcaaaaatgtccaaaattgatatttttacttctagtaattaggtgttcttgttttaggttgtaaatctctttcagagtttagtacatagcaggctggcctaagtactgactccttccctgcatgagttgcagaccatcgttttgtttgtttgttttttgtaactgcatagtgaaagaaatcttagttttgaaattctggtctcctgtttgaatgcatttgattgtgactgaatgagctctctctgactatttctggaataaaaagttgttgccttttctccagttcacgagggtttgcttctgagactaagtgctgctcgttaacaagtattgttaacaagcattgctgagcaaagaacacctgagtttaagccctggccctacttcttgctggctctgtagacttgagcaggttatttaataagctctctgaaattcagtttctcatctgtcaactggggtaagaactgctgatgtgcccacttcaaattgacagctgtaattcttaaatgagattatatttgtggagctgctttgtaatgctcagtgtatgtaggtatcactattttttccatttagctagaaatctagaggctttttcacttcatattttatgtaagctataaaaactatgattgattatttttattttactgatagggaatttacactgaaggagaacttaaggaacttgcaccagtttctgtatcaggttagatacaaaactgctacaggaacccttcgtttttaacacaccagcttttgcttggtaatgatgaattaatactctcttatcacatgtcaaactactaagctaagcactctacacattactttatttaacacgcacaacagagttgtgttatttagggactgttgttatgccttttatagatgaggagattgaaactcacagaggccacgtatctaagcattttctcaagctcaccttgctattaaggggcacagcctggattttaactcaggcattctgatgctacagctgtgatctattcaacattgtgttatattctctaatttgtcatttcgtggctttctagttcatgaaactgtagtaaatattttaaatctgcttttagaagttctgaattgaatatttttattaggaatacagtgtagccttttattaatatggtctcaaattgtaagaacataaagtaaagccagaaacgtaggttgaaacagaactcccagatccatgagttcagataaattattgtatagttttctaaaatacacaggaatgatttttcttttttttagatgtctaaaaaaatgtgctatctgtagttattaaattgtcattgctaaataaaggttgcctttgttgtccagaattattagctcaattgtattcagtctgaataatcttaaaaaaaaaaaaaagaaataaactataacatggtaacagttggcactctttttccctcctctccttgcaggcattctttagtggcaggctgaaggccagagggaacatcatgctgagccagaaacttcagatgattcttaaagactacgccaagctctgaagggcacactacactattaataaaaatggaatcattaaatactctcttcacccaaatatgcttgattattctgcaaaagtgattagaactaagatgcaggggaaattgcttaacattttcagatatcagataactgcagattttcattttctactaatttttcatgtatcattatttttacaaggaactatatataagctagcacataattatccttctgttcttagatctgtatcttcataataaaaaattttgcccaagtcctgtttccttagaatttgtgatagcattgataagttgaaaggaaaattaaatcaataaaggcctttgatacctttgt

SEQ ID NO: 12692 - DNA, 9450 bp, Homo sapiens
aggctcgtatttgcaagaaccagtatatccaggacaaactctacaaactgagatgtggaaggaaggaaacagaattcattttcaaaccaaggtatgaattttgctttttcacccttctcacatgctttatcattgtgttccatcttaccatttttttttggttagtactatggatagaaagttctttttaagtaatggtaaattttaattaaaaataagatacagcttgtctggtgttttcaaaatttttatttatcaggcaacacttaataaaatagaagtgttttgcaccctgtgttttattttctcttttattttcaactaaattggtagctatctatgtagcagtggcccagctattctgaaaacccagccaaccatgtctttttggctcaactagtcaatcaagtcattgtcaaaatatcatcttaaaaaatttaaaggcatgactcagacagatatacagtgaaaacatgacagaaatctatctgactcattaatgaaggatcttgcaatatgataaaacatgttcgaaaaaaaattagaacaacagtttatatggtccaataggaaagttattctaaaataattttgcagagttagagacaaaattagttaatatcctatagaacaataaaatcttatcctttatgagttttctctggacagaaatcatatgcatcttgattacacaaaaaatccacaaattaacaagttacatcacagagtctgggcctaacaaatagtaaatgaggttatttaggggtgaggctgttagcaattgctccagtaaaatactaaaaggacatgcaatcattgttttatttgcaagttattaaaagacagtttttgttaacacagttgaccaggctaatactttttggcttgatcatttcatgctatatagagcatattaaacaactccaatgataataggaacagctttcatttattgagaacctataaactggcaatagtattttctttaatatgcataataaatctgtatgtaaatataagaaaatctaggttcctaagaaaatctaatctaggtgtcctaaataacttgctcatggtcacacagcaagtggttgagctgggatagaaacccgatcagcatggcttcaaagctttgattacaggccccaaatgtcttttctgtatcatgttttctttcacaaatagatactgcaaaattcttcttacatggttgctttactcctaattcctttctgctggttgcaatatcattttcctgcttaatttgtacatattgtttattttacttttcaaattcctcctgtccttcaggcttaagttcaagctccactttgctcttagagacagtctcttactattccccactttcctacccatagatacactcaaattggtgttctctgaaagcctttgcagctaatatctgtgccacatattttggagccctcacattttctaatttgttttgtatgagtaagttttgctttttgattaagattatgaactctaaaagtgttaaggaccatgactatattacaggtttttattttcctgcaattctggtgatgaatagtatgtaaataatttctatggatacaaacttgaagggctgagaaatgattaaatgtctaaatataatgtattcttgccattttgttaaattctaagcatgctgtcttatcttttcagcatatttgctatatttttcttcagtgattatagatattctttttctattagttttaggactccttctctccctgcctccttttctcactttctccctcccttcctcctttcctttctattcttaagatataagaaacattttaaaccagtgttttaaaatgatttgcttgatttggtaacaataaagtaatttactgaagtgcattttgttcattaattatctctttccatgcttttcaatgtatgtaatttgaagtaaagtgaacaaattacttgaaagatcttttttcctccaaaatatgatgagatgtagtcagagaatgatcttcttgattgttaaaaatcaaagttttaataaacgctatgttaaactttagaaacttatcctatacatttgtagcaataacaatttttatgaaagaatagccattggaataatttgaaatgaaggactgggaattagaatttgaattcctttaatgactattttgataaaagcctatttagacatttagttcatgctgtgtacacttcctcttgaaataagacctggaattactacttaaaaaacactattatgatttgttcctagccaattttattctatattagcagaacaaatgtactttgagtaccattacctcatgtggctattgtgctatgccttttactatttataaggattcagcatggactgaattctgtttataagagtgcatcccctgatccccacttcccccccaaaaaatgcccaaaataccaaggcccagtctctatcagtgtatttacattagaattttgggggatgggacctcatagggtttctttgttctgttctgttttaaagggctccagctgattataaagccaggtttagtaacagttgtattaaatcagaaagcctttatgtttgttcatcttgacatttactttagcagccttttattttatctggattcattcatattctttctttcactatgaggcaacaaactaataccattttcacactttcgtactgtttcacagctgaaattacacttccattgtaatcagaataaatctttcttttcttctcctcctaaggtccaagaaactggagacattgtcatttcaaatgcatatgtggatcttgcaccaacatctggtacttcagctaagacaccctctgaggtaggttataaaaattagtatccaagccacttcctcatttaggaatttcagttaaggtgactttaagagtggttaggctacgttagaaaattaacaaccatgaaactattcttaattcttgaagtgaaaaacattaattcaaaacagcttggaatagaaggaatactctggcaatttatgaactttaaaaaactcgttttgcaggatactaggatatctttcaagagaacataattttctagttttagaataaataaatcagttgtttaatcagaatcttaagcaaacagcgttttggagaaaaatagattaaaaagttgaatatcctgtacctttttcttgatttaaaggtttatataaagttttgtatgcaaatatataaaccagcagcgtgtataatttattaaaacattgtattatttattagcatgctgagacttttgataaaaatgtttatattctatctctgaaatattaactttgtaatgttgaggtttcgatacccatgatctttaattgtctgtcataaaccatataactgactgaaaattaaaatcccttaagaatagtctaagaaaaaaaaaaacttagagcgggctcggtgcctcacgcctgtaatcccagccctttgggaggctgaagtggttaggtcacttgaggtcaggagttcaagaccagcctggccaacatggtgagactccatctctactaaaaatacaaaaattagccagccttggtggcaggctcctgtaatcccagctactcaagaagctgaagcaggagaatcacgggaacccgggaggtggaggttgcagtgagccaagattgcactactgcattctagcctgggcgacaagtctgtctcaaaaaaaaaaaaaaaaaacaaaaaacaaaaaaaacccaaaacttaagttttagagctgtaaagaaattcagacttcatgtaatttagtattattttataaataaaaaaaatgagaccatagaagttgattaatttgatcaggatctttctaaagttagctaaaacataggttgtccagttcctatttttcttttaaaatattatttctgaattctaataaaagtaaaatcctgttattaagaggactgaggttctgagtgatgtatacaaataagaaagtatgaaagacacattgtatgaagaaaactgacttatgtacagagttttaaaaaatcttttttttgcacatgttttataatcacttttctccatgagttatttttacagaacttttaaagtttattttgttgtcgttgttagggcgggaagcttcagagtacctttgtatttgaggaaataggacgccgcctaaaggatattgggcctgaggtggtgaagaaagtaaatgctgtatttgagtggcatataaccaaaggcggaaatattggggctaagtggagtaagttatagccctgattttataatattctaaggtaattcttagtaaataaagtatctttttaacaattaaagacctttgaaggtaggtaaatcttacctttttaggtaagttttttttcttttcccgtgggaatgaataggtttgggaatgtccaaaggggggtgtgtgtgtgtgtgtgtgtgtgtgtgtttgtgtgtgtgtgtaagagatgtagggaatcaattgaaatgaaaataacctgttttaagatttcattgtaatccttgaaagtagtttaaacagtcatcttggctatatgcatctttatctaatcttcagcttcttaaacataaggcaaattcatcaagtcaaaatgaagtatttttaagtcatgatatttgacagttacaaaattattttattcataccaaaacaataatttggattatcttaattatcaatataaaatcactattttctagatatatacagattatggtcaaaggtgtttgtttatctaatctagggaaattatctattagagtgccatgcacccaatataaaacatcttgccgcagaaagaaagcagtcatatttcttttcactgatgtggaggtccaaagagaccctggtaccattttgtgaagaaagagaaattagaggataaaaagaataaagaaaaaatattctgtcagatcttttgcatctgctgtgtaactcacatccttaatcatggcacacactttaattatggaatattctaacctcacctttattttcctagagattcttcaattaggttgaaaagatgaaaatggataggaggtagagcagtaagtccctgaattccctttcagcagagtctgttgcttgtcacagttatcttactgtattatggtcatttataattgtatgttttctctcatttgactttgggcttaatcctgagaaatggctgcagtttgtctatttctagcttctagtatagtcaataacacataataactagcctgattctgtatatgttggaatgagtgctaaaagccatgtagaaagcatagttttagaaaatagtatggctgccttttaaaaaaaaggttctgaaattgatgctttaccttctattaaaataatgtttattgtatggatagtgatgtttattttttgtttagtatgagtgaaatatgtaagtataatatgatactgagatatttcataaataactaacatattttatagtatttattactattaatttctaaacccagccagaagttgttgtagtaaaccctttgaatcctattttattgttctaagcaacggtaaaaaatcggaggaaatgaaagatgacataaaggcataagggagataaagaatcagaggatttatgtggcctacagaatagtctgctcttgaaaattaaaacataggtactcttatctgaaactccagaaaccaaaaagctctaaaaataaacagttttttttctcatgattcactggtggtgaagtgtgacttgaacttatatgatgctgttgattgtctttaactcagctagtgtgagttagacaagtatagaagtaatatgcacgtttatagattgttgcaccattgggggccttttgtaatatggaatacatgttttatgtattatatttcctttctaaaatctgattccaaattccaaaacacatcagcctgaagcagttcattcagataaggacttgtggacctgtacatgtatataaataattcttgtagaacacaagtgataagagacatggaaaaaagtgctctctgctttcagagaatgggaggattggttcattcaatgaacatttgagtatttatatgccaagttctctgctaggtggagactacaaatatgcattgacaggatgcctttttttttttttaaatccatagggataattatttacaggctgtgtgtcaggaaaggtgaaatactggggttgaggaaacaaaggttgttgcattgcagagtgaaaggaagacctcaattaaggaaatagtaataatggagaggagagggcctatgtggaactattgctaagattgaattggctaacttagctactgattatgtctaaaaatcaagaggaatgagaaagagtcaaaactaatactgtggttttgagcttgtgtgcttgaggatgttgactgcattactagaagtatgaaacaggtagaggagggaggtttgggagagaagaaggtaagttgtggtaccaacactgtagcccaccaagatctggactatattgtggggactgtgggcctggaatttaagagtaacttcatagctagaggcagagagttggaaagcatatttgaggaattagtagttggaaccaagaacgttggcttcatacaccaccttgacttcatgacatgcaggaagaaaatggaaggaaaatctttgttggtcctgctgttcctgttcactttatggaataatggttctacacatttccatcttgtctgtaaaacaaaatgaatatcatagaatttggcccacaggttttaaatatgcaatttgtcagtattttaggcaaagacaatcctatactttcaaatagaaatatattagtttgtatgtatccaatacctgtaaaataatattcactgaaactttttcataaagatttatttccatgtgttgaatacaatgttgctgcagcaaaatctgttttgttttctttaggatgataggtttaagctggttagcattgagcagtttggttgttttcctcctgaattaaattgtggtttcctttcacatgtttgtaatcatttccattataggaacataagtggaattgacatttagttggcaagatactatggatttttgtttgaatattgtttttgtttgaatacataataaatgaccgagtttttaaaaggcacgtactataattagttgtgtagagttaagtctgcatatctggactaaatccaacctccattatgtactatatatgtactgtatgatgatgtgactggatgaggatgttctttgactgttagaggttatctattttgaatcttagacatttgccacagtatgtaagaatgtacagaggtttgggaactggcattcttttgataccagaataattaattcttgaggataccatgtgatcattaaaacctctgagctcctgggttggtgctcatcttctagcagtcaaaccagattgccgcttaggattctcaacttggatataaactaaatctcaagggtgttggttccaaacattggatttggattgaaatgagtgtctcatgcatttatagaaaagtcttgaaagattttccttgaaaaggaatatgctctccagttaggaatgggggcctgtttgttggaggtgtatctgcctcagggttactctctattcccaaagcaacagtgactgtttcttctcttactaacagcagctcctgactgcgtgctcatgtacatttatcttcaaaagtacacacaagtgcacaaaatcatttaaaacaatttctgactttccatcttctctgtgttattcatcttaataacatcattttgtacttttttttgtttgaaacaatttgagaattatagaaaagttgcaaaaatactagagaacttttgtctttcatccagtttcctcaaattgttaaaatttgtatctcatcttctttactatttttttccatcatatgtgtttttttcttctgaggcatttaagagtaacttgcagacatgatgtccctttatgcctaagagactatgctactagcattttctaagaacaaagacattctcttatctattcacacaacaaagatcaatatcaggagattaacattgatgcagtatgttagctaatctgcagatcttgttaatatttcaattgtcccaataatgtcctttatagcaaaacaataataattattattcattactaaaatgaagaaagaaaaagaattgatcagggtcccatctgggattatacattacatttggttcttaggtctctagtctgctttaatctggatgagttcctcagtctttgcttttcccaattttgagatatttgaaggctggagaccaattattttatagcttgtttcttggtttgtttttagttgatgcttttttcatgtttagttttagtttatgaacttttggcaggaataacacaaaagtaatatgctcttggtgtgatttttaaaaacttaatttttaacctgggtttttttctttgtgtttgttattactaatatatattttatatatatatatatatttttgggggtagacatccttctttcatgtgcttttccatttatcaaataattcctaagtattttctcttcaaggaagtataggggatacaaagacaaaacatgtttgtgccagcaaagacctaatattaagggaaggtagcataaacaaaaacagttccttctttctcctgtagtgaccctttgtgatttgtaaagtatatatcttaataagatcctcaggggtctccaagttttcaaatgccatattctcatctgttacctcacccctccctcattaaatgctgtgaagtatgactgaaattgttatggactctttcagaagcttagttattaataaatacagagctaaaaatcaacagtaagatgcctgtaatgaattctgccactaagagaaaatgaatacaatctctttcttcacttctgaaataagattagctgtgatcttataggtgtctataaactcaaggtgatggtggtggttgcagaccatgacctgagccactacagaactggaagttccacttctttacctcaaatttctgtattcttgtatttctatattttgctttttttctaaatgacagataatgtataattgatagatagaatatgtgtagaataagtgccacattaacatggaaactatagaaatgtctgcattttacttggtttattttaccctcattttgttggagagaaaaagatacacattggtttcttcctatttttcccagctattgacctgaaaagtggttctggaaaagtgtaccaaggccctgcaaaaggtgctgctgatacaacaatcatactttcagatgaagatttcatggaggtggtcctgggcaagcttgaccctcagaaggtaatgttctca

SEQ ID NO: 12693 - DNA, 149 bp, Homo sapiens
gggatagcattaggagatatacctaatgctaaatgacgagttaacgggtgcagcacaccaacatggcacatgtatacatatgtaacaaacctgcgcattgtgcacatgtaccctagaacttaaagtataataataataataaaaaagaa

SEQ ID NO: 12694 - DNA, 463 bp, Homo sapiens
caatttcaggccctgaaatgtgtttttctttcatttgtatacatcatgatatatatttgctaacattttattatataaagtgcttttaaaaaattatcatttacttctcttagcatctcatatgggaccttgcaagtcaccagtattcaataattgtttatttgatttcattatattaagaagacatgtaaaggaaagaatattgagtcattgggaaagtaaataatctatagaaccattatatggagtcatggggaaggaaaagagcttattggaattatacaaagcatattaaaaagaatgatgctttcttatgaattatagaatattttctataaataaaacttgttaaaaataatcagtagtttaaaagtaataaaagatcagtaattttaaaaagatatggctagtctttacacagcatttcagtagtctttggaaaacagcacagcaattaatgaga

SEQ ID NO: 12695 - DNA, 2531 bp, Homo sapiens
ttaggttttgctgctttatacacaggaatgatttattttacatactagtcagttacaacattagcctgtaaaatgaaatccattttttaaggtctcataaggcagaataaacttcataatattatgctttcacattagccagtctgataaagcataaacaacttaagactatggtaacagtttaaaataaaatttacagaacaggcactttgaagtcagctactgtgtgtaacttcacagttaacgttacttggacatatctcatttcatcaaaggttatcacccagtgaagcaaatgttcctttgatgcagacgcacaaacagatttaggttccaaacactgtattctggttgtaatacatgcaagacagaccctaagttagaaaaatcttctgaaagaaaatgaaaaacaaaaagcagccagaaatgaaagcatttacaagcacttgaataaggcctttcaatgttaaatcagtgttttaaatcccttcattctcaggtaagggattaagaggccgagagagatatcgtctgcgagggtgaggatactggaggttggcagtgtcagcatcgcaagagtgctctaccagaggaggaggaggaggaggaaggagctgggcataactggaccatctcgatccagcccgtggggaatccagaggggtaaagaaatacctgaaacaatgaagacaggaacaaaacaccaaacaaaacaaaaacaggaaaaaaaaaaacacaagaaaaagagaaaagtagtaaatacaaagagaaccaaagaggagaaaacacatgctagaaaaaaaaaaaaaagctttagtatattcatgccaaaactaacagaacataatagcacaaatcaagacccttactcaaatcaagattgcttaagcaagtatagaaacttgaaaggaatacaatctgttaaacttaaaatgttaaaaaatatatataaatgttacaaagaaaaacattaattttataaattcaaaacattttctaatctctcagaaacatctgatgctattctgtacatttacagatctagttaagttttttatcttaagcaatggttcactcacagcagcagcaagcacacattttttttagtgcgtacatgatactgggaatacacatagtatggctggctactgcaacatgcttttgaagaactacaaacattgaacacttatttttctgcaaaagccttagaatagctaccaaattttgataagtaaaaggattcacagaatgactgtgccctactgttattcttcttccatcttgtaacttaccgataatacttacgcatattagcaaacttaaatatttatagctttgttatcaaggtcagaactttacaggacatgaattaatttaaacagcgaactaaattaagaaaatcttgagacatggaatgctgacaattaatttacatgcacaattttagtaaaattttaatggcttctcttaatagtgtgtgtccaaattttgatttgaaggaagctaagccatggaataaataacaccataaaaatacacaaatgtatataagaaacatttatctctttagtgactatgaattaaaaacttataaaaaaagtgtttccatcttagtcccaaattgtaaatgaaacaataccaaatgcttaacctggctacaaactgtacagtcaagttcctttcattttactattactactttattaattcactcctttactaatattttttaaatattacaaagaaatgacagagttgtactgaatatcatggataaagcaaatctacaaaaagtaaacaaatcagcactcaaaacaatctttataaaaaatatttattcaatcttcaaattaaaattataaaagttcatcattttaagctgttttaagaaagcaaaagaaatatgtctatattttccaaatgaactaaagtggtattcccctcctcccaactactcagataagaatggtaacaacccttttaatctttaaacccaaattagtttcaggaacatttcaaaaaattgttttggtgacaatgtctcaacagaaagcctctccgtttatatttcaaaagtttcaaatagtgtcaataaactgactagtacaaaaaatatacactgtatttttaaaggccttttggattgcgtttagtagtaagcaggctgctggtgtatcttgggagaggtcaaacggcgctggggaaggggaaaaggagctcgctttccattcctgtgtgcatgcaacaagcagcaaaacagcaaagttactccagttagcttgtactcagctgtgctttctgttaaaggacataatacaaatggaaaagggaaaatgcatcacagatctaacacagatggttattggcacaataagaatacagatcaaaaaatagaagctatttacaaaagaaaatatgcagtacaggcagtgaccaaaaaccagactttaaaaaatcaactctaatattatttgtttcatgaaataatctttataatctggtatcttccacggtaacctgaaattgttttg

SEQ ID NO: 12696 - DNA, 912 bp, Homo sapiens
tttttaaatatattttattacataacctacttggataataattacaaaagctttaaacagtaattccaagtagtgaaaggcaatttcctttaaaaaaaaaaaaaaaaaaaaaagaccaaaaagtccacattaggttttgctgctttatacacaggaatgatttattttacatactagtcagttacaacattagcctgtaaaatgaaatccattttttaaggtctcataaggcagaataaacttcataatattatgctttcacattagccagtctgataaagcataaacaacttaagactatggtaacagtttaaaataaaatttacagaacaggcactttgaagtcagctactgtgtgtaacttcacagttaacgttacttggacatatctcatttcatcaaaggttatcacccagtgaagcaaatgttcctttgatgcagacgcacaaacagatttaggttccaaacactgtattctggttgtaatacatgcaagacagaccctaagttagaaaaatcttctgaaagaaaatgaaaaacaaaaagcagccagaaatgaaagcatttacaagcacttgaataaggcctttcaatgttaaatcagtgttttaaatcccttcattctcaggtaagggattaagaggccgagagagatatcgtctgcgagggtgaggatactggaggttggcagtgtcagcatcgcaagagtgctctaccacaggaggaggaggaggaggaaggagctgggcataactggaccatctcgatccagcccgtggggaatccagaggggtaaagaaatacctgaaacaatgaagacaggaacaaaacaccaaacaaaacaaaaacaggattttaaaaacacaacccaaagagaaaagtagtaaatacaaagagaaccaaagaggagaa

SEQ ID NO: 12697 - DNA, 5097 bp, Homo sapiens
tgattcctctgtgtagcatctttggggccctcattgctgtgtgcctcatcatgggtctcttcgatggatgcttcatttccattatggctcccatagcctttgagttagttggtgcccaggatgtctcccaagcaattggatttctgctcggattcatgtctatacccatgactgttggcccacccattgcaggtaaatataatgattctccagtagttatattaattcatagtattttctacttcaggtcttaattaagtctcatttatatgtaaaacatattacaggttattgattactggtcttttgcttttatgtatgccttactggtaacatttttaataagactagctattaaacagtatgttgaatttgctgaagagtccctcttatccttactggcagctaaaacactatataaaacactttgggaggctgaggcgggaagatcacctgagctcaggagcttgagaccagcctggacaacatagtgagacactatctctacaaaaaataaaaaataaaaaaattagccaggcgtggtggcatgcatctgcagtcccagatgcacaggaggctgaggtggggggattgcttgagcccagaggtcaaggctgcagtgagctgtgatcataccactgtaccccagcctaggcgaaaccctatctttaaaaaaaaaaaaagttgaagattctgaaagatttctaaatatgtcggcttttggtaagagatcatacatccccctgaggagtagttgatgaaaaataacatgatagaaaaaacccaaatgcctgtaaatagctaactgggtaagcaaaatgtggaatatctacagtgcaatattattcagccataaaaaggagtaaggtacagaactgatgctaccaggtgaatggacctcaagaacattatgctaagtgaaagaagccaaacataaaaggtgacgtggctgggcatggtggctcacacctgtaatcccagcactttgagaggccaaggcaggagaatcatttgagctcaggagttccagactagcttgggtaacatagcaagaccttgtctctactaaaaataaaaaaaattagcctggcatggtgacacatactaatattagtgtagtcccacctactccagaggcggaggcgagaggatctattgcgcctgggagatcaaggctgcagagccgtgatagcaccactgcactccagcctgggtgacagagtgagaccctgtctcaaaataaaaggtcatatatcgtatgatttatttcatgtgaaatatccaaaataggtaaattcatacagatagaaaactggtgactgccaggggctggagagaaagggattgggaagtaactacttaattggaatgaagtgtccttttggcatgatgaaaatattttggaactaaatagaagcagtgggtgcaaaacattgtgtatgtgctaaatgccactgaattgttcactttcaaatggttaattctatttcatgtgaattccacctctagaaattctctgaatgatattataaagatgtcctatgttcagtattacttgggtgcctgtgtcaattagtattagaagattcagtataaatatgataaaatttaaatgtgtgtactgtcatctgtgtttggcacatgaggtgctcagtgaaggtttagctcaattcattctcataccctgaactgtattcctagtcatgaatcaagcaagcagagttactactgagcagaccaaatccagtttaagttcaaaaggtcatggtctccttataggagaaccctccattccttcttctctcccgcaggtaatatagtattcactcttctttctatagcctacaagcttagttttatagtttctaagtccacagcagattttatataagcagcactctagtagtaaatagttttgctaccagaagtgacagttaacagagcaagaataagggaggtaacaggaaacttctaaagcaggcagaacaccaccacacagcaactggcagcagaaagctgctggctcaccaggaggctctgagggcatcatagtattacagcagaacataatcatgagtgttcataaggaggaagagttcaggaatggtctgattccaaagatagaaaacttgtgcatttacagatattgtctattttatatatgcagaatggatgtacacatttttatgtgttggtacttaattggacaaatggtcagctatttatttaacaatgtcagatagatatttagtacagtatattccctggacattttagataacttaggttttatagtataagttataagagtttaaaaacactaagataacttttaaaaccatgagtcctggaatttgttagagaaattagaaatgttgagtaccgtaaaagttttcagaagcagaacccgaatatagaatgccattaataattcttatatacttacattttcttccaggtacttataaaccttagtctatttccaaaatgtatttaacaacctaactttcatccaaattattaaatttaaaatttttcttaattttgaattatgatgttaaatagttttcatgttatttcataaaaaacaaatacaccaaagagtagtttgaaagctgggcatggtggctcatgcctgtaatctcagcattttgggaggctgaggtgggaggattgctttagcctaggagcttgagaccagcctgggtaatgtgacaaaaccccatctctacaaaaaatataaaaattagccaggcatggtagcatgcacctgtagtcccagctactcaagaggctgagctgggaggatcaattgagcttgggaagtcaaggcctgcatgagccatgattatgctaccgcactccagcctgggtgacacagtgagaccctgtctcaaaaaaaaaaaaacgtctacctttctatcttttcaagtaatgtcttggtatgaaaatccagaggactgtactttatgacaacgttaaagatatgagatctttttcttcctatcaaaaaaggtttatatttcagatctgtttcctaaaaaaaaaaaaaagtctgatgtctgagatgtctgaatcagtcctgtggctgatctagaccccctacagagccacacttgttctcccttggtgacagctttttcccttctcagggttacttcgtgacaaactgggctcctatgatgtggcattctacctcgctggagtccctccccttattggaggtgctgtgctttgttttatcccgtggatccatagtaagaagcaaagagagatcagtaaaaccactggaaaagaaaagatggagaaaatgttggaaaaccagaactctctgctgtcaagttcatctggaatgttcaagaaagaatctgactctattatttaatatcttacatacctccaccagactggacttgctttttgaattttaagcaagtttcctttccttttatacaaattgcaaatttcatatttttttaatcacatcctaggaatagcacaataattgggaaatagaacccttatcactagaagaaccattttctgccactaaatatctctgatgtttccatgagtctgagggcagagactctggtatatgaaaacatgtctgaaagtcacatattgtgaaaatttgaagctatctcagtaaaaagcagctttggaaactgtgaatgatctttagcttgtacaaatgtttaaaaatacctcaggctatactgaaagggttgcagtttggttaggagtggaaatattttgtttgttaatgatgtcttcagttctggtacctctgttttactttcttatgctctttggaaactttttgcaaaatttaagcctgggttctagataataccagatctacctaaacctcaagtctatgttaaagttgctttcctgctgttaaataagctatgatattaagatattctgacttgctccagtgtcaagggaccttctgggagcaggtgctaacatagtgttcagaatcaatatgtgagatgaaaaggatcccctccaggaggatcctgagctgttcagaaatcatttaagtttacagcgttgttccctttgcgtttgcagtgcgttttactcaagtagccagaaacaccccacgtttctgaatttgtttaaactgtaacaataaagtaaaatagaatgcatgaaagatattctggcgattgtaacttagaatttttctgacttctggatttgttggcactagaacctgatatttaaacaaagtcttactgagcagctatcaagtggcagttacaggcacaaattggtggaggctggaggatggggaggggagcaaaaccctttatatttgtgaagaaaatatctgtagctgatagaaataattgcttaaattggtttatgaaattaatgagtctgaaaaggttaaaagcacttataaaaagaaccaagtcctacatttccagaactttctggcaaaaatttgcactcatattatttatcctatgaacattcccattgtttttttttgctatttatatacagattatcataagaaagctctcagtttgaggacccaaaataaaaccaaagtcatgccatgacccatactcatttacaaaaacaagaacactttcctctatccctaaaattatgctttagtacttgaggcctttaaaagttagtgcttttgattgtgaagacattcagcaacttactttgtcatacatgcagttgcaccttaccacttctaatagtgtcatatttcatattcaggggacttagataatttgcctgtggatggttcttttgcaggaaaaaaaatctacattttgaccatactaccctttcatgttcttattataagcttttagaaaatgatttcattcagtcatgtccagttatataaaacgttactttctcatttttgagaagttcaacaaaacatactactaagaccaatcatcaaacccactattataaatgttaattttggctgggtaaggtggcttgcgcctataatcccagcactttgggaggctgaggagggaagattgcttgagcccaggagtttgagaccagcctgggcaacatagcaagatcctgtctctactaaaa

SEQ ID NO: 12698 - DNA, 143 bp, Homo sapiens
gcccacctgtagccccagctactcagaggctgaggtagtggaaggattgcttgagcctaagagatggaggctgcagtgagctatgccactgtactctagcctgttcaactgagcagaaccctgtctgtaaaagaaaatcaaaa

SEQ ID NO: 12699 - DNA, 408 bp, Homo sapiens
aaatcttattcattgttgaaacctctagcacatagcacagtgcctaccaaatagtaggcaaaatcaggtgttcaattctattaactactctaacactgaactgaaagtgttcaatggctcaaaataatataataagccttaactctggggtgcttaaatttatctataatctctgccagtgaagtatacatagttttaaaggttaaaaaaaaatcaagtgtttaatgaatttgagctgattgagcactgaccagatacaggatccttaaacttcataatatctagtccaaagatgaattttttttttggtacagattctgacttcaagggatttgcaggctgggagggaaattaaatatataaaaagtcattttcggccaggcgctgtggctcatgcctgtaatccca

SEQ ID NO: 12700 - DNA, 4750 bp, Homo sapiens
ttaagcatgtaataatgatttaatgtacattgtgcacaaatacaatatttaaaaaataaaaatagaaaatcaaaattcaaatacaaaagtaaactacattcatcactccaaaatatcttttaaggagaattgttaaaactgaccaaaagagtcaactaaagcctgaataaaattttgatgctactgttacattaataattgaacagcatttacaagaaaactatatactccacaaaatgtatgtgttcagtcttagtcacttatctgctcttaagacgtaaataaatgttcttaggggggaaaaccaattatccagtcctccccgcttccttatttgtctgttcccaccactatcctctccccgacctatacatacatacacacacacacacacacacacacacacacattctagcatgatattgtctatgtggtagagccttaaaaaatgttatttctttcagatatggtctacaaatagaaaaaataatattaatgagcattgtcaaaagttttacaatattttgagaaaatcacgcataaactattaagctgtatgttccattggaccacaactttatggttgagcattgttaaaacaaaacataactatagacatcattttctggatgactctcattcagaattgctggtattcctggctcttctttgggtttttctttcatttctgtaaaatcaaataaaataaaaaatagattcaataaattgtattgggacaattgactctccatttggaggaagaaaaactgctttacaacatacacaacaacaaaccgtagatggggtaaatttttaaataccataaagttatagaaataatagtgtttttagtaatcttaggatgctaagcagaacacagagaccagaaaccataaaggaaaagactagcaagttcgaatacctaaaaagtaaaattatatatggtgaaaaccactataaacaaagttaaaccaaatcaaagacaactggaaaaatatttgcaacatatacatagtaaaaactattatttaaagaggttttttaatcggaaaaaagaaataaaaaatgttgaatgggataaggattcaaacaggcaattcttaaaaaattatatttataataatcctgaaaagatgtctagtaacattaattataaaagggggtgattaagaccattaggtgtgttttattttttaacctatcacttctcagccttttggctaagatcaagtgtatttttttttttttttttttgagccggagtctcgctctgtcgcccaggctggagtgcagtggcgcgatctctgctcactgcaagctccgcctcccgggttcacgccattctcctgcttcagcctcccgagtagctgggactacaggcgcccgccaccgcgcccggctaattttttgtaattttagtagagacggggtttcatcgtgttagccagaatggtctcgatctcctgacctcgtgatccgcccacctcggcctcccaacgtgctgggattacaggcgtgagccaccgcgcccggccgatcaagtgtattttttaacctagcagacagacaaggatttttaaaatgtcataatgtacagtgctgacaagggtgtggggaaaaggcacctgtctcgtgtgaattgctaccacatttctggaggctagtctgactgactgtatattcaaactttaaatttgggtaccgtttggcccaacaatttgatttctaggggttgattcaaaggaaataatcagacaaacttcagcctccagtgcctccatttccttatatttagaatgggagtattatttatccagtagagcttttaacattgaataaaataaaccacataaaatatttaatatggtgtctggcacatagaaaagtaccagataaatgttaactaaataaatgttattcccaatgatgttcattgaacattgttgtaatagtaaaacttggcagtaacctaagtgttcatccttatagagactggttgaatatacatatagcacagtactatgcagttgttacaaaagacatcataaagatggctgcaatacatattgtaaatgaaaacaaaaacaagttacaggataggatgggtactgtctcatttgttgaaacaaaacaaccttaacattgggaactgaagatagaagatggtattataggggacttttactttacttgatattcacttacatattgctttattataatgaacacttactacttttataatcaggaaaaatagatattcccatttatttggtcaaacaaagccaaaaataaaataagcgttaattaattgaccatatcgaccttgctgggtttagaatgaagcagttaggaatcaggacgctgtgttggttagagctgcttctccagcagggtactcctgtcagtgcacgtactgcttcacatgcctgcttttgctgcaatgtatttctttaaagtagttcttcaaaactggtattacttggaaaccaactagcaccatgtttttgttgcactcatcttttaggataaagagcaagtaaactactaaagggatttctttagaaatcagtttcctggggataactatggtctgatagactcagtccatttcttatactgtctacagtattgtacaaagagagctgaagttctcagttatgtctctgaggcaagtgaaattaaagaaaggttgcattattttcaaattcctatacttaggaaaaagtttttcaggaacaaatcttgaaatagaaagggtttttggtaaacctgataaatcctacaagaatgaattccctagtaacaggattatattttacagcttttatctccctcagtacttcgtactatgaatttacctgctttccatttatcaggcaaattaaatttcctagaaaaacttcattcatcaagctttcttgttaatgtagacttaatttttaaaaatattttgcaataattcatcctatattgggttcatttcactgactatagcatctcataatggatggatagtatgaataagtacttaatgtacatgcttgcattttcaatttttttaactctttgaaatatgccaagacagacgttggttgcatgaaaatattgttcacttaaaactagtcaatgaaattcacagtatccattgaaataacagggaatacccaggattgtcagagaaagttgtaaatcactactctgggggagatgtacctaccttggtgctataaacagcccttaccttgaggaaaagtataagcatctttagcatcttcctggtgtgctttaggatcctggccttggggcccacctgtttcttggtgtggttctggaaagcattctttaggcacatccttatttttatatgtctcagtagagaggtcttcaggccccggtgtttcttggtatatttcaggtgaatattcttcaagctgggatgtttcttggtatatttcaggtgaatattcttcaagcccaggtatttcttgatacgtttcaggtgaatatttttcagacccaggagtttcttggtttatttcaattgaatagtcttcagaatgaggtgtttcttggattgttttatgagagggggctttaggcacaataatttcgttacatgttttatgaggaaggtatttaggttcagctgattcttggtgtgtttttgtagaaaggtctttaggctcagctatttcttgtattttaggaaaaaggccttctgtctcagctattccttgatctgtttcattgtattcctctggttctgctggattttggtctgtgtcaagaatatagcctttaggcacatctggttttggatatgcttgaagagagcatcctgccagatcagctgtgtcttcagatgttggacaaggaaggattttgggtacagcagcttcttggcacattttaggagccagatcttctcgtttagccatatcttggtacattttgaaaggatggtcttgaattacagatattacttggcatgtgttaggagagttgtcttcaggttccttcatgtcttggcatattttggaagaattgtcttgaagtacagatatttcttggtacattttaggagagaggtcttcaggttcagacacatgttggcatgtttcagaagaatggttttgtactgctatttcttggtactcagaaaaattctcctgatatatgttactttcttgacatatttcagaaaagtgttcctcaggcacaactttttgcggggaggctactgaaggaaatactttggttatgctcccaggtggctcagtttttttctctataggtgccagtgctttctccactatttccttttctatctgtggctgaggctccaccttcaattctgtgttttgttgtctctttctgcctcttcgatttccttttcctgttctctgctgcttgcgttttttctgttctctgcagaaagaacagaattagtgtcagcagtggtactacagaattcaaataaatgcttgtaataacagtgccaggtcccccactgcctcattgcacaagtatcatgaactagtcacttaatctctctgggcctcaatctccttgtttgtaaaatgaaggagcagctctagatgttctcaattcttaggagagggaatgtttctccaggacttcgtggcattgataccatgcttaccaggagccttcttggtgagggtagtgcatgcgcgtatgcgtgcgtgcgtgtgttatagcatattcttaaagttttgttatggaa

SEQ ID NO: 12701 - DNA, 14021 bp, Homo sapiens
  misc_feature (10324)..(10324): n equals a,t,g, or c
ttaagcatgtaataatgatttaatgtacattgtgcacaaatacaatatttaaaaaataaaaatagaaaatcaaaattcaaatacaaaagtaaactacattcatcactccaaaatatcttttaaggagaattgttaaaactgaccaaaagagtcaactaaagcctgaataaaattttgatgctactgttacattaataattgaacagcatttacaagaaaactatatactccacaaaatgtatgtgttcagtcttagtcacttatctgctcttaagacgtaaataaatgttcttaggggggaaaaccaattatccagtcctccccgcttccttatttgtctgttcccaccactatcctctccccgacctatacatacatacacacacacacacacacacacacacacacattctagcatgatattgtctatgtggtagagccttaaaaaatgttatttctttcagatatggtctacaaatagaaaaaataatattaatgagcattgtcaaaagttttacaatattttgagaaaatcacgcataaactattaagctgtatgttccattggaccacaactttatggttgagcattgttaaaacaaaacataactatagacatcattttctggatgactctcattcagaattgctggtattcctggctcttctttgggtttttctttcatttctgtaaaatcaaataaaataaaaaatagattcaataaattgtattgggacaattgactctccatttggaggaagaaaaactgctttacaacatacacaacaacaaaccgtagatggggtaaatttttaaataccataaagttatagaaataatagtgtttttagtaatcttaggatgctaagcagaacacagagaccagaaaccataaaggaaaagactagcaagttcgaatacctaaaaagtaaaattatatatggtgaaaacccactataaacaaagttaaaccaaatcaaagacaactggaaaaatatttgcaacatatacatagtaaaaactattatttaaagaggttttttaatcggaaaaaagaaataaaaaatgttgaatgggataaggattcaaacaggcaattcttaaaaaattatatttataataatcctgaaaagatgtctagtaacattaattataaaagggggtgattaagaccattaggtgtgttttattttttaacctatcacttctcagccttttggctaagatcaagtgtatttttttttttttttttttgagccggagtctcgctctgtcgcccaggctggagtgcagtggcgcgatctctgctcactgcaagctccgcctcccgggttcacgccattctcctgcttcagcctcccgagtagctgggactacaggcgcccgccaccgcgcccggctaattttttgtaattttagtagagacggggtttcatcgtgttagccagaatggtctcgatctcctgacctcgtgatccgcccacctcggcctcccaacgtgctgggattacaggcgtgagccaccgcgcccggccgatcaagtgtattttttaacctagcagacagacaaggatttttaaaatgtcataatgtacagtgctgacaagggtgtggggaaaaggcacctgtctcgtgtgaattgctaccacatttctggaggctagtctgactgactgtatattcaaactttaaatttgggtaccgtttggcccaacaatttgatttctaggggttgattcaaaggaaataatcagacaaacttcagcctccagtgcctccatttccttatatttagaatgggagtattatttatccagtagagcttttaacattgaataaaataaaccacataaaatatttaatatggtgtctggcacatagaaaagtaccagataaatgttaactaaataaatgttattcccaatgatgttcattgaacattgttgtaatagtaaaacttggcagtaacctaagtgttcatccttatagagactggttgaatatacatatagcacagtactatgcagttgttacaaaagacatcataaagatggctgcaatacatattgtaaatgaaaacaaaaacaagttacaggataggatgggtactgtctcatttgttgaaacaaaacaaccttaacattgggaactgaagatagaagatggtattataggggacttttactttacttgatattcacttacatattgctttattataatgaacacttactacttttataatcaggaaaaatagatattcccatttatttggtcaaacaaagccaaaaataaaataagcgttaattaattgaccatatcgaccttgctgggtttagaatgaagcagttaggaatcaggacgctgtgttggttagagctgcttctccagcagggtactcctgtcagtgcacgtactgcttcacatgcctgcttttgctgcaatgtatttctttaaagtagttcttcaaaactggtattacttggaaaccaactagcaccatgtttttgttgcactcatcttttaggataaagagcaagtaaactactaaagggatttctttagaaatcagtttcctggggataactatggtctgatagactcagtccatttcttatactgtctacagtattgtacaaagagagctgaagttctcagttatgtctctgaggcaagtgaaattaaagaaaggttgcattattttcaaattcctatacttaggaaaaagtttttcaggaacaaatcttgaaatagaaagggtttttggtaaacctgataaatcctacaagaatgaattccctagtaacaggattatattttacagcttttatctccctcagtacttcgtactatgaatttacctgctttccatttatcaggcaaattaaatttcctagaaaaacttcattcatcaagctttcttgttaatgtagacttaatttttaaaaatattttgcaataattcatcctatattgggttcatttcactgactatagcatctcataatggatggatagtatgaataagtacttaatgtacatgcttgcattttcaatttttttaactctttgaaatatgccaagacagacgttggttgcatgaaaatattgttcacttaaaactagtcaatgaaattcacagtatccattgaaataacagggaatacccaggattgtcagagaaagttgtaaatcactactctgggggagatgtacctaccttggtgctataaacagcccttaccttgaggaaaagtataagcatctttagcatcttcctggtgtgctttaggatcctggccttggggcccacctgtttcttggtgtggttctggaaagcattctttaggcacatccttatttttatatgtctcagtagagaggtcttcaggccccggtgtttcttggtatatttcaggtgaatattcttcaagctgggatgtttcttggtatatttcaggtgaatattcttcaagcccaggtatttcttgatacgtttcaggtgaatatttttcagacccaggagtttcttggtttatttcaattgaatagtcttcagaatgaggtgtttcttggattgttttatgagagggggctttaggcacaataatttcgttacatgttttatgaggaaggtatttaggttcagctgattcttggtgtgtttttgtagaaaggtctttaggctcagctatttcttgtattttaggaaaaaggccttctgtctcagctattccttgatctgtttcattgtattcctctggttctgctggattttggtctgtgtcaagaatatagcctttaggcacatctggttttggatatgcttgaagagagcatcctgccagatcagctgtgtcttcagatgttggacaaggaaggattttgggtacagcagcttcttggcacattttaggagccagatcttctcgtttagccatatcttggtacattttgaaaggatggtcttgaattacagatattacttggcatgtgttaggagagttgtcttcaggttccttcatgtcttggcatattttggaagaattgtcttgaagtacagatatttcttggtacattttaggagagaggtcttcaggttcagacacatgttggcatgtttcagaagaatggttttgtactgctatttcttggtactcagaaaaattctcctgatatatgttactttcttgacatatttcagaaaagtgttcctcaggcacaactttttgcggggaggctactgaaggaaatactttggttatgctcccaggtggctcagtttttttctctataggtgccagtgctttctccactatttccttttctatctgtggctgaggctccaccttcaattctgtgttttgttgtctctttctgcctcttcgatttccttttcctgttctctgctgcttgcgttttttctgttctctgcagaaagaacagaattagtgtcagcagtggtactacagaattcaaataaatgcttgtaataacagtgccaggtcccccactgcctcattgcacaagtatcatgaactagtcacttaatctctctgggcctcaatctccttgtttgtaaaatgaaggagcagctctagatgttctcaattcttaggagagggaatgtttctccaggacttcgtggcattgataccatgcttaccaggagccttcttggtgagggtagtgcatgcgcgtatgcgtgcgtgcgtgtgttatagcatattcttaaagttttgttatggaaaataaataattctcattacaaattaatagagtggcattctggtttatacactagtctctttgcatttagtctttgtgtgttacttccctacccctgagtaaactcatacaaatcgagtttctagacctggcacagctcctcgtctgtgcagcctgcaggtggatgctgtatatggcttgattatcaaatacattattttgtgtaaagaattctaagttgctacagtatatatcaaatgaggtatactgtaaggggtcaaaagctgcaaaagcacttcttgaagttaagaagtcaggtagataggcatgagtggccatattatacctattcctaattaataaattaaagatctagaagatgaaaggatatgcatggtaattgcagccagtgacaaattgttaggcactgcaaatacaaccaaatacagatggctaatacagatgggctgggggctgggggctgggggaagtactataaataagcatttcatcatttttctaaatctactgaaattctgtttcatgctacccgctccatggagccttctctaagagactacaggactaaaatgctctcccagcttagcactcctataggacttattgggtgtaccatgctaaaggcaaggaatgtaggctgcctcatactgtagttatttctgaagaaactgtatttcttttagtaaacattttagacagtctttggagataaaaaccagtgttttttacatctttatagtgcccatcgttccttgcatatttaaaaaaagtataccctgttccattttttgtgtatgtttgaaatttccgttgtaaaaaagtgtttttaaaagattacctcaccaaacacagtttgaagtcaataccaaaaaagtatatatgttcacttctaatatgaggctatagaaaaaaagaaaaaaaggtatagatgtaacagagcagtctaaaataatattgaaaattatatttaaaaaaggaaatctaggccgggtgcgttggctcacgcctgtaatcccagcactctgggaggccgaggctggtggatcacgagatcaggagttcaagaccagcctggccaacatagtgaaaccccgtctctactaaaaatacaaaaattagccaggcatggtggtgcgcgtctgtaatcccagctacttgggaggctgaggcaagagaatcgcttgaacccaggagatggaggttgcagtgagctgagattgtgccactgcactccagcctgggtgacagaatgagactctgtctcaaaaaaaaaaaaaaaaaggaaatctaaagatgatggttatggcacctcagcattttgaactattactacaagtaaccaaggtgacaagataaatcataaaattctgataaattttttgaaaaagatattaatagtaatccaagttccttaggaaacacatattttttcctagatattaaatcctaaagaagttgttatttaaatctctgtatgaggagatctgagtaatgtaatagtccatgtcttcccaggtagtttttcaaaaaatgcaaaaaatacctatgtggcctaaactttagtctgtactctctcatggttgtgggcaagtcacttaacctctacatgccttggtttccttgtaagtgaaatgaggtaaataatatcggcccaatttcatgtggtggttataagaattatatataataacttacatgaatgaattattcaaatataaattaggactcatatgaatacaggaaacacttatagtgcttgtatatgtcaggcaccgtttaaataatttagttattttgttatctcatataatcttcacatcagtctatgaagtaggtagttattattttcattttgcaaatgacaaaactgaaacacagagatgttgagtaacttgcccaacacttgtatttgataatcaagccatatacattatccacctgcaggctgcacagataaggagccgtgcctggattgcaggtctagaaaccctgagtatgagtttactcaggggtagtgaagtaatacacacagactaaatgcaaagagactagtatataaaccagagtgccaatctattcgtttataatgagaattatttattttccataatatttccaagggctctggctaccaagtaggggagccaggctacgaatctagtcattctggctttaacagccaggctcataaccatgcactctgctgcctctctctgaaactaataaagtttcactgtatggtgtgttgtagtgagaaaagagggcacaggccttagcattatagagatgtatcaccagagcaagtccagccagctgccaagaggctcactaaggtgttatccatttgagtgaataccctcagcccagcaagcccagaaacctgattctgttagcacactgagactacctccatttatcaggggcagagctcatcaagcagatttaaggagactgacatataaacctaaagaccaatttttaaatgaacagacatacaaagtcacatagtagaaaatacctggactggctgggcacagtggctcacgcctgtaatcccagcactttgggaggccaaggtgggcgaatcacttgaagccaggagttccagaccagcctggccatcatggcgaaaccccgtctctactaaaaaatacaaaaactagctgggcgtggtggccagtgcctgtattcccagctacttgggagctgaggcaggagagtcacttgaacctgggaggcagaggttgcagtgagccgagattgtgccactgcactccagcctgggcagcagagtgagactctgtctcaaaacgagtgaatgaatgaatgaatgagagaaagagaaaaaagaaaaggagaggagaggggaggagagaggaggggatgggggagaggagggggaggggaggggaggggggaggggaggggaggagaatacctgggttctgggctcccaaacaaatgcaccgtctctgtagataagtacttgggaagccaagtaatgattggaagattgcttagtggtatggaatttgggagctaattggataatcttcaatagacctgccacaggaccctaatacaaatatttctactgtaaaatgatacacgtgttcctaaaaaaacctcactttctgcaaaatcatcctctataaagttacagtggttatggaggtggggcaaataggcttgggacaaatgattcaaaacccttgcaacattttaacactaactaaaacaataattggtaccaggagagagaacttggatggtctagacaagcagtttactgtggctggaggctgcctcaggggatagtaaatgcaaatatagtgtaattgcaggcttgaagctgctgagacctgagctctgagccagcggggttgccgttaagttgggcacaggagggaagtgcaagctgccacttgatggagagctgcgcaaggctggtgttgtgcctctctgaggagggaaccctggatgctggctgaaaagaatcctgcttatacaacagccaagctgaaggctttttctttccagctgaaagctttaattctcttcccactattctgctttcttctgactaggaaaaaatcatgaaccaacacaacccccacattatactgacatcattctcctatttatcaatcgtatgtgaacttggtgttatagaaacatctgttgtagcagaacagacagtgctcagtccacagcggggtttggggattggaaaatgccctttcttaggaagagtgctttgcttaaattagtggttctcaactggggatgattttgcctgtcttcccccaaccccaccccagaagacttttgacaatgtttggagacattttgttgtcacagctggggtggaaggtgctgttggcatctagaggccagaaaatgctacaaaacatctgcagtgcacaagccagccccccacacaacaggaagttctcctgcccccagtgtcagcagtgccaaggtggagacactttggcttagatggatgctgcacttttggctctttgggctccccttccaagcaagcaagtccccagtttccacaatcatatttgaaatggatgcaattagatgtcgcctaatttacagtcatgttattgtacccccttcctgcatttacatacaggtgaacatacaggttatctaaactctttgtcactcatttacagcgaatgttttggcttattccatggagagttaatcacactcattcagtaaagatttagctaatagaaagcttggcgaacaatcttggaggcttcttcaatgatgtttcccactcccaacaggatgcttctatgtttatattacctaggagctaaacgccaggcttctctacaatataattcggttgctcagtgctttaattaaaagagaccagggaaaaaattctgttcccaccattttaccagctgtgtgtgtgactttaggcaagaggtgtaactcactggaggcttagtctctgtttttctgtaaaatagggataaccatgtctgatttacaggattgttggaaagataaaatacagtgtgtaaagtgcacagcactactttatgcataacatcctcaataaatatattagttccctttcccttgtgatgctaccatacccaaatagccattgtgatgtttccttttcatgcacttcagctttctttttctaagtagttctctgtttctcaaactccaggttccaatgacttctgtaataaaatgaaagtgattagaaaaagtgatgaactgtggtgtctatcagcaaaagtcctgtagccaagtggcagagtctctgttctaggtttttctcctagctttttgaggacaaggactgcatctcatttatccttgtatctccagagaaagcctggaagcagacattcagcaaatgtttttgaatgaaaaggtcagagacctactcctacatagtatttgtacataagtgtgctaccaacctattaatttcttcaaagtaattttatatattgtacaaataatgaaaaaagtagccatattttgctgtctttaacatgataacttgttttcattttattcctcacttctatccagtctttatattacacaaagttgtaagaatagcataccacaattttaatctttttattaagctagcgttatattagaactattttccatgacgtagtcttcataatgataattttaatgacaatgtgatacatagtctagttgatgtactctcatttacccaatcattcctcttggattgagcatttagattgttgctagttatctttgccttgtatatcaaattataataagcatattcattgcatatagcttttctttggtattttttccttagaacggtgttttttcaagttctttggaaaattaagggtttgatcaaaaaagtttctgctgctgtctaaggttgagaaaaattgatgagtctttgatgcagagcttcctagagcctgtgaagtgatacaaatccacactgggacctctaaagaatagagcatgcccccttgaaccatggtgcttcttgttcttgggataagggttcttaataggaanaattatatctttatttttaccaacctctaattaaaattgacagttccttcaattatgaatgtagataacaaaccacagtagttttggcagtatatgacttttttttcaacttttattttaagttcaggggttcatgtgcaggatatgcaggtttgttacataggtatacatgtgccatggtggtttgctgtgcagatcatcccatcacctaggtattaagcccagcatctattatctattcttcctgatgctctccctccccctcagcatatgacttggtccctataaagaaatcacatatttttttatcacattatagttgttgcagataccttaaaatatcacctactggctatgacttatttgacttgatactattattagacccaccactggatattgtaatctataaataatcatatatattactatataataattttttattttgatatttgtatcttaatgtaattattccctttctagtcttatatatttaattttatgcctttaaaaattttattcaaagaaggagtctctgggttcatcagaatgccaaagagatccatgtagcaaaaaaaatttaaaacaatgtcttaaggtatctcaaggcctaagtttccacaaaacattttgagaaatgttgctttaggatagatccaaggactgagattagtgagtcaaaagaataagcagtattatagctctcaccacttattgccagatctctttccaaacgttagaccaaatttgtgctgccatagaaatgtatgaatccacttgttttaccacagccatcgaatgaaattattggatgaactagtctcattagctttcatttatttcctttttttttttttttggccagatccattgaaaagagaaaattatcataccccgaattcttctcaacagccaccagctcttaaggtatttttcattacctggagaatggttctcttcttgatgagggtcaggtgtctgatggtgcttcaaatgagattggtcctttcccaaatccatcttgctgcaataccttcctgctattttggtctgacttccacaagcagcctagatgcttttttaaaatatcaaaaacatctaacacttaaaaaaaaaaaccacacacacaagtttgcctgtcacttgacttcccgcctaaaagttttatctggttggaccacaactgcaggctaattctactatctttatcacactgcacaggtgtgagtaggggaaatggctggtgctagcaacccctagcataggttgctatttatacagggaaactctctgaccacagcctggcatggcacagcctctagtcagcactcttttggttctatctgccaggaagtgtctggatccgatgttcctttttacagatggaggtagcctagtgtagaaagaacacaatctaggccccaaccagctcagtggcccagggcaagtcacctcccttttctatgactctctgcatttgcaaaatgggtaaataattcctgtcttgcctacttcatacggttcttgtgaaagtgaaaataatagatataaaagtttctagaaagtgtgatatatattaatcttacatggtttcctgtatgtagcttttttcaccttaatctgttgcaaaataatgtacagttttgctgtgtatgctgttagacttagttaagaaatagacataaagaaccaaattagaatttcacagcaattttgtaccctttttggctcaccaaatcattcgcaagtgactcaagataactagtgaaatccattgttactcatataggggaaggtgaaaaattacttcttaatgaaaatatcaccacattatatcccagaaattaagttgaaataatcaaaggaaccatcctatctccaagcagtaaccccatttgtgaagacaaggagccacagactactatggttcaactaaagaagaaaccctgagcacctcctgatacaggaagccagtctgggagatgcaggattaatatatgtgttctggattcagattgaattgaagtgagtttgaattccagtgttgacattccctaattcagtgacctgaggcaggttagatagccttggagtcaatttacctatctataacatggggacaatattggtatctacctcagaaagttactgggatgattaagtccagtaatccatatgaggcattttatgtgtgcctagcatattgaacttggtcagtaaatgttagctaccaataaaaatacagtaaccagattttggtaaagcaagtcatagtttaaatgcactaaagagagaatctgaagaggattctttataaagaaagacctttgtaatgtgaatagatacccactacttccatggagtcttaaggcattagaactggaagagcccaaaatcatctagtccctgcctattttgtatacaaagaaactgagaaccgaggaggagagttacctatacttagtattttattacttattgccagcagcatctcttacagattaggagatgggtcatcattttgtgtgcttgatctttcctgggtataaaaatgtgtgtatcatgtaaatatattagagaaacaagctgtcaaacacactaaagggtatcgagaatgatataacaaacacccaagtatctgccactaaaatttaacttggtttttaattactaaaccctaatatttagctttacctctctcagttccccagtccttctcttaagtaaatctctgtatctaaaagttcaggtaacttcagggagcccctgctcaaaggaatcctgcacggaacagcaggcattatttgcttgaaaattttggattttcagatatggggtttaaataactcaaactaactttaaaaattacaaaatagtgtttttttaaatattggtccctttagttgatatgttttaattcttattagttaggttgtttcttacattaggatagtttaataaaataacattatagaatccctctgggacaccttcagtggatgcagaggtacttcttgaataaaattgtccttactaagagcttgtaacacccagttcaacaattcagcaaattttacttaatgccccctcttgtgctgtagagacggatggtgcagttcctgagccctgtgccctgtaggctcatagaggagaaagtgtgtacatctgtattgcaaggaaataatagattctttatatcctgctacaacctacctaagtcaattccacccctgccccatgttccctgtatctagaagcagagtgtggagggactgtaagagggtggggtttcaagttaacagtaaattgaaggtaatattgggtggaggaggccagtggagagacactttggagcaaactagattggaagtcaggcaaggtgtctctggcatgataaacaggccagagtgggaatttgagacagaagtagcctacagtaagtttacaagccacagttcatggtcccttctctctgtagaaaattctagttagaaatttagttagaattctctaactagaatttccagaatgtgtgttaggcattaaagtccacatattttttgacaaatgctgccttgttctagagttatttgcatatatacataaacctctctctaggccacaaacccttagagagcagatacagctcctgattcacttttctgtctccacagtatgatccggtgggaggctt

SEQ ID NO: 12702 - DNA, 170 bp, Homo sapiens
tagccaagcgtggtggcgggcgcctgtagtcccagctagtcgggaggctgaggcaggagaatgtcgtgaacccaggaggcggagcttgcagtgagccgagatggtgccactgcactccagcctgggcgacagagtgagactccgtctcaaaaaaaaaaaaaaaaaaaaga

SEQ ID NO: 12703 - DNA, 101 bp, Homo sapiens
gcttgaacccaggagatggaggttgcagtgagctgagattgtgccactgcactccagcctgggtgacagaatgagactctgtctcaaaaaaaaaaaaaaaa

SEQ ID NO: 12704 - DNA, 196 bp, Homo sapiens
aaaaaaaaaaaaaaatagccaagcgtggtggcgggcgcctgtagtcccagctagtcgggaggctgaggcaggagaatgtcgtgaacccaggaggcggagcttgcagtgagccgagatggtgccactgcactccagcctgggcgacagagtgagactccgtctcaaaaaaaaaaaaaaaaaaaagagacgaaactat

SEQ ID NO: 12705 - DNA, 6682 bp, Homo sapiens
agacactcactgcaccggagtgagcgcgaccatcatgtccatgctcgtggtctttctcttgctgtggggtgaggcctcctggggtctgggtccctggggcgggagggggcgggaacaggagccttacgggggctgtctccgcaggtgtcacctggggcccagtgacagaagcagccatatgtgagtgcaggggtgaggtctgggaatggtgggcccaggccgggggggagccctgtctctgtggcactgagctgatcccagccaccccttgcagtttatgagacgcagcccagcctgtgggcagagtccgaatcactgctgaaacccttggccaatgtgacgctgacgtgccaggcccacctggagactccagacttccagctgttcaagaatggggtggcccaggagcctgtgcaccttgactcacctgccatcaagcaccagttcctgctgacgggtgacacccagggccgctaccgctgccgctcgggcttgtccacaggatggacccagctgagcaagctcctggagctgacagggccaagtgagccggggcatgaattgggggccaggaggcagtgggtaggttgttgactggggggtctcccttcctccaagtcacccgatgtctctgagccccaagccccaatcttcccatctgtcaaatggggatgatgtctgtgttgtaaggaatacatggttgtgtccccagcaggcccggcatgccgtacagctcccacacactctttttctcttgccgtatgccttgtttccactggtgcctgcctgccttttcccagcaatgccctccatccctgtctccttcacagtcttatgagtgtggggcccaggttctgctgggcttcccacgtctcctgttatgcagaagcactcttcaactccaccccacccacagagtccttgcctgctccctggctctcgatggcgccagtgtcctggatcacccccggcctgaaaacaacagcagtgtgccgaggtgtgctgcggggtgtgacttttctgctgaggcgggagggcgaccatgagtttctggaggtgcctgaggcccaggaggatgtggaggccacctttccagtccatcagcctggcaactacagctgcagctaccggaccgatggggaaggcgccctctctgagcccagcgctactgtgaccattgaggagctcggtgactgtgggaaccatctctgggggctgctgggggaggaggatacagggggcatgaccacattcatcctgacctccatgctgaatgtccttgcccaggaccaggtccaggaagctggccacacggttgcctgggtctgatggttgcaaaggagtttgggcagaggatgcccaaagaatggaagggtgaggccgggtgcggtggctcacgcctataatcccagcactttgggaggctgaggccagcggatcatgaggtcaagagatcgagaccagtctacccaacatgacgaaaccccgtctctactaaaaatacaaaaattagccaggtgtggtggcaggtgcctgtagtaccagctactcaggaggctgaggcaggagaatcccttgaacctgggaggcagagcttgcagtgagctgagtggcgccactgcactccagcctgggcaacaagagcgaaactccgtttcaaaaaaaaaaaaaaaaaagaatggaagggtgttcctgggattgccacccggagggcagaggtctggggactgggcagagggcagctccagggatggggcagcctagtaatgctgcctgcattgcagctgcaccaccaccgcctgtgctgatgcaccatggagagtcctcccaggtcctgcaccctggcaacaaggtgaccctcacctgcgtggctcccctgagtggagtggacttccagctacggcgcggggagaaagagctgctggtacccaggagcagcaccagcccagatcgcatcttctttcacctgaacgcggtggccctgggggatggaggtcactacacctgccgctaccggctgcatgacaaccaaaacggctggtccggggacagcgcgccggtcgagctgattctgagcgatggtgagccggggccagcagggacagggacgcggctgggtccctggggagcaggagcagtaccaggtgtagagtctggggaagtgcagtgctctgggccagggtccaataccaactttatccgcccacccgccgattcagggtcctaaactgcaaatatgatgatgagcgtgacaaccttcaggccccacagggaataactgggtgaacaggtctggcccaggccacagggggcaccacctggcaggtcccatcccagctgccaggtctaggtgagcactgagggcctctgctgaggcagctcctccgctcgcttgccttggacctgatggtatttagcaaactctgagcaccggacagcgaaccccatgcccagcggaccacaggggcccctccgtggggcgggcattggggcggtgctcagaagacgctcgtggagcaaatccactactgagcggcatcgtgcaccaggcatcaagccatgcacaaaacatgtccccgtccccgcttcccgtctgtgtctgtagacaaacaaattactaagaaacagtgaaagggtgcgtgtgagatatccaaggactgggatgcaaaggtggggcgggcccggaggaggcgagggaggaagctggccaggtcattgcgggcagaagactcagccaaggcaaagagcgcgaggccagaccacgcgttagggccgagccagccgctgggcgcccgggtcagcccgtgtgctgctccgcagagacgctgcccgcgccggagttctccccggagccggagtccggcagggccttgcggctgcggtgcctggcgcccctggagggcgcgcgcttcgccctggtgcgcgaggacaggggcgggcgccgcgtgcaccgtttccagagccccgctgggaccgaggcgctcttcgagctgcacaacatttccgtggctgactccgccaactacagctgcgtctacgtggacctgaagccgcctttcgggggctccgcgcccagcgagcgcttggagctgcacgtggacggtgagctggcggggcaccagcgagggcgggcgcgggttcagtgcccctcggggcctcctgtctttcccctctttccttgggcgtccgacggcggcgctctgggccttggttcagcccccatcgcctaccccggcggggagcaggcgatcggtggtcgagggtctggggacgcctggaatttcggcttatttcccacggacgcaagcccgtaggtcacgtgtagcgtggtggtcggcagcagggaggctggccccaggttttcttgttcagatccctgcagctctgtggctgccttgttttattactggccatgtcagtcgtcatactggaccccccgccccggccccggtcccgcaggcgcacggctgatgtgtccttctccccatccccgccgtccccagctctgtttgtccctctgatttcctcatcgacgtctccaggactcagagcccagcagagcgtgagggcacaggtctgacctccagatcttgaggtcgtaccctttgctgggagcaccgttttctcttttctttcactttctttcttttctttcctgccttccttcctctttctttctttctctttccttctttctttcttccttccttctttctctcttttctttcttcttttttcttctttctctctctctcatctctgccccccaaccccatctctctccttcattcctcccttttcttctcctttttgttttttttttggataacttacttttattcttgcaggccggagtgcagtggtgcagtctcagctcactgcaactttcgccttctgggttcaggcagttctcctgcctcagcctcctgagtagctggtattagaggcgcatgccaccatgcccacctaattttcgtatttttagtagagaccgggttttgctatgttggctgggctggtcttgacctcctgaccttgtgatctgcccgcctctgcctcccaaagtgctgggattacacttgtgagtcaccatgcccagcctattcttgcagtgttataagccaccatccacaattgatgaaaaatgtttaatcttggccaggcaaggtggctcacgcctgtaatcacagcactttgggaggccaaggcgggtggatcacaaaatcaggagttcaagagcagcctggccaacatggagaaaccctgtctctactaaaaatacaaaattagccagctgtggtggcacatgcctgtaatcccagccacttgggaggctgaggcaggagaattgctttaacccgggaggtggagtttgcagtgagtccaggtcatgccactgcattccagcctgggcaacaagagcaaaactccatctcaaaaaaaaaaaaaatgtttaatctttaaattgtacatctatatcctatgactccaaattttatttatcactctccttaaagtctgaagaaaatgattaatttactaagctccaaagacaacacagtcccactgacataacatttagtatgatgtcctactctcctgttagaattaagaacagccagtatcaaactggcctgaaatctgattgggttcctgggctcagaataactgtagtaaatttgtaaatccacactaagacacaaaattaaactaggatgtgtatatctatcttacaagaaaacgtttcacagtaaaaattaacattatgattttaccaaatttcaacattatagtttgttaatccaatcaagctttcaaaattcctgattagcttacaattaattgcaaataacttcatgtagtttggctagcatttcaaaatggatagggaatataacttttaaaatgcgaaagtatattatacatattgcacttttctgctaggctgggctagtatcttccatggcaagatactcaaactattgaataaaatacacatttaaatcaagcacttacatgtacttcattaatttccctgaaattatcaacagcattaccaaaatcttccaggattttgtaacatttgattccttacagttttgttttgtttgtttgtttttgagacggagtgtcactctgtcacccgggctggagtgcagtggcgcaatcttggctcactgaaacctctgcctcccaggttcaagcaattttcctgcctccacctcccgagtagctgggattacaggcgcacgctgccacgcccggctaattttttgtattttagtagagacggggtttcaccgtgttacccaggctggtctggaactcctgagctcaggcaatccgcctgcctcggcctctcaaagtgctgagattacaggtgtgagccactgcgcccggcaccttaaatacacttttaaagttaaacttatggagggaaaaccctcatctattgacatagattgtatgtccttttttggtccctccatgaaggagcaccgttttctccatcatttcttcttcccttcacccgtcagagtgaccgaggctggggaccccagaagccccagagcaggcccgaatctgggacttccacggtcctgggggaggggtgcggggacactcacgtgtggcgcggatgtccggggtgtgaaggcagcgggcgcagctcggcggcgccggaggagccctctgcgcccaggaacaagacagggaagatgaagccggggctgaggcgcaggcgcgggcgcggcctggggtgtggcctggggtgtggcctggggcgtggcctggggcgtggtgtgcctggggcgtggcctggcccgaccacccgcccgctccgcccaggaccccctcccaggcctcagctccgggcgacgtggagtggggcggtcctggcgggccgagatgccgtcctgcgctgcgagggacccatccccgacgtcaccttcgagctgctgcgcgagggcgagacgaaggccgtgaagacggtccgcacccccggggccgcggcgaacctcgagctgatcttcgtggggccccagcacgccggcaactacaggtgccgctaccgctcctgggtgccccacaccttcgaatcggagctcagcgaccctgtggagctcctggtggcaggtgacgtttccctgggtcccgggtgctggttccgtctgctgatgtttgcctgggctgtgcccacctccaggagggcctctcccggctcctcccttgggcacccctggttagcgctgggtctccccagggctcgtgggggaattgcgggcgaggaaccgcccagcaaaggccctgcagctggaggcgcagatgggggtctcggctggcagccgaccacgcgcttccttccgggggggcgtcagggaggtcggccttgatttccgcgaggaggagggcataggatttcccctcctccaccatttctcttttctcccgttgtctagaaagctgatgcagccgcgggcccagggtgctgttggtgtcctcagaagtgccggggattctggactggctccctcccctcctgttgcagcacaaggccggggtctctggggggctggagaagcctccctcattcctcccaggaattaataaatgtgaagagaggctctgtttaaaatgtctttggactcccagggctgagtgggctgggatctcgtgtcctcaa

SEQ ID NO: 12706 - DNA, 421 bp, Homo sapiens
ctcgtagcggagctaggctgggacacccagggtggggaccagacctccccgggtgggaatgacaggatgtccatggaggctgagtgtgaaagcaccacggtctcacccctgtcctgttccatcccaacaggctgtggtgaggagagggggaggcaggggaagcgggaggcctggcctccaggcagcaggctatagccacatgagtgaccaccagcagctcaggtaactgagcacatgtcacgggtaggcctgggaagcgcaggtctcagctgaatgacctgggtggaaatccgactccagagccgtggtgggtcacaccatgcagaatgaaccagtgatggagaaggaaccacagtcctcaggaagagtgagggtgcacctccagacagcccatgtgagggcaaccgcagaaagtctgaaa

SEQ ID NO: 12707 - DNA, 348 bp, Homo sapiens
ctcttgggctcaagtgatcctcccgcctcagcctcccaaagtgttgggattacaggtgtgagccacagcacctggccaaccaacacttctcagggcctctttcatctgtgctcttccaggatgctgcctcttactccctgggcacctcggcctggtcccagcaggtatgggcagttgcttgaggctccagacatactcacctctacctcgaccacatcaaccccatcaccaagaggaggttcagggaagctgcattttgtggtcttgtcctcccagtccagggtggtagtgctgggctgttcccagcctcccacagcagagctggacgctgtggaaatggctggattc

SEQ ID NO: 12708 - DNA, 206 bp, Homo sapiens
ttgtggcgagcagtcagtactttaattcaggtcaggctccgacacctggggagacggggtcctgcccgccccaccctgaggtggaacccccagctgctcctgggcacagaatcatttacaaaaataaatatgaaaaaagcagcaactctttagtgatcatggaattaatctgacagcattaaatgtgtttaagcatctggcatatc

SEQ ID NO: 12709 - DNA, 571 bp, Homo sapiens
cgaggaagggccaggcctcccgccaggcccccgcccccctcacatttctgagtccgcatacatcccgttgattaagtagtccacctgggtgtagtccttcttcttgtagctctcataggcctgcagggcaaacaaaaccaagactgtgatgaaaagggtcaccccgagtaacagcaccaccagaaggagagttttgtctaccacggcctgggtgaggggctcagtggtgaccaccatgtactggccttgggtgctgggctggcacgagtccgtggctggcatcttagtgccccctgagctcctgggtgttggcccagtggaatcagtacctggtgtggcttcagtctctacctgctccggtgcctgggatgtgcctggcccagcggccctctgggtatatggcatggggcttggctgtgtcgtgggggacatggcctccatctcagggattgggctggtgtgaggtactggcactgggctggcagttggctccctggcttgtgccttggtggtggtcaccactgtgggggtgggggcgggctctggggttgtgtttgagggcatgggtgtg

SEQ ID NO: 12710 - DNA, 843 bp, Homo sapiens
  misc_feature (717)..(717): n equals a,t,g, or c
ttgtggcgagcagtcagtactttaattcaggtcaggctccgacacctggggagacggggtcctgcccgccccaccctgaggtggaacccccagctgctcctgggcacagaatcatttacaaaaataaatatgaaaaaagcagcaactctttagtgatcatggaattaatctgacagcaattaaatgtgtttaagcatctggcatatctcctcaattgcaccaaaagaatttggaagcacttggtttggtctcaaaggcaaaaggaaaggacgaggaaggggccaggcctcccgccaggcccccgcccccctcacatttctgagtccgcatacatcccgttgattaagtagtccacctgggtgtagtccttcttcttgtagctctcataggcctgcagggcaaacaaaaccaagactgtgatgaaaagggtcaccccgagtaacagcaccaccagaaggagagttttgtctaccacggcctgggtgaggggctcagtggtgaccaccatgtactggccttgggtgctgggctggcacgagtccgtggctggcatcttagtgccccctgagctcctgggtgttggcccagtggaatcagtacctggtgtggcttcagtctctacctgctccggtgcctgggatgtgcctggcccagcggccctctgggtatatggcatggggcttggctgtgtcgtgggggacatggcctccatctcanggattgggctggtgtgaggtactggcactgggctggcagttggctccctggcttgtgccttggtggtggtcaccactgtgggggtgggggccgggctctggggttgtgtttgagggcatgggtgtg

SEQ ID NO: 12711 - DNA, 10346 bp, Homo sapiens
ttgtggcgagcagtcagtactttaattcaggtcaggctccgacacctggggagacggggtcctgcccgccccaccctgaggtggaacccccagctgctcctgggcacagaatcatttacaaaaataaatatgaaaaaagcagcaactctttagtgatcatggaattaatctgacagcaattaaatgtgtttaagcatctggcatatctcctcaattgcaccaaaagaatttggaagcacttggtttggtctcaaaggcaaaaggaaaggacgaggaaggggccaggcctcccgccaggcccccgcccccctcacatttctgagtccgcatacatcccgttgattaagtagtccacctgggtgtagtccttcttcttgtagctctcataggcctgcagggcaaacaaaaccaagactgtgatgaaaagggtcaccccgagtaacagcaccaccagaaggagagttttgtctaccacggcctgggtgaggggctcagtggtgaccaccatgtactggccttgggtgctgggctggcacgagtccgtggctggcatcttagtgccccctgagctcctgggtgttggcccagtggaatcagtacctggtgtggcttcagtctctacctgctccggtgcctgggatgtgcctggcccagcggccctctgggtatatggcatggggcttggctgtgtcgtgggggacatggcctccatctcagggattgggctggtgtgaggtactggcactgggctggcagttggctccctggcttgtgccttggtggtggtcaccactgtgggggtgggggcgggctctggggttgtgtttgagggcatgggtgtggatttatttgttgtgttaaccacaggctggtccactgacacctggctaatgggaccttgtgcttggggacgcatagggggtacagggcttgccgcggtgtcactgggcatgtgcttggaaggacttggacgagtgctcatggggctgcttgtgtttgctgtggtcgctacagtctgagcacgtgtggccaatgtggccagggttgctgttcttggcaacgcgctgctctttggcacttgtgcgagggctgtgctgagagatggatgcccagtggcggtagtggacggggtccgccctgtggaagtggacgtgggcgcggggagtgcaagtgtcatgggagtgctggaggccgcagtcatactggaggctgtagtcgtgggagcaatggaggccacagttgtactggaggctgcagtcgtgggagcactggaggccacagtcatactggaggccgcagtcgtaatggaggccgcagtcgtactggaggccacagccgtgggagcaatggaggtcacaccatcagctgcacctcctgaagttgctggttcactcacatctgtcctgcttgtgtcctctgttgtgacttccatagagttgaggtgggctgccgaagtccctttggtcaatgtgacaggagaagctgctgccatggttacatcctcagacgttttattatcaactgtttccacagatgcattcctcttgactaatcccttccacattttgttagggacaaagttgccttaaagtcagaaaaaggagaaaaagagagacaatcatgttcaatcctgcacagggggattgctcagggatcggcttccacccaggcctgtggggccccctcctcagcccagccagagtcgggggaggtgatgtgcgaacatgcttcctccccatctctcttcccactgttggcatgcagctcattgaaaaagcccttgtcaatttgattttaaaactcctttgccctctatgaaccccctgcccattgaaggcttcagaccttcactatttgatccaattcccaaaacatcagagtaaaagtctcacacaacaggtgtgattcaccattaaaagcccactgaacgcacacccaggtttacaaagcagataaactgcacaggtattcacatcataaaagaacgcttggctttgtgaaaggattcactgcaggaattcttggaaatgaatggcacagagtgggaacgcagttaaagatctgatgtatgaaggaatcaattccccagtgaagattcaatttagagatgacatcaaatcttgcaggccaagcgagcaaacctttcagggctcagctgcctggtcctgctaggggctctttgcccaccatggccctggagaaggaaggttggcctgacaacccttccctgtgcggcacctgggagggctgcggttcctgacgcgttggcctgggtttgcagatgctgctttcaagggctcagcatgctttgtggccaccgtgggcccatccagcagtcacacagctttctcacttacgtggatcgttggatgccgcatggctttcagataaggacaaggagaaaatccaaatgagcacaagagctgtccacatcttgtgggtgagctgggagcaaggctgggcggtccccgaggctcccagccagccagctcctcaggctgctaatggttccctcctgcttggccaagggatctgtggtcaagaaagcacgctggtcagaaggcgtctggccagcaacacacagccttgcctgagagcacctgctgtggagggctctggcagggtccaaggtgcagactgagccaagtgctgagaccagggcctggtgcccaggaagacctcagccatggtatagtaatgaactgccctgtgctttgcatctgatcacttcttgacccgatttcactatgaatctcaacctgcaaaagttcccattctcccatcctagagttcagagtttaaaggagcaggagagagggctaagacttggttgtgttcatagggtgaaggccttctcatcaccaagactggtcaagtcttcctcctcagcttcccccatagtctgcagagtacaaatcaagcctaatgcaccccatgtgcaccctgtgacaggtgactgtgcctttcacatgggagatactacttaaccattcatccatcaatccacccattcatccatccacgtgcccgcccacccatccatccacccactattctatccatctactcatctgtccatccatccatccactcacccatccatccatccacttacccacttacccatctatccatccatccatccatccacccacccatccatccacccactcatccatccacccactcatccatccatccatccatccatccacccacccacccatccatccatccacccacccatcgtgctgggaagcaaggaggagacagtatgcgggcaggccttgaagagtgaggtaggctgatactctgggcagaagccccaagggtggctgggccccagaggacagggtgccacaggggcccagaggacacagttcagccagtggtggtgtggtcggcatgccaaggaaggcttcctgggaaagcgatgcctgggccgcattctgaaagctgggtgggggtgggcaggcaggtggagagggagcagcagatgacaacagcagggtcagaggcaaggaagagcgtggtgaggcgggaattagtctggagagcgtgaggaggccccatgagccatgtggcagtttagatttcacagtagggggatgcgagtccctccggggccttagacaagaacagaaaggtgcttttagcaagaggggaggcaggggcagccagtgaggggcagcgatccaggcacctgatacagaggctctctcaatgaatgaaggcatgagtgaatgagtgactgacccacttcagagactgcagtggtccccacagccggcccaagttgctgtaaagcaaagccctctccttcattctaatgctccacagaagtgatgtggacgccttaacacatttttatttttttgagatgggtctcgctctgctgcccaggctggactgcagtggcatgatcgtacctcactacagttttgacctcccaggctcaaatgatcctcccacctcagctgggatcacaggcgcatgccaccacacctggctattttttttgtgtgtgtggagagaggattcttgctatgttgcccagggtggtctccagctcctcggctgaagcaatcttcccaccttggcctccaaagtattgggattacaggcatgagctattgtgcccggcccttaatgtattataaaaaaattatttggtttggtttatttgttttgttagataaaataatgaaaacagtcacaaggtaaccagcacttagcagcccacagcaaagtgtggccccagctgcatagctgtaggcagactggggctttggggtgctgggtgagctgcccattggtcactcagggacgaaggggccattgaatgcatgagtggcagaagcagccttttagctctttcagcattcactgtcattcccttgaggaagctactgtaatagggtcaagagaccatgcaaggggagtgggagaccagcaggacacacagaggccaacagcactgcctgcgttccaactccagctcccatgctcactaaccaagtgacatgtgcagccacaggacctctgagccccgctgagctgcatgggagtgacatgggacatgggatcacacgggcaaggacccagcatggcgcctggcttagccagcagcccacccgagaagcacttccagctacgcaaaagcagccactgcgcaacaagaagcccctgggtggcttcctgcctcctgtaatccatgtggactgttgtcaagctgccccggggctggagaaagcccttagagcacacactcctctggaaggctggtgtgttccacgagacttccggtctctttccaagagtcactaacttttctctagcttcaaatggtgctttctcttcaaaatggtctgtaagggctcctaatgtgttaggggcttagaaaaattacttggccttacaaaccacagatctagagtgcaaaaagcattctttgttctgacagaaaaaagtgtggcgggggggatggggagagaagaaactaaccaatatcatgcaaggcagaactgaaactggaaggtttcgggcacaaagaactcacaatcctccacgggtcaaggcagtgcagctgggcttttgataaatatgagtatttaaatggctctctcttgggccagtaacatctaccgaatgtttttaaaatgctaccacccctggtatgttccccaggcccgagcccgggatttgaggtcctctgggtgagttaaaggtgagatgatgtggcaggggcttcttatgggtgaagagggtctcggctcctgaatgtaccccagccccaggccttctgctgccccctcactacaaatctctagggcaggggtcagcacactttctctatagaggacaggatggcaaatatttgggattctgtgggccatttggtctgtgtcttagctactccattctgccgctacggtacagaggcagccctggaatagaagtgaatggtgggcatggttgtgtcccaataaaactttatttatacaaacaggcagcaggtgggattcggccacagtttgctagcccctgctttagcacttcagccagcttcagggaccgtgctccagctacagcagggaggatcagactcaatgtactgaatgaacctcctccttcttgtccagttctttgccttggaacagacaaggaccttctccttcctgagaggggacagcctttcatcatcttctgctaagaggcgcccctccaccaccctgcatgagtaagacacagcctccctgcagcacagaggaggcttctgtgagtgcccacggcatcaccaaggtcagggagaacctcttgaggtaacttgcatttgtgtcacgaagccgaagagggttgcaggggattgcgtgatccccatcctgttcatgggccaccaccccagtccactcagaagataaggcctcctgatcagatgcaatgactcatgcatgtaatccccgcactttgagaggctgaggtaggcggatggactgagctcatgagttagagaccagcctgggcaacatggcggaaccccatctctacaaaaaatacagaaattggccaggactacaggtatgcatctgtagtcccagctacttgagaggctgaggtgggaggatggcttgaacctgggaggcagaggttgcagtaagccaagattgcacctctgcactccagcctggaccacagaaccagacattgtctcaaacaaacaaacaaaaaaaaatggaggcagggcctctgacagttaagggccacagactgggcctgggccttccttggttactataaggcctggctgtctttccttttcccttgaccctctgatgatcttgcaaagctccctctgggctcaccgtcccatcacccaacaagcaggcccagcctgcagggccaggacacttaccagaggctgctgctaaggggatgctcccagcctggaccatcttcctccttggagagctgtgggcttgacactgtgtcgctgggcgaagtctggctttgcagggggtgaaagccacgtggtggggcactcccgggccatgccatcctttgtggcacatgtgagacgaaggtagactctccactctagtaacagacgcatctagagtttgaaaaaaagtccacattccttatgaaaggcatgaaggaaaattccagtgaggagggaggcacaaaaagagcagaattcaatagatcattcattccactgggaaaacgacaacatggatcaaagctttcaatgtcaaaacttccaatgcaggctgggtgcggtggctcacgcctgtaatcccaacactttgggaggccgaggctagtggatcacgaggtcagcagttcgagaccagcctgaccaacatggtgaaaccccatctccactaaaaatacaaaaaaattagctgggcgtggtggtgggcacctgtaatcccagcgacttgggaggctgaggcaggagaatcgcttgaaaccagaaggtggaggttgcagtgagccgagattgagccactgcactctagcctgggcaataagagcaaaactgcgtctcaaaaaaacaaaacaaaaaacaacaacgacttccaatgcagcaacttctactgcagtttcttttaaggaagcactcagacagaggtccaaagatgatctacaaagatatttctcacagcattatttagaaagagtaaaaaactggaatagttctgtcaagtatggccccattcatatataaaatactatggcaactgttaaaaatacacaactctctacttattgacatgggaagatatatagcatgcatcagtaaatgaacacggcaggttacacagcaacgtgtggaccatgatcctatttttgttaaaagggacatttattcaagggtctggaaagatttgcactagaatgttaatgaatatccctggggaatggattcacctgtgattttcattctctacttcatatctttccttctttttttttttttaacaagcatgtatcacttttggaaaacatttctgaaaggctccaaggaaagaaaacagcatattttcttcaagtacttcaagccactaagcagaaaggcacagagttatcccacctgatacagtttcacatgctgatttccataatttagagagactacacgatctatatatcaggagagacattttcctaggagccaaccaaaacttcggaggaatccaggagcaaagccataatgcaaagatgtcaaccggcacaaatgcttctctcattgatgaatatttaacgcgtactcaggagattacagaaacagctcgtcacctcttatcatgggaaggttatcagtaggtggtgatatcaaggaccaccatgggcctgctcccaacacagatgcccacgtgtgcacacacagccacacatacatgcacttagtcacacacgcttgtgtgcgcacagctgcacatatgtccatctgcacatgcacacatgccaccacacatgtgcactcacacaggcacacacatacacatgcaaaatcacacacacaaaggtgagggcacacacacggagcaggtccacaaggctatatcaggacactccacgggtttctcaggaaacttctgctggataccatcaccacttactccctcccagccggtggggctggtggtcactcccacagaaacaggaattggccactgtgtagtcgagaacaggccttcgttgtcctatgacttcatccctctgctatggtcctgcctccactttccaacagaatattctaaatgtcaagatcccatgcgggaacctgtggtcatctatgtaagttgactcatgatggacaaaccattaacaacatttaaaataacagtttcccctgcaaaggcttcaagccaaaattaggatgtgggtctcgggaccccaccagttattctcattattatgtggtacagggagactgggtagatcagggtctcagaccataatagatgggaaaaaagagaccccaggggcaggaggggaatgagcgagagagaattaagtttgtattaagttggagaccagggcagatggaaagacggaaggttaggctggcactgggagctcccttcttcaggggtcagctccccataggatctgcaaggaaggtgcaacaggatactcccttgagccatgtgacactccatgacaaaggcacccccaactatgcccctgggtgtcaacctccctatccttttctggttcatgacctcgagatgcctcccaaggcatcttgtctgaattcttgtgttccgaaccttggcttgttatatgtggcgcactttatgcaagttacacaaaactggactccaggcgtggtgctgcatgcctgtaatcccagacactcaggaggctgaggtgggaggattacaagcccagaagtttgagttcagcctgggcaacatagtgagaccccatctcttaaaaaaaaaaaaaaaagggaaagaaataacttaattctttttttctggcatagagaggttccaaagaccaatcctgaagcttggtaaaggactacagctgttacccccacattctatcaggctattaagactcactcagccgcaacatggccaggcccccacaccaagttaggcaagctacagataccaaggagtaggaactgcaaacacaaatacagggcaaactgcaggtacctaatcctgacacgtcacctggctgaactttggtagcagaagcccaaggaacacagacttatggctttgtgtatatagacattgtcctgtagtccaaaggatgtgactctgtggcagacgggaacctagaacattggacatttattatattacattaactaccttgcttgcttccaggtttctggaagttttggtaacacagctaaatactagggcctagtttttgctaagaacgtgggtagctctgacattcctttgtccattaggcagatccactgtataaatggaaacatctgtattttaaagattttcctagctgattttatcgaaatgttagagattttcctggggcgagggatagctgcaagttattacagtcagatttctaagcacgatgattatttctggtggcaaaccatgcgtgtggaggccgattcctcctatcagcctaacgattaagtcaacatgctaagcagccacacgggggctactaagtgactcgcacgggggaagcaggcagggagacagatgggcaggggagggaatctggggcaatgcacaacctccacccaggtagagagagggtctgggggataggtctgtgtcactcaagtaagagcgacacttcttggggtccagtcccgtcctgggcttgcccgggaaagaccccaggacaaattcggcccccttccagagtgtccccattctgctcccacaatgggacaagccggcctcttctccagtctgggcccccttcggccctcctccctcctcctgtctcttgggcccccagccatgctcggcccccagttgacttcttcagtacctgcattgctcagcgtcttgcactctgtgcgtgccccatccgccgctcctcctgtcccgttcctcctgcctctctcagccccactcactctcccactgcccctcgtgcccccatccaaccctcctcctgccccccaacctctgtctctcagtcccaagccagtcagggagccctgacagcagctacccggacggcagtgcgagccccttacccgggcgcagcaggcccccggcggcctggtggccctcggacagtaggaaggagcctgaggcccggcgcggggacgtggccggcagcgcaacccaggcagctccgggcagcgcgccctgcccgggccccgc

SEQ ID NO: 12712 - DNA, 421 bp, Homo sapiens
acttcgcctcattttacagacgtggaaacaggctcatcaagtgctctgtaattgtaaaacctgggataacaaaggagcaaaacgcaatttagaggcaagtgtgtgggacttgactttggttagaaataggctttgcaggccaggcgcggtggctcttgcctgtaatcctagcactttgggaggccgagacgggcggattatctgagctcaggagttcgagaccagcctgggcaacatggtgaaaccctgtgtctactaaaatacaaaaaattagccgggcgtggtggcgtgcgcctgtagtcccagctactcgggaggctgaggcaggagaattgcttgaacctgggaggtggaggttgaagtgagcagagatcgtgccactgcactccagcctgggcgacagagcgagactctgtctcca

SEQ ID NO: 12713 - DNA, 3747 bp, Homo sapiens
ttttttgttttactgctgtgcttgatatacgtgaagtaatgaatatcaagcaattcatttttactgcatctttacttttacatttgtttttaggttgcctaaaacatttaaatacaaataaaatgagtgtagcaaaaataatgaaagccaacagcaggtaactttacaaataatggaatgtgaactgtttctgcccttatccagagtaaaatgggtcacaactttgtctaaaggaacacttctgcagccgtagtcaaaggtgtgcacagtgagattgaatattccatagatatacaagatgtaacatgtgggccaggtgtggtggctgacacctataatcccagcactttgggaggccaaggcaggaggactgcttgaggccaggagttcaagaccagcctagtcaacatagtgagaccttgtctctataaaaaaataaacaagtatgaaaaaaaaaaaaaaagggccgggcacggtggctcacgcctgtaatcccagcactttggaaggccgaggcgggtggatcacgaggtcaggagattgagaccatcctggctaacacggtgaaaccccgtctctactaaaaatacaaaaaattctccgggcgtggtggcgggcgcctgtagtcctagctactctggaggctgaggcaggagaatggcgtgagcctgggaggcggagcttgcagtgagccgagatcgcaacattgcactccagcctgggtgacagagcaagactctgtctcaaaaacaaaaaaaacaaaaaaacaaaacaaaacaaaaaagatgtaacgtgatatccatgggatatctgtttctaccacagccgtttaagtgctccaaaccttaaagtacccacagttactacacctgtgactggaaccaatgatcccttttactccctgccaggacaaaccaatgtgtaggcagttttctttgcttagacatgaagcagttttaacactggcccttgtgaagccacaatgtaccaaaagtactatgccaaacatttataacctttagaaaaattccacatttccatattggccacctcaaaatggaaacagataactccctaaatgttaaccggccctgctctcctaatattaaacataaaaaccacatgggaaatatagatattcaagtagaagtagcataaacctgtcataaatcataaacaaaaactctttgtgggacagcatggatgacaaatggtctactatgtaacttttagaatgaggcagacaaagttggaaggctggttaattttccccttgttctcctgcttcagcttcatttccttgggttctgatgaaggacctgagatttttataagtcatcttaaaagccttgctgattactcaagagccttagtagaagtctgaaggggtgctctattgaggcctcatgtattcagcctcctactggtaacttttctgcataactggactgtaaccccagttacagatcttttaaaatttttgccatttctgaagtaagtctttattcctacagattattgtgactagagtgttaacttttcgttgtatgaatcaaagcatgtcttcagggcctcttgcactattaccccagtacctagattcctatatacattcttatgattgcctcttatagttatcttcttatagttttatctcttctttgattcattttcatttcttttttttatagacacatttattcagcatcacgatcaaactattacatttagcaatcaacagcatgagtaaaaaaaattatctacactaaaactctttgttggcatgctttacattttccacagaaaagaaactaaaataacctgttatacaattagtcacaaacacagtcctacttttttttttgcctatacacattaatattgtctaaaacatgtcttctttgtagcagctaggccctgccaccactgtgcttggctgagttcacaaatctgttgtaacctgtagcttctttgtcacttctctggctctcttctgctaagtatttttctggcagtaattaaaatctgccactgccatagctactgactggaaccaccatagctgccttggttttgtgttttggccagtatagaatccagagcttctgcctccaaagtttcctcctttcgtgcatccaaaatttgaggactgattgttataattgccaaaattattgtagcttccaccacctccaaaattgctttcactgccaccaacaaagctgcttctgcctccatcgttgttatagctgtgagagctgacactcctgctgtagccactgccctgatttccataatcctgcctccacttccatagcctctgcttccttcagcgtaaccagggctgcccctctataaccactgttgttaccaaatccattatagccatccctgttgctaccagatcaccaccagcatggctgctaccaaagtcaccacaaccactgaagtttctcctccatgaccaaagttgtcattcccaccaaaaccacctccacgaccatcaccagagtttccagaaccatttcgacctctttggctagatgaaacactagccatctctttcttcgacagggcatccctaacttcatagttgtggccattcacagtatggtatttctttttttttctctcgagacaaggtcttgctctgttgcccaggctggagtgcagtggtgtgaacacagctcactgcagcttggacctccggggctcaagtgatcctcccatctcagcctcccgagtagctgggactacaggcgcgcaccactgcacctagctaatttttgtattttttgtagagatgaggtcttgccatgctgcccaggctggtcttgaactcctgggcaagtgatcccctgcctcggcctcccaaagtgctagaattacaggcatgagccactgcacccagccagtatttcttttaaaaatatttgtttatttattttgagacaaagtctcacactgtcggccaggctggagttcagtggtgtgcgcatggctcactgtagcctttacctcccaggctcaaacgatcttcctgtctcagcctcttgaatagctgggactataggcacatgccaccatacccagctaatttaaaacaaatttttttaaatttaaaatgtatcttttttaaagcccccaacaaatatccttttcatagttaagtgggcatgtggtctttgagaatcttctcttgatacagctcttctgtccaccttatgtagccttgcattcacggctgcatccacctcctccacagtggcatatgtgacaaacccaaagcccctggagcacttggtatttggatctctcattaccacagtctgtgagtgctccctgttgctcagaatggctcattggaccctcactggtcatttcaaagctcaactctctgatgaagaacttctacagctgttgggactacttaagagactctgtcttagacatgatagcagtgggaagagagactttaatgatgttttcagcggcatccatgggtagaaaaagccattctcgtttctaattgctgaatatactctgctgtgaaattagacttagggcaaactgagactcagtaggcatgttatagaaaaatatataatcaggccagttgtggtggctcacagctgtaatctgagcaccttgggaggctgaggcaggaggattgcttgagcccaggagttcaagaccagcctggacaacatagggagactctatctctaccaaaaaaaaaaaaaaaaa
